United States Patent 6,833,447 (MYXOCOCCUS XANTHUS GENOME SEQUENCES AND USES THEREOF) - sequence listing, part 2

SEQ ID NO: 883 - DNA, 10607 bp, Myxococcus xanthus
gcgactgccgccaggacgcttcgttgccagtgcctaccggtttgcatttgcatgccggagacactaggcccgtgaagcaaagcccctccatcgtggagaaccgcagttcccacgccgaggagggggttccacgcgctgacttcagagggaaaacgccggagcggccgtgtaagccgagttctgttcccccccctttcgggatgggcggtgaacattcatctagggccctggttgcccaggggcctcatcagcgagcaacccgaacgcatgggacgggccatccctgtcctccgtacggcgaggacgcgctcctattggctcttgctccaggtggggtttaccgagccgtccgagtcaccccggacgcggtgcgctcttaccgcaccgtttcacccttacccgcccctttcggaacgggcggtctgttttctgtggcactttcctgcgagtcgcctcgactggccgttagccagcaccctgccctctggagctcggactttcctcccgccacccatgactgcggtgaccggcgttcacccgggccgctccggcaccttgcgcttacaacagccgggcaggggcggtccactccagggcgtccaccgggctcaggaacgtccgcttccgcgcgcgcaggcggcggcccgttcgaggagcagcgcgcgttctcgcgcgttcgccgtgagggcggcggcctgctcgaactccgcgcgggcctcgtcgagccggcccagcttggcgagcaggtctccgcggacgctgggcagcaggtggtatccctggagtgacggctccgaggtcaaagcgcccacgagggccagccccgccgccgggccgaacgccatggaatgggcgaccgcccgattgagctccacgacaggggaggggacgacctgggccagcgtgtcgtagagcgctgcgatgcgtgcccagtccgtggcctcggccgtgcgcgcgcgggcgtggcaggcggcgagggcggcctggagcgcataggggccctgagcgcctcccagcgcctcggcgcgctcgagcgccgcgaggcctcggcggatgaggagctggtcccagaggccccggttctgttccagcaggaggacgggctcgcccttcggcccgacgcgcgctcgtgagcgggacgactgaatctccatcaaggcgacgaggccatggacctccggttccttcggcgcgagccccgccaggattcggcccaggcgcagggcatcctcgcagagcgcggggcgcatccagtcatcgccggccgtcgccgcgtagccttcattgaagacgaggtagatgacctcgagaacggtcgacaagcgggcggccagttcctcgctatcggggacgtcgaaagggacgtgtgcctccgcgagcgtgcgcttggcccgcacgatgcgctgggccacggtggggacggggacgaggaaggcgcgggcaatctcctcggtcgtcaggcctccgagcagccggagcgtgagcgccacccgtgtctccttggagagtaccgggtggcaggagacgaacatcaatcgcaacaggtcatcgcccacgacgtcgtcgagcgcggcgtccaggtctggcgcggccgtgccttgcagcgactccagttcgtgaccgagttcctcgtgcttgcgctcgaggagcttgcccctgcgcagttcgtcgatggcgcggcgcttggcggtggtcatgagccacgcgcccgggttgtccgggacgcccgtctccggccatttttcgagcgcggtgacgagcgcgtcctgtgcgagttcctccgcgcggcccacgtcgcgcaccatccgcgcgagacccgcgatgaggcgcgccgactcgattctccagaccgcctgaatggcccgttgtgtctcggtggatgccgtcacgggcgtaactcaatcaccgttcgttcgcggcacaaggggcgtgcgcgcccggcattttctttttgaaagtgcggcgtgtaccgtcggcgagccatgcggcggcttggacacccagcgggtagtcggtccgtgaagctgcggtccactgccttttcggggtacccccggggacaactcatcaggagcacaccgtcacgcgtggccgtctccgcggcaagccgcagttcgggccacgcaagacacgacaggtggggccagtccgccgcatggcgtgagtgtggaagatgagcgagcggcacgtcgtggctcaggcgctcgcgtccgcgtttctcgcggggccatggatgctcaaggggctcgttgaaaggggcacggaggtcgtcggaggacgggcgccttgggtgtcgtccctggctcgcagcgcgatgatcttcttcccgcgtccgccgcatgcgcggatggagttgctcggggacttgttggcttcgcgccccgcgttcatgcggggcttcacagacccttcggcgcgtgcgcgcatcgtgcgttggatttcgtccgagccgcggatggcgcggcagccgtggcccgtgccgtcgctgtcgacccaagccgaactcgcggagtggttgggggtgacaggggcgcaactggactggctggcggatgtaccgggcatcgagcgcacgtcctcgccagggcggtggcggcgctaccggtacacctggattccgaagcgcagcggcggtgagcgcctgttggagcggccgggattggacctggtgctggtccagcgcaagctgctccacgacattctggaccacatcccgccgcacgacgcggcgcatggcttcgtcgcggggcggagcgttcgtcgtttcgcggagcctcacgcacggcaggccgtcgtggtgcgagtggacatcgaggacttcttcttcgcggtgcggcccgcgcgaatctgggcggtgttccgcacggcgggatatccggacggcgtagtgcgcgcgctcgcgggcctctgcacgaaccgcacacccagcgcggtggtgtcgcaggcgcggcggccggattcactcgccgatgcgagcacgcgctggcgtctggcgcggaggctcgaatcgcgtcacctgccacagggggcgcccacgtcacccgcgctggccaacctcgcggcgtaccggctcgacgtccggctgtcggcgctcgccgaggcgatgggcgcgcggtacacgcgatacgcggatgacatggcgttctcgggtggtgacgcattggcccggcgcacgcacaagttgctgcggtacgtgagccagattctccgggaggagggcttcacgccgcgcacagggaagacgcgggtgatgcaccggagcacccagcagcggctcgcgggcgtggtggtgaatgatcatccttcgattcgccgtgtggactacgagcggctgaaggccattctccacctgtgccgcacacgaggccccgcgagtcagaacaccgagggccatcccgacttccgagcgcatctgctgggacgcatcgcctgggtagcgcacctgcatccagcccggggcgcgaaactgcgcgccactttcgaccagattgcgtgggactgacgcccacgcctttcgactacccgacgggccagtagagctttttcagggggaccagcgcccgtgtctccgcgtcgaggttctcgtactgctcgaccagaagctcacgaaggtcggagagcgtgagaagtcggaggggaaccgaggagcggtctgcttcataacgcgcatccttggtgaacccgcccgtgctgacgtagaggcatcggtcgccctgcttgcggcccccgagaaacgcacgaatcgactgggagttcatggactcgcccacgcggtgcttcacctcacaaaagatgcggggttcctggaggcccagcccgtctggcgaagcgaagatgtcgacacctcggtccgcgccaggtgcggcgacgcgcgtgcggtagcccatggcgcggaggatgcccgcgacgagttcctgcatctcgctccagttcagccttgcgatacggtcctcgatgaattgttcggccttttcgaactgctcctcccggagcaccgcttcagtgccctcgtcgctgtccacggcaggggccggcgtgggcgccagggacgctacgggacgttccagttccacggcttgcgcccagagttccgcggtggcttccgcgctgggccgaaacaatgtggcgatggagccgaggccgttgcgagtcgccgcgctcaactggtttcgcaggacgtggtgcgtccagcgaacgcggcggacaagcggaggcggcccggcgcggttttcgacgcccgattcgatgcgccccagtaggtagacgcgctcgttcgggtcgtaagtcaccgcgctgtcgccttgctcaacatcgcgcatgaaccggcggacctgggccgcccagactcgtcgggtgccttccttgtcctccggatatgccttggcgaaccgggcttcaagctcatccgcgctcaagtctggcgcgagcgggccgaccttgtcccatccgatgccgacgtgcccttccgccttgaaggcatcgaagaacgcggcatcgcggcccgcacggatgaaccacaggcgcttgttggcagtcaccaattccccccctgatgtccgtccctggaatgactacatccgctcgtcgatggcgcggttgctcatctcatccgcctcggcgttctgcgcgcgggggacgtggtgcagcttcaccttggtgaagcccttgagcagcttccgcgcctcttcatacagcggcttcagcgtcgggctcttcacctggtagcgcccgccgagctgacgaatcagcagctcgctgtcggcgaagacttccaccttgcgggcgcccagtgactgcgcatgcttcaggcccagcagcaggcccatgtactccgcgcagttgttcgtctgatgccccaggaaccgcccgagccgcgccaccacgttgcctgcggggtccatcagtaccgcgcccgcgcctgcgggccctgggttgccccgagccgcgccatctgaatagacgcgcagccgcggatgcgattcggaatcgggcgccgcatccaccggcgggctcatggccccagccggcacctgcgtgcccggagccgacgcagcggaggctggcgacatcccgccgagccgctgtgcggcatcctcaatgagctgcccgaggtgttcccgggtgaggcctcggaacgcacgtaccgtcccttgcaacggctcctcacgcgcgatgtggcggaggatgtcgatgatggacggcgcgggcatgtccacgaagccgtgccgctacttcgacgccgccggggtttcctgcagcgcttccaccgcgtagatgatgcggttgcacgaaggacagatgtccgtgcccagcccggtgcgaagctggttgtagagctgcgggggcacgttcatgttgcagccctggcaggtgccggcgaccacgccgaccatggcgggcagcttcttcttgcgcaccacctcgtagcggcgcagcagggtggcatccacgctcgaggccacttcggcacgacgaccttccagccccttcacctgcgactcggcctcgcccagcttgccgcgcagctccgtcatccggccagacaggccctgctgcttcgtcgcgtagtcggcctccttgcccttgatggcctcgcgagcgccgccgagctgcttcgtcagctccgtcagctcctccgccatcgtcagattggccttcttggcgatgtcgatttcacgggccagggcggagtactcgcgggtggaacgctgctcgctcagccgcgtctcccacttcttcaccttgtccttctcgtccgtgatgttttgctcgagctgggccttctgcttctccatgtcggagacgcgtgcccgttccgcctcgatggcgctgcgggccacacccagttcccgctccagctcggcaatctgacgggggtgaacgtccgcggccttccggagcgaggcgacctcgaggtccacgttctgcagctccgccagcgctttcaatttctcccgcaaagttgctgcctcccacagggccgcaccgtgtacggcaacggcctagttcttgtaccaacaaggttaatgagggtccaacgtccaaataggccacgagtcatccctcgtggcccttgctgccatgctgcatttgaaacagcttcacgcacccgttagaccggagcgcgtgcttcgtccatccttcgtcatcgttctttgcgcgctcactcctgcctgcaaggagtccgcgtctccgccgcccgccaccaccacttcgccggccatcgcgcccgccgccacgaacacgaagtggggcgtcatcgaggggcgcgtccgtcttaccggcacgccccccgcacccgcccgccagcccaccatcggcaccgtcgtctccgtgtgtggcgaggagacggaggagcgcacgctcgtggtgggaagcgagggcgcgttggcccacaccgtggtttcccttagagacggccacgcgctgcccgcgtccgcgcgcgccgcgccggaacccgtgctggaccagaagcagtgtgtctatgacccgcccgtgctggccgctcgcaccggcagcaccctggtcatccgcaactcggaccccttggtccacaacgttcgcgccgcctccggaacgaaccgcgccttcttcaatgtggccatgccgctggagggcatgatggtgaagcggcggttgcccgcagagccaggcgaggtccccatccactgcgacatccatccgtggatgcgcgcgcgcgtgcgcaccttcagccatgggtacttcgcgaccagcggcgcggacgggcgcttccaactggaggtccccgagggcacccacaccctggtcctctggcacgagcggcttccagaacaagcccgcaccgtgacggttcgcgccggcgagcgcgtccaggtggacgcggagtggccggtggccgacctgaagtagcccgccagtccgtccccttgaaggattccggcgctcgacgtctagaaggttgagaagccgcgaatcgattggcgtttccgttccagtagaaaaattgttatacggacggcagaagccacgaccgagaagagggggccgagtcatgcagcagcaaccaaagaagcaagcattcccgagcaacggcatgcgcggcctggaggcgccccgcaaggcggcggttcggcccatcggcatgcaggagatggggccgaccctgtacgagcagctccgccgcgcgctggtggagctgacgcccgtctcgtccaactgaagccaggccgtccgggcgcgaacgccacggcctgaaaagcgaaggggctcccggcttgcgccgtggagcccctcgttttttgcgaacctagatttcgtcctcttcgctttcgcctcccgccgcctcgtcgtcgtcgaaggagtccagctcctcctcctcgtcttcgccgcgaccggcgggttcctccggttcaataggctcaatgaccttcggggcggcggcgagacggccacgccttccctcgggctggggcttgagcgccgggctttcccgctgatccgccccacacttcgggcagatcgggtccggcttcttcatgtcgtagaacttcgtctggcacttgaagcagacgtgttttgttccgaggtccttcgccggcattcgccaccttgtgttaaaggcgagtgaagacaggggggagggcggctcaatagttgggccgcaagacagagtcaacctgtggtttgcgccggagatttctagcggtagcatccgcccgcgttttcccccggaagctggacgcccctcttgaactttacctgcgacaattgccagaagcggtattccattgcggacgaaaaggtccgcggcaagacggtcaaggtccgctgcaagaactgccagaacgtcatcaccgtcgaagggcccgccgaggaagagaacacccgcgtggtgtccctcgcggacgtggagcgcatccgcgcccaggagcgttccctggcggagcctgaagcgagcgccgccccggcggccgtcatcagcgcgcccatcgcggccgctccggtggcgaaggcgcccgcggccgcgctgcagacgccctgggacgatgagcccacgcgcgccgcgcccatgaaggccacgggttcgccctggttcgtcatggtgcgcaacaagcaggagggcccgctggacgaaggcgccctccgtgagctggtggccaccaacaccgtgaatggccgcagcttcttctggcagcagggcatggcggactggaagcgcggttcggacatccccgagctggccggcctcttcgagccgccgcccgccgtcgagccgcccccgccgccgcccgccatcgccgcgccgcctccacccgagcctgcacgcccctcgcgcggcgcgcccgtgcgccgggagccggaaccgcaggccttcatcccggagccagagcccgagccgcggcacgccgagtccgagcagccctggccggacgaggaagaggaagcgccggacaacacgtattacggcgaccccgtgcagcgcgcgcagccgcagcctcagcagcaggcccaggtgacccgccgcgcgcagcagccgcagccccaggccgccaacgccgcgccgctggacgacgcgctgttctccgacctggacctgccgggcaaccgcaacggcggtgacggcgaggagccccaggacgacggcggcgtgccgtaccccgatgacccgcgggccgcgctgggcggcggcgaggatgacgacgaaggcaaggccgtggaggacacgcgccacttcgccaagaagtcgggcgtcacgcgccgcaaccccgtttggaagtacgccctcttcgcgttgctgctgctcatcgtcccgctgggtctggcgtatgtcctgtcggagacgctgggcgtggtgccgctgcgcgtgcagacggtggacgccagcggcaacgcggtggagcagcccgtcttctcgtcggaaggtgtgggcgcgctgcgcgacaagctgatgggccgtgagccgccgcccgcgccccccaagggcaagcgcccggtgcccccctcggagggcaatcgcccggccgccgcgcccgctgacaccggcgcggttgcggacccggaggccgccgcggcgccgtccaagggggcgctggaggccgtctacgtggacccggacaagaaggacgtggacccgacggtgcgcagcggcgaggaagtggccgccgcggacaccgaggaagtcggcggcccgtccgacgaagaggtggagcgcgtgctggcgaagacgcagcccgccttccgtgactgcgtggaggccgaactgcggaagaacccgtccttcaagggcggcaaggtgacgctgacggccaccgtggggaactcgggcacggtgaaggcggccacgttcgaccgcaaggacctgaaccgcaacagccccgtgggcacctgcatccgtgaccgcgcgaaggggatggtcttctccgccttcgctggcgaggacgtggacctggagattccgctggtcctctccaagtcgatgtagccgcctagaggtcgaagcttccggccggcggcggcttcttgccgcgtgtcgccttctcgcgggccctgcgcacttcctcgcgcagggcctcggtggcctcagggtccacctccagggtgtcgaggtcgagcacgtctccctcgcggatgcccgcgggcaggtcgctcagggggcgcgtcagctcgcggccctccaccaccagcacggcgatgtcgtcttcgattcggtccagcgtggcccgggtcgtcatggggcgtggctcctcaggggttgcagtcccgggcaggccgccgtccacgcgaggcctcttcccggctggagaaggtcaccaggttcgatgacttgatcttcacgacgttgcggcaggtgggcctgtggaacacgtcgctgcggacgctgccgacgtaggcgcccaccttcacggcgcctgagtcggaggcctcgcttcgcgagcgcgagcccgcgcgagaggggggcgccccttcgtctgtcgggtcgtcgaggctcagggtgtacatcttccccgtgggctgcttgcccgagccgtcacgcgtgccggagcggcccgtcgcgcgctgggaatctcccgcgagcgcggcgtcccggggcatgggcgtgcccaggcccgggtagctgtagcgcgtgtcctccgggacgcccgccgacaggcgctgcggcgtgacgacgagcgtcttcccgtcgctcaccacctgcacctcgccgtgaaggtcggtgcggaacacctgcgcgccggtggcctccaactgcttgagcatggccggcgcgggggcgccaatcaggttgccttcacccgcggagatgacggcggcgcgaggccccacggccgtcaggaaggcggcggtggtgggcccttcggtgccgtgcgcggccaccttgagcagcgtggcctgcatgggggcgttgcgcgccagcaggtggtccaccgtccgggcatgcgcgtccgccatgaagagcaccgcggtgtccccataggtgagccgaaggatgacggagttggcctccagcgcggcctcgggcacgtcgagcagcggctcggtgggcgcgcggggccacagcaccgtgagggacacgcccgcgcccaggggcagccgctggagcgcattgggcgtggcgggggaagggg

SEQ ID NO: 884 - DNA, 6776 bp, Myxococcus xanthus
tcgaccgggctggtgccggcgccgggcgtgcgccacgcaatcacctgccggggctgcgtgggctgaggccagtcgatgtgggcggtgcgagggcccttctggggcggctcggcggggacggagacctgggcggccttgcggtcccaggggccgtagtgctggcgcacgagctccatgaccttggcgtcgtcgaagtcgccgatgatgaagagcagggtgttgtcgggcgtgtaccagcgctcgaagaaggtgcggctgtagtcataggcctggggcatcgcctggatgtccttgtagaagcccatggtggtgtgttggtacgtgtggcgggtgaaggccgcggcgttgagctcctcctccatcttgaggaagggggcggcggcgttcttgtggtactcgccgagcacggcgagcgcctccgtctggaaggacggctggctgtactccaggttccggaagcggtccgcctcgatttcgatgagctggggcaggccggcggtggggccgtaggagtagtagagggtgatgtcgtcggtggtgaaggcgttgtcgtcgtagccgaagttcccgaggatgcgctcgcggtcgccctccgggtgcgtcttcgtgcccttgaacatcatgtgctcgaagaagtgggcgaagccggtgcggccgggttccacctcattgcgcgagccgacgcggaccacggtgacgtaggcgatgattccgcgggacgggtagggcacgcggaccacggtgaggccgttgggcagggtgtccgtgtggagggtgtacgggaaggcgtccgacgccggggtaggggcggcagcggcggccggcagggcggtgcccagcaggagcagaaggagggggagcagtcgtctcattcaggtgcctcgtggccgggacggaagaagcgggacccggcgggtaggcgaccctacgacggctggctcggtggaggaggggcttgtgggccgagtgtccacggccgtgcgcccagaagtgcccgcggccattcaggaggattgacgcgcccccgtcagcggttaatgtgaagaagacggggcgcggtgagtggccgcgtgacgtgcagtgaacctaccgggggcgacctggtttcgacgggggcattgaagttcgagacgcgtgccgagcttgtcaggtagctcgtaaattcaacccggcaaagacacaaaagccaacgacaacgttgagctcgcgctggctgcctaaaaacagcccatagtgcgcggtccccccgccctcggcctgtggggttgggacagaccgtcataatgcaggctggctgccgagggtgcctggacccgaggtggcgagatcttcccaggaccggctctgagtatcccgtccgtgggagcctcagggacgtagcaaatcgcggactacgcacgtagggtcgaagagcggacggctttcggacgcgggttcgattcccgccgcctccactgtgaagaacgagccccgtggcgccagcaaggtgccacggggttttcttttgccagaccttgcccatggaaccgcggggggtgggcaccccagaagatgtgcgtgcctgtgcagtgattcgtcacatgggcatcctgtgaccgctggcccggggcctttacagcaaacatcgttcttggtcgtatgatctgcatcctgggggggccgttggacatcatggtttaggtccgcagcgagccttttcgaggcccgggacaaggacaaggtcatgagcatgccagtgggaaggcctcatgcagaacccttaggcgatgcgccgcgcgagcgaatctgggggagtaggctcgggtggctcacgggtgtggatgacaatggtcgattcctggtggacttcgggggaaacaccgaggggccgctacctgcgaagaggactatcaatctgacatcagaggtagtgcgggccgcagtggccacacgccagttcgcggtgcttctctttgaagatggggatccccggctgccgctggttatcgggctggagcagggccacagttccacgcctctgctcgatgtcatgctggacacggcgggcattgagcccgaaccggttccagctcccaccgaggcccgggtcgacggacagcgggtcgaaatagagggcaaggacgagatcgtcctgcggtgtggccaagccagtatcacgatgcgtagcaacggcaaggtcgtcatccggggcgtgtacgtggaaacgcagtcctcgggggtcaaccgcatcaagggtggctcggtccaggtgaattaggggctacgcgaatgatgctggacgtactggaggagcatctttccgaagcggccttcttttggagccagtgggagcgcgcgctggtcgcgcccgactacacgttggaagagaccgctgagctagaagagcggttgctcgctcatttggatggactggttgcggcgggggccgcggctatcgaggtgctgtcctccgtggtgtacgagcgcgaggacccgggtgaggtgttcgccgccgcttggtcactcctcgcgctggctccatctctcgtgcttgatgcagtgaaggctcgggcgaccgatgcgccgccaccagttcaggcctccattcggcgagccctggagcttggcgagaaaggggtggtggagactgccttggcccccttgctcaccacggccgagcccatggctgtatctgtgctgggattccgggggcacttgcttggcggcagggcggaggaactgctgagccaccccgacgcactggttgtcacggcggcactgcgagcgcttaatctatcatcgaagtcccatgcccccaggttgcttggcgtgctgttgggagactctcgtccagaggtccggtgggccgccattgaaaccggattggtgtttggcgtgcgcgacgcatggacagtctgcgaacgagaatccacggccatgggaagcccgctgcgccggcggttgtgggccttgcttgctgcggcgggaaatgtgcggttccttgagcggctcatctcgttttcggaggcggcggccactcgcgaggatgcgctctgggcgctggggttcactgggcaggtgcctgccgcggaatcttgcctgaggtggatgtgtgaggagccgcgcgtggcgcgcctcgcgggtgaggccttcagcgccatcacggggcttcgcatggcgggggcacacgtgctcccggagccagagccagaggatgccttgccgcccctggaagatgaggacctggatgcggacttgggacttcgcccggaagatgcattggcactccccgcccaggaggaagtcgcgcgctggtgggagcgggcgcgcgatggattctcgccagccaatcgctacctgagaggaaaaccattcaccggcgcgtcccttctggaggcgctggcgcaaggccccatgcgacggaggcatctgtatgcattggagttgatggtgcgaacgagaggtgcctacgcgatccaggtgcgagccttcacgtcacggcagcgggagcaattggccctggcttccgctgtccgcgagcggctgcctgcatggggattcatgagttgaaggcaaaggcggggggatatgcttcaggttcgcaacgagactcccttctcacccagcatgttcatgttccccgatgtccgggggatggacacgctatacgtggtggtgaaggcgacgttcacctttcgcaaggggcggctgttcattgcggaaaatcagcaaccggtcgtcatggcggacacattccggggagagcccgggcaatcgagcatccgagctgcgagcgaggcacacttgctcaagccaggcacagacgtgttgctggagggcgaggcacacgcgccccggggcaagccggtggcctcctgccccgtcctggtgcgggtggggcctgtgaagcaggtgatccaagtcttcggcgacagaaaatggcggggaggggttctgtctccgggtatctcttcgcccgagcccttcgtgaagatgccactcgtatgggaacgggcctacggtggcgtgcatgaggtgacgaaggaacgcgtgttggggaaggcaagcaatcctgtgggacagggcttctgcggcaagcgtggtggttcggaaatggtgggacgcgcgttgcccaacctggaggatccaaggcaactcattcgctccatttcagacgacccggttccgatgggcgtggggcctgtggcgccatcgtgggagccgcgaaaatcgtatgccggcacctatgatgaggcctggaggacccggcgcgcgccctacctgcccctcgacttccaagcggagttctttcaggtcgcgcccgcggggatgtgtgcccgggagagactgaagggcggcgaaccggtcgaattaatcaatgtgtcactcgaaggcgtgcagcgctacacgcttccccgctgtgggctgagcgtgacagtgaagattgccggattgttcgagcgccctccacttcatctggagacagtgggcctggagccgggctccggacgggtgtgcatgacctggcgaggcgcggtgggatgcgacaagcgggcattgaaggtcgaggaggcgcgcttccagttgctgtcattggaaggcgcggaggattgagatgagcggaggtgctgagattctcggcgtcggaatgatgacgccggtgggagtgaatgccccgtcgacagcggccgccattcgggctggcatcatgcgtgcgcgggagacgtcactgatggacctccgtttccgtccctacctgggggcattcgtctccgaggagcacctgccggctccggatctgccggtcgctcgtggactggccgcacgtgagcagcgcatgttgcggctggcgctgcccgcactgaaagaggcggcggcgggattggagcgcccgctgccgttgatgctggggctccccgaagagacggaattatcagcgcggagcgagccggtgcccttcctgaaggcgctggggctggcttccggcattgcgctggaactacagcgcagccggtgctttcccaatgggcgcgctgcggggttgctggcgctcgacgcggcggtgcggttcctggacgaaagcaaggctccggaagttctggtgggaggactggacaccctgttggatccgacggtgttggcgacactcgaaggcgaggaccggatacgccggtacgggccggcggatgggctgattcctggagaggccgccgtgttcctccggcttggaaggaagggagaggggaagcggctcggccgtgtcccgctggcacgcgttctggcgacagcgacgggaaaggagccggggcatcggtacagccgggagccataccttggggaaggtctggcgcagacctgtcgcttgctcttcgactccactccggctgggctaccgcccgtgcggtgtgtgtacgtggggttcaacggagagaacttctgggcgaaggagtggggcgtgacattccttcgctcgcgtgagcgcattgccgaggcgcatcggttggaacacccggccgagaacgtgggggacccgggagccgcatacgggccgttgatggtgggggtggcggcgctgggattgcggaagggatatcgtgaggggcctgtgctggtgtggtgctcctcggaccgtgagtcacgtggtgccgtactgcttcagcgtgaagatccggaggcttgagccatgcctgagtttggcgaagcagtggctgggggcgacggggccgacgacgggcacccggaggactgtgtcttctgcgcggagtggccgcgtgaactcaagggctacaagaccaagcatggcctgctgaaggacgaggacgacctggcggagagcctccggagcaacgccaaggaactcacgacggacaagaaggtagggccggtctatccactgcccggtgggagcgatccaacgatggggtgggtggccaaggcgggagcgctggaggaattcgaggtggagattggcgcgaccccacatcacatcattccgggaaaggcctccatggccaagtcgcgtctcgagcagtggacgcgcgcggagaagggcaaaatcaaggaggacattggctacagcatcgactgcgcgcgcaatggcgtctttctcccaaagctcccggacctctatggcacgaagcacaaggtgcccggagtgacgatggcccagttctacggccaaacatggagggcgctgagtccggcctcgaaagagggcgttggcttcctggtgatgaaggatacgtggctgcagttgcattacacggatcatagcaagccatacaaaaccagccccaccatgaactatgacaaggagacgcggctggagtgtgaccagttggcgcacctggcggaacgatttcggattgtctgcgaacgctccaaggatgacgacgggaagcgctatccaccctattccctagtgcacctcattaatcaaaaatccgattttttcaaaatgcgaatcacggggcggcccgatcagtggaaatcatgggtgtcgacattggctgaagacctctccatggcggtcaggcagggccgggagttgcttgtcagtaagctcgctttgacgaagaagacgcgcggttagtcaattgtcgcggaggtgtgtgtgtattacaggttggatgcgaggtatgattttgctgcacatggcgtcgagggtgttgccttggatgagtcgcccgacgtcgacgtcccttggaccatgggaatccgttatccggaccccgtacaagagcccatcccgtgctatctcgacccgcgcaggggtcccgtgatgcccgatctcatca

SEQ ID NO: 885 - DNA, 6553 bp, Myxococcus xanthus
tgctctaaagaggccacgaagccgagctccatgccgtcgcgttctctcccgatggccggtggctggccgccgcgggcaggcccggcgcgctctggctctgggactggaagcaggggcgcagggtggccttgctgtccgggcacacggatgtcgtgcggggcctggccttctccccggatggtgagtggctggcgagtggtggactggaccggacggttcgtgtctggcgcatccgcgacggcgcggaggtgctcaggttcacgcatgacgacatcgtcatcgcggtggccttctcccccgacggaggacggctcgtgtcgtcgagcatggaccggaccgcgcgggtgtgggagctgacggcgcgtcgcgaactgcaccggctgacgggacacggggacaaggtggagtcctgtgcgttctccgcggatggcgagcgggtgatgaccgcgtccgcggaccgtgccatccgtttctgggatgcccggaccggggccctgctcgacgtgcagcgcaacacgggggcgctttcggccgtggccatcgatgcgggtttccagcagctcgtgcaggcggggtgggaggggcgcgtgcagcgcgtggacgtgcgcggcggtggcgaggtcctggagcggttggatgcgcaccggaccttcgtgatggccgtggccctgtctccggacggacgcacgttcgcttccggtggcatggacggtgtcctgaaggtctggtcgcggccggaggtgcctccggacgtcctgctgcgggagcttcccgcctggcctgaggtgctgacctccgtggggccagacgccttcgtgtcgggtggggaggacggtctgcggagctggtcagtctcggccggaggcgaactccactcccgcctggaggcaccggacgccgtgggggccgtggccgtgagcgcggaccggcggttgctcgcggtgggcacgttgaagggggaggtgcgtgtgcgagacgtccggtccggaaatcagctgatggtgattccggccgcgcgcgaatccatccgggcgttggccttcagcccagacggcgcattgctcgccgcgggagtggcgcaggacgtcgtgctgtgggctgtcccctccgcgacccaggtggcccggctgacagggcacaccgggaaggcgtgggcattggcattcgatgccacggggcaaaggctggcttcgggcgcggcggaccacacggtgcgtatctgggacgtggcgcgaggcacggtgattcgcgtcctggaggcgggcgaccgggtccgcgccgtcacgttcctggcgtccggggagttgctgaccgcgggaatgcgtcagcccatccggctctggagcccagatgacggccgcgtgctgacgtcgatggattcgctcacggtaggcgtcttgtcgctcgcgatggcgcctcagggggcgttcgtggcgtccggcggagtgggaggagagatgaaggtctggcggcttcccgacggggcgctcatgggggaggtgcccgggttgcaggggttcgtctccgccgtgaccttctcttcggatggagcgtggctggcggcagcggcttccgaccggacgttccacctgctgggcttcgacgccttcgcactcccgccgcccgtggagccggacctgacgcggattctgcggcgccatgggctggcctgggatgacttgcggggcgcgttcactctccactgacactgatggcagtcgtcgtccgtgggcttgagcggcatcgccggcaacaggggaggggcatctggatttgacgccccggccgctgaagcgtcacggaatgatgagatagacagcggagtccctgggcagggagtcgttccggtagagggcgtttcggacctatcccccgtgacggtgacacgggcgccttgagccgcccgtgtgggttggcgggcgcgccgcgcatgccccgcgagcaggcgggcggcgcccagtggccaaattgtttgagctcaaaagtatggacgtgctccgtctgacctgttaacgactgactgccctgttctctgggtggactgtctcgcgcgccagcgtcctcgctgagtgtggatcgggagagggccgccccttgtgccaagtctggcgctcaggacgagtgtggcctgttctggtccgctcgcgcctgtcgtccattgccaggagttgcggttgtccacccgtcttacccgtttctcgcatgcgcttttcctgtctggattgacctgcctgctcgcgcccgaagcacgcgccgaggaggaggtggtggaagacccggacatgctcaaggtcggcggtgcgctgcgcctcaatgccttcttcaagacgtggcctggagaagaagacaaccgcaaccgcggtggcgacgtggcgttcgatacattccggctcaatgtcgacgccagactttccaaggtgttgctgtccgccgagtaccgcctctattcggggtactccatgctccaccacggctgggtgggctatgagttcacgaaggcgacccagctccagttcggcgtgcaccgcgtgcccttcggcgtgctgccctatgcctcacataactggttcttctccctgccctactacatgggcatggaggacgactacgacctggggctgaagctggtccacacgcaggggccatgggacctgcaggtcgctttctacaagaacgacgagggcagcttcaccggccggagtacggacagcgcgcgctactcgtatgacgtggtgcaggtgagcagctccaacccgggcgaggcgtacctgggcgtggacagcgcgaaccacgagagcaacaagctcaatgcacgcgcggcgtacacattccagcacggggacctgggccgcacggaagtgggcgtctccgcgcagaccgggcagatctacaacagcgtcaccaagcgcaatggcctgaactgggctggcgcggtgcacctggacggctactacggcccgttcaacctgcgcatggaggtcctcagctacggctacgacctgaagaaccccgagggccacgacgactccatcgtgacgatgggggcctatgacgcgccctacaagatggccacccggggcaccgtctacgcggcgggcctttcgtacgacgtgcccgtgtcgtggggccccatcacgaagctgaccttctacgacgacttcagcctcttcgacaaagccaacgccgcgttcgagacgtcgatgcagaacgtgctcggcatgctcgtcaccgcggggcccgtctacacctacgtggacgtggccagcgggaagaaccagccctggctggggcctgcttatggccacgcgctcgcggagggcgatccgaatgccccgtgggagacgcgcttcaacatcaacgtcggctactacttctgagatgccccatggagaagattgaagtccgtggcttgcggaagatctacggcggcaacccggagcgggccattgccctgctggagaaggggcagagcaagcagcagatcctggaggagacggggtgcaccgtcgccatccaggaggcttcgttcgatgtgaaggccggcgaaatcttcgtcatcatgggcctgtccggcagcggcaagtccacggtgctccgctgcctcaaccgcctcatcgagccctccgccggcagcgtgcacgtggacggcgtggacgtcacccgggcggacagggcgggcctgctggacgtccggcgccggaagatggccatggtgttccagaacttcggcctgctgccccaccgcagcgtcatccggaacgtggagtacgggctggagatgcagggcctggagcggcgggagtcgcggtccaaggcgatgcaggcgctcgagctggtgggcctgaagggctacgaggagaagctgcctcacgagctcagcggcggcatgcagcagcgcgtggggctggcgcgggccattgccaccgacgcggaaatcctgctcatggacgaggccttcagcgcgttggacccgctcatccgccggcagatgcaggacgagctgctggagctccagtcccggatgaacaagaccatcgtgttcatcacccatgacctggatgaggcgctgaagctgggtgggcgcatcgtcatcatgaaggacgggcgcatcgcgcagctcggcacgccggaggaaatcctcaggagccccgcggacgactacgtgcgcgccttcgtggagcacgtggaccgcaccaaggtcctcaccgcgcgggccatcatgcggcggccggagtcggtggtgcacccgaaggacgggcccgccctggccgtcaagcgcatgcgcgagtcgggcacctccacgctcttcgtgaccaaccaggcccgcaagctggtgggcctggtgcgcatcgaggacacgctgcggctcatggcggagaacaagcacagcctggagggggcgctcgtcaccgacttgcccaccacgtcaccggacacgccgctggcgaagctggtggcggtggcggccacgactcagattcccatcgccgtcgtcgccgaggaccagtcgttcctgggcatcgtgagccgcgccacgctgctggccagcatcgcgggggagcagccctgacatgagcacactgagaatcggcgaaggcttcgaggagctgattgactggatgggcacgcgcggcgcgccggtgttcgacgccatccgttcggggctcacggcctgcatcaacggcctggagagcgcgctgctcctgccgcccagctacgccatcatcacggtgttgatggtgctcgcctggcgcctgtccggcctgggcacggccgtcttcacggcgctgggcatgctgctcatccaggacatgggcctgtggaaggcgaccatggagacgctggcgctggtcctcagctcggcgatggtggcgctggtactgggcatccccctgggcatctgggccgcgtacagccgcgtcgtggagcgggtgctgcggcccgccctggacctgatgcagacgatgcccgccttcgtctacctcatccccgcggtgctcttcttccggctggggaaggtgcccggcgtggtggccaccgtcatcttcgccatgccgcccgcggtgcgcctcaccaacctgggcatccggcaggtgcccactgaagtcgtggaggccgccatcgcgtttggcgcgacgccgcgtcagacgctgctcaacgtccagctccccatcgccgtccccacgctgctggccggagtgaaccagaccatcatgctgtcgctgtccatggtggtcatctccgccatgattggcgcggggggactgggcgagcaggtcctgaagggcatcacccagctccgcatcgggctgggcttcgagagcggcatcgcggtggtcatcctggccatcgtgttggaccgcctgactcatgcgctgggcaagccccggacgcgctcatcatgaaggagacccgtcccgtgaagatttcctctctcaatcgtctgcccctgctgctcacggccgtggcggggctgctcgtcgcccccggatgcaagcaggagaacaaggcgcccgccgcgggtgacaccgaggcgcccgcccccgcgaagaagcccgtggtccggctggtgtacgtgaactgggccgaaggcgtggccatgacacatctggtccaggccatcctggaggaccgcatgggctacgaggtgaagaccaccatggcggacgtcgccccggtgttcgcctcgctcgccaacggcgacgcggatgccttcctggatggatggctgcccgtcacccaccagagctacatggagcgcttccagggcaaggtggtggacctgggcaccaactacgaggacgcccggattggcctggtcgtcccggcggacctggacatcaccagcatcgagcagctcaacggcaaggcgaaggacctgaaccagtccatcgtgggcatcgactccggtgcgggcatcatgacgacgacggagaaggccatcgcggagtacaagctggacctgaagctggtgccctccagcggcccggcgatgaccgcggaactcaaggacgccatcgccaagaagcgccccgtggtggtcaccggttggaagccgcactggaagttcgcgcgctgggacctgaagttcctggatgacccgaagggcgtctatggcgccaaggagtccatccacacgctcacccgcgtgggcctggagaaggacctgcccgacgtcgcgacgctgctgcgcaacttcaagctggatgaccagcagctcggcagcctgatgggcgccatcgccgaggccgaggacgcgccggagaaggccacccgggagtgggtgaagaagaaccaggcgctcgtggatggctggattcccaagtcctgagcgcgatgcgaggcgctccgggggctttcagttcccgggcgccaccttcgggtgtccgcgctttcgtgccgcggattccatctccatgagcgcgtggatgcccgtccgaagctgttcgtagatgtcccgctcggtgacgcccagacgggtggcattggagacatcatggatgccgtcccgggcttcggagtgttcgccgtgcagcctttagagcacgcagga

SEQ ID NO: 886 - DNA, 6891 bp, Myxococcus xanthus
  unsure (1)..(6891): unsure at all n locations
cgcgacttgcccgtcttccagtccaccaccaccggcgttccgtccgcgtccacgaaggcgaagtcgggaatcgcgaagaccttgaggccgtccagcgtgaagtgggcgaagtcgaagcccgcgtccacctccagccactgctcgggcttgaggctgtgcgccaggtccttccagcgcgaggagaagaaccacgacagcgcggagcgcaccgtctcccagttctgcttccacgcctcgtccggcaccgcttcggcgtactcgtgctccaccaggccggtgaactgcttgcggtacttctgtgaccagtagttcttcgagcgcgagtgccggaagtcgtcctgcatcagcttgcgcgtgcgcgcctccaccgccgccgggtccacctcgcggcccgcgcgccagtccaacagcacgtccttgatgctctcgtgcaccacgctgccggcccacgtgtagcggttgcccagcttcttcagcacgtagagctcgcgtacgtccttgggcgcgctcgcctcccagccgccccaggagcggtagtagtagaggtagtacgcgcgaaggcactcggagaacttctcgtggcggctcttggaccaggagaagtcgttgctgagaggggggcgccgcatgaaggcgcgcatcctaggcgttcgcccgctccaccagaaggggaacaggcggggaaacaggcccccgctggttgctgaaagacagtcccctcatgcaaccgggaaggtatggtgcgcgctggcatgaagacccaacccttcaagggccgggtggtcctcatcacgggggcttccggaggcattggcaggacggcggcgagggcctacgcggccgcgggcgcggatgtcgtcctggccgcgcgccggctccccgagctcgaggacgcggcccgtgaagtggcgtcactgggcgtgagggcactgccggtgcggtgcgacgtcacggtgggcgacgacgtgacgcggctggtgcgcgagacggacgccgccttcggtgggctggatgtgctcgtcaacaacgcgggccaaggtctctacggaccgctggagggcgttggggaggagcaactccggcaggtcttcgagctgaacgtcttcagcctgtggcggatgacgcgcgaggcactgccgctgctgcgcaagcggcgtggcgctcaggtggtcaacgtcagctccgtgctgggccaccggggactgccgctgctgggcggctactgcgcgtccaaggccgcggtgaatgcgatgacggagtcgctgcgcgcggagctggccgccgagggcatccgggtactgctcgtgtcgcctggcttcaccgaaagcgacttccgggagaaccgccttcatgcggagggctggcgacaggacgccattccgctgaaggccatgtccgcggaagaagtcgccgacgcaatggttcgtgcgagccggagtggacggcgcgacaccgtgctcacgctgcccggccgggtgatggtggtggccaaccggtgggtgccttccctgttcgaccgtgtcgcccgccgcatggcgcttgcttcgaagaagaaggacgcatgagctccccgtccaaggcagcacccgcacggaagccccgcgccgggcgtcccccttccgcgccgctcgcggccactgtcacacccgcgcaggcgcacctggccagcgtgcgtgggccgctgctggactggtacgaccggaacaagcgcgacctgccctggcgccgcactcgggattcgtatgccatctggctgagcgaagtcatgctccagcagacccaggtgtcgacggtgattccctactgggagcggttcctcgcgcgattccccacggcgcgcgcgttggcctcggcgccgctggatgacgtgctcgcgggctggaagggactgggctactacagccgcgcccgcaacctgcaccgcgccgcacaggaagtcgtcgcgcgcttcggcggcaccctgccctccaccgccgccgagctgctcgaactgcccggcttcggccgctacaccgcgggcgcggtcgcctccatcgcctttggcgaagaagcgccgctggtggacggcaacgtcgcgcgcgtcttctctcgcatcttcgaggtcgaaggccttccaggagaccgccagcgagaggccacactgtgggcactcgccaccgcactggtgaagggcgagcggcccggtgacttcaaccaggccctcatggagcacggcgcaaccacatgccggccagagaacccgctttgcctgctgtgccccgtgcgcggagcctgcgtcgccttccgcaagggccgcgtggacgagctgccccccgccaaggtgcgcgccacgcccaagaagctgacgctggccgtcgccgtgtggccccatgccggcaccctcctcttcgcccgccgcgcggacgccgggctcttcgggggcctgtgggagctgccggccgccgaaatcgccgacgacgcaccggacagcgaagcccgtgcccggctctccgccgcgctgggcgtcgacgtgaccctggaaggcgcgctgggcaccgtgaagcggcagctcacccaccgagacctctcgcttcggctgctgcgcgtctccggccctcgccggcccgcgagcacgcccgccttccaggagcttcgctggtgcgcccctgatgacgcggagaagctcggcatgagcaccgcgatgcagcgagcgctcgacatcgcgctgggagcgggcgtgctgccaggcggctgaaggcctctacgtcggccctacatacgccacctgtccgtcgctcgacacagaggcagtcctcctgtcgcactgacaaccccggccccccgcctgccggttcctttcagcatcgacgcgccccaatctccgcggactctttccaccggaggaatccgagcatggcacgccacaccgccaacaagcagacggggccgtcttcaagcaagccgcctgccccctcggcccaaaccaggccacgggctccggagtcgcgccccggccccaccaacgagcagattgcccgccgggcctacgaagtcttcctggcccggggcggtacgcacggcaactccgagcaggactggttccaggccgagcgcgagcttcggctcggccgtcagtgacaatccgctgacgcccgggcgcgccgtcgctgagcgcgggacggaagcacccgggatgacggccgcgttttcatccgccggcagtcgcggccagggccgtggattcagcgctgcgggtcacggcccaggccgagcaccgtggagggccgccaggcccactcacctcgtcacgcgccgccgcttgcgcaccgggggagcgtccgaggcgtgcgcgggggcacgtgggccgtagtagcgccgcagccagcggctgagcccgtcgaagccagggaaaagcacgcgctcggtgatgttgctctggtccagcttgtcgcgcacctcccacttgagcgcggcggggatgatgagcttgcgcacaccatccacctgggcttcgaggaaggtgtccaggcgaagctcgggcccgttcatcaccgagaagagcgcgaactgattcacgatgcgggcgtccagcgacggtggctccaggaagagcacgaacgggtgcttcgcgaggtggtcgaaggtcgaaaggtccgacgccgtcgtggccagcatctcccccgtgaagacatccgcgccttctcgctggagcagcgtcttcaaccgcctgggaaggtgacgattcgtctggcggtagtccacacaccacaccatgccgtcctctccataccgctccgggttctcggtgaggaagtggagcgccacataggggctgaaggtccaatccagcatccgcgtgggcagcccatgatgctgggccagggcgagccagtcccagacggactccacgggctgcgggctgtagctccgcgcgtacttccggaaggccctcagcaggtccttctccttgcgcacgaacagccccttgcgattgagcgccgtggacaggtcgttggtcacctggggcatgccacggaagacaaaggtggaccggtgacgccccaacacctcgctccacgacccggcgaagagcgcgtcctgcagctccaaccatgtcccgatacgctgttccaacatggcccagaacccccgcgacacaataagcatcgcggcggggccggggccgctcagtggggattcacggtatcaacggagggacgctcggcggagagcgcgctccggagccgccgctgcgccaccttgagctcctccaggatgcgctccgcgtcgatgaccgagcgcatcgccagcccgcaggcaggcgtcagcaccaccgtggacaccacctgcgcgaaggtgaagccggcgggcagcgccgccttcagcgtggcctccaccgagtccaccagctctcccacctcgtaggtggacgccaggtccgtggggatgatgcccaggctcagcgtcgcgcccgcggcgaggaagcgctccagcgcggcccccgcctccaccatcgcgtccagtgacagccgcacgtccagggagagcaggtccggctggacgtccagcagcgcggcccagtccgtgttgccgcagcagtgcagccccaccagcgcgccttcgcgctgcaaggccaccaccagcaacttcagctcctgcatggcaatcaggtgccggggattcgtgcgctggagcgcgtagagcccaggctcatccagatagaacagcggcgtggtgcccgcgcggcgcagcgccttcaccatggccagtgagcgcgccagggacagccggtacatcgcttcatccaggcccggcacctccagcgcgggctgtccgtcggtggtgcgcgccaccgagcgcaccgtgaagggccccgcgagctgcgccttcgcgaaggccagcttccgcgcctccacttcccacaggaagggccgccaggcccggcacgcctcgggcgagggctcgaaggcctcgaactggccggactgaaacgccgcctccagccgcgcctcgaaggcagcgcgccccgcctgccaggccgcgaggtctaccgtgcacagaccttcctcatcgaaggccaggcccggcagcccctccagggccgcgggaatcatcaactccgagggcttgcccactggcaactgcggcaggaacggaatgtccagggccagcgcggcctggagtcccagctccacttgcgtgtgcggcaagctcccgattccggtggtggcgcaggcaggcagcaactggacggctcggcggatgttcggcgcgctcatggcgcggactctatcccctccccggccttccagtgtggctgcccatccccgatgcgccgggttcccgaccttcctgtccggcaacaacgttccacccaagaaccgggaagcaccccggcggacaagggagggggcattcatgaacaggcgctgtggatgggggacgggcaccctggcggcggcattgcttgccagccccgccgtcgcggagacgccccgcgccgtcaaggcgcagcccgccccgggcttcggggcctccggcctgacggtacgcagcggcgtgacgacctggtcgggcaacgtaggcagggagacaggcgtgggcgcattcctggccctgctgggggaagtccccattgcctccggcgtgggcctggagctgggctacgagggctccgccaacggctacgcggagccccggcgcggcacgctgtggcggcacaacggcggcctgctggccaaggcgggccccacgctcttctcgcagtggaagcccttcgtcggagcgggcgcgggcgtcagctacttccaccccacacccatggacgtgggcaccgccttcgagaagggctggggcgcggaggtgccactcgccgccgggctcgagtaccggcacaacggcgtcaccgccggcctgcgcgccacctaccgcgtgctcgtagcgcgggacttcgctccgaacagcgcggacgtcggaaacctcttcagcgccgacctcagcctgggcgcgcgcttctgagccgtcacgtcacctcacgtcacggagaagtacgacgcctgcggatggtggaagacgatggcggacaccgaggcctccggctccatcatggagccgtccgtgagctgcacgccgatgtcctccggccgcagcgccgcgaacagcttcgactggtcctccagccgggggcaggccgggtagccgaaggagtagcgcttgcccacgtactccgcgcggaagcgctccagcatcgtcatgtcctgccggtccggcgtgccccacatgctgcgcagctgcgtgtgcagcagctccgcgtagccctccgccgtctccagcgccagcgcctgcaccgcgtgcatcttcaggaactcgcccttcgccttcagctcctcggacagctcgcggatgccggagcccgcggtgacgacgaacatggccacgttgtccgtcggcgcgccgccctccagcgggcgcaggtagtccgccaggcacaggccgccttcgcggtcctggcgcgggaagtcgaaggacgcggcctccttgccggacgcgccgtcgaagagcaccacccggttgccatcactgcccgccttgtagaactggaacacggcgcgcgcctgcatgaggccgccgcgcaggaagcccttcagctcctccacggcctccttgagggcgagcgccttgcgcccctcctccgtcttcgccagctccgcctcggccggcgtacccagcacacgcgctgaggagcgtaggcccaggtgccgcccgtacagcatcaccgggttgatgaacttccagatgtggtccagcggcgtgttggtcagcacgtgccgctcccagtccggcgcggtcggcacggcgtccagcaccttcacctcggcgctgcgcccgcgcgtcaccagcgccgncgggggc

SEQ ID NO: 887 - DNA, 8917 bp, Myxococcus xanthus
tgcggctactcacaccccgtagagcagcaccggggcgaagcccgccgcgtcacacgaggccagcacgtatcgtacgccgccacgctcacccgtgaagcccgcggcaatgcccgccgcgtgcaagtggccatagacgcacaccttcggtccgaaggcttcgatgggctcgctgaaggggggggacttctcgttcgcgtacaccggcgggaagtgcacggccaccacgcgcaccagcggcgtggggctggctgcctccttcttcttcgcgtcctccatggaggccgtcagccggcgcgtctcccgctccacatagccggtgtccgccgcctcgtcccccatctccccaccgggcatgggcggcgcctccggcgcggtccacagccggctgcccgcaatcacccacgggcccatgacgacggcgttgttgtggaggaagccctccagggttcggaagggctccagcagcttgcgcagcttggaggcggagtcaccccaccagtagtcgtggttgccgcgcaccagcaccttgcgccccgggcgcgcgtccagccacgccaggtcgtccatcacctcgtgggcccgcgtggcccaggagatgtcccccgccacgatgaccacgtcctccggagccacccgctcatcccacgcgcgctgcagcggcagggggtgctcggaccacccgaagcggtgcatgtccttctgtcgcgtggagggcaggtgggtgtcgccgattccgaagagccgcatggccccctcatagcggaagccctcgcccctgtcggccccctcgtcctatcccctgcatccggtgtcacgccaaaaggtggggagaactggaaaggtagtaaataaactttacgtcgggctgtctcgaaacacgtcagtgcgacatcggttggccaatccgacgcctggattgtcagggcttacatgtgcgtcattcctgattccgggtggttgcaccgtcgggggcccgggttcgagggcagatttcttgacgggaaggtggagcatccatgctccacctggggtcgggaaaaagaggtgctccctgggaatgcgcggctggcatgcatggtgctcaggagtggccccctgcgccgctcccgtgggacgggggcgaccgtggagctgctgaccccccttcaaggagtttccatgcacgtgttgcgcaagacgttcgcggtgacggccgcggccatggccctggcggcctgtggcccccagcccgaaacgtctccggaagaaacagcacctgagtcgcaggttcccgcaggcgcggtggacgacgccgcccgcgcggtggccgacgcggctcgccgcacgcccaacgaactggacgcgcagttcacgaaggccgctggtgagttcaacgttccggtgagcctgctcaaggccatctcctacgcggagacgcgctgggagcacgtccgcggcgaggaggagttcgagggccgcccggcggcctttggtctgctggccctgcgcggtcagctcatcaccgacggcgccgccctggcgggtgtgtccgcggacgcggtgcgtgacgagccgctggccaacctgcgcgccggcgctgcgctgctgtcgaagtacgccgatgaggcgggcatcgaccgcgcggacctgggcgcgtgggccccggtggccgtgcgcctgacggacatctccgacccggacatccaggcgcactacatccacaacgacgtgtactcggtgctgcgcgagggcgcgggcgccttcacgccggcgggcaaggtggctgtgtcgctggagtccactcaggtcaacccaaagttcgccctgccgaatatgcaggcccttgcggccggcccggactacgcggcctccatctggcgcccgtcgcccaactacaacgcgcggcccgctggcatcggtcagcaaatggtcgtcatccacacctgtgagggtggctactcgggttgctggagctggctgaccaactccgccgcgggagtgagcgcgcactacgtggtcaacgagagcggcaccgaggtgtcgcagctcgtgcgtgagtcgagccgcgcttggcacgtggccgctgcctaccgcagcagcctcaacggcggcgtcaagtcgaacctcaacggccggtcgacgaacgacttctccatcggcatcgagcacggtggctacgccagctcggcctcgttctccacggggatgatcaccacctccgccaagctgacgtgcaacatcacccgggaccagggcatcccgcgcgacagctaccacatcgtggcgcacggccggctgcagccggagacccgcacggacccgggccccaactggccgtggtccacgtacatcagcaagattcgcagcgagtgtggtgacggcggcggtggaacgaacccggtcatcgtcgtggacagcaacaacgccaacaacgactccagcaagggctacatcgcggtgccgtccacctgggcgcgtggcaccagcgcgggctactacggcaacgactactactacgcctccacgcagcccgtctccgagccggcggtgttccacttccacatgcctgcggcgggcagccggaccatccaggcctggtgggtgcagggcaccaaccgctctcccgcggcgcccttcatgattacgcacgcgggcggcaacagcacggtgacggtgaaccagcagaccaacggcagcaagtgggtgacgctgggcacctacaacttcaacgccggctggaacaaggtgcagctgagccgctgggccaccgaaggctacgtcgtcatggcggacgccctccggattcagtgaggtggtgatgcggggccttgaacggcttcaacgttcctggccgtggcgggcgcggtgtctgaccgcgctcgccgtgctcggtgtcggatgttccggccggtgtggcgggacgtccggctccgggccgctgtccaaggaggaggctcgctccattccaggcgcggtcatcttcttgtcggagcgggcagggcagaaggatgtctggaaggtgagtccggacggtgtggagacgcagctgacgcgcggcgaggaggacgagtaccccggtcccctgtcgccggacggcaagtcgctgctcgtcatcaccgcgacggaggagggcgggctgcaccgccagcagatgcgggtcctgccgctggatggcaagagcccggcggtaccgctgcacccgccccgggcgcgtgcgcgcaacgcgagctgggcgccggatggcacctggttggtggccgagtccgacgcggagggcttcagtgacgtggtgcgcctggagccccgtgagggggggccggaggtgcgcctcacgcaggtgccacaaggctgcttcgagccggcggtgtctccggatgggaaggaggtggccttcgtatgcagccgcgagggcgaccccgaagtctacgtggcgaacgcggacggcagtggtgagcgccgcctcaccttcttccaccatgaggaccgcacgccgaagtggagcccggacggcaagtggctcgtcatcgtcagcgatcgcgagcgcaaggaccggctgtacttcctccgtccggacggttcggacctgcgcgccgtgtcgggcgagtccttcgagggcgacgagcgtgaggccgcctggagtccggatgggcaacgactggtctacgtgagccgtctgccggatgggaacgcccgcatctggatggtggcggtggcgggcggcgcgccggtggccctgacggacggcaagcaccgggacgacatgcccgcgtggagtccggacgggaagtacctggccttcgtgtccgagcgccagggcgacacggacgtgtacgtcatgcgcgcggatggcagcgggcagacgcgtctgacgaccgccaaggggccggactggctgccgcgctgggcccctacgcgctgacggccgagccgtctcccgccgccggggcctggtcatccgggacctggggcgggagcgggttcgcgccgggcggggccacgggcaggctgaagctgaaggtggagccctggccgggctcgctctccacccagatgcgcccgccgtgcgcttcgatgatgaggcggctgatgtacagccccagccccagccccttcgcgtccgacgcgccgctcttctgcgtgcggaagtacttgtcgaagacgcgcgcggcgtcttccgggctcagcccggggcccaggtccttcaccgacaccaccacctgttccggctggagctgggctcgcacggtgatgggctgcccaccggggctgtacttggcggcgttgctcagcaggttggccatcacccgctccagcctcgccgcgtccatccagatggggggcagcgcgcctgggacctccaggtggaagcgctcgcgcacgtcgggggccacgtcccgctccatcacctcttccaggaagcgcgccaggtctcggggctcgcggcgcagcgtctcccgctgggactccagccgcgagccttccagcaggtcctcaatcatggtgttcatccaggccacgctgcgctggatggcctccgtcatggattcctcccgctccaggttctgctcgcgcagggcgcgccgcagcagtcccacgcgcaggctgatggtgtggagcggattgcgcaggtcgtgggagatgaggctgacgtattcctcgcggagccggtccagttcgtggcgcgtcgtcacgtcctgcgccgtggagaccacgccgcgcaccttcccgctgggaccgaagacgggggccgcggtcatcaacaccggcagccggctcccatcggggtggaggatgaggaactcctcgggccccgcgagctggcccgtgagcagcgcgcggacgatgggcacgtcctcccggcgggccggcttgccgtcggtggtgagcacgacggggttgatccccgtcatcgccagcgacacgcccttcagcgggcgcccgagcagttgctccgcgacgggattggccaccagcccgccgccgtccgcctccgcgaagacgattcccacgggcgtgtggtccagcagggcctgcacctggctgcgctgcatctctgcttcctcacgggcgcgctggaccttggagaggtaccgctctcgctccgacacgtcgcggacgacggcgagcacgctgggaccttccgggcctgataccgggctcagtcgcacctccagcgacagcgggctgccgtccttgcggcggccttggatggcgcgctcgcccaagccggtgtccaggctccggccaccaaagagcccttcggggaccagcacctccacctcgcgtcccagcagttcctcgcgcgggtagccgaacacccgctccgcctccgtgttgacgaagcgcagcaggccttgcgcgtccaccgtcagcagcggcgcgggggtggtctccagcaggccccggtagcgtgcttcggaggcctccagcgccgcggtggcctgttggcggtgggcttcaatgtggtccagcgcccgcgcggacaggagcacgagcgccgcgccgcccgcgctcacgaaggtggcgaagatggggagcttcgcctccaggttgatggcgcgcacctcgtgcaggagcatcaacaccatgcccagcaccgaggggccgagcagcgtcaccggcaccagccggcgcgcgaggaagccgccgagcgaatcgcgggtgatgcggcccatcagtcccagccccggccatgcgcagagcgtgcccactgccagcaacatcagtgtcagcgcggtgggcaggcccatgctgcgctcggcgaggaagggcagggtgcccaccgtcaacaaggggcccatcaacaggccgttgaggcccagcgtcgaggtcaccagtgacaacacgaccagcgtgtcgcgcaaccggacggagtggctccgctccgggagggccagggccgcgcccagcagcgtcaagcaggtggcggagaggggagaggggagagggagcaccgaggcgtgtccatcgagcaggcgcagcatgatgtgctccatccccacgtcccagcccgtgatgtcgcgcaggagactcaccgcgccgatgaccaccatcaccagcgcgcaggcggtggccgtggattcctgatggcggaacgggcgggcgcgcagccgcaggcccagtgcggcgccgccgaaaatcatggcgatgcccgtcaccggcgtcatggggatgccagccacgccgggcctcagcatctccacgtcccaggcccagcccaggaggtacagcgcgcccacgagcggggcgcccagcgtcgcgagccaggcgatgccgcgggccatggctgcgctccggcgctgcggcctccagcactcgttcatcgtggcgtccccctggaacgcacagggctcctcccgtgacgcaccggccccaggcccccggtcgagacgctccagcgagagatgcgtcgcgcccttgcatccggcatcggacgcgagtgcggcgcagcgatgggtgcggacggtgggggcgccgccagtcattggctcgggccgtgcgcgcctccgtcggaacatgggggcggccagcgcgcggggcagcagaccccgagcagccgagccgcgagcggaaggccgggcgccgcgctgtctagggaggcgggtggaggccgggatggacggtgagcaccagcccccagcccggcgccacgcccacgttgcgtggcgtgtagtcgtccgtgcccgtgacggacaggaggaaggcctccgcgtccgcgcccgagtggacgtagacgaacaatccgtccgggccggtgccctcctggttcactccctggaggtcggcggtggggtagtagatgcgaccggccagcgcctcgccgtcgggggcgaccttcgcgccagcgacgggatggccgctggcatccaccacgcgccccagcacgaagccggcgtcgcgcagggtggccgcccggttgtcggtgtggccccggatggcgctctcccccacgcagaccctgagcgcgtcatggaaggcgtccggcagcgcccacacgcgcgcaccaatgatgtccgtgcgcggccgggcaccggtgaagccggcgtcgtagacgacggtatgggcgggcaccaggcccgcggcctccgcgcccaccgcgaggctcaggtgcatctcccgcaccgccacgtcgcgcacggtgaaggcgccatccgcggcggccggcgcggtgccgaaggtggcgttggcgtcattcaccgccagccgcaggggctccgcggcggtgaggggcgctccctccagcgagggcaggggcaggccccgggcctcgatcaaccgccgggcctcggggagcaggtccaccgtgccgctgacaccaatgtggaggttgtccaggtccacggcctcggcgtcgtcggtctgcacgccagggtcgggtgtgtaatcgccagggccgcagcccagtgagagtcccagcacggcacatggaaccatcaggagaggacgcatcatcgcgggaaagctctccacggcctcacgtggcggcaatccaccccatgctccgtccgtcccctggtcgacgccgcggtggtgctggccatggggctggagggcgccgcgctgtccgaaaaacatcagcgccgcgccccggagtgggacgcggcgccgttcatgtggaagccaggtgttgtcgaaccgtcacccgccccgcggtgtggcctgactcagcgccagcggccgttgccgccggaggaggacgacgaacccgagcggccggacggaggcgcgctggagcccgaggacgacttcccgctgctgctacccccgcgtccccagcccccgctgctggagctggagcccgagctgctgctggagctccggttgctgctgccggagctgctgccaccgcgtccccaaccgctgccgctggagctggagttgctggagctggagttgctggagcccgagctgctggagccgccgctgctgcctccccgcgtgttccagccgctgccgctgttggagttgccgctgttggagttgccgctgctcccggagttgccgctgccccagcggttgccgctgttgttgtcgcgcgagtcgtcgtccttcggcgcggcgttgttcgaggtgcgtcccgcgggagggctgctccatccgctgccggagttgttgctgggcgcggcgttgttcgaggtgcgtcccgcgggagggctgctccagccgctgccagagttgttgccctggccgcgcgacggccggtggttgccgcccgagctggaaccgcgcggcgtggtccagcgcgtacctcccggaggaggccgggttccgctgtacgtgttgccgggcaccacgggacggttggaggggcgcgtcgccgggcgcacgtagccgtagcccgcggaagcgctgtgcgtgcggttccacacgtagccgcggttgcgctcgtagcggtagatgcttcccgtgctcgggtagtagtcgtgggagtggcgcccgtgcatgttgcagaggccgccgtgcgcgtgcgggtggtcgttccagtaccagaccaccgacgggccactgtagtagtacgcgtcgtccgagtagacgtagtacgtcgtggtcggctcgtagtcgtggacatgcacgtgcgagtacgggcaccagccgccgccgaagtcatcggggatggggtggtcgctcgaatagctgtactcgatgacctgaaccggggcgtggtgccgcgccggcccgtggacgtgggcgacacagccagtgcccatcatcagggcaagcggaacggcgagggcgagcaggcggcgcatgtggtgactctcctgggcggagtggacggccgggccgtccaccttgcggccacgcgaggaagacggccgagcgtggagaaaattcacgcccgggtgcagtcccgctttcgtccacccgccagccccaggataacgcccttcgtcctctggtggacaccgcctgggtggtgtagggggaaatgtgcgtg

SEQ ID NO: 888 - DNA, 7515 bp, Myxococcus xanthus
ctgatggcttccggcgtggcggagtgggcgcaggagaagcccgcgctcatcgacgccttcgtggccgccaccctgggcgagtcgctgcgcctgtccatgggcatgtcgaagacgccgttgttcatcagcgcgcgcgacgagagccaggaggcccgggccattcccgagctatccctgctggcgcagacgttctggccgcgccgcgatctgggcatcgaggcctggtgggcgcccaagacgctgcccgtggaggcctgggtgcgcgtgggcaatggctcgcgcagtccgttgggcaatgacaacagcctgcccgccctggacgcccgcgtggatggacgctggggccgcgcccggggcgacgtggatgccttctggggcttccgcgctggcgcgggtgtccatgtggagaacgcctacgaccgggccggcatcggtggcatcggcccccagaacttcgtcttctaccgggcccccccggtatcggggcctcgctcggtggtggaggcgcacgcgcggctggacgttgggcccgtgagggtgctggcggaaggcgccgcggcctgggagcggcgctctcgcgataccgatggcaatcccaacaccccgcgcgaaggactgccacggatggagagccagggggcctcgctggaggtgtcctgggtggtggtgggacgcccccggggcgacggcgctcgctggcccgtggcgccgaacgaccccaccggcatggacgccgtcaacgccgggcaggtgcccacgggcgccgtcgagctcgccgcgcgagtggagcggctgtggcttgggccgggtgcctccgacatccagcccggcggtacgacgggcggcgccctcgcggtccgctggtgggtgacgtccttcttcggtctcggcgccgccgggtacgcccaggggtacgacaccgcgccgctggaggacccgggccggcgcaactcctggctcgccctggcccgagccaccgtgagcgtgccctgagcatttcgacttcgacctgggcccaggggggcgtgcccagggcgttccgatgcacctccctccgccctcggagcacaccatggtccgcaccgaacgcgtcgctcgtcgtgtcttctccaggctgaacctggccctgctgctcacaggcgccctcgcgggctgcgggggccccatggagccggccccgtccgcgctcgaacccgaaggcgcgcaggacgtccaggcccaggcgctgacgtatcccagcggcagcagccagacggtggtgtcccgccgtgtcgtcttcagaaacggctcgggggcctatcaagcggcggcggggttcgagcacttccgcgcggcgggcgcttttgacatcgcgctccacaacatccgcatcgcggaggtagacgcgcctgccacgcgcgaggccctggtcctcatgtccgcgggccagaagatttcgagcagcggccactccagcggcgtcaccggacaggcctccaactgggatgcgtcctgtgacagcgtctcctgtcccaacgtgagcctggacggccgttcgctggccatgaagctgcgcgccctgggtttgtttcccagcgggaagacgtacctgtccgtcgtcaacgacgccaacttcgaccatctgttcgacagcgacacgaagcagcgcatcgtgaatggcttctcgaactggctccaggcgcaggtccgtccggagactcgtgccatctacctggcgggcagctctcgcggtggatgcttgatgatgcgcatggcgcaagcgctccgcgcgaacacggcgctcgacggcatcgacatctacgtgtcgtcattcgacggcgtgtgccgcaacagccagggtgagctggggaccttcgacagcaagatcaacaaccccgtgcggccctggggtaccttctatggcgcgtgggccacgaacctgacggcccagttcccccgccgcgacaggctccacatcttccacgtggtgggaggccaggaggtcgctcccgccacgggcatccgcgccttctccggctacgcgggcagcaccccgccttcgacgggcacgaacctcgactggggctggtacaagcagacctgggtgaagtggcagcacaaggagattggcaatccctacacggaccccagcgcgtcggaccaggcgcaggcggtggcggagacggtcgacgcgcacttgacgtggctcgacgcgcgcctgccctgacgcggctcaaggaaacccgggcggccgaccttcctcggccgcccgcagtcgcgcgccggggttgagttcaaaggcgagcccgaactgccacagcgccacgggctccaggaacaggatgttgtagtagtcctgtcccttcacgtaccgcgcgaagacgccgaagcccgcgccccaccgggggtagacgccgaactcagccttccacgtggcccgctgcgagggcgtctccccgaagggctgcgacacggacacttccaacgggaaacggtggttgctccatgtgcgctggcccatgacgccggccgcccagtgtccgtcaccgtagacgaaacgctgggcgcgggtgatgcggccagggcccatggaggtgttcagctcgaaggcggcgaacccgcccaccaaccacgcgttgcgcaggtccggctccacgtcgaaagccaaccggctgtggaactccatgcggaagaggttcgtcgtgaagctgccggacacctcgttcagcggcagttgcccttccgacggcgtgcacccggattcgccgcgcgtctggttgctgtagaagcacccggactccccattcgagtagtgccccacgatgacgttgagcgcgagcgccaatccccgcaccgccgcgccctctgcccgaggcttcgccagcggtcgcaggtgcgccacctggaacgtcgccttcgcgatgaaggacggcgggatggcggggtcgctcggcgtgtccacgatgcgcaactgcaccgccggggtgatgatgagcgacaggaaatactcaccaccgggccgcgtgaagtctccgtgatggagttgtggcagaaagaggttgggcgccacctgcgcctcgaagatgagcttctccggggagttcggcgccccctgacggcgaatgcggttgggggagtcgaggatgtagctgcggtccaggaagagtgggatcggcgcgtcgtattccacgtgccacccgtccgcgcggacgacgcccgccagcaggacacacgtcccccacaacagggcggcccaccaccgctggactccgccccctgccccccacgccctggacgccccatgattcacggggccggacctcaggcctgtggccagtgggttgtcacctgcccccgtggaccgcacgcgcgctcgggggcattcacacgcgtcagcgtcaggcgcgcacacacttcccggcccggcggtctcacggccattgcacacccgcggacagccggacgcgtgaagtcagggcgcgccggggatgcgccagccgtccgctcgcagcgccttgcgcagccgtggcgtgtccttcacggggtcccaggcaccacaggcccagggcagcacctcgtccacgatggcacggtggacctgtcgtgccgacgcatgcgggctgagcggttctggagactcctcgctggcgcccagcgcgaaggtgatgaccgaccggcggctcagcgcccggcacgcggcatggacgcacgcgcccagggggtccacttcaggcgggcgcggtgcgacgggcgcggacggccgggggacacacccgcaggcgtagttcaccgaccaggcggcggagaaggcatccggcgcgcaaaactggctgggggtgaagtttcccacctcggccacctgcgccgcgtgctcctccgagggctcgcagagccagcggtccatggccatgaccgcgcggcgtgaccagtcgttgttcgggtcctgggactcccacagccacagcacatgcctcgcggcggcgagcgccacgcgcacctccacctcggtaccgaaggcggccagggactcaagccacgggcgaagcgccagggacggctcctcggtgcgctcgacgggccacgccacgtccgtcaagagcgcggcgcagagcggctcctggaaacggtccgtcctcaagggcggcgcttgctgtcgcagcaccgcgcgcgtgatgtcgtccatgacggcgtccacatagggtgccaggacctcgacggaccggagcgcgtcgagcggcgccagcgcctccgcgccccggacgcccagccgggcgatgaacaagagggctcgcttcccatcttcgagccgtcgggtctcaccgagcgggccccgccaggaaggcggaggcggcccgtcttcttgccggcgcgatctcgcgctactcgccacttcgagcagtcttggaatcgctcgtgacggcgccagcagcgacagcacgcgcagggcctcattccgattctcatcgtccacaatggcctgctcctccagcgcggtgaggacctcttcgtcgcgcggaaagcgagcgaggacatggagcccctcccggcgcaccgcgcggtgggcatctccgagcagcgatagcgcggcgacgcgaacctcgtccggcaacgggtcctgcatcgccgccagcacctgcgccgcgtgctgccgcgtcggcgtgtcgccccgctccttgagacacggcaggacggcgcgcagggccatgggggtggcgcgtgggcgcatgcgcgtcagcaccgccaacgccattcgccggacccgcgccacgggctgacggagcacgtcgaggagcgccggaatcgcacaggtggggagcgggtcgatggtgcccagcgccgcgacgcactgcccgagcatgttgcgcgtggcttgccaggaagcctcctggtccgctcgcaccagggcctctatgagcgcgggcaccgccgcgagccctgcctggcacacgcggtcatgtgcatccctgccgtcgaaccagcggatgcggtctccggcgagcgcggcaatccactcgcgcaccgtctttccttccacctggtagccggaacgaaccagcgcggtatccagccgccgcagcgaggcgaggtcatccggccgcgccttgcgccacaacgcatcaaggtcttcgtgttcggccatgtgcagcccgacggtgaggggactcagggagatactggcagggagattacggacatggccagacgggaccaccagttgggggcctgacgcggtcgcgatatgacgtcacgccatgaacccgttccgtctccctttgcgcctgggcgtcgtgtgctgtctgttgctgtggtcccttccagcggaagcgcagtccacccaggcgaggccccgcgcccgcgacctgggcatcaccttcggcggccaatccggcccgaacaacgccatcaccgacgtgtccggcgtggaggtgggccacacgacgctgatttcgggtgacacccgcggcccgcgcggcaagggcgcggtgcgcaccggcgtcaccgccgtgctgcctcgcggcaaggacggtgtgtccgaggacgtcttcgccgccatctacgccctcaacggcaatggcgagatgacgggctcccactggctcaccgaatccggccagctcgccggccccgtgatgctcaccaacaccaatgacgtgggcaccgtgcgcgactccgtcatctcctgggcgatgaagcgcggattggagtgggagctggggctgcccgtcgtcgcggagacgtgggatggcctgctgaatgacatctacggcttccacgtgaaggccacgcacgcccaccgcgcgctcgacagcgccaagagtggtcccgtcgcggagggctcggtgggcggcggcacggggatggtgtgccacagcttcaaggccggcatcggcacggcgtcacgcaagctgcccgagtcggagggcggctacaccgtgggcgtgctgttgcagtgcaactacggcgcgcggcacctcttcaccgtggagggcgtgcccgtgggcgaggagatcaacgacctgcgcccctgctacaccgggcccaagaagccgagccccggcatgttcaaggacttgccagcctgctcggcgtcgcgcggcgacacccagccccgcacgcccgagggcgccggctccatcatcgtggtggtggcgacggacgcaccgctgctgccgcatcaactggagcggctggcgaagcgcgtgccgctgggcatcgggaagatgggaggcctggggggcaactcctccggcgacatcttcgtggccttctccacgcagcggctgaagccccccaccggcacggacgtggccggtgtctcgacgctcgacaacgagcgaatgacgccgctcttcgaggccaccatccaggccacgcaggaggccatcctcaactcgatgctggcctccgacacgatgacgggcgcggagagcagccgcgtctacggcctgccccaggaccggctcatccaggtgatgaagaagtacggccggctggcgccccccgcgccgtgacgccgcgcgcgcctcagtccgcgcgctgaggcgtgggcgcggcggccccacgctgccgcgcctggacccacgcctgcacccgcgcctcgaggatgtccatcgccagggagccgtcgagcagcacgacgtcgtggaactcgcgcacgtcgaagcccgggcccagggcctgctccgcgcgcgtgcgcatctcgcgaatcttgagctgccctaccttgtacgccagcgcctgccccggccaggcgatgtagcggtcaatctcgttggtggtgtccagctcctggcgcggcgagttctccatgaagaagtcgagcgcctgctgccgcgtccacttcttcacgtgcatgccggtgtcgacgacgagccgcaccgcgcgccacatgtcgtaggccaactggccgaacttgtcatacgggctggtgtacaggcccagctcgtcgcccagcgtctcacagtagagcgcccagccttcgccataggccacgtagtagccgtagcggcggaactcgggcaggccgggctgctcggcggccagggctgtctgcagatggtgaccgggcacggcttcatgcagcgtgagcggcaccatctcccacagggggcgcgtctctggccggtacaggttcaccaggtacgtgcccggccgcgagccatccgacgcccctgggtaatagaagccggtggtcgcgtccggcgccatggcctccggcgtcggctccacgccatagggctgccggggcagcgtcttgaacagccgcaccagcgacgggtcgatgcgcttggacaaggcccggtagcgcatcagcagttcgtccccgtcccgcgcatagaagcgcgcatccgtccgcaggaagcggaagaactccgccagcgtgcccttgaagcccgtctgggccttcaccgcctccatctccgcgcgcaggcgctggacctcagccaagccgagcgcgtgaatctcctccgcgcccaggccggtggtggtgaacttgcgcgcgaggaaggcatacagctccgcgccgtcgggcac

SEQ ID NO: 889 - DNA, 8590 bp, Myxococcus xanthus
  unsure (1)..(8590): unsure at all n locations
cgtgctctttcgctaaaggacgcgctgttcggtgaggtggtgggcgccctcgatcacacgatgggggaacacatccttcacgttggtgcgaggcatgcacagcgggctgcgcgtgtcgtcgatgagcagcgggaccagctcgtcacgcagcgcggacacgaaggccgcgtcctcgcgcttgtacaccaccaccacgtccttggccatgtcccgcagttgcgtcaccacgcggtagcccacccgtcccgctccacacaccacgacgtggcccttcatcgtctcggagaccacttcgatccactccttgtcgttcttgtgccgggcgaagaagaggtacgcgaagcgcaccacaccatccgcgaccagcgcaataccagcaggcggaatcaccaggttgagcagctccaccatccagtcgtccacatagggcagcgacggctggccgtagagcaggaagtaggtgtggtgcagcgcctcgccgaagtcgatgcggtcgccgcccggcccgcggaagcgccaatggaagagcagcggccctcccaggaacagcacggcggacagcaccagcgtggtgcgaaatcgccgcaccagcgcccgcaggtagcgcagattggcccggaagtgcctgcgggactgcttcatggtggctcctcgactacgacgccggggtgatgcccgtttccgccgagttccgcgcgcgacgccgctccaccatccacaccaacaacacgcccagctcgtagcagagcagcatggggccggccatcagcgacaggttcaccacgtctcccgtgggggtgatgatggccgccgcgatgaggcacaccacgaaggcgtggcgctggtacctgaagagccaggacgacttcaccacgcccaccacgcccagcagggccatgacgagcggcagctcgaagatgatgccgaaggcgaggatgagcagcagcaccagcgagagctgctcgtgcatggacaacatgggccgcgtccaccgcgccgcctcatgcgccgcgtgcgccgtggccagctccttctccagccgccacagccccgccagttcctcggtgcgcgtgggggcgatgcccgccagcaggctcgccgaaccgtccatggccgccgccgccgccgcgaagtccttcttctcgtaggccgtcacggcctcaccgctttcaccgctgcgacacgcggggatggcgcgaacccaccaccccggtcagaccgcccagcctccaccgcccgtatctcacctgcgggggcgcactcggcgcggtgctggcctggcctcgcccagtggggctcgttcttcggagcgccccgctctcgttcgccagcgaagaagcgcaaggcgtcatccgcgcgcagccgggccgtgtccaggcgctgctccagcgcgagcgtctcctcctcgttgaggaggaaggtgaacatggagggcagcaccgcgaagtagcagaaggcggcgccgaggaggaaggcgatggaaccgaacgccacgaagggcgcggcgaagcggcgctcctccggatacaggccgggcgagacgaagccccagatctgcatcaggatgacgggcgtggtgaggaagatgccgcagtacacgcccaccttcatcaggacgttcagctcttcgatgccggacgtgtagatgagcgagcgattctcgggcggcagcgcatccagcaccggctgcatcagcaggccgaaaatcggcttggcgaagacgagcgaaatcgtccccaggatgagcacggcgatggtgcaccgcatgaggcgcgagcggagctccgtcaggtgatccgccagactcatgcgcagctcggagtcggcaccggggttgatgggcggggggctcaggactcagctccgtttcggggcgttgcgcgccaccgtccccgggatgggcgacagcgtgggcgaggtggcggtggaagcagcgggctcgggcggcgcctcggcggtgggctccgcgcccggctccgccgtcgcagcgtcctgcgcgggcgtctccccggcatgcacgtcggaggtggccacctcacgaggcccctgcgcgtccatttccagcacctgcgcgggcgacgagggctgaggagacgccgcatcggccggaggtgacgcgccatccgtggcgggaggcagggtggcctcgggcccacccacggcctgcggcggctggggcgcgaagcgcgtcccgggccgcaagggcgcggtgggaggttctccgatttcctggtccatggcgtagaactcacgctccacgacgttgcggacctcatccgtctggcggcggaactcgcgcaggaacttgccgatgccgcgcgcgagctcgggcaaccgctgcggcccgagaatgagcagcgcggccaccaggatgaacaccatttcgcctgcgccgatgttgaacatttttcctgacgcgctccccggagcagcccggtttatcgcgccccggggagacaggcgcaaccgttcgtctcgccaaagcatccgcccgccacccggaatgggcggcaggcaacccgaaggcgccctttcatactacgcgtgagaatccgccccgggcgagagcggaaccgccattccttgcgagggagccaccgccagcgcccgtgcctgctccctgctgtgcacccgccgctccaccacccacagcaaggcgggaagcaacagcgtcaggaccatggacactccggccatccggggaatgccgcccagggtcccgtctggcaggtccgtcagcagccgggcgctgaggaaggcccccacggcggcggccatgtgctggacggcggactggagggacatgaagcgcgcacgtaccggggtgtccggcacccgtgacgtcagcgtgttgtacgcgacgttgcgcgtccccatggccaccatgaagagcgtgaagatgacggggacgggcatccaccgaggcaggtggacgaagcccacgtaggtggacagcagcaccagcgcggagcccaccgtgcccaccttgaaggagccgtaccggtccaccatgggccccgccacccggagcgtcgcgaagctggcgatgccgccgatgaagtacggcagccagagcaggtcgcgcgggtagcccacgttctgctgcagataggcggacaggttggggatgaggacgaagcccgccatcatcaccaacgccgtcatcacgtacgacagttggatgtcccggttggccagcagctcgagcacgccggcctgtttgcggggccccgcgtccagatggccgcgcacgggtggcaggtagaagatggcgcccagcaccaccagcaggcccatggcggccaccgcgaagaagggcacgcgccagccgccgaactcggccagcttcagcgccatgggcacgcccgccaccgaggccacggagaaggcgcccatcaccgcacccagcgcacgtccgcgccgctccacggggaccaggtccgcgatgatggacagcgacagcgacgtggccggcccgccgaagatgcccgccaccacgcgcgccagcatcagcgtggacatgcccgtggcgaagccacccgccgcggtggccaccaccaggcccagcatggacaccgccagcgccttgcggcggtcgaagcggtccaggaagtagccaccggccagccccgccacgctggcggcggccgtgtacgcgccgccgatgatgccgatgtgcgacgacgcgatgcccagctccttcgcgaagtccgggcccagcggcatcaccatcacgaagtccaggatgttcacgaactggaccgcgccgatgagggccaccacggcgcgctcggagacctgtcgttgattcggcatgaagacgtgtctacacccggaagcggcgaacctccgcacggaggatttccgcctgacgctggaggttgtcgatggcctcctccaactgcttcacggagcgtgtctggtgctcggacacgcccttgatggtctccaccgccttgagcacctgctcgctgcccttcgtctgctccttctgggcgcggttcaggtgggtgaccatctcgttgatgctctcgatggagcgggtaatctgcttgctgccgtgcgcttgctcctggctgctgcgctgcacgtgggcggtgagcgccttcattttctccgcgctcttcatgatctgctcgccgccgcgggcttgctcgttggaggccttggaaatctgctgcaccgtctcactgatgcggtggatggaggccgtcacctgcttgctgccgcgcgcctgctccacggtggcccgggcaatggccttcaccatctgcgtggacttctgggtgctgtcgttgattttgcgcagcgccccttccgcctcccggcccagttgcacgccctcctccacgctgcgcacgccttggttcatcaccaccacggcgttgcggctctcttcctggatgctgcggatgagctcggcaatctccttcgtggacgcgccggtgcgctcggccaggtccttgatttcctccgccaccaccgcgaagcccttgccgtgctcacccgcctgcgcggcgatgatggccgcgttgagcgccagcaggttcgtctgctccgccacgtcgtcgatgacgttgaggatgttgccaatctcggagatgcgccggcccaggctttcgatgacatgggccgcgctgcggcttgtctccttgatgcggtcgatgccggtgagcgtcttgcgcagcgactccacgcccgtctgcgcgtcgtcgaagacctgctcggacaggcgggccgtctccttcgcgttggcctccacctgaccgatggcggcgtccatctggctgatggccgaggacgtctcctccgtggaggcggacagctcctggatgttggtggccacctccttgatggagaacgtcatctcctcgatggcgctggtcgtctcctccacgctggcggccatggcctggacgttctccgccacctcgtcgttggtggcggccatctccatgatggaggagctgctctcctcggcgctctggtagaggacctccacgttctccgcgatgcctcgcagcgaggccatcatctccaccatggaggaggacgtctcctccacgcgcgcctgcaccgtgcccgcgccggacgacaccgtggtgccggtgcggtgaatctgctccaccacgcccgccaccacgtccgacacgccgcgcacccggcccagcgtgtcacgccagctctgggcgatgcggttgagcgcctcggcgagctggcccagctcgtcccgcgtccccacgtccacgcggccggtgaggtccgcctccgccagccgccgggccatgcccatcatcgcgtccagcggcaccaggatgaaggcgcgggagatgaagaaggccaccagcaggaacagcgtcaggccgatgccgaatgcgagcatcacgacgcgctggagttcggtgacgaccgcgtccagcccggagttgtcgagcaccagcagcgcctgccccaccacgccgcccgacagcgtcaccgagcgcgccacggagcgatcaccgttggcgaagcggaagccatccagcggctggccctgccgggccttcagctccgcctggaaccacgcgggcggctcggccgggtgggtggccagcacctgaccctcgctggagaggacggccagcaccttgaagtcgtcgtcgcccgcgcgcagccgccccaagctgtcgggcagggccgcggcgggctgggccatcagcatgctgacggcctgactggcacgggcctcgccccgcttctgcaggcgctgctccaggtgggcttccacgcgcgaggggacgacgaacaagagcgtccccaggatgagggtgaggacgagcgcgaaggagcccagcagcaggctgcgcaggccgggtttcttgaaccggagagccaagacgaggcactgtagggagggaaacaccggcagggcaagaacagggcgccaacgcggcctgtcccccggggggcgctgacttcccgcctggcggatgcgtaaggtcatcccgatgtcctccaccctgctactgacggacccgctcttcttccagcacgaccctgggcagggccaccccgagtcgccctcccggctgcgccgcatcctcggggtgctggccagcacgccggtgaagggcacggtgatgaccgcgccgcgctccgccacggaggcggagctggcctcggtccacacgccggagctgctggcgtacctccagcgcatcaacgggcaccgcgcgcaaatcgacccggacacccaggtgtcccccgacagcgtggacgcggcgcggctggccgcgggcgcctccgtgcaagcggtggaggcggtgatgaagggcgaggcccgcaacggcttcgcgctggtgcgcccgcccgggcaccatgccgagcccgacaaggccatgggcttctgcctgtacaacaacgcggccatcgccgcggaggcgggccggaagctgggcgccgagcgcgtgctggtcctcgactgggacgtgcaccacggcaacggcacgcaagcggcgttctggtcgcgccgggacgtcatgtaccagtcggtgcaccagttcccctacttcccgggcactggcgccgcgccggaggtgggcgtcggcgcgggcgagggctacaccatcaacgtgggcctgccgggcggcaactcggacgcggactacgggatgattttcgaggagctgctgctgcccgtggcggaggcgtaccggccccagctcatcctcgtctccgcgggcttcgactcgcaccagcacgacccgattggcggcatggacgtcagcgagcgcggcttcgcggccatgtgctcggcgatgaagtccctggccgacagcgtgtgccagggccggctggtgctgctgctggagggcggctattcgctggagggcttgtcccaatccgtgcatgcctgcgtggaggtgctcgccgggcgcaaggacagcttccccacgggtgacacgcacgcggacgcgaaggacgcgctgcgggcgagccgcgaggcgatgcggccgtactggcctcgcgtctagacgttggctggatggcgcaccgcggctcgcgccgctgttcatcccctggcaaccgtgcaagaagcccggcagcacacgggaggactgcatggcggagatgagctaccggacggcgttggtgacgggtgcctccagcggcctgggacgcgggctggcgctgtggctcgccaggcggggcgtccgcgtgttcgccgccggacgccgcctgccgcagctccaggccctgcgggatgaggcccaggcggccggcgtcaccgtggagcccgtggagctggacgtcacgaaggcggacgccaccctggagcgcatccgcgcgctggacgcagaagcgggcgggctggacctggtggtggccaacgcgggcgtcggcggcacgacgaatgcgaagcgcctcccgtgggagcgcgtgcgcggcatcatcgacaccaacgtcaccggcgccgccgccacgctgagcgccgtgctgccccagatggtggagcgcaagcgcgggcacctggtgggcgtctccagcctcgcgggcttccgcgggctggccggccacgcggcctactccgcgtccaaggccttcctgtccaccttcatggagagcctgcgcgtggacctgcgcggcaccggcgtgcgcgtcacctgcatctatcccggcttcgtgaagagcgagctgaccgccaccaacaacttccccatgcccttcctcatggagacgcatgacgcggtggagctgatgggcaagggcatcgtccggggcgacgcggaggtgtccttcccctggcagctcgcggtgcccacgcgcatggcgaaggtgctgcccaatccgctcttcgacgcggccgcgcggcggctgcgctgaccttccctcttcccctttcccggagacgccctgtgacgacgccacagcccttcgcccaccgtttcagccaactggccgagcagcgctcgccgttctgccttggcatcgacccgtcgagagacctgctgacacgttggggcctgcccgacaacgcgcggggcctgcgcgacttctgcgagcgcgtggccgacgcggcggggagctccgtcgcggtggtgaagccgcagagcgccttcttcgagcgccacggccccgagggcctccaggtcctccaggagctgatgcggcgcttcaagtccgtgggcaccctcacgctgctggacgtgaagcgcggagacatcggctccacgatggaggcctacgccgagacagtcttcggcgagggcagcgcctacgaagcggacgcggccaccttcaccgcctacctgggcctgggcgcgctgctgaagacgctggagcgggcgcgcgcctccggcgccgccgccttcctggtggtgcgctcctccaacccggagggcacgtcactccagatgtcgcgcggcgaggacggccgcaccgtggcggaggccctggcggacggcctgcgcgccttcaacgagaagcccggccaggacgcggcgccagtggcgggcgccgtcatgggcgccaccctccccgactcggaccgcggcgtcatcgagcggctcggcggcgcgctgctgctcacgcccggcatcggcgcnaagag

SEQ ID NO: 890 - DNA, 7012 bp, Myxococcus xanthus
  unsure (1)..(7012): unsure at all n locations
cgacaggcgggccatcgtgcgggcctcgcgctccaatcgctgacgtgcctgggccagcgagtcctccccaagcctcgcgaggttcagcagcttcagcgccaccttgcggtccagctccgggtcataggccgcatggacgcgccccatgccaccttcgccgagcaacccgagcaccacgtaccgtcccacccgcgcaccggagacgagcagccccgtgtcgaccaacgggggaggactctccagcccccccagcgcggcgagcacgctccggcactccgagcaggcggagacatgctggcgcaccgtcgtcatgccctcggggtccaacgcgccgttcgcgaaccccgaaagcgcgttctcatccgggcagctcactcgcgcccctccagcaggcccgagaggctcaagtccaaccgtccatggatggcgcgcatcacgctgtccacttccggctcgggcaacgacaggcgttcagcgagcgcgcgccgcgtccgtttctccagcagcgactgcaccgcggtgagccggcgtgagagggtggacttgtgcaggtcgaacagggcgcccatgcgctccagggagaggcgctcgacgaagtgcagccgcagcaactcccggtcttcatcgtccagcgaggccaccgcccggacgaaggccgcgcgcacatgcccccgtgcctcctcccgcacgaagcccagctccaggccgcccggcgcggggtgttcggcgagcacctcggcctcgacgtgggacgcttctcccagcgccttgcgcatccgcagcgcgagccttgtcgcggagatgctcacccagtgcagcagcgggcccgcgcccgcgtagccgagcaaccgggacggagcctccgcgcgaggcatcaggaggttggcccggagcgcttgcaacacctcgtccgcgaacaccggcgaggggtggatgcgcgccagggggacgcgcaacttgaggagaacctcctgctccaggagcgcacgagccgctggcagtccctgcgcgcaggagagcgcgagcgcgacgtccctggcatgcagtcgctccagcgagagcaccgggtccaccgctcgcgaaagcagcgtccccaggtggtgagcgaaggccttggactcgggcgcggcggcttggagggcggcggccagggagacggcgcggtccacggcctccctggcactcggcgccgcacggaggcgagcggaggatggctcgccagcggcctgcaacacccactcgaagaactccgcgttcgccccatgcatcccaagcgctcctgacaccacgctgacgatacatcaagcccctgattcaacgagaccagggccccggagtcacggggtgctcaagccttccgcgcgctcagggcctcggccagctccgcgtagaggtggatggcgctgcggatggacttctcccagtcgcccaggtgcaggctttcattctccgaatgggcataggtgtacgggtcctccacgccgatgagcagcgcgggcacgccgcccagctccttcgcgaagggctccacgaagggaatggaggcgccgcagccaatggcgaccgccttcgtgccgtagcccttctccagcgcgcggaaggccgcctggaacgcggggtgggacgggtccgtgtaccaccaaccggacgcaccctccgtgtcgaagtggacctccaaaccccacgggcacaccttgcgcaggtgctccttcaggcgctgctccacgtcgcgcgcctccaggtccgggacgatgcggatgcccacccgcgcccaggccgaatcacagatgatgttgcgcgcgtccttgcggctgctggcctggatggcattgatggcgatgctcggctgacgccagttcatctcccacggatgcgccccgcctcccagcacctgcgcgcccggcagaaggcccgactgcgcgcggaagtgcgcctcgtctccgggcagggattcgatgctctggcgctctccgtccgtcagcggcttcacgcgctcgcggatgccttcaatggcgatggagccatccgcgtgcgtcagcgtggccagcatccggcacagcgccatgacggggtccggcaccggcccgccccacatgcccgagtgcaccgcctgccgcagcgcccgcacctccacgtccaccgtgacgagcccgcgcagcgcggtagtgatggacggcaggccggtatcgaagttggacgtgtcggtgaggacgatggcatccgccttcaggagcgccgcgtgctcctggaggaaggcgcccaggaagttgctgccaatctcctcctcgccctcgatgatgaccttcacgttgagcggcaacgctcccgcgcccttcagccacgactccaccgcggacgtgtgcacgacgatgcccgccttgtcgtccgccgagccgcggccgtacagccggccgtcgcgctccaccggctcgaacggagggctcttccacgcggcctcgtcacccgcgggctgcacgtcatggtgagcgtagagcagcagcgtgggcttgcccggcgccttgagcacctcgccatagacgtaggggtgcgtgccctcgatttcgagtagctgaacgttttcaaaaccacggtctttcaacagccgtgcagtcgcttccgcgctgcgtcgtacctgcgtcgcatcgaagccaggaaatgagacactgggaatgcggaccagggacttgaggtcctccaggtacgtctgcttcttcgactcgaagtgtgagagagcattgtcggtggacatgcccaccccttaacccaaaaaggcgggcaggcgtgccatgtccccgcgcggatgttgcgcggtccaagtatcatccggagccatgtccgacaccccgaccctgctgctcgtcgatgacgacagtttcgtgcgccgtatcctcaaggacgtcatcgccgacacgggcatcgagctgcggctgctcgaggctgcggacggtgaggaaggcctggccgtggccgcgcgggagaaacccgcggtgatgttcctggacctgttcatgccgaagaagagtggactggaggtcctgggcgccatcaaggcggtgtcgcccaccacgcgtgtgttggtcatcagcagcatggacgcggagcccgtcgtggagcaggccatggcggcgggcgccgtgggcttcgtgggcaagcccttccatccgctcgagatcgcctcggccgtgcgccaggcgttggctcactgacccccggggtgttttcgtgtcgtcttctgctgtcggttactgggtcgcggaccatctcggacgtgtgctggggcccctggcgctccaggccctccgggaactgatttcctccggacgcttgaaggccgcggtgcgcgcctcgcgggacgggacgaactgggtcgccctgccggagctgcccgagctgagcgacttgttcgccagcgcgcgccccacgccctccctggagctgcagcaagccgagcgcctgcgcgcgcagatgcgcgccatgcagagcctgccggcccacgaagtctttggcctcaagcccaccgccagcctggacgagctgcgtctggcctacttccgcatggccaggcgcttcacgccggaccacgtgtccccggacacgcatccggagctgaagaaggtgtcggcggagatcttcgacttcctgtcgcgccgcatgcgcgatgcggaggccaactggacgcaggcggcgcaggcgccccgcccgccgccgcccgtcgtgcccgccgcgccgccccggcccccgccggtggtgcacgcggcccccgcggcggtgcgcgcgcccgtcgtgcccgccgcgcccccgccgcgccccgtgcaggccgcgccggtgatggcgcgggcacccattgccccgccgcccgctccaccgccgcccgcgccgccaccgcccgccccggccatgcgccgggccgcggcggcgcccacctattccagcgcggagttcgtcggcctggagcggcgttcggatgaccgcatccacgcggacgtgaaggtgacgctgcagaacgcgggcatcttcaccgaccaccgcatcatcaacctgtcctcgggcggactgttcatcgccacggacaagccgctgcggctggggaccttggtggaactcaccttgcgcttcgatgagccgccccgggtgctgacactccgcagctccgtcatctgggagaattcgctggaggacggaaagaacccgcgcggctacgggttgcgtctgagccaccttcgcccggaggagaaggagttcgtgcagaagtacctggctcgcgcaaaggacctgaagaagaagccctgaggccaggcgctacagcatctgccccaggaagacggcgcccatcatcacgtagaccgccatcacggccatgacagccttcaactccaggtcatcgcggtccatcaggttcttgaagttcatcatcgtgccctccgagtgttgcccctcgcccttccatacggggtgcggaaaaacccattgcgtccaccgacgccggctccgctgaagttcccttgcggacggtgcggtggactcagaggatgaccgtcgtgtccaccgcctccgccgaataccggctgcttgaagcgatgccgctccccaccgccctcatccgcggcgaacaggtgctacgggtcaacgcggcgctcgccaccctgctgggcgttccagcgtcggagctggaagccctgtcgctctccgaaagcatccgccgcttcgtccccgcggaacgcggctgggtggagccgctgtatgaatccctcgtccgcggtgggccgctgcccgaaggtcccgtgtgggtgcgcgtgcagccggtgaacggcccccagcgcacgctggccctgaggcatgcgcccggagcgcacccggacgaattggtggtggtgctgctggaggcggaagcggaggactccgtgcggcgcctcacggaggcgttggtggcggccgccgcgacgatgctgcgctgccgcgacgagcggtcggtgctggagacggccgtggacgccatctaccgccagggcttctccgtgtccgtcgtctacgtggacggcgacgccttccggtacgggcccctgcgacagagccccttcatcgtggccgaggccgagcagctctacggcatgcccctggcggacgtgcgcattccgaacgccgcgctgccgcacttcctggaggtgctcgagcggcgcaaggcggccttccaccacgacatgctcggcgtggcgcgcttcccgccttcggccaacggggagagccccgtgtgccagttgcatccaccggacatgcgcgggctggacgcgcccatcctcgtggacgggcacccgttcggcgtgctctccgtgcagggccccgccctcacccccgcgggcgccagcaccctggagctgttcgcgcagttggtgggcggcgcgctggagaacgtgcgccaccaccagatgtccgcggtgcggctggaggaggtgtcccggctccaggacgagctggtggcgcgcgagcggctggaggtgctgggcgaggccgcgggcgtcgtggcccacgaggtgcgcaatcccctgggcgccatcctcaacgcggtggcggtgctgcgccgcgaggcccacctggggcccacgggacaagccgcggtgggcatgctggaggaggaggccatccggctggaggacatcgtccgggacctgctggacgtggtgcgcccgctggagccgcgcccccgccccgtgcagttgggcgagctggtgcgccgggcgctggggcagatgcatggcccgccggacgcccccacgctgcgcttcagcgtggacgaggccgcggagacgcctccactcgaaggggacgagacgctgctccaactggcggtgacgcacctggtgcgcaacgccgtgcaggcctcacccgcgggcggcaaggtacggatgacggtggagcccgcggacggaggcgtgcgcctggtggtggaggacgaagggcccggcattcccgacgtggacccgcagcgcgtcttccagcccttcttcctcacccgcgccaacggacgggggctggggctggccattgtccggcgcgtggtgctggcgcatgagggcagcgtgcgcgccagcagccggactcgcggcggtgctcgcttcgagctgtggctgccgcgagcgcctagccgtatgtctcccgtttgatgcgcttgtcctcgatgcccagcgcgtggaggtggcccagcaccgtctccatgaagcgcggcgtggagggcgtgcgcgtctccagcgccttgcgccggtcccacggcgtaatcgccgggccgcaggcgtacaccaggcacgtatcccggtcctgaatcagctcctccagcagggactggtggacgcggcccttccgcacggcggcgccgaagcgcgactcatccgtctcacgggtgagcgtgtgcaccacgcgcacgcggtccgggtgctggcgctccagggcggccagctcttcgccgtacagcacgtccccccacgtcttgttggagaagaggaaggtgtggcgcagcttcaacccccggtggagtgcgtccttgaggatggcgaagttgggcaccgcgccggagccggccaccaaatggacgacgtgctccgtgcgctcctccacgtcctccggcagcacgtagggccccatgaaggccatcaccttcatccgcgcgccggtgagccggccatgcacgaggtagggcgacaagagcggcggatagcgggtgaggccggggacgaactcctcgtccttcacggtgatggccaccagcggctcgtgtggcgcggaggcgagcgagtaggaacgctgcggctccttccgccccttctgctcctggaggtaggccgacaggcggcccaaggcggggaactggtgcgggtcgatgttgaggaactgcccggccttgtaatccaccgggactccgccgaaatccaggaacagcgtcgccgtgtcgtgcgtgtccatccgcacgtggtcgacggtgacctcgtattccacgggcttnctggcgcgcgacgcgcgggct

SEQ ID NO: 891 - DNA, 6380 bp, Myxococcus xanthus
tgcatcaccagcgccatcatcgccaggatgccgccttcgccccggttgtccgccttcatcaccagcagcaggtacttcaccgacacgacgatgatgagcgaccagaagatgagcgacagcacccccagcacgttcgcgggcgtcggcggaatcccatgcgcccccgtgaagcactcccgcaacgcgtacagcgggctcgtgccgatatcgccgtagacgatgcccaaggccccgagggccagcagcgccgagcgcttgaaggtgtccgggccctttttgacgtcttcgccgcccggcactccggtggtggtcgctttcacgaagccgcgctttagctgaacccgggcctggagcaaccgccaccgtatcgcgcacagagtattcccttgtgcgcctgacgcctccccgcctcggcgtcacagggccctagggcggggagtgcgtccggaacgaacactcccaggccagggatgttcgacattcgcgacggcatggccgccctgcccggagggacgctcctcgccccgttacagccatgctcccatgcaacacgatgggtggggggactcgatgacgatgttggcggcacttggtcaggcagaagcccggcggtccggagcacgaggtccagcgatgctggaagccatcctccaggtctcccccctggccatccacctgatggacgtggatggcacggtgcggctgtggaaccccgccgccgagcggctcttcggctggagccgggaggacgtgcttggccaccgcgccccctgggccaccgacgcccgctgggagaagttccgccgccatcaggagcaggccacgcagggcatggagccgccctgtctggagctggagctccaccggcgagatggcacgcccctccatgtggagctgtgggcggcgcccatgccaccggccaccaccggtcccgcccagtgcctgggcatgctggtggacgtcaccgagcggcgccggggcgaggcccaccgacggctcctgtcagaggccagtgaagtcctcggctccagcctggagcaggacgcgacgctggagcacctggtgcggctcgccgtgcctgcctgcgcggattcctgccgcgtgttcctcgaagatgccccgggcgaggtgcgatgcgtggcgtccgcgggcctggatgcacgggagcccctgaatgcgggtacgcctctcgtcccggacgaagcggcggtgtcgcgaatcatcgcgtccggagagccggcgctgcacgacgcggagccgccgtcctggctgggcgtgccgctggcgtggccggggcggaagggcgccgcgcttgtcttctcgcgcaccggacggaccttcgacgcgcgggacgtggcactggcgcgggagttggcgcgccgggcgtcactcgccctggaccacgtgcgccagtaccacgaggcgtgccaggccatccgcgcgcgcgaggagctcttggccatcgccagccatgagctgaagtcccccctcagcgcgctccagctccaggtgcagaacctgcgcaccgcgctggagcgctcaccggacgccgtcccccgggagcggctgcaccgggggctggacctgatgggccggcaggcgaagcgtcaggcgaagctcatcgacgcgctgctggacgtgtcgcgcatccacgccggacggctggagctgaacccggagccggtggacctgggcgccctggtccgcgaagtggcggagcgcctcgagccggagctggcgggcgcgggcacgcgcctgacgttgacactgccgttggaggcccacggctactgggaccggctgcgactggaccaggtgctcaccaacctggtgtccaacgccatgaagtacgggcggggcaaccccgtccaggtgacgctgtccagcacccaggcccacgtgcgcctggacgtgcgcgacgcgggcatcggcatcgcgccggagcacctgcaccgcctcttccaccgcttcgagcgcgccgtgtccggccgggactacagcggcgtcggcctggggctgtggattgtccgcgaggtggtggaggccatgggcggccacgtcaccgtgagcagcgagctgggcgtgggctccaccttcaccgtcgtgctgccgcgggcgcgcgggtgaggacgccggggctcacccgcgcgggcgcgcccctcacagcgcgaggaacaggatggcggccttctcctcggggctcgccgcgaggaactcgtccggcagccagatttccgagtcgggcgtcatggcccggtcgcagctgcgccggcccgtgtagaagcggttcgtgttcgccgccttcagccggtaggtgcagtcgcggacgtagatggtgagctcgctggggctcagcttcaggttgacggggcgtccgccaaatccgcccttggccacgatggcgtccccctccttcgtcaccgtcaggttcaccggcgcgccgccgacggcgccctccaccgccccgtccttcagcgtcagggcgaagttgcccttcagcccgcggcccttcagcatcccgggcgagcgagccacctggaagtccgcccccgacaccgcctctggcgtcatctccaggttgaacgactggtaggcaatcttcatgttgatggcgtcctgctttcgttcggccatcgccacgctcgcccccagcaccacccccaacaccagcacgctccggcggagcggcatcagcatgcgcttcatgtggagacctcctcgtacggtttcatccccggctgagtaacgacagtgtggacaccggataccggcccgtcatgcaccttggggtaacccccgggaattgctttcggtgcggtgggcatcccgccagggaggggccgccaggagtccaccgtccacgccgtgggcgcgcgccgtgaacggcgttgacacccagccccatcccgcgcgcgcaaccccgcggaaacaggcccgtcctccggtggcaggccccttgcgatggcgcccttccaaaaggagcgggccatggcggagacgggcaacacgcggtggggaacggcgaggctggacggaggcaaggtgctgcgctggagcctcctgcacgtgggagcgctggtcgggggcacctgtttcttctcgtggagcgcggtggcggtgttcgccgggatgaccgcggtgacgatgtgcctgggcgtgtcggtgggcctgcatcggggactcatccaccgggcctttcgtgcctcggcgcccgtggagcgcgcgttggcgctgctcggcaccctggccggcctgggcggccccatcgcgatgagccgcatgcatgacctgcgcgacttccaccagaaccagccggaagcggactgtcccccctacttcggctaccgcgagggcttcacgcgcgccatggcctacgccctcttccacacctggcacccgcgaagcggcgccgcggacgtgccagcggcgccccatgtcacgcaggacgtgttcttccgcgggctggagcgcgcgggcctgtggctccaggtgccgctcgccctggcgttgtacgcactgggcggggcgccctgggtggcctggggcatcctggtgcggctggcgctcacccaggacggcttctggtgcgtccattacgtgagccacgtggagggcgagcagccctacgaactgccgggctgcgccgaacagggacgcaacgccggctggctggcgctgctgagcatgggcgagtcgtggcacaacacccaccacgtctacccagcctcggcgcagatggggctcgggtggcggcagccggacccaggctggtgggccgtgcgcggactggccgcgctgcggctggtgcatgatgtgaagtcgctggcccacctgccgccgcgtccgggcgcacgcacgcgccgcccggagcctcatcgaacccggcgcctctgcgtgctcgccctacgccgggcctgacgctccgatgtgggcgtgcttcactcctcgacgttgcgcaggaagtccgccacgtgggcgaagcgcgcatcgaggaagcggcgcaggcccccggagatgccccgcgcatccatggcccgttgcatggagcgcacccacgcatcacgcatggcgacgccgatggacaggtggccatgacgcatgcgcagtcgggggtggccgtgacgctccgtgtagtcctgcggcccgcccaaccatcccgcgaggaacaagccgaaccgctcgcgtgtgccgcggttcacccggccctcggcgtccagttcgtgcaggcgcgccagctccggctcgtgggcgtccatggcgtcgtagaaagcctcggccagggccatggccgcgtcggtgccgcccagccggtggtacggcaggtcatccgggctcggcacccagtcgtcttcagtcggcatcttcagttgtacggacatgctttctttctaccgctggagacgcccgggttcatggagactcgtcattcccctcgaaacgcccggctgatctccggcggacagagcggcaggcggtccaggggccgctcgccctggcagatttgacctgggagagaggcggttgctagagccacggccacccgtgcccatccccccccgcgtcgcaccctcccctcccggagtctgggtgctcgacgacagtccggtagagagccaggccatctgccgcgcgctggagccctactgcaaggtcaccgggttcttggacggagcctcgctgctggaatccctgacgcaggggcccgtgcccgaggtgctcgtgctggactggcacctgcccggcatgtcgggcctggaggtctgccgcttcgtccggagcaatcccgcaaccgagcacatccccgtcctgctcatcaccgggaacacgcgcgcggaggacgtggtggagggcctgtccgcgggggccaacgactatgtcttcaagcccttccgcccggtggagttcgccgcgcgcgtccaggccctggcgcagtgggagcgcagccggcgcaagacgttggaggatgaacgggcgcgacgccggcggctggaaggcacgctgacggaggtccaggccgccgaggagcgcgcctggcgcagcgagctgcgcttccggctggcggcgcgcgccacgcgggacgcggtgtgggagtgggacccgcgcacgggcctcatggattggacgagcggactgcacgaagtcttcggctacgcccccggcaccatccgggacgagcatcgctggtgggaggaacggctgcacccggacgaccgcgcgcgcgtcgtcgccagcctccaggccaccgtggagggccccgagcacgagtggcaggacacctaccgtttccagcgcggagacggctcctgggcctacgtggcggaccgctgccacatcatccgcgacgcgcaggacaacgcgacgcaggtggtgggcgccatgcaggacgtcaccgagcgccacgaggccgaggccgcccgggcccggctgctggagctggagcgcggcgcccgggaggagtcggaccggcagcgcgccatgctggccacgctcttcgaacaggtgcccgcgctgctcggcgtgctgagcgtgccggaccagcgctgcgtggtggccaacgcgcgtctgaggcagcgcttcggccagcggcagttggtgggccgcacgctccgcgaggccctgccggagctggagggccagaacgtcctcgagctgctggataccgtcttcgccactggcgagcccttcagcgcgcgggagctgcccgtgcgcatcgcccaggtgcccggcgcccttccgccggaaggctacttcgacttcatgtaccagccgatgcgggacgccagcggacggctggccgccgtcatcctgttcgcggtggaagtcacggactccgtcctggcgcggcacaaggagtcggagctggcgcagcagatgaaggcccgcgcggacttcgagcggcagctcatcggcatcgtcagccacgacctgcgcaacccactgggggccatcagcctggcggtgtccatgatgctccagcgcggactgctggatgagcggcaggcgcgtcaggcgcagcgcatccggagctcggcggaccgcgcgacgcggatgattcgcgacctgctcgacttcacccgcgcgcgtcagggaacggggcttccggtgtacccgcagcccatggacctgcacgaagtcgttcgcacggtgctggacgaggtgcacgccggctggcccgaccgtcacctggagacggaacgcaccggagatggcgtgggcacgtgggacccggaccggcttgcgcagctcattggcaacctggtgggcaacgccttgcagtacagcccgcccggcacgcccgtgcgggtgacgtcccgaggcgatgacgacggcgtcgtgctggaggtccacaacctgggcccggcgattccccttagagcact

SEQ ID NO: 892 - DNA, 7513 bp, Myxococcus xanthus
ccactgatgaccagcaccagcgtcgcggcgacgttttcgttctccgtttcgatgccgaagctggcggaggccatggcggcgccggccaggcactgcgccagcgcgagctgctccacgaagacgccgcgcagcgtgcggcgcagcatcgtcgcgcccgcgcacaggcccaggcccaccacgcccatcacgacctgctcctcccagaggcccgcgcaggcgaagaagctcagcacgaagatggcggacagccaggcgccgacgccagcgaaggccttcacgaaccagggcacggccacggactggcgctgatgggcttccagggccacgcgggcccggtccacagagtcgggctcgagctggccttcggcctggagcgcgttcaacacgtcctgcaacgagggacgcagggccatgtcaggactcctccgtggcgccggtgacgcgggcttcgtgccgcagccaccacaccgcgagcgccacctgggcgatgacgaagagcggcagcacgaagaggcccaggacttccacgtcctggtaggagtcgaagacgatgctgacggcgccggaggtcaggagcgtcatcacactcaccgcgccgagcgtgagcatgaacagctcgcccttcaggtgccggtgcagggcgtactcggccgcgagcgaggccagcaccaggaggagcgccaccacggcgccggtgggggctcgcgccgggtgcatgatgaatggcaccgaggcgatgagcaccggggccaccgccatcaccgccagcacccggggcacccagcgcgcctggagccaggacacgcgcaggttggcgaagtgctcgtaggtggcccaggtgaagccgttgagcccgcccaggaccaccgccagccagtaggtctggtccagctccgtatccagcacctgctcccagaagaggaggatgccggtgttgaccagcaccagcgtcagcaaccccagaggcgcgaagcgcgacaccgccacccagggaaggatgagcacggcccagccgatgaacagctcatacgggtccgcgcccgtctgatacgcctgcccgtagacggccagcagcgcgcccacgagcaccgaggccgcgaacagcgacagttgcccgcccagcgtcgcgccttgcttccaggcgcccacggccgtgcccgtgatggccgccgcgatgaggcccagcttcgcgaagcggtgcatgtccgcccagttgtacgcgaagaagtagatgacccccgcgagcaccagcagcgcgcccaggcccatcagcgtggtggagaggaagcgccgccagtcctgccgcggcggggtggccacggacaggtgcagcgcgcgttccagggtggtcggcatcaggatgccagcgtccgcgagtgcccggagtcgctccggcgtcgcgtcaaggtcgagcaagggtttcaacacgggcgcagtctagctgtccggccggggagcgcgtccatcggcatgcctgccgcccctggccggagagcggccccaggggcatggtaggttgccggccctcgtgcgcggctcgcacatgtgccaaggggccctgtccatggcggcgaacctggagtgcccgaagtgcggcagcgagctcgacgtgacggggcggggcccgggcgccatcattcgctgtgcctgcgggaacctgtcagccgtcccgaagcgctcctattgggcgagcccgcgcggcgtggcgctggccctgggggtgttcttgctctgcccctgtgtgggcatcctggccgccatcgccatccccaactacaacaagcttccggtgcgctccaagcagcaggagtgcaaggcgaacctccgtggcctctacgccgcccaacgcaaccacaacgccgagcacggcaccttcgagccgcgcatcgtgaatgcgggcttcatcccggagcgaggcaaccgctacgcgtacttcacgggcacggggccgctggtgacgcgcgacgcggaaggggatgcggttccggcggacgccggtggtattggcgtggaccgctctcgggacgcgagccgccgagccattaccctggcggaccttcctgcttgggtgtcccggcaggtgggcgtctttggcacgtgcccggactgctacgtcaccatgggctgcgcggggaacatcgacatcgatgacacagtggacgtctggctcatctccacgaagccgctcaaggatgagtacggcgaggccgttcctcctggcaccccgacgaatgtcgtgaacgacgtcgacggttgacgggcccggtccgccgggagccgtcgcttcgcccggcgaaatcgccatgggcggacgacccggaaatcccgcgcttttcgtatctgactttgagagcgaccgacggatggacgggcctgaatcccgttccacctcgcccgccaatccacagaaaggtttcaaccgtgcgctcaatgatgaagcgtctctccctgggtgtatgcatttccacgtcgatggcgttgctggggtgcggcggcgagatgatggacgccgacgccatggcggacatggcgctgcccgaggaggccgtgggcaccaccgcgtccgcggtggagacggccagtgacttccgctttcgcaccgccaaccgctacgcgggcattcacggctacgcggcgggctacggcaactttcatgaagccaactacggcgcgggcgtggtgcgtggcaccatcctgctcaagccgggcaccgtggcgcactacctcgcagtgccccgctcctcgctgggcaacactgcgctgagcaacatcccggagttgttccgccgcgcgcaggactacggcaacgcgcacgggttgggcatcgcgctgccctcgttcgagcagggcctcaacggctccgtcgtggagtacggcgtccacttcctccaccccagcgtcgtcgagttccgcgacgtcccgggctgggccattggctacccggacgtgacggacgccggggccatgatgcgcgccgccagcgactacgcctcctcgaacggcttcgccgggggcctgcccaccttccactccgccatctacagcggcacgagggtgtatggcatgcacctcatccgtccgggctacgccgattcgcgggacgtgctcgcggacgtgctggcgatgcaggaccgcttcagttccgacaccgccaccgtcacgggcgacaactgggcccggacgctgcggcgccacgaggcagcgcaggactccatccagacctgcacccacctgaccaccctggagaagtccgcgctgcgcagtgcctaccgcaaggccatccgccacacgggcacgaacgaggccggcatcaacgcgcgggcggaattggggggagacgatgtctggatcaacttcggcgtgctcttccctcagggggacacggagattgcccagacgctcatccacgagatgatgcacatcgccggctactcgcacccggaccgccgcaacggcatcgacaccccgtatgacggtggcccgtactacaactccgcgccgctgcgcgccgagctgtgcatcgcgggcttccagagcatccactcgacgcgtgagtccagccgcgagccgcagacgcgctgagcggagacaggctcggccgtgggagggccgaattcgggcgtgaacaggggctccgcgcagtccaggcggagccatcctcccaggcgagcatccgcaggtcagcgaaggcatcccgcgcggtgaggggaccgcgcctgcgctgttcgcatcggatggggagcaagggacactccctgctattgatgaggcggttgcgagggatggctcattggcgagatgggggggggatagggtgtcgcgctgtccgttcattggggggcggacattcactgggggattcttcgtcagtggtacatcgcccagatggttcactacgccgagcacgacgcctatgagcctgtcttcgcgaagttgaaccatgaaattccgcggggcaatcacttcgccttcctggcgggtgtcgagccggcggatgcgcgtgacacggctggggccgccgcggtggaggacgccgtcgccgtgggcgtggacgtggcgacgaacccggccttgaaggccatccagttcggcgaactgccggtgctcgtggccaagcaggtcggcctttcgggggagtgccctgactgtgccatcacggccgcctgtgtcgccaatctcgaccgggatggcgacctggacgtgtggctcatctcctcgaaggaactcaccgggctggatggacagcctgtgaatcctggtgagcccctccacttcatgaacgacctgaaggactgacgcgcacgctttcgtgagcggtcatgcgcggacgggcggtcgcatgcgtcgtctccctcaatcccgtgaatcgtcgtcgtccacgagcatcatcccgtgcttcgtgagcagcttgcgcaggtacacccgggcgatacctgcctcgcgggccgcgcgggagatgttccggtcgcagcgtgcgatgaggccctggaggtagtcccgctcgaagacctcgatgagccgctccttggcctccttgaagggcagctccgcgtcgagcgtgccttggggcgaccggaccgaaccggagggggcgtccatgggcggcagagtgtcctcgcccagatggatggcctgctccaccacgttgcgcagctcgcgcacgttgccgggccagggatactgggccagcagggcgcgcgtctgttccgacagggcgctgggtggacggcccagccgctccagcatggcgtcgatgagcaggggcaggtcctccacccgctcccgcagtgggggcgggacgaccttgagcaccgcgagccggtgatagaggtacttgcggaaccggccctgttgcacggcctgctccaggtcgacgtgtgtggctgcgacgacgcgcatgtccaccgtgcggtagtcgttggcgcccacgcgcttcagctgccggcgctcaagcgcgcgcaggagccggggttgcagctccaggggcagctcgcccacctcgtccaggaagacggtgccgccctgggcacgctcgaaggccccggcgcgctccgtttgcgcgcccgtgaaggcacccttcacgtgcccgaagagctcggactccatcaaggagggcggaatcccggcgatgtccacgatgatgaagggcccaccggcccgcgggctttcctggtgaatcgcctccgcgcacagctccttgcccgtccccgtctcgccctggacgagcacgtccccaccgcccgcggccacccgctccaggacggtgaacagctcgcgcatcctcacgctggcgcccacgagcgcgccgaagttacgccgcgaggacaggggcatcggccgctcccgtgagtcctcgggcaccaccttgaggacgacggtgcccagcgtcagcgacgccccgggccgcacctccaactcggtgaagcgcaccccttcatggaaggagccgttgcgcgagcccaggtcggtggccaccacccgttcgtccgtcacctccaactggaggtgctgccgggacacgacgcggtccgtcaatacgatgtcgcacgtcgaggacgtgccgagccggaccacccccgggcgcaggacgtggctgtgtcccgcctgttccccggagagcatcagcagcttcaaccgcaaggggccgcgtcgcgccaccgggacgggcgccgtctggaccagcgcgtccacctccgtgtccatgtcgcctgggtccgccacggcgggcaggctacaccccacccaggcgggggagggggtgacaactgttgttgccacctgacaaccgcggttaccaggcccgtcggagcgcctctccgggcgtcctcctctggagcgcgcgcctcgcctcggctccggaggtgctggagcgccctggcacacccactgcaatggcctggatccacttcgagaacgacaccaccgagccgcccacccgcgatgtcttgccttgaatggcaaggcactctgcgggtgggcttgtttgtctttgatttgtactcgctcccctcggaagcgcgcgaaaagtaaatgaaaacaccgcacgaaacaccgcgcgtatccgacagagaatgttcatgtagtcagcgcgcggggcttttggctgaaacagccacttgcccccaatccaaaccatcgtagcaatcgctatcaggagtcacgaccatgagcctgtccatcgcgaagtccattctgtgcaacggcttctccggcaacacccgtggctgcggccccacggaccgctaccaggcggcttatcagtcgatggacccgtccaaggcggcgcagacggtgctcaagcacttcgacgccatcgagggcgtgggcatgaacgccagcggcaagggtgcgggggacaacaacatcgggacgtcggagctcaagcgcgtggcggacccgaacagcggcttcccgcccgatgtccgcgccgccgcgaagtggatgctcgaccaccccatcgccctgcgctcgctggaccagggcgccagcaaggcccatggcggcaacaatgaggtgcacctgagcaaggcggacctccaggcgcgcgcgggcaatgcgtcggactccggggctccgcaccggcctggcttcccgcagcgtccgccgctgttcggctccgggttcggagggggcttcggcggcggctgcggcggcggactcggtggcccgggcggcctgcccaacccccaccgtcccaacttgccgccgcggctggacctgtgcggcccgcagtcccgcccgccgttcggcgctggccgccacgagcccatggacgtctacaaggcggctcagacgctcaaggaccacttccacttcgccgagggcgtgggcatgaacgccagcggcaagggcgccggggacaacaacatcggcatgtcggagctcaagcgcgtggcggacccgcgcagcggcgcgccgaaggagctccgtgaggcggcgcagttcttgatcaaccatcccacggcgttgcgctcggtggaccagggcgcgagcaagtccaagtccagcaaggaggtccacatcagcctccaggatttggagtccttcacggcgaaggcgccccgccgcgagacgcagtccaaccgtctggacctggcgcagttcatgggtcgggcgagcgtctggggctgagcccgcccgctgtcccggcggcccacccgtcatgggctgccgcgctgtgctggaggtgactgggagtcgggccctggggggagcctggctggccacatcctgacactggcgcctccgggggggagggcccagtgtcagggcatggcaaccatcgacatcaccaaagccaacttcaaggaaatcgtctcgaaggagggaatcgtcctcctcgactggtgggccgagtggtgcgcaccgtgccgcaccttctcgcctgtgttcgaacaggcgagcacgaagaatccggacctcgtcttcggcaagctcgacaccgacgcagaggtggaactcgcgggggctttcgccatccgctccatccccacgctgatggtcttccgtgacg

SEQ ID NO: 893 - DNA, 7529 bp, Myxococcus xanthus
cgcggcgccgccgaggtctccggcgagtgcgaaaacgccagtgtggagtcacagggctcgggcgccttggtccgcgtctgcgtgcccctccgcaacgacaccggggcgcctgtcgaagtggagttccccccggggctcgtcgtcgtgtccacctccgagggacgcggccagaacgggctgctcatcgagcgcaccatcctcgtcgttccacccactcgcccggggcccggcgggcgggacgatgccggtaccccggacggcggggtggaggagaacgtctacatcgttcctctctacatgtactgcctgaacgaggagcgggacccctccaacgaattcatgacctacgcggtcggccccatcacgtcggatgacgcgctgcaggaactgctgcggctcctcgaggggaaggtcatcgacagctccgaggacgtgggcgtggtgcagaacgccctctatagcatcaccgagggccgcggcctgacgacgccggaccgcgacgccatcaacgacctctgacgcggtacgacgtcaggtctcggattgcgcgcgatacagagctgtcgcgagaggtggttttgacacccggtgtatcgcacggctaacatcgcgcgccatccgcagattgcactgcactgtattcaaacacctgctctggactccacttcggactccatcatcgccgccgaacggctcccccccgttctggaggtttctgaaccatgctgaagggcaagactccgctcgtcgtcgcgcttgtgctgggcctgctggccggcgtcatcgcgtattccgccatcaagaagaaggaggcggatgtccgccgcggatggaacctggtgcccgtcgtcgtggcggcgcaggacgtccctgaaggcacggtcatcaccttcgagatgatctcccagcgctccgtgccggagcagttcgtgacgtcctccgtggtgcgtccggactccgcgtcctacatcgtgaaccagaaggtgctggtcgcgctgcaggcgggtgatccgctgctgtggagccagttcgagacgaccaaggccgccgagcggctgtcgtcgaaggtgcagaagaaggcgcgcgccctcaccatcgaggcgaagcacaccacgtcggtgggcggctggattcgccccaatgaccacgtggacgtgattggcaccttccgcgacccgcagacggacgagaacgtcgccgtgacgctgcttcagaacgtcatcgtggtggccacgggcaagatcaccggtaccaccaacgtgaacctcatcccggagaaccagcgcgagtacaacaacatctcgctgatggtgctgccggaagaggccgaaatcctggtgctcgcggtcgagctcggccagctgacgctcagcctccgcaacgaggacgacgtggacctcatcgaggagcgtggccgcgcgaccatcagcacgctgctgtcgggtgagcgcacccgcgtgctggagcagaagcgccgcgaaatcatccagatcatcaagggcggtgccgagcgggccgcgggcgctggcgcgccgtgatggcgtgcgtcgtccaccctcgctcttagggaagcgcgcacatgcttgctggaatcgtcctcctcctcgtcaccggctcggtcttcttcttcagcctggtgatcttcagcgtcctgtcgaaggcgtatgagcagtaccaggagcgctacgtcgccaagtcgatgaacgacttgagcgacatgttcctcttcatcgatccacgccagatgttgatcctcaacatcgcgtgcatgtgcttgttggggatcctgacgtacatcatcttcaaccccatcatggcggtggtggccacggtgttcggcttcttcctgccgatgctgatggtcaagcactaccggaagcggcgcatcaagaagttcaacgtgcagttggtggacgcgctgcaggccatggccaacgccttcaaggccggtctcacgttcccccaggccatcgagcacgtggcgcgcgaggcgatgccgccgctgtcgcaggagttcgggctcttcgtgaaggaagtgaagctgggtgttccgctggaggaggcgctcatcaacatgggccgccgcgtgggcagtgacgacctggagctggtcgtcgtgtccacgaacatcgcccgtcagctcggcggcaacatggccgagatgttcgagacgatctccacggtgatccgcgagcgcttccgtctggaaggcaagatcgacgcgctcacctcgcagggcaagctgcaggggtggatcgtcgcggcgatgcccggtgtgctcggcatggtgctcaactacatgcggcccgacctgatggagccgatgatggaccacatcttcggttggatcctcgtgatcatcatcgccatcatggaagtgatgggcatcctcatcatccggcgcatcgtcaacatcgatatctgagaggtgcaccgtggacgatgtcctgacgccaatcttgatcggcagctcggcgctcctcttcgcgggcgccgtgggcttcctgggcctggggctgtaccagacgatgctggagcgcttcctgtcggaggtccgtgacgagtccacgggcggcatgaagggcttcggctcggtggccatccgccgcctgggcgcgatgaaccgccgcttcatgtggcccggctacgaggccaaggcgcgccgcaacctcatcaaggcgggcgagccgcaggcgtacaagcccgaggacatcatggcgctgcaggaagtcagcgcggtggtgggcctcatcatgggcctcatcctgctcaacggcttcggcgtgagcctggtgtgggcgccgctgttcctgctcttcggcatgtactacccgctgatgtggctgaacgaccaggtgaagaagcgccacctgctcatcagccgcgcgctgccttacagcctggacctgctgacgctgtcggtggaagccggcctggacttcaccgcggcactggccaaggtggtggagaagggcaagccggggccgctgcgcgaggagctgcagttggtgctcaagcagctgaagatgggcaagacgcgtgaggaaggcctcaagagcatgattgtccgcgtggacctgccgcccctgaccaccttcgtcaccgcgctcatccaggcggacaagatggggaccagcttgggcaaggtgctgcgcatccagtccacgcagatgcgcatcgaccgcacccagcgcgcggagaagctggccggcgaggcgccggtgaagatgctctttccgctcatcgcgtgcatcttccccacggtgttcatggtgctgttcgggcccatcgtgttccaattcatgttcggaaacgtcgcggggtagcgccccgtgcccatcctcctgaccatcacgcaggggctccagcagggacgggagctcaccttcgaggcggccgaggtcaacatcggccgcacctcggagaacgacctggtgctgcacgaccacggcgtgtcgcgcaggcacgcgcgcatcgtgctccgcggcgacaagtacttcgtcgcggacatgggcagctcgaatggcaccgtgctcaacggggggctgttgtcgggtgagcagcagcttcgggatggggacaagattggcgtgggccccgtcgagttcaccttcgtctgggtgccgccggagggggacgaggacgccacgcggcccatccgccggggcgacccggtcccagcgctggacccggacgccacccgtcccatccgcctcaacgaccccattcccgccgagagcggcatcgtgctgccggagggccatcccaccgcgcagcagcccgcggtggtgccggtgcgtccgggcaccgccgccgtggcgaaggccgaacctggcgcggggcagacggcggcggagcgcgcgcgccgtcgccgggagctcgcgggcagtcaggcgggcaggttgctcctgtggtgggggcagctatcgacgccggcgcgtctgggcgtgggcgcggtcggaggcggcctggtgctggcgctggtgggcgtgctggccgtcttcttcatgcccaagggcgaaggccgggcgtccggcgtggagccggaggacctgggcttcgaggtgatttcagactcgttcggagtgggcgagggcgtgacgtgggagaacccggagcacaagtcgttcgccttccagttcgtcacgccgacgcgggcggtggccgtggtccactacatggccagtggcatctccaaggaggaggtggcgctggtcgtcaacggcgtggacgtgggctgggtgccgccggacgtgaacgcggtgacggagcgcgggctggagcagattctcccgccctccgcgctgaagcggggtgagctcaactccatcgtcttcgacaacgtccgcaacccgccggggcaggacacctggcgtgtgtggaacctgcgcctggaaatcatcccggtgccggagttgccgcaagacgagctcctcgcgaaggcgcgtcagtacgtggtcgcgggcgcccggttctatgagtcgcgcgacgtcggcgcggagaacctcttcaaggcgtggcagcagtaccgcttcgcttgggtgacgctggaggcgctggacaccaagcctgacatctatcaggacgtgcgtttccaactcggcgaggtagcaaccgagctggaccacaagtgcagccagctgatgctcgatttccaacgcagcgtacagtaccggaatgcgcggacggctcgggccgcgttgcaggaaatgggtcgacgcttccctacggccgagcatcgctgccacaatctaggtttgcagttggcttacgagcacgagctgtaggcgcgtgctcacttcgacaggaagtcggtgattcgcatgtccaacggttcccctccggcacgccgccggcccccttctggggcgccctcgggtgggaccgggtcccgtcccgccgtgcgcaggacgtccgcccggcccgcgcctgcccccgtcgccgccgcccggctcatttgcatcgctggccccaaggacggtgaggagtttgccctgtccgaggaggagtacgtcatcggtcgagcgaccgataacgccatctgcatcccggacacctccgtgtcccgcaagcacgtcatggtgcggaagtcgggagcgggctgggcggtgagcgacctgggctccggcaacggaacgctcatcaacggcgacgtcgtcaacgaggagacgccgctggccaacggtgacgtcatcacgttgggcgacacggagctgcgcttcgaggacgtggccaactccacgatgatggtcggcgcgccggcccccgggccgcgtcctcggccgggggcctctggtagccgcggcgcggtgccgccccgtccggggcctcgcgtcgaagggggtcgcgtgcgcagtgcgcgcgcgacggcggccacggcgcctacccccgaggagctgaagaagaagaagctcatcacgctgggggtggcgggcgcggtggtggtgctgttcgcgggcttaggcgtggtgcggatgaacgtccagaagcagcaggcggtcgccgcggaagaagcccgtcagggcaagagccaccgggagcggctgggcagcctgttccaggacgccaagaacctggttcgcgagggcaagtgggtcgaagcgaaagcgaaacctggagggagctccagaccgaggcccccgggctacccgggtgtggcggactacctcgggcacgccgcgcgcgagattcccgtccaggagaagctgacggcggccaaggaggccctggcgaagaaggagctgggcaaggccggtacgctgctggccagcgcgggagagagccagtttctctacgagcaggtgaactcgacgaagcgcgcgctgtcggaggccgcggacacgcgcacgcgcgaggcgcgcaagctgctggatgagaatcagctcgacatggccaaggccatcaccgaagacatcctggtggccttcccggagcatcgcgacgccaagctcatcaacgagcaggcggcgcaggccatcatcgtccgggacacgcccaggcccgtggtccaggggccggcccccaagccgtgggagcccgcggttgaccgcttccgcgacggagacatgtccggagcggtggccatcctcaacgcgtgcatggcgcgcacgccgcagtgcaagaaggtgctcgggcaggtgacggagttcggcaacctctacaagcggctggaggacctggacgcccggggcctgtcgaagctgatgtcgctggacaaggacatcaccggcggccgccctagcaagatggcgcgcaacgcggggacgcgggcggccaccatcttctacaagggcgccaccgcggcgaaggcggcggggcagtggagccgcgccatggactactcgcgcaaggcgctgcaggcggaccccgggcacgcgggcgccaccaacatcatcagtgagctgaaggcgaaggcgaaggacgtctacctccaggcctactccttgaaggacgggagccccgaggaggccctgcccaagttcaaggacgtggtggccatgacgccgccggatgacgagtaccacgagaaggcgaagacctgggtcgagaagctgtcccgatgacccggcgcaaggtgggaggcggcacgctgccgccagtgggcctgcagggtgacctgtttggcagtggcgcctccacgcctcgtgcaactggcgcggcgcggaaggccgcggcgccgccgaagcctcctccgcctccggtggacgaggacggcacctcgctgctgggtccgatggagggcgcgccgcctccgccgcccaagcccgagcgcgtggtgctgtcggtgggggagctgacccgccagctcaagcagacgctggagtcgcgcttcgctcgcgtcatcgtgcgcggcgaggtgacgggcttccgcgggcccaacgcgcgcggccactggtacttctcgctgaaggacgcgggcgcggccatcgacacgaaggtgtgggcctccatggcggcccgcttgcgcttcgcgctgcgcgacggcatggaggtgattgccgaaggcagcgtggacctgtacgagccgcagggccgctacagcctcatcgttcagcggctggagccggtgggcgagggcgcgctggcgctggccttcgagcagctcaaggagcggctggcccaggagggactcattggtcccgggcgtgtgcggccccccaggccgttgccctacctgcctcggcggattggcgtggtgacgagccggaccggcgcggcgctccaggacttcctgcgcgtgctgcattcgcgcaacccgcggcagagcgtcctggtggcggatgcgcgcgtgcagggcgaaggctccgccgtggaggtggctcgcgccatcgagcggctggctcgcacggacgtggacgtcatcgtggtgacgcgcggtggtggctcggtggaggacctctggaccttcaacgaggagcgggtggcgcgcgccatcttcgcctcgccggtgccggtggtgtccgccattggccacgaaatcgacttcaccatctccgacttcgtggcggacctgcgcgcgcccacgccca

SEQ ID NO: 894 - DNA, 7538 bp, Myxococcus xanthus
atgtcgtggggccgcatcggtcacccgagcgagatgttcaacgtgggtgacgaggttcgcgtcgtcgtcctcaagttcgacccgacgcaggagcgcgtcagcctgggcctgaagcagatccaggaggacccgtggcaccgcgccgacgagaagtacccggtcggcacgcgcgtccgcggcaaggtcgtgtccatcacggactacggcgcgttcatcgagatcgagcagggcgtcgagggtctggtgcacgtgtccgagatgtcctggaccaagcgcctcaagcacccgtccaagatcctggaggtcggccaggaggtggaggccgtcgtcctggacatcgatccgaaggccaagcgcatcgcgctgggcatgaagcagatcgagcagaacccctggacgctgctcgaggacaagtacccgatcggctccgtcatcaagggtcagatccgcaacgtcaccgacttcggcgtgttcgtcggcgtcgaggagggcgtggacggcctggtgcacgtctccgacatctcctggacggtgcgcatcaagcacccgggcgagatgttcaagaagggcgacgaggtcgaggcggtggtgctcaacatcgacgtcgagaacgagcgcttcagcctgggcatcaagcagctccagccggacccctgggagacgctgtccgagcgcctgcccgtgggcagccgcgtgaagggcaaggtcaccaaggtcaccgacttcggcgcgttcgtggagatcgagccgggcatcgagggcctcgtccacgtctccgagctgaaggaggagcgtgtcgagaacccgcgtgacgtggtgcaggaggcgcaggatgtcgaggtgaagatcatcgacatcaacaccccggaccggaaggtcgcgctgtcgatgaaggcgctgatcggcgagggcgaggactaccgcgagtacctccgcaagcaggcggaaggctcgaaggcgcgcctcggcgacgtgatggcgagcaagctgaagaagtagtcttcagccgcacgcgccagcacggcgagacggccgggttcccgagagggggcccggccgttgccgtttcggggcggggcctgctatgcaagacgccgcgcgctacggggccgagcgcgcgggggacaatccatgtctgttcgttctgttgcctggggcagtcgcgccggggtggcctgcgcgctcatgctgagtgcggtgtttgcttgttcggatggaagcagcccgaatccctctgtgtcccgccctccgggccaggcacgcatcgaggcccccgtcgtagggctcacggcgggattgccgggaggcttccggtgcatcgccgaggatccggacggtgacgcgctgacctatgcgttcgactgggggcgcgcgaaggcggaagtcagcctgtccgaacgtgttcccagcggcaccgccggtgacgtggctcccgtcttccagacgaaggggcagttttcggcccgctgccgcgcggtcgatacccacggacagttgggggcgtggtccgaatacgcgctcttcgaagtgcacccggcgccaccgctggatgacgggaagcgggagctcacggtggaggtctttggccacgggcgcgtgacgagcacgccgagcggcatcgactgcacgtccacctgcagcgctcgcttcgaggtcggagccgaagtcaccctatccgcggagccacagcccggctggcgcttcacggggctgctgcgctgtggcaccgagcgcgcgtcccaggtcgtccgggtcgaccacaactatcattgtggggcagggttcgcccgacgggaggagcaggccgtggagtggcgccagacgggcgcctcctaccccagcgatgcgtcgtggggccccgatggccggctgctcgcggtgttggatcaaaggggcacgcgaggcggcctgcgcatctggaatgcgggccttgggcaggttgcccgcatcatccaccaggactccactgacatccgttcggtgtcctggggcccgcgggacgaggacctagcggtggggctcgcggatgggcgactggccttgatcgacccggcgacgggagcgctccaccagacgtggagcgcccacgctgggcccgtggtggggctggcctggtatgcgagaggaaatgagctggccagcgtcagccacccggagacaggcggcgcggaggtgcgcttctgggccgcgtcctcggggacggagagccgggcgccgttgcggacggcgcgcaccctccggaaaatccactggagcccggacggagcgcgggttgcgttggagatggcgggcgagcaggtggaaatccacaatctggacccctgggtgcaggtccacgaggtggggcatggcgacagcttctcctggagtccggacggcgctcgctacgccgtggggagctaccggaacgtccgggtgtacgaaacggcaacccacgagctccaggcctcctggtttggaccgtggagcgtgtcgtcccgcatggactggagcccaacccaggactggctcgtcatcgtggacctggtccactccctgacggtcctgaacgtcaacaccgggacggtggtcgcaaacggcaccgaggtgccccccaatccgttggacgccctgggcttcagcgccgtgcgcttccacccggtccacgactcgttcgtcgcggtggcccgcaggcccgcgtcggtctccaccttcagcgtggacgcgcagcaatcgcggctgcagcgccacgagttggtggcccattcgtccgcgatcaacgccacgaagtggagtccggcgggggaccggctggcgtcagcgggcgacgacggaaaggtccggctctggggcgccgcgggccaggcgctggcgactttggacggacacgagggcaagtcggtccgcgcgctcggatgggacgcgagtggcgcacggctcgcgtcgggaggtgctgatggccgcgtctgcgtctgggacgccggcacgggccggctgacgcagccgccgctgcagatgatgcaacgggcgcaggggcatacacccaaggtggagcacgtcgcactgagtccggacggccgcacgctggcgagcgcgggcgcgacgctatttctcacgggaagcatgaccagcgtccaggtctgggacgtcgcttcgcgcacggagctgctcaacatcccagagacggacagccccgtcgtagcgctgggatggacgccggacagccagtcgctgatcatcgtctatacccacgcggcatgggatgtctggaaccgcagctccggggtgctcaagcgcgtggagtccgccccggaaatcctgaccaccgcggcgctcagtcccgatggaacccggttggcctgcagcgaccggctgggggtgtccgtcctggacgtggggacgggggctgtcgtcgcggagacccctatgtggatgaggcaactgtccctggcgtggcacccggacggtacgcgcttctccggtggcggtgcgtatcagctcgtcttcgactggcaggtgcatgagcacggccaacttctgcccagcgtcatgggggtccacgacagcacggtcctgggcgcatcatggcgcggggacggcgaggtcctcaccacaggtggcgcggacatggcgctggtcacctggcgcgcccgctaggaaccgtccgaccggtaggttgggcaggggcccatccagcacaccgccagccttcgtgacttcgcgcggttacgagggctggcgcgttgcgtcgtgcacagtggacgctcacgcccgtgtgacgagcaaggatgcttgaactcagggaagtggccggtgataagggcccccgacactgttatcgaagagcatccgcacatcctcaagaggaggcaggtttcatggctcgtgacgtcgtcatcgtgggcgcggcccgtacccccattggtgcctttcagggcgcgctcgccaagctgacggccccgcagctgggcgcgatcgcgatcaaggcggcgctggagcgcgcgggcgtgaagcccgaggccgttcaggaagtcatcctgggctgtgtgctcaccgcgggcgtgggccaggcgcccgctcgccaggcggccatcttcgccggcctgcccgagacggttcccgccaccacgctcaacaaggtctgtggctccggcctcaaggccgtcagcgcgggcgcgcaggccattgccctgggtgacgcggacgtcgtcgtcgtgggcggcatggagtccatgagcaacgcgccgtacatcagccacacgatgcgtggcggcgcgcgcatgggcaacgtggaattcaaggacgcgatgatccacgacggcctctgggacgtgtacggcaacgtccacatgggcatctgcgccgaggagtgcgccacgacgcaggacatcagccgctcgcagcaggacgagtacgcgctggagtccacgcgccgcgccatccaggcccagaaggaaggcctgttcaaggcggagatcgtcccggtccagattccgggcaagaagccggaggacgtcgtcaccgtctccgacgacgaggggccccgcaacgcgaagccggagaagattccgggcctgaagccggtgttcaagaaggacggcacggtgacggccgccaacgcgtcctccatcaacgacggcgccgcggcgctggtgctgatgagcgaggagcgcgcgaaggccgagggccgcgccatcctgggccgcatcacgggctacgcccaggcggcgcgcaagccggtggagttcaccatcgcgcccacggacgccatcaacaagctgctgaagaagcagggcatcagcgcgggtgacgtggacctctgggagatcaacgaggcgttcgcggtggtgtccatcgcgaacaaccggctgctcggcctggacgtgtcgaaagtgaacgtgcgcggcggcgcggtggcgctggggcacccgattggcgcgtccggcgcgcgcgtgctggtgacgctgctgcagacgatgcaggacctggacaagaagcgtggcgtcgcgtcgctctgcatcggcggcggcgagggcatcgcgctgatggtggagcgctgaacttcctctcccaataggagaggggcacggggtgggggcctgccaagggccttcaccccgttcgcacatgcgggagggcggatgaacaaggtctacgcgaacgcggacgaggcggtcgccgacatcccggatggctgcacgctcatgagcggcggcttcgggctgtgcggcaacccggagaatctcatcgaggcacttcaccggaagaacgtgaaggacctcaccatcatctccaacaactgcggcaccaccgagctggggctcggaatcctgcttcagaacaagcaggtgaagaagatggtgtccagctacgtgggagagaacaaggagttcgagcgacagttcctctccggtgagctggaggtggagctgaacccgcagggcaccctggccgagcgcatccgcgcgggcggctgcggcattggcggcttcttcaccccgacgggcgccggcacccaggtggccgaagggaaggagacgcgcgtcatcgacgggcggctgcacgtgctggagacgccgctgaaggcggacttcgccattgtccgtgcgtggaaggcggaccgctggggcaacctggtgttccgcaagacggcgcggaacttctctccgatgatgtgcatggcggccaaggtcaccatcgtcgaggcggagcacatcgtggagccgggcgagctggacccggacctggtgcacatcccgagcatcttcgtgaagcgcatcgtccaggcgaagaacctccagaagtggatcgagcggcgcaccgtccgcaagtcggcctgaggagcccagccatgccactgactcgtgaacagattgcacagcgcatcgcccaggagctgcaggacggcttctacgtcaacctgggtatcggcatgcccaccctggtggccaactacatccctccgggcatggacatcgtgctccagtcggagaacggcctgctgggcatcggcccctggcccgtggaaggccaggaggatccggacctcatcaacgccgggaaggagacggtgacggcggtgcccggcgccgcgttcttcgactcggccctgtcgttcgggatgatccgcggcggccacatcgacatggccgtgctgggtgccatggaggtcagcgaagagggcgacctggccaactggatgatccccggaaagatgatcaagggcatgggcggcgccatggacctggccgtcggtgcccagcgcatcttcgtggccatggagcacgccaacaaggacggcaagcccaagatcctcaagaagtgctcgttgccgctgacgggcctcaagtgcatccaccacatcgtcacggaccacgcgtacatcgacgtgacgccgcagggactcatcctgcgcgaggtggcacccggagtgacggtggagcaggtgcagaagctcaccgagccgaagctgacggtggcccccgacgtccgtgagatgaaagtctgagcgtgtggggataaggtgcaccgccgcgggcgttgtacgaaccccgcggcggagcgcttctcatggcagacagtcccaacacctcgacccctcatccccgcgcgccccgtctcgagtacgagctgccggtggcctaccgcagcgtctctggcttcgtcaccgactgggcggtgaacctgtcgaaggggggcctctacatcaacaccgacaagccgctggccgtggacacggtggtgcggctgttggtgacgctgcccggcgcgcacttccccgtggagctgaaggggcgggtgacgcgcaccaatgccgtgggcgtgcccgcgcctcagtccccagggatggcggtggagttcctggacgttgatgaagacaagcgaacgcgtatcgcggagttcgtggagcgcctgcgctcggagctcccgcccgaatagcgcctgaatgctgccgctacccgaacttcccattgaattgaccatcgaacgcctcggccagctcggcgaaggcgtggcctcctggcaggggcgcaccgtcttcatcccggggaccttcccgggcgacaccgtgcgcgtccacctggagacgcaaggccgtgtgctgcgcggcatcctgcgacaggtggtgtcgccaggcccggaccggcgtgacgcgccctgcgtgtacgcgtccgactgcggcggctgtgactggctggcgctggccgagcccgcacagcgcagcgcgaagcaggagatcgtcctctccaccctggagcacctggggcacctggctcgggacagcttcaccgtgcgtccgctgctggtggccccacgcgactggggctaccggcgccgcgcggtgctgcatcccgcgggcaagggcgcgctggggtacttcggccggcgcagccacgaacgcgtacccgtggaagtctgcggcgcgctcacgcccgtgctcacggcgctccccggcaagctggccccgctgctcaagcccctggcgaaggatgccgaggaagtgctgctgctggcggaaggggacaaggccgcgttcgaagtgaatatacttgagagct

SEQ ID NO: 895 - DNA, 6468 bp, Myxococcus xanthus
ccacccgcacgccgttgtcacgcgcgtggtagaagaccgcgctgcccgcgggcaccagcggcttgttccgctccgtcaccaccttggtgaggtactccgcgatgccgccgtcgtgcttgtacgtcaccgacgtgggcgggctggacgtctcgtccttccagacgaccgtcatgcccttgtgcaggtagctcttggcctccagccgctcgcgcaccagctccgcgtcgaacttcagcttctcgccgaaaatctccgggtccggttcaaacgtgacggaggtgcccgtgccacgcgcggcgccatccaccttcagcgtgctggtggccttgccgcgcgcgaacgtctgcacgtgcttcttgccgtggagcttgatctccacgacgagcttgcgcgccagcgcgttcaccaccgagctgcccacgccgtgcagaccgccggagtggatgtagttgccctgctcgaacttgccgcccgcgtgaagggtcgtgaggatgacctccacggccggcttcttgtatttgggcatgatgtcaacggggatgccacgcccgttgtccacgatggtgacgctgcggccgtccttgtggagcgtcacctccacggtggtggcgaagccgttgatgacctcgtccaccgagttgtcgaggatctcccacagcaggtggtgataccccgtgctgtcggtgccgccgatgtacatggccgggcgcttgcgcaccggctccaggccttccaggacctggatgtccgcgcctgtgtaggtttccttcttcgtcgccatggcgtcctctgcctagtccttcttctcgggcaacgggatgaaggtgacggcacgcgccacctccttcacggcgtcgcgcttcgacatctcatggcccttgcccgccgcggcccgtcacctcgtacttcgccggggacaggtgcagcttgcggcccttctgcgtttcgaactccagcttcgcgtccttctgcgcgggcgacacggcgaggaagtccaccacgcggtcgccgccgtccaccttgatgacggtgacgcccttgcccgggccggccagctcgttgacctccgccaccttgcacaccagggcgctggtcttctccgtcagcaccgccaacaggtcgcggtccgtcaccggctgcacgccgatgatttcgtcgccttcgcccgtcttcgcgtagcggcggcccgcgcgcgtggagacctccaggtgcggctccagcaggaagcgcatgcccatgccctgcttcgtcacgcccaccagtttctgcgggcgcggcagccgcgcgtccagcgacagggcggacaccacgcgctcgccgtcgtcgaacttgaagaacttctgcaccggctcgccgtagcccgtggaggcgggcacgtcgttgaagcgggtgacgtacgcggtgccgaagttgctgaacagcaccaggttcgccttcaggctgccggccagcaccgccatcaccgcgtcgccttcacgcaggcgcgtggtggacgggtccttcacctcgcgcacgcgcttgacccagccgtcgcgggtgatgaccacgtgcgcgtcctcgtccgcgatgaacgcctcggcgctgaactccatctcctcggagcccgcgccgccaatgcgcgtgcgacgcttgtcgttgtagcgggccttcatctcgcccagttcgtcccggacggtgccccacaccttgttcttgtccttgaggatgccctggatgcgcttgatttcggcgcgcttctccttgagctccttctccacgacgagaatctccaggcgggccagcttgtagagcttcatctccaggatggcgtccacctgggcttcatccagcttgaagcgggcgatgagcttccgggccgcgtcctgctttccttccgacgcgcggatgattttgatcatctcgtcgagcgcgtcgtagaccttctcgaaaccctccaggatatggacgcgccgcagcagctcgcccagctcgtgctcgaagcgcttcgtcaccacgtcgaagcggaaggtgaggaagtaccagaggatgtccctgaggttgagccgctcgggcgtgctcaactctggcttgtccttgatgggtaccaggcaggtgaggttgacgccgaagttcgtctgcagcggcgtctgcttgtacaggtacgccatcaccagctcggggttggcgtccttcttcagctccaggacgatgcgcacgtccttggtggattcgtcgcgcacgtcggtgatgagcggcagcttccgctcgcgcaccaggtcgccgaacttggccaccagcgtggacttgttcaccgtgtaggggatggaggtgatgacgatttgctggccgcctcgcttgaggtcctccagcttgtactcaccacggatgcggatgctcccctggcccgactcgtagatgtcgcgcagctccttcttgtcgttgaggatctgcccgccggtggggaagtccggacccttcacccacttgagcaggtccttcgtcaggagctgcgggttctcaatgagcgccaccagcgcgtccaccagctcgcccaggtggtgcggcgggatgttggtggccatgcccacggcgatgcccgtggtgccgttcatcagcaactgcggcacccgcgcggggatgaccaccggctcctgcagcgtgccgtcgtaggtcggccggaaggccaccgtcttcttgcccagctccgtcaggagctcgctggacagcatcgccagacggcactcggtgtagcgcatggccgccgcgccgtcgccgtcgagcgagccgaagttgccgtggccgtccaccagcgggtagcgcaacgagaagtcctgcgccatgcgcaccagcgcctcgtagatggaggcgtcaccgtgcgggtggtactgacccatgacactgccaaccaccttggcggacttctggtacttggcttcgtgcgtcagccggtggtcgtggaacatgccgaacaggatgcggcgctgcaccggcttgaggccgtcacgcacgtccggcagggcgcgcgaggtgatgaccgacagggcgtagttgatgtaccggcggcgcgcctcgtccgcgagcgaagccggcacggagccgtcgccgttgccacccgcgccgccgccactcccgccgccaccgctgcctcccccggccccctgcttctttcgcgatttcgattcggcttctgcgagcatggtcgtcaatccacaggtgagaacgccccgcaccccgaacgcggcgcgcgacccgcgcactcctcacgttggggggcagaggtatgtaacagggcgccgggactaccatgccaccctgacattgggaacgaattcggggggttgcgcactctccaacagtgcccacctatacgtctgtccagtcctatttgccagcagaaccccactccaaccccgcggaattccgaggtcgggggcctcctggctggggcatgcggcgggacggtgggtgcgggtaggacaggacggctcgtccccctggcggcaggtggacgccctagggcgtcgcgtcgcgggccttcccccacgaaccgtccttgaagatgcgcacgcccttgccgctcccgccgccaatcattccaggaatggtggcctggagcggctttgcgccgggcggctggtagacgacgcgggccttgcgagcggagggcagggcggcgctggtggcgtccaccagcaggtagatggtttctccgtccacgtggagccgctcggggtcctggcggtggttgaactcggccagcaactcgccgtcatccacggaggaggcctcgctgccgagcaggcggaccttcacccgcagccagctcacgggcggggcgccttcctgcttcgcgtagtcgcgcacgccctggatgacgacggcgacgtcggcgccgttgccgggcgcattcttcgtcgccaggcgcaggcccgtctgcttgctgttgtcggtgtcgagcagcagcgtggcgttggcgcagcggctcttgcactcgtcgccccacggcaccttgtcgaagcgcaggcgcatggcgaagtcactgccttgggggccaatgacggcgttgacgatgacgggacgctccccgtccggaggcgcggcatagcggaaggtggcgcgctccttggcggcgaaggcggtgccggcgagcagggtgcaaaggagcaatgggcgcttcacgtggagacctccccaggggcaaaaagggcctattcaagagggaaggggcccaccgcatcaagtcccgggtgttcgagtgaggcttaggtgggggaagtcgcatggtttcgatgcgcgcgcaggctcaggggcgaagcgctgcccgggtggccccgtggcccatcgcggccggtccggctccgcgggtggcgttgagccagccgcgccaagctaccgggggcttggctcggttcggcaccgtcgccgttaccgctacctgacggcgggccttcggtgtggagtgggcggtgggagggccggcgcccgaactcagctcgtgggggttatgggcgtgccttggccgtgcccttctgccagtacgtcgcgacgagcaccgccgcgaggcgacgcttgctcatcgcgtcgcgaagggcgtcgaaatccttgtcggtgtagtcgacggaatcgggccgcgtggccacggcgagatgcctctggggaggcacagccgcgacaaggcgacctccggggaccggtcagcggtcgttcagtcctcgtgggcgcgctttccgtaggtccctgcggtgagcgtcttgagcgaggcgcggacgatgccagtgagcacgtcgaggtcgaccttcgtgaggtccttgatgtacaggcatccggtgccggtcgtgtgcggaccgagcttggcgagcgcactggcgtgggcgctgaggccgtcagcgaggtagacgacggttgccgccttgcgcggagagaagccagcggcgggtgcggtgccacggtggccgctcgcgtactggtacgcgtactctccgaacccgacgattgagggaccgaacatcttcggctcgagcccggtcacctcgcgcatcaagtcgagaagcacctgggcgtcgcgacggcgccctgcaggcgtcacgttagcgaggaacgccaacggatcggcatcggtccacgtggttggcatcgcgcccattgtgctcactggttgaaggaaacgtccacggccgccgtcacgtccttcgacgagcgtgccgtgtcgccctcggtgagccgcgcttggcggactttcgaagcgagcagcgcctcgccgctgcggacagtttggagtgcttcgacgatggtgtcgatgggcggggtgtcgtcatcgagaggacgttaggcgcctcctgcgcgcagctcgtgatggccatgcgccccgcgtcctcaattggatctggactgacgtgccaactccgcagcgccgcttctctgacgtgccaagatttcgaggccaccgggctcaccattcttcggagggccactttctggcagtttactgtcggcatccgcttcacagtgaatgcgtggcgatgcggtgctcgcgggcttgaaggcgaagcgccaacgctcctgactcgacgcctggacttcgtggatacgcggcaggcgaagggctcctgccgggcgcgattcaatagacaggcacgcactcaccggaaacgtgacctcggtgtgaacgcccgttggacgctcgacaccggtcaccgccgcgcggcatgtcaggcccggctacttcctcggccgcattcggaacgcgacgaaggcatccacgttgtcgaaggcgaagtacgggttcttcttccgcaccgcctccatggacgtcaccgggacgtccgcgtagtcgtggcccggaaacagcttcgccgtgtcgggcaccttcgccagcacctgggacagggagcggtacatgtcctccgggttgccgcccttcaagtcgcaccggccgcagccgttgatgaacacggtgtccccggagaccagcgcatcgccagccagcaggcagtgcgagcccggcgtgtgccccggcgtgtgcagcgcatggaacacctgcgagcccacgcgcacgtcgtcgccgggccccacgggccgcagcgcgccgcccagctcgcgtagctccggcgagaactggacctcctcccgctgcgcgtacacgggcacgtcccacatcgacagcaggtcgggcagtccgttgatgtggtcgaagtgacagtgcgagacgaacgcgcccaccacgcgctttccatccgccttcaccgcctccgcgatggcgtccacgtcccacgcggggtccaccaccaccacctcgtctgagtcccggggccccaccaggtagacgaagttgtccatgggcccgagcttgagctgccgcacgtacggttcacgcatcgcgatatcctcctccgcttcaggctccactctaacgtccagggtttgaaggcgcgggccgattccctctttccgggccctggacgaacgattcgcgatcaccttcgcccgggc

SEQ ID NO: 896 - DNA, 6482 bp, Myxococcus xanthus
gtgctctaaaggtgcggtatggctcggtggtgacgcaggcgcggccgccatcgctgcgcacgcgcatggcggcggggctggacccctacgcacagctcacgcacaccatctacgcgctgatgtacgggcagacgcagcggatgccgctcacggcgctgccgctgcacacgcccgcgcagacggcggcgctggtgcaggcctatggcgcgatgcccgggcccacggcgtgtgacggcatcgtccccacacgctcgcaggtgtatggccgggtactggccgcggtgcgtgcggaccacctggatgcgattggccacttcgaccagcccgcgcaccaaccgccgcacgtggactggctcatctccggctctggttttcgcaggccccagttcgagtcgacgtggaagagcatcgtcgacttcatgctggaggacgagcgccccggcatcacggggtcgtgacgacctcgaagacctccgcggccggcagggtcagtagacgcccatcaggtgaatctgcacgcgcggattcccaaggtattcctccagccgccatcggctgcgcatgccgtcatcacggatgcccaggccgcctccgggcttcggcgcctccgcgctggcgagcgcatcccggagctgggacacggcccaggagtcgaatttcgggtcgccggagccttcgagcaccttgaggtcgagcagcttcccgtcgcgcgcctgccagacctcgacgatggccgcgagcgcgagcaccggcgtggtgacgtccaccatgtacatgttggccgcgcgtccagcctcgacagccgcttgcatgcgattgcgctgctccaaccggtggtcccggggctcggcggcgatgggagtgcctgtctttccgaagcgcgcaatggcatccacctgctcgcgcttcattcgtgagcccaacaccttcaggtctggaggtggcgggttcaccaactgcttcgcgaagccttcccgcaacttcgcgaagtagggatgcgtggcgccgctcgacgcgcgtgccgtggcggcggcgtcctgggcccagccgtccacacgcacccgggcttcctcggcctgccgggccgccagcgccttcgagtctgggccttcgccagggcggagcgtccgtcccgtcgaaggggggccgccgcgcagcatgccgccccccagaaggccctgtgactccaggttgggacgctgctgtggctgaggaacgtcgcgagggacgtcttgcgccagggctggcggcggctcgccggagccagttggggcgacctcgggcggaggttcctcggatgcgtcgggggcctccgtcgtggtggggcgcggacgctccgcgtgccgaggcgggtcctccttcttcgaaggcgggcgcgggggcgcttcgtcaggaggcggctggcggggctccggcgctggcggctcgggaggaggcgtcacgtcctggtagacgacctccatctcgacggcacgtggttccacgcggcgctggcggtcgttgggctcgctgcctgacagcgccacgaagagcgcgacgtgcaggagccccgacaccaggagcatgaaaatcagttgagcgcgccgcgacacggcggacagcttgcctcgacgcgtcgccacagtgaagcagccccttttgacgggtgcccggagctgactcctgcctgccagctactcgccttcacctccccgcaacgctggcggtcccgaacttcagtgccgccgcctggccccagcgcaagggggcaaccctaagccgcctcaggccttcttcagcaccgccaggaagcgggcatccgcgatgtgcgtcccctcgaagtcctccagccgaacgggaatccactcacgggccttgtcccccttctgccggagcgcggcgtccagggtgttgaacacctcgggaggcggctcacagatggcgcgcacgccgcccttggccttcgcgtggaaggacacctgcaactcattcacgagcgccaggtaacggcccggcgggaagcggcggaagagccacacgcccatggtcagttccatcaccgtcacctgcacgcccaggtacacgctgcccacgtggttgcgcgtgcgccgcttcagcggcacggacacctgggcccgagcatccgatgcgtcctccacccggacgcccatcaccgaggacagcgggatgatgttcttcaccgccaccgtcagcagcgcattcgccgcgctgggagatacctggcgcagccgttccacgaggtcgagagcaagcatggtccgcccatcataccgaccgtgagcccgcccgcctgccccccaggtgccacgcacgggctggcattcccggcaggaatccccaccttggaatgaccttctggaggaaccgcgcaccatgaactttccaagccatgtgaatctccccaccgatgcacgtgaggagctcatcgattcgctcaataccctgctggccgacgccatcgacctgcattggcaaatcaaacaagcgcactggaacatccgcggccggcacttctacagccgccacgagctgttcgacgacctggccaagcacgtccgcaagcaggccgacgagttcgccgagcgcgcgggcacgctgggcggctacgccgagggcaccatccggctggcggccaagaacagcgagctgcccgaatacgacctgaaggccgtggacggtgacgaccacctcaaggccctggtggaccgcttcgcccgctacggggccagcatccgcaacggcatccaccgctccgacgagctgaacgaccccgtcacctccgacctgctcacccagacgctgggcgaggtcgaactggacctgtggttcctggagagccacctgcacggcgagccccgcgcgggggcgcgccgcggaggggacgtccggccccaggacaccaccaccagcccctccaacgcctgaacggagcgttgaccaccggaaggcccccgcgcgcctgctcaagagcaagcgcgcgggcggactccagcgtatagaaggcgtcctttcgcgacggaggacgcctttttgacttcacagacgcgcatggatgggaaggtgtgcctcatcaccggggccaccggcggcatcggcctggaggccgccaaggcgctcgcgcgcatgggcgccacggtggtgctggtgggccgggacgcgggccgcaccgaggcggccgtggccgccgtgaaggaggccgcccccagcgcccaggtggactggctccgcgccgacctcgcctccctgaagtccgtgcgggagctggcgcagaccttccgctcccgctacccgcgcctggacgtgctgctcaacaacgcggggctcatcatcgaccggcggcaggtgacggaggacgggctggaggccaccatggccaccaaccacttcgcgcccttcctcctgacgaacctgctgctggacgtgatgaaggccaccggcccggcccgcatcatcaacgtctcgtccgatgcccacgccgcgggcaagctcgacttcgatgacctgcagagcgagcgcggcttcatcggcttccgcgtgtacggcacgtcgaagctggccaacatcctgttcacccgcgcgctggcgaagcggctggagggtacgcaggtgacgaccaacgccctgcaccccggcgtggtgcgcacgggcttcggtcacaacacccagggcttcttccgccacctcgtcaagctgggcgcggcgttcatgatttcggcggagaagggagcgcggacgtccgtgtatctggcgtcctcgcccgaagtggaggcagtgtccgggcagtacttctacaaatgccgtccgaagaagccgtcctccgccgcgcggaacgacgcgctcgcggagcggctctggcaggtgagcgagcagctcacgggagtcaagggatgatcgacctctacacgttcgcgacgcccaacggacagaaggtatccatcgccctggaggagctgggcctccagtacaagacgcatgtggtggacatcaccaagggcgagcagttcaagcccgagttcctggacatcaaccccaacaacaagattccggccatcgtcgaccacgcgacgcaggaccaccgtccgctcaaggtcttcgagtccggcgccatcctcatctacctggcggagaagacgggccagctgctgccctccaaccagcgcggccgggcggaagtgatggagtggctgatgttccagatgggcggcgtggggcccatgttcggccagctctaccacttcgcccgcttcgcccccaagaaggtcccctacggcatcgagcgttatcacgccgagtcccggcggctcgtcggcgtgctcgacgggaagctgggctccggggattacgtcgcgggccgctactccatcgcggacatcgcgctgtatccctgggtggccggcgcccgcgcgagcttccccgagctgttccgggggaacagcaacgtcgtgcagtggctccaccgcgtgggcagccggcccgccgtggagcgcggcatgaaggtcccccagctcaagtagtcccacacagcttcccggaagcgcggtggctggatggccgccgcgcttccatgtgttctcctccgtcatggccacgctcgaacaactccgcttcgacaacacctatgcccgcctgcccgccgggttcggcgcgcgcgtccaccccagtccctttccagacgcgaagctggtgagcgtcaaccctgccgccttgaagctcctggacctgacgcccgaggaggcgcagcgaccggagttcgttgcggcgatggggggcgcgaagcccctgccggggatggagcccttcgccatggtgtacgcggggcaccagttcggcgtgtacgtgccccggctgggcgacggccgcgccctgctgctgggcgaggtccgcgacgccgccggggcgaagtgggacctgcacctcaagggcggcgggcccacgcccttctcgcgcgggggtgacggacgcgcggtgctgcgctccaccatccgcgaatacctgtgcggcgaggccatgcacggcctgggcatccccaccacgcggggcctgggcatcctcggcagccaggccccggtgtaccgcgaggcggtggagacgggcgccatgctggtgcgcatggcgccctcgcacgtgcgcttcggcaccttcgagttcttccactacaccgagcagaccgagcacgtggccacgctggccgaccacgtcatcaccgagcacttcccccaactcgcgggccaggaaggccgctacgcgcgcttctacacggaggtggtggagcgcacggcgcggctgattgcgcagtggcaggcggtgggcttcgcgcacggggtgatgaacacggacaacatgtccatcctgggcctcacgctggactacgggcccttcggcttcctggacgacttcgagccgggcttcatctgcaatcactccgacgaccggggccgctacgcattcgaccagcagccgcgcatcggactgtggaacctcgcgtgtctgggcgaagcgctgctcaccctcatctcggaggatgaggcccgcgccgcgctggccacctaccagcccgcctacaacgcgcacttcatggaccggatgcgcgcgaagctgggcctgcgggagacgcgcgacgaggaccgcgagctggtgagcgacctgttcgcccgcatggccgaagcccacgtggactacacgcgcttcttccgcgcgctgggccacttcgcctcggcggacggcgcggacacacgtcccgtacgtgacatgttccccgcccccgagggcttcgatgcctgggccgggcgctaccgggcgcggctggccgccgagggcagcgtggacgcagagcgccacgcgcgcatgacgcgggtgaaccccaagtacgtgctgcgcaactgggtggcgcaggaggccatctcccgcgcggaggccggggacttctcgctcgtggaccggctgctcggcgtgctgtcggacccgttcgccgaacaccccgacgcggagccctacgcggcggcgcctcccacctggggccggcacctggcggtgagctgcagctcctgaggccgcgccacgggcgaaggttgaagaagcgaagattccgcccggccacggttgccggaacacacggcaggcgcaacctttgctgtctatggtgacggacctcacccggttgcccctgcgaggaaaacaaggcgcctttcacgtcatcgtcgagtctccccgaggctccacgctgaagctcaagtacgacacggcgctcaaggccttcagcctctcacggccgcttcccaggggcctgagctatcccttcgactggggcttcatcccctccacccaggggccggatggggacccgctggatgcgatggtgtactgggacgacgcgagctttcctggcgtggtgctgccctgccatgcgctcggcgtgctccaggtggagcagaacaccggtgacggcggacgcgagcgcaatgaccgcatcgtccttgagagca

SEQ ID NO: 897 - DNA, 6855 bp, Myxococcus xanthus
cccggtcgtggttctcacggaggcgcccttggaggtggcgcggcgcctgggcatccgggcgggcctcatcgtgccgctgttggcgcgaggccgcgtgctcggtgcgctgtcgctggtccggggcgactcggacggtgtgcccggcgcgtccgacctggagctggcgttggagctggcccggcgcgccagcctgtccctggacaacgcgctgctgtacgcggaggcgcgcggcgcgcagcagcgcaccgagcgcctccaggccatcaccgcggccctgtcccgcgcggccaccgccgaggacgtggccgaagcgctgatgcgcgaggagttgcgccccgcgggcccggcgcgcggcgcggtgctcggcatgctggaggatggccggctgcacgtgctgggctccttcggttacgcaccggcggtgctggataccctgcgagggctgtgggcggaccaagtgcccggcgtggaccgggcgctggagcagttggagccgcagtggttctccacccacgcggcggtgccgcgcgccgtgcccgagtgggcgcgggacctcgtccagggcgtggggcccggggcctgggcggtgctgcccttgaaggtggagcaccgcatccggggcttcctgctgttcacgtgggacgggccgcaggtgttcctcgcggaggagcgcggcttcctgtcctcgctggcgcagcagtgcgcgcaggcgctggagcgcgcggcgctgtacgaggcgctgcgtgagcgcggcggcaagctgcacgtggcgctggaggcgggcaaggaggccgaggagcggctcttcttcctgctggaggcgagccgcgcgctggccgagcacctggacgacgtggagtggacgctggagcacctggcgcgagtggccgcgcgaaacgtggccacgtactgcctggtggagttgatgggagcggacggcgtgccgcgcgccgtggccgcgtcccaccgggagccagagcgggacgtgtcggtgctggcctcgctgtcccttccatgggtggagggcacgctgcacccggcgcgcgagtgcttcctgtcgggggagacgcgcttcttgcccgaggtggggccggagctgcgcgagcgcatgtgccaggggcccgagcaccgcgcgttcctggaggcgctgaatccacactcgctgctcgcggtggcggtgcgcatgcgcggacgcacgctgggcgtcatcacgctgggcaccgcggccccctgccgccggctggtcaccgccgacgtggccatggcggaggagctggcgcggcgcgtggcggtggcgttggagaacgcgtcgctgtaccgggacgcgcaggccgcggtgcgtctgcgcgacgagttcctctccgtggccagccatgagctgaagacgccgctcaccagcctgaagctccagcacgggctcatcgaccgcgccgcgctcggagacgtgggggacaaggtgcggccccggctggccacggccgtgcggcaggtgcagcggctgagcgcgctggtggacagcctgctggacgtcagccggatttcgctggggcggctgatgctggagccgtccgacgtggacctgggccaggcggtgcgcgacgcggtggaccgcatggaggaggtgttctcccaggcgggctgtccggtgcgggtggaggtgccgggcccgctgccggggaagtgggatgcgctgcggctggaccaggtgctggtgaacctgctcaccaacgcggccaagtacggcgcgggccggcctgtcctggtggaggcggccttcgagggcgaggagatggtgcgggtgtcggtgcgtgacgagggcatcggcatcgccgcggaggacctgccgcgcctgttcggccgcttcgagcgcgcggtgtccgaccggcactatggcggcctgggactggggctctacatcagccggcagatcgtggacgccatgggcggccgcatcgaggtggagagccggcccgggctgggttccatcttcaccgtgcgcctgccccggtccacggcacaatgcgcgccatggtgaccgtgggaagggcggacgtgcccaaggcgttgtcggtggcgaagttgcggaaggagtacggcggcaaggccgcggtggagggtgtctccttcgaggtgggacgcggagagattgtcgggctgctgggccccaacggcgcggggaagacgaccaccatcaacatggtgctcggcgtgctgcagcccacgtccggcaccatccacatccaggacctggacctggcggcgcagcgctccgccgcgttggcgctgacgaacttcgccgccgtctactcgccgctgccgggcaacctctccgtgtaccagaacctgcgcgtcttcggcctcatctacggggtgaagtccctgggggcgcgcatcgcggagttgctggagcagttcgacctggtgaagtaccgcgacgtgaagtgtggcgtgctgtcctccggagagcagactcgcgtggcgctggcgaaggcgatgctcaaccgtccgcacctgttgctcctggatgagcccaccgcgtcgctggaccccgcgacggctcgagacatccgcgcccggattcgcgagttcgccgcgcgggacgccggcggcgtgctgtggacgtcccacaacatgtacgaggtggaggaggtctgcgacagggtgttgttcctggcgcgcggccgggtgctcctggaaggcaacccgcgaacgctgcccggcgagcacggccaggcctcgctggaagaactcttcatcgccgtggcgcgcgagccgctcgcgctggagcggagctgaccatgcacctgcaccgggccgccgccgtcgcgcttcgccactactacctcctgcgagggagcctcgcgcgcttcctgccactcttcgcgtgggtggccatcgacatggtgctgtggggcttcatgagccgctacctcaacaccgtcacctcccaggaatacaacttcgttccggtgctgctgggcgccgtcctgctgtgggacttcttcatccgcgtcatgcagggcgtgacgatggtgttcttcgaggacgtgtggtcgcgcaacttcctcaacatgttcgcgtccccgctcaccatctccgaatacctgggcgggctggtgctctccagcatcgccaccagcaccctgggcttgttggtgatgctggtgctggccagcaccgtcttcggcctgtccttcgccgcctacggcgtgctcttcgtgcccttcctgctggtgctgttcctgttcggcatcgcgctgggcatcttcggctgcgcgctggtgctgcgcctgggcccggcgtcggagtggttcgtctggcccatccccgcgctgctgtcgcccttcgccggcgtgttctacccgctgtccacgctgcccgcgtggatgcaggccgtgtcccatctgctaccaccctcgtacgtgttcgagggcatgcgcacgctcgcggcggggggcgcgttccaggtgtccacgctgctgtggggggcttgcctcgcggtggtggaaatcctgctcgcgtgtgccttcttcacgcgggtacaccgacaggccgtgcgcaccggactcatcgcgcgatacagcgctgaaagcgtgagctgatacaggacgttttcagtcgtgctgtcgacacggtgagggcgtgcgaaaacgcgtggccgatggggctgtgggcgagtctaatctccgtggtggctgtatccgcggggggccgagtcctggacgaaccgcgcttgtgactccagaagccgcgcccctgcccgcggactggtgtcgacatgtgcaaggtggtggctgaggtcgtcgtggatgaggcccggcgtgggtggcagcaatcgtacacccgtacctggagcataccgatgcgaagcctcaatcctgttttctcgtccgcggtggtgatggccctgtgctcactgctcgcgggcggttgtggcggttcaccgtcgggcggtgagtcggacacgcagacccctcagagcggcgggctgggaggcaaggccggcgaaggaggccctgtcttcggcgacgagccgacgtaccccggggacgatgacgccacgccgggcaaggtcaccatctgccacattccccccggcaaccccgccaacgcgcacaccatctcggtgtccacgtcggcctggccggcgcatgagcggcatggagacacgctgggcccctgcgaagggggcggcgaggagccggatgccggcagtggcgaggagccggatgccggcggtggcgaggagccggatgctggcagtggcgaggagccggatgccggcggtggcgaggagccggacgcgggtgctccggtgtgcgcgcccattggcgaggcttgtggtgagtccgccgcctgctgcctggggctgatgtgcggcgaggacaacacctgcgatcccgtcatcggctgacgtggatgaacgcacctccccgtccgcacctgggcggggaggtccgccgcgctcggctcacgggcgcggacgcgcgttgagcgcagcacacttgccgaggctccagacggtggcgcgacgtctaccatggaggtcccgcgaggcgtgcgtgctccgccgaacagagcggtcgttgcgcgttcgacgcacgttccgaagggcgtcgcgaaacgcgccgtgacggcgttagggtttcagctcaaggagggggacatcggagcgccaggacgcgcgttccgaacgggcactgtcacatcttccgaaacccatttcgcgctggctcgtgcgtgggcccactggctgctggccggagcgggggcgcctgtcgcgcgaaggacgttggcatcatgtcccggtcggacgtcaccacctccgttcccgtgttcacccagaccttccggtccccgtgtggctgtgtccccgcgcacgggggggcctgcgagtgtccggcccgggcgggcgcgcgtcgtgtgtccatggggtgtccgccatccttcatggtgccgcccgcgagggaggccccgctcccgtcctcggcggcctcgctggtgggacagcaggtgggccacttccggctgctgcgagagctgggccgggggagcctgggcgtcgtgctgctcgcggagcacgcgctcatccagaagcgcgtggccatccaggtgcttcacacgcacgtgacgcaggacccggcgcaggtcgctcggttccttcaggcggcgcgcacgctgacgctcatccagcacgcgcacatcgtttcgctctacgacctgggcatgcgcgacgggcgtccctacctcgtcagggagtacctggagggacagagcctgaccgccttcgcgaaggggccgctggcgtccgcgctggtggtggacctgctcacccaggtgtgtgacgcgctgggcgccgcgcatgcgcacggcatcgcccacggcagtctcaatcccgccagcatcttcctcatccccgatgcgaatggccgccagcacgtgaagctgctggacttcggcatcgccgggttgctcccttcccccgatggcgccgccgacctgtcggtggccgctgacctcttcgccgtgggcgtgctgggcgcgctgctggtctcgggccggctgtcctcgcgcgggcacgcggcggaggagccgccccatggccacgctcgggaggtgccaccgctgccggcgggcatcccgtcggcgctgtcacgcgtgctgctcaaggccatggcgcgccgcccgggggaccgttatgccagtgcggccgagctgcgcgcggcattgcaggcgtcggtggcgctcgacggcggcgtggcgcatccagaggccctggagctggagcggcttcccagttggtacacgctccgggggccgccgggggccgcgcccgcctccaggtagggcggcctggctgtctcggcggggcgtcatgccttgcgtctggcggggccctcctcgttaatccacttcagctcccatggcctccgaccccgacgacaagcttcctccccagggccgcttcaaccgcctgcgcaagctggcaggcctctccgtgcaggtgggcacggatgtgctcaagagcggcgcgaagcgcctgtccgggagcacgcccgacctgctcagcaaggaggccgcggagaagctggtctccaccctgggcgagctcaagggggccgccatgaagatgggacaggccatctccatggacccggacctgctcacccccgaggtgcggcaggtgctggcgcggctgcagaaccaggcgccctccatgtcctacgcgcaggtgtcgcgcgtggtccaggcggagctgggcgcgccgccggagtcgctcttccgcgagttcagcgaggagccgttggcggccgcgtcgctggggcaggtgcaccgcgcggtgctggaggacggccgggcggtggcggtgaaggtgcaataccccggcatcgacgtgtccctggccaacgacatggcgaacctgggcatcgtggcgaaaacggcgtcgacggtgctgcgcgtgtccgatgcaggcgcctactttcaggagttccgcgacgagatgctgctggagttggactaccaccgcgaggccgagctggcccgaggctttccgcccaacgtggcgaaactgcccgagctgtgtgtgccccccctcattttcagccacaacgcgaaacgggtgctgacccttgagctgctggaggggctcaccctcaaagactgggtggcgaccaattccttcaaccaggggcgctttcccgtggggcgcccacttattcttgccacctaccgggcctttttttgggcgggggaaaaacaccccgacccccaccccgggaaatttattgggaatcccgaccggccggttgggtttgttgaattttggttccttaaaggctttttcccccgctt

SEQ ID NO: 898 - DNA, 9321 bp, Myxococcus xanthus
cacgcgcagctggtacttctccaatttcgggagcagctcgcccatccgctccaccaggtccgcgggcggctcggcgcgggacacccagccccagtccgcccccgactgcccgcgccgctggccttccacccggtccccttcacgcagttggagctgcggctccggggcctcctcttccgggtacagccccgcgtgcaggagcggcccgcccgattcgggccgcagccgcgcgaagcggtgcgccgggttgacctccaccacgctgaacgtctccctggccatcaccgtctcctcggatgtccgacgtcgcggagcctacccggtgttgcgcatgccggcggcgatgccgttgagcgtgagcaacagtggacgatccacctccgcctggccctcgcgcttgcgcttgagcagctccacctggaggaaggacatggggtccacataggggttgcgcagggagatgctgcgctggagctgcgggttgttgtcgagcagcttcgactcgcccgtcagccgcttcacctgcctgcgcgtgcgccggtgctcctgctggatgcgccgccacagcgaacgggtggcgggaggcgccagcgacgcgtaacgcccggcgatggccatgtccgacttcgccagcaccatggtgacgttgtcgatgacggcgcggaagaagggccactcctggtacatgcgcttgagctgcgccgccccaccctcctccttcgagaaggcctccagcgccgagcccacgccgtaccagcccgggaggatggcccggttttgcgtccaggcgaagacccacggaatcgcgcgcagcgtgtccaggcctcccgccctgcgcttgctggggcgcgagccgatgggcagcgacgcaatctcctccaccggcgtcgcggcggtgaagaactccaggaaccgtgggtcctcccacaccagggcgcgatacgccttgcgccccgtctccgccagcgtgtcgaacacggtgcggaaggtgcgctcggcctcgggctccggtcgcggctgcgcatccagcgtgtgcagcagcacgccgcccaggatgagctccaccgtgcgccgcgccagctccgggcgcgcgtacttgtggtccagcgcctcgccctgctccgtcgccttgtagccacccgccaccgcgcccggcggcagcgcgagaatcgcctcctgcgcgggaccaccgccacgcgccacggactcgccgcggccgtggaagagtcgcagcgggacgcccgcctcacgagacacctccgtgagcgccacctgcgcgcggtacagcgccgcgctggccgccaggagccccacctccttgccggagtcgctgtagcccaccatcacttcctggccaccgcgcacgtccaggtgcttgcggtactccgcgtccgcgaagagcgtgcgcagcacgtccgggcccgagtccagcgcgcccaactgctcgaacagcggcaccacattcgccgtggcgcagccccgcttctcgtcccacaggcccgcgtgcttcaagcagcggaaggccgcgagcacgtcctcggcggtgctggccatgctgaggatgagcgtgcggcacgcggactcacccgactccgactgggcctccttcagccgcgccagcacttccaggagccgcgccccaccttccgtcggcgccgggcccccgttgaacgagcccgccgcgctcaccgcgtcctcggccggcgcgcgcacctccagctccgccaacgacagtcccagcgcgagcacccgctcccggacctgccgcacgtcgcgaagtcccgcgtgcgtgcccttcgacgcctccagcgcgcggcccagcacgtccaggtccgccagcaaggcctccggcgtgcggtaggcgccctgcggcatggggacgctcgtcccggcgcgctgctgcgtcacgtagtggagcgcacggtgcagccgctcctccatgaagcgcagcttgtgccgcagcggctcgcccggggtacggggaccgtagcggcgctcggtgtcgggcagctcctccgcgtccttcgccaccgagctcagcagctcctcggacggcttcgcgtgacgcgccgactgggacagccgcccgcccaaccgctccaggtcaagcagcaaccgtcgcagtcctcgggcccggtgcgcgcgcagcgtgtccgcgaacacgtcgggcgtcaccagcgggttgccatccatgtccccgcccacccatgagtggatgcgcacgggcgtgtccaccggccccagcggctcgccgtaggcgcgctcgaaggcccagtccagcagctcggggagcagggacagctcgtcggcgagcacctcctccacgtaccagaggacgttcttcacctcgtcacccacggtggggcgctcgcggcgcagctcgtccgtctgccacaggagggtgatttcctcgcgcagcagcgccaggttcaccgaggactcgcgcggcgtcagctcgcagcggtcccgctcctccagcaggcccgccatgcggtagagcttctccagcagcgtgcggcgcacggcctgcgtggggtgcgcggtgagcgtcagcgtcacgcgcatggtgcgcatggcctcgcgcacgcgctccgcggggatgcccgcttccttgagcacttgcagcgtagcctccagcgaaccacgctggggcttggcggacgcgacctccgcgtgggtgcgggcgcggcggatgcggtggtgctgctccgccaggttcaccaactggaagtagacggagaaggcgcgcagcaccggctcggcccgttccagcggcaggcgttggagcacctccgccagctcggccgccaccgcgcgccggccggccacggggcctcggcggcgctggatggcgaggcggcgcacttcttcttccaggtcgaagagcgcctgcccttcctgttcgacgaggacttctcccaggagccggccaagcaggcggacatcccggcgcagcggctgatccacggtacgcagtcgggccatatggtgcgacggtagccgctgagcagcgaactggcccgcatttccgcgcgagaaagtgacgtgcgcccgcgaatcacggcgaggcgtctgtcattcccggccgactcggtcccgaaacgcgccagcacgcgccaccgcccgaaagccacccggccccgtggctcctgagccacacacccgcccggtccaggccttgcacaacaggcctcccgtgggccgcgaacgacaccgcggccgaggagcttgtcgccatgtggacgatgcgggggtggaaggtgacgttgctgtgtggctggctggccgcgccggtggccctggccgagacggcgatgctcgacggggtgccgagggaggcgagggccgcgcgtggcgcggagctgctcccctccgagtcgatgttccccgacgcgggcccaggcgaggtggacggccccgtccttcgctacgcggagccgctgtcctgccccgccgcgcccgagggccgggtgtgggtggcggagacgcaggcgtgcgacgacgccggctgcgagtcgctcacgacggtgtgggcgggctcgtggaccgtcgaggacgcggggctggaagtgcgctgtgagacggaccgcgtggtgctggccgcgggcgaatggcggatggtgctcacgccaggcgcgggcggcggcctggaggtgagtgagctgacgccgccggagcccgagtcgctgtcggcggcgcgaccctcggagacaccggcctccgaggactgagccgggctacacgccgatgcggcggagcatcaggatggggccctcatccaggcgcctgtcccgcaggtcgatctcgcagtcaatcatccagtcgccgtgcccttccgggtcgatgatgcgctgctgggtctcccacagccgcgtgccggactccttcaggaaggtgttggcgggcttgcgcgcctggggcgtgagcaccacgaccttgtgctcctcgaagtacggcgccatggcctgctccagcttgggggccgtccattcgcccagcgcgttgtccagcatggccagcgcgtccatgtagcgcttctggcccagcgccttgagcagccggtgcagctcctcgcgcacgcgcgcggcgaaggccttcgggtcgtcggtgagctccttcggcttgagctccaccaccggcttcgcctcgacggcggcgtccgggttgcgcatgcgctcccactcatccagcaggctggagtccacctgccggagcgtggcgcgcagatggtcgatgaagtcctccacctcctccgtgcggaagcgctccggcaccgtctgcaccagcgtcttgtacgtgtcattcacgtaccgcagcagcacgccctcgctgcgctgcaggccgtactcacggatgtagtccgggaaggacatgaaccgctcgaacatgtcccggacaatggacttgggccggatgttctcctcgcccacccacgggtgcttctgcgcgaacttgttgaaggtgccgtagatgaagtcgcggttgggcttgggccactcgagcttctcgagctccgccatgcgatcgtcgtactccacgccctgcgccttcagctcgttgatcttctcgcccttgagctggttgagctgcgcgtagagcaccacgtccgggttctccaggatggcctccaccagcgacaccacgtcgagcgcgtacgtgtccgtggtcggatccaacagctccaacgtgtcgagcaggtacagcgacagcgtgtggttgaggctgaagtcgtgctgcatctcccccgccaccttcaccgtggcacccgagccgccctgccccttctccacctcgatgatttccgccccgcgcagcgtgcggaagtcgcgcgcggcctccttgaggtgccggcgcttgaggtagtccgagtcgtggctgcgctgcaccagcgtcaccagccgcttgtacccgccgttgccttccgtctggtggtcgctctggagcaggttgagaatcatgccgtgcgacaccgcgaagcgggactccagcggctccggcatgccgttctggagccgctcgaaggtgctccggtcgtactgcacgaagttcttctgcggcggcttggccttgggcgtcttcttcttgcccgcggcctccttggcggccagcttgatgttctcgatgacgtactcgggcgcctgggccaccacgctgccctgggtgtcgaagcccttgcggcccgcgcggccggcaatctgctggaagtcgcgcacgctcagcgtggtcagcttctcgccgttgaacttgaagagctgcgtgaagagcaccgtgcggatggggatgttgacgcccacgcccagcgtgtcagtgccgctgatgaccttgaggtgtccgtgctgggccagcttctccaccagcaggcggtacttgggcagcaggccggcgtggtgcatgccgatgccgtggcgcaggaagcgctggaactccttgccatagggcgtgtcgaagggcgcgtcctggagcgccagccggatggcctccttctcctccttggtggagaagtccacgctcatcaggttctgcgcctgctcggcggcggtgcgctgggtgaagttcaccaggtagatggggtacttcccacgagcaatcaggtcttcaatcgtctcgtgcagcggcgactcgcggtagtcgaagtccagcggcacggggcgctcggcgctgcgcacggtggccacttcccggccggtgagcttcgtcaggctctcctcgatgacgtgcgtggggcccagcgtggcggacatcagcaggaaggtggtgtccggcagcgcgatgagcggcaactgccaggccacgccgcgctcgcggtccgagtagtagtggaactcgtccatgacgacgtagtccacgcgggcgctcgcgtcgcgcagggccaggttggcgaggatttcggcggtgcagcagatgatgggcgcgtcgcggttgatgctcgcgtcgccggtgagcatgcccacgttctccgcgccgaaggcgtcgcagagggcgaagaacttctcgttcaccagggccttgatggggcaggtgtagaaggagaccttcccctccgccatggccttgaagtggagcgccgtcgccaccagcgacttgccggagcccgtgggcgtcttgaggaacaggtgcttgcccgccagcagctccaggatggcctcttcctgggccgaatagaggctcaagccattggccgccacgtagccgacgaagcggttgaggatttcatccgcgtccaggggcggttcgcccttcttggggagcagtgcggcgagcggagcttggatttcaggagtggccatcacccgtggacaataggcggcgcgcccggcccctaccgggaaaatcgcaatcggcggcacggggcgtgacggcaggcgcccccttcccgcacggaagggccggggggaggccccctggaggagtgtccgcgagtctccgggcgcaagggccgggggcgcgatacccgggccccggcccgctccgtaccgttgcccatggactgaaggtcagggggtggggatgcggagaaccgtcagacagaagatgacgcgcctcaagcgcgcggcgctgctgggaggtctggtttccgcgccctgcctctggagcggctgtgagcagcgacggggccccacggtggacgcggccgatgttgccgaggccccggctatcgcggggctggaaggcggtccctccaccaccacgattccaacggctgacggcgggaatgctggcgcagggccgggcccggcaccaggacacgccgacaccggcacgggtggcgcgggagcccacggcgggaccggcagccggagcgagactccaggcgcgagcgcatacacacccggcagcggcccgcgggacagcggcaaccggaccggtggtggcagcggcccgcgcgatagcggcagccggaccggtggtggcagcggcccgcgggacagcggcagccgggccgcgggtggcagcggcgctggccgaggtggcttcggaggcgggggcagcctcacgggtggccacagcgcctccggtggggacagcctgtcgagcggcaacagcgtgacggggggcggcagcagcaccggccaaggcggcagtggctcgggtggagccacgggcttgcacaactgaggaagcagcgcgggtggtccggcctcgggaagtaaagggctggacagtgccaatggcggcgacagcgtgtccggcgacggcagcggctagggaggctcgcggtccggtgggatgatggggctctgacgccgcttcacgcggtgcgcctcaccgccacaccgttgccggacgcgctgtcccgccgggccagcagtcccttcatcgccgtcaactgcggcgcgcgaccaccagagttgctggggagtgagctgttcggccacgtccggggccgcattcaccggcgccacgcagacgcgcgaagccctgttcagcgcgacgcgtggcgcccccctcttcctgccccgcatgttcgacccgcccaccgccgcgcgagcgctgtcggattccgcgcgcgaagaggagccggagctgctgagcgcctccggtgagctgccgacgctgcgcgagacgagaaaccgctgacctgtgcgaggcgctgcggcactccaagggcaacgtggccaccgccgcgtgcatggccagccacaaccgcacggacttctacgaactgctgcgccgccacggctgcccccccgtccaccgaagcgttgtcgcgtgcacatctcgctcgttcttcccgtccatggcggtgtgcttttcaactgcccaaccttcagctgaacagcagttgagggggacgagagtcatgcgaatcacacgagcgatgttgggtgtggcgatggtggggacggccgtgatgttcgccggctgtggagagagcagcgccaacgagaacacgctggggccccagcaggcggccgcgggccatccagtgacgctcacggacggccagattctgggtgtgctcctggtggccaacgcgggcgaggtgatgctgggccaggtgggccaggcgcaggccaccgacccgacggcacgtgacttcaacgcacgcatggtcaccatgcactcagaggtcatccagcgcctggagcagctggccacggcccagggtatcgcgcccgcggagagcccggtgtcgcagcacctcgagcagacggtgcagaagaccgtcgacatggtgagcgccacgcaggcccctgccttcgacgtgtcggtgatggatgcgcaggtcgccgcccacgccggtaccgccctgctgggggattctctgctcgcgatgcaagtgcagaacccggcgctcaaggatgaactgatggcgattcggaagacggtccaggcccacctccaggaggcctcgaacatccagaccaccctctacaacgcgaagcagccgtagccgcgacgcgcagccgtccgcccgggagtcgcagccccgggcgtgacggcgcttcgcgcgtgacggcttccggacaatgcccccagtccctgggggcgatggcatggtgaacgcccgactccagcgagcgtcacagcaccttcacggccttgaccatgtccggcgacagctcctcgtgctggaggatggagaagcccagcttccggctgatggtctgcatggcgcggttgcccgcgaggatgtccgcgacgatgcgctccatgccccagtcccggccgacgtccaccagccgcttcagcatctccgcgcccagcccctgccgctgcaccgggtcgctgatgaggatggcgaattccgcgtcgcgcgtgcctcgcagccgcgtgagcctgcccacgccgagcagctctccgtccttgcgctccgccaccagcgccatctcccgcgcgtagtcgttgaagcagatgcgggacagccgcgcgtgcgccacgcgcgtgctcaactgcatcaaccccgcgtagcgcaggaacaccgtctgctccgacaacgtgcggtggaactccgccatcttcggctcgtcctccgggcggatgggccgcagcagaatctcctcgccgctgcgcaaccggtagggcgccacgtactggtccgggtacggctcgatggccagcttcggcagctctgcctccgtcaccgaggccgggtgcagcaccacgcgcgcgtccaaggccagcagccgctcgggcgaggccagcagcgggttgatgtccacctccttcacgaagcgctgctccgccaccaactggctgaagcgcaccatgagttgctccagcgccttcaggtctaccggtgggcgggcccggacgcccttcaatgcctcgtaaatgcgcgtctgctccatcatccgccgcgccagcgtggtgttcagc

SEQ ID NO: 899 - DNA, 8518 bp, Myxococcus xanthus
ctaaaggcctgctggtgttggtaggtacaactcgaaggcctcccgcaccaccaccgcctcgtactcattcaccacgaggcgcttgtccttcacctcgtagcccagcggcgcgcgtcctcccgtccacttccccttgcgcctcgcggcggccaccttgtcccgcgtccgctcggaaatcatctcccgctcgaactcggcgaaggacatcagcatgttcaacgtcagccgccccatggcgtccgccgtgctgaagttctgcgtcaccgagacgaaggaggcgcccgccgcattgaagcgctccatgactttcgcgaagtcgaggaggctgcgggagaggcggtccaccttgtagaccacgacgacgtccacccgcctcgcgtccacgtcctgcagcagccgctggaaagcgggccgctccatgttggcgccggtgaagccaccgtcgtcgtaactctcttccaccaacacccagccgggctggcgctgcacgtaggcgacacaggactcgcgctgggcgtcgaggctgttgaattccatctccaggcccgctgcggtggacttgcgcgtgtagacggcgcagcgcttctcctcggtgagcggtgctttgctcttcctcatggttcctccgtccccgctgtcgttgtcgggcgtgccggctcggcgctcgaggcctccttctgcccggcgagctgctccgcgacggccaccagccgctccacgttgtcgttgagacgccctagttggcggacgagctgcggcatcgtcgtctcatagaagcgctggcccatgtacgtttggaagaaggcgggtccgctcatcgcgtcaccgccttcgggctgccgtccttaaggccgaagaaggtgaagccattccaggccgtgcctgtaatcagcttggccacgctggagaggctgcggtgaagctgcccctcgtattcgattccctcctcgcgcaccgtcacccggtgctgagcgcctttgaatactcgcgtcagcaccgtgcccggcggcggcaggcgcacgtcgcgcccgtccgcagcggctgcgcgcccgtccacagcggctggaggaggcgactcggagggcttcgtctcctccacctgtcgcatccgccaccgctcgggcagcttgtcgcccaactccgaaatgcgtgcgacggcgcgcgtggagaggctcccttcggccaattcctgaatccggaaggccaggcgcttcttcaggtagtcccggttgcggctgcgcgtgggctcgccgtacagctccaggtacttcgccgccaaatccggcaccgacatgctggccagcgcggccagttgccgtggcacgtccgccagctccttacgcgcggcccgcgcaatccccttcttcgccatggtggtgtctccttcgtccggggcagcacgccctcgggcgagagccatggacgctctgtccccggaagaagacaagtcgagagtccgcggctcagccatgcgcgctctcctccgcaccccacgttggcgtctgtcgttgcggctgcgcatgccgacgcagccacagctcccaaagggcctcggacagcacgtccaccgcgtcgtcctggcgctgcttcggggtgctgagtcgccccccgactgaaacctcaaccgcatgctgcttcgacattcgcgtatccatcgtcatgacaaaggcctgagagcgaaatcgaggggatacatggcacccgcagcactcccgccaggacgaccccactcgccaaacgagaaacaccgggcatcgcagcacctccctgccgtggcccgtatgggccgcagcgggaagcgcttcagtggggcaaacgaagtgttctcgtcagggcccttgccggcttcacccggccggcgggaatcgccacgcatgggaggctcgcatccgttcgcttccaacgcgcataggcctcccacgccgtggccgtccatgcatagcttgtcttcctcagccccccattgaagacgtggctcgggtgcgggggcagcggaatcggctccgtcgcattcagccggccgcgaatcagcagcggcagccagctcgcgaaggcgagcaactcctccccgtagacagtccactccaggcgcagacgccgctcccccaaggggagccccacaccgctgaagccaaaccggcgcagcatggcttcggagggttcaaaaatgaatcggttcatcgaaatccgcgtcaccggcggcgcttcggggaaatgcctgtccggccaggagtggcgcgagagcgtcacccaattcagccactccccttgccgccataccagccgccgcccctggtgaagcatgggggccagcggctccatttccgacgccagacgttgaagaaactccgcccacagcttgctacgcgacagccttgtcatgactccacctcaagaatgggtttccacccagacacccgctcgaaagcactcactcaggacgccccttcctccgcgaagccatagccctggccgcgccacccacggcttgcctcctcgacgtgcgggaattcctccgcggagatgaagggcaccttcgcgacgtcaatcaccagggcacacctgcgcagggacttgccggcgaagcagacgcgctcgcttggggaaacgacgtaccctcccgcgcggtggttttcgtgaatgaggcgtcgcagcgccttcgtgtccaccatctctcctcggtagtcggtgcgcttgcagtacatccggaaggcgtcgtaggcggactccaggtggaggcacagccgtccctcgacgaaggcgtaatgcacgcggtgcttcagctcgccctgaatcgccatgttggacagcttctggatgaagacgtcgagggcgtttcgcacgccctcctcttcctcgaggacgtccttcagcacggcgtccacggcctcacgggcgcccaagtcggcgggcaacgggtagccgcactcctcggcgaactgctcgaagaggtgaatgcccagcagcatggccgtcacgttgtcgacgacgcgcggaggcacctgtcgccccttcacgaagtcgtccgcgacggcgcgggccaggcggtagtccgcgtcgaagtcccgacccaggcagaattgaatgtagcgaggggcaaagagggccaggcgcacagacgtcacctcgcggaaggccgcccggtaggccggctgctgcaccgtcgccttctccgggctgacgggaagaatgcgctccacgagtgccgcttccgtggcccgcgtctctccgcagacacacagcggggcctgcaagcggtaggtggacaccgtcaagtccggccggccccgctcctccgtctctcctcggtagaggcgccgcatgtagcggtgcaccaagtggaggcgcgccggcggcatgtcatggggcttgtactcgtccagcacccccggcacggagcgcgtctgagggcagcagtttcacgagggcgaattccgtctccgtcacgctgtaggcgtccgaggccggcacgccggccagcggccagaaaacttccgtgcaggtgctggacttgccgctgccctgcgtcccgtacgagaagagaatggggaaggagcccaccttctccaagaggcgcggcttcagcggcgtggcgaagaaccaccccagcatgggcagcaccacctgcggcgtgttgattcgcggcaggtactcgaaaaccgtgcgcgccacgtcgtggaagctgtcgtcgtccgtggcctcgtagcggacacgcgactcgagtgacgccccattgggcaggtacgccacgggcgacggggagagaaagccctccttcccaatggtgcatccaggcgccacccacacgtggtgcgccccctgtttgaagtcccccagcacactggtgcccggcagccgcggcaccgcacgccgcgccaccgcgcgcagcaacccctgtacgttgttgtcgctgcccgtccactgcgtgtggatggagggcaggtggtgtagcagctccttgcgcgagttgaaggcccgcctcggcagccgcgccccttccacgctggtgcccttgtccgtgcggacgtctccgaggaacacctccccctcctcggtttcgacgacggccttgggcgtgaaggtgaaagacgaaatcgccttcgcgtctccgcgctgcgtcaccgtgtagtagcagtacgcgtcctcgtacacctcgccgtcgatggtgtcatcaccgctgctgctcttcccgcctcccttggagtccgcgccctcctcgccctctcccgctgcggaagtgcgcacggcgcgggccatggacagccgaagcttctgcgcggccaggccggtgcgcacctccagcaggcccaggtacttctcctgcgcggacggaggacggtgggagatggcctccagaatgggcttgaggcgatacgccatctcctgggccggcaccgtggcgagcgcctccacggccttctcgatgtcgaagacgacgtcgtacagctcgcagcgcacgtccggctcgcggttgacgcggcagaagcccaggccctggagggagtggcagggcggcgccacggcgccatcctcgcgggcggtggccaccaccttttcgtaggccttggagatgtacaccttgccgtctctccccttcagcttcccgaggccccggcggtcgtactcgaggacgagctcggtgatttcgtcgaggcccaagcccttgtgcgcgaagaagcgcaccatgttgaagatggcgacgctccggtcctccgccccctgctcccacaggcgctgcaccgggccgcacatctccaccggctgcgcccagtcatactcccccgcctccgtccggcgggccttcaccgtcccctgcggggccgaggcagccggcgccagcggcatcgccacctgggctggacgcgccaggttcgccacgggctgctgcaccggcgcgcgcagcaggcgctccaggagtcctgcgtcttccacgcgctcgaagccggcgagcgcccgagctgctcggtgaggccgctccggtgtccccgcgccccttccggctgacggtgcccaccactttgatgatgcgggccacatcgtggatggagtccacgtgcacgcgttcggaagcgaagcgggcacgcacctcggcttcgaaggccttcaggcccgcctgcacgcgctcgtggctctcgccctccagcgactgcggcggcaaggcgaaccagagctgcgcgccgttgccgctcatcatcagccgcggtcgaacgagtccctgcgcttcgcaccaagccgcagcggcttccgccacctggagcgtcagcgagagctcgtcctcagtgctggccgtgtccttggggcgcacggggtccaggtccaccaccgtggccgtcaccgcctcgatgtccttgctgcccgccccagtcctcaaggggcgcaggacgttgggggccagctcgagcaagcgccggggccgcggctgaatgcccacgtacacgttgccgccggcattggccgccacgcaggccgcgacgaaggcctcctcgtcgtcgaagaagcccagaccgacgatgccaccgccgcccgggcggatgacgcggacctcgctcacgccatgcggcgcgtgcgctagccaccgccaggtggcgcggatggcgtcggggtttggagtgcttggagtggtatcagaaggtgtcgtcatcgaaggtgttcactccatgtagaggttcaatgggcgctggccgcagccgccactcccagcaccgcggcgtactgctggcggcgcttcacgtggtggcgccgcaggagcggcaccttcctgtcgaggaagtcgatgaggacggcgctcttcttgtcctcgtgcgggcgcatcaggcgtccgaggcgctggacggtgcgacccttggcgcagccggggtacaccacgaagacgcgcgagaggcgcggcaagtccagcccctcatccgccaagctggtggccacgaggacgcggacgcgtccagcacgagccttgtccaggagggccttgcgctccgcgcgcggcaccgcgctcgtcagcgcagcggcaggaatgcccgtggccgacagccgctgcgctagcagctcgcaatggtccacccgccccgtgaggacgaggcacaggtggcctgcccatgcttcgcgggccacggcgccaaggacgaggtcattgcgagccttgtcctccaccagcgcccccagcatgggcgcgtagtccgcggagccgacgtaggggtactcgaaggccgtctccacaacgcgcacctcgggcaccaccagcaccccgcgcgcgacgagttcctcgtgcctcaccaccgccaggggcgcacccaggtacaggcgcaagagcggcgtcagcccgtcctcccgctcgggcgtcgccgtcaggcccagtcggtagcgcgccgggcaacggtccacgattcggtggaaagcgcttgcaccaatgtggtgggcttcgtcgaggacgagcaggccgaagcggccgaggaaggcgtcgagcttcgcgtcctcccatcgggtgagggactggacgacggccacggtgacgggctgcacatcttcctcgcccgcgcccacgaggcctgcctccaggcccaggcgctcgcgcacgtgctctcgccattgctcggccaggtccagggtgtggacgagaacgagcgtctgagtgcggaggcgcgcaactgcaccgagagccaacatcgtgttgtggcacacaacgccattggcgacgaactcgtgcgtctcgggcaccgaaaggtccacgacgtcggcctcgccatcttcgatggactcgacggaaaggaacgccaccggaagttcgaggaaggcttcgatgggcaggcactccgtcgggcactccgagccccagcgctgcaccatccgctcgagcgcggcacgggaaggagcgtgctctccatggacgtagttgccgaaaatcctcccctcttggctgctccaggacaactgcttctgggcggttcgatagagccgctccaccagcccattgatggggacagtgtcgacgttagggtttctgcagcgcccctcggcacgagccaccgcctcgcggaggcgaagtctgttccagttcgatgagaaccccacttcacgttcgaaggtcgcgacgtcgttgacagtcactcgccagtacaactgctcgtatcccgcgacggtgcgcgagtggcgcgacgccagaatcccgagcccgaggagagcaacctggacctctcgggccattcgctcggaggcggtgcagaattcgataacccccttgagaggatcgacggaggcatcaccgtcgaacaggccgcgcaagaaggcgcgcatgatgtcgcgccccccgaagcggacggcccgtgggatgcacttccccgcggccctcgtgtagtcgagccccaaccacgccaaccactcacgcaacacgactgagcacaggaggtactgaattgagtcactcccgttgcgactgaggtcgatgccaatggaggcagcccagcgagaaatgaacccgacattgtccgcatccgcgttcgtgaactccgtcacgaggcgcttggtgagcgtcccctcggagaccaggaggccgcaggcctcggccgccacctcatcgagcaccaggcccttggggagcttcaagttcgccgcatacttgggctttacccagcggaatgcctcgggaagagaggagcgtccccacacctcgctgccgcgacgcaaggcgacgcggtccccaacgtggagttcgtccatgcgcacccaggcgagggcgtcatcacgcagcactcgaatgggatgctccggcgtcgcctccaactcatagccaagagcgagtcgggcccgtttcgttggtgagcgccccccgttgtagacggcgttcgtggttgcgcgacccgtcgacgtgtccacgccgacttccgtgaaggccgcatgttcctcgggaacgccgacggcaagctcagcggcggtgaccagtccacggtccgtgaagatgagggagtcatttttcacacacttcccgcctccacatgggagcaccgccgtccctggggtggccttcgccagccgctccacggcctcggcctggtagtcgcgcagcgccacctccggcagcttcggcaggcgcttgggcggcaacactcgcgcgtcctcgaaggacagcgtcaggcccgccccgtccgcagcccttcgcagcaggtgaatggccccgcgcggcagcaccagctcgcgtccctcctggcggaagaagtacagcgtctggggttccgcccccgggcgcttgcgcagccgcaccagcttccaatacgcggggttgggcagggagagcgcgcggcagagggcctccagcaccttgggcggcacgtcacccgccgcgagccgcagcccggcatccacacgcacgcgcagcgtccgcttgcccgtgctcgtgttgcgcgtaggcgctgacggcgcggcccccacgctggagtcatgggtgcgagagacaacacgtcccccgtccccgcgcatttcggagaagtcttccaccgttcttgtgttcctcaaataagcagtcgggggc

SEQ ID NO: 900 - DNA, 7713 bp, Myxococcus xanthus
gggctccggcggtgacgttgatatgccggggggcaccggttccgggacgccgcccgccgggtccagcgcatccagggcccgcttcacccgctcggcgttccagaccgactgggcgctcacctccgtccccttctccagagcaaaccggacgcggcgcaggtccgcggtcagctccgccagcgcgcgctgcacctccgctcggagcgcgtgatagcggggctcggcgggcgccacctccagcatctccgtcagcgcgatgagcgtcaccatcatcgaatccgcgccttcgaccagcaccagcagctgttcgccccggccgctctcccccgcccggcccatgcgcgtggaggccagcacggtgcgcgcttgttcgatgagctgacgcatgcgggcctgccagggcgcctccggcaggacacccgcggcggcggacgcccccccttcgagcggccagcgccccacctcttccgcatggtccgccagcgcgtcgtaacaccgcgcgatggccaggcgcgcgggccggtagggcaccagcggccacagcatcagcgcgaggaacatggcccacgcgccgcccaccaggaacaagccggagcgcagcaatgcgtcagccacgtcgttggcgggaagcgcgagcgacaccacgaagtagttggcgagcaccacgcccatcaacccgggcgtgtccccatacgagcgggcgaagccacacgccgtcacccagaacagcgtggcgatgacggcggcccacgcgggcaggtgcagcgccgcggccaggcccaccacggagcccaggagcgtcatggcgcccatggtgagcgcgcggtcccagtagggcccgccccggtccaccagggcaacgaagagcgcggccataccgacccacgtggccgcgggaaggtgcagcagggccgcgacggccatgggcccacccaccgcaagcgcggcgcggaccccggcgccatacgcgggacggcccggctccacgcggaggaaggcctggaggtgatgacggagcggactcatcgcgcgagcaattccaaaccactccgtcctatgtcacaggtccgcgcgcgcatcgacgcttccatggagccaccccacgaaggtggtgtccaggcgtgaacgcggccgggcccgttccaccggatggatggagggcgagcggccaggggcccgcgtcagccggcctctcgctccgggcccacgccctcgaagtcctcctcggcgggcgcggcctcctggaaggcgctgggcagcaggctgaagggcagcaccttccccaacgccgcgagcagcaggatgccgccgggcgccgcgaagatggccagcgcgggaatcgccttggccacatcgacgagttgcgcgcgcatgcgccggcgctcgtcgcccgtgagcgcctgacgccgggccgccttcgtcagcagcaccgccaggtcgcccgtctcgcggacctcctgcatcagccggtagaagttcttctccagcgcctcctggatgccggccaccaggtcctcgcccatggcgcccgcggcgtccgacacggtgaagacgtccacgatggcgcggtggcgggcgtagaactccgccatctccagctccagccggtgcagctccgcgtccgggacctggagcgcctgcgccagctcgcggatgaagacgcgctcacgccgcgtcttgcggccatccaccagcgccgccagcaacgtctgctccagcaggaagtggcgcacgtccacgctgcgcacctggcgcaccacgtcctgcaccgggcggcggcgggcgaaggactgcttcaccgcggccttgagctcggacgtcatcgccgccggcagccgcagggactccacctgccgcaggatggcgcggcgcgcgggcaggcccggcacccggtccacacacgcaagccccgtcagcacatccaccagcagcgccttctgccgcgccgcgaagtccagccgccgctgcgcccgctcgcggtgcagcgtgccgcgcgagaagtagtcgatggcctgccggcagaacagctgcgcgtccgcgtactgcgcgccgttgtgcaacaccagcccgtagaccgggtcccccgccagcacgggcgagcgcttcaccagcgacgcttccaccttcgccgtcagccgccgggacaccggacgccccgaggcaatcgccgcgtccaccgcctccgccagctccagctctccggtgagcaccgcgaacaggaccaggagatgctcggtgcgaacggccgctggagcccccacgagccggcccaattccagcgccatcagcgccagggtccgcaccacggcgcggaagagctggtcctccagcacgcgcgcctggagctcggtgggctgcgccacgtccgccgcggagggtgcgtccgcgggcgtgccgtacagcaggccactggcgcgcagcgtccgccgcaggtacgcgcgagcccgggcccgcccggagcccagcggcggcgcggacggagccggcgcgcccgcctcgaaggcgaccgtctccgtcaggagtggcaagagccaccccgccttggtgaagtccaacaccggaacacccctggagcgccaggcaaggcccatgcgcggcgcgaggaccgggatgtaacccaggggcattctggtttccactcggccacgggacagggtcaaggcccggaagtcagcgggcgtagaaccgccacttctaccggacccaaccatccgcgcccggtgcctacagcgcggtcgtcgcgccgggctccgggaccaccaccttggccgtattgcgcagcttcttcagctcgccggtcagcgcgtccggggtgccctgaagcagcgggaaggtgccgtagtgcatgggaatcacgctcttgaccttcaggagccgcaccgcctgggccgcctccgcggggcccatggtgaagtggccgccaatggggagcagggccacggagggcttgaactgggtggcgatgagcgacatgccctcgaagggtccggtgtcacccgcgtggtacagcgtaggccccttgtcgatttccagcacgtagcccacgggcgcgcccgcgtactgcgccggcgacttcgggtccgcggcgtagctgctggagtgaaccgcctctaccaggtggaacgtgacgtccttcacctggaaggtgccgcccgcgttggcgcccacggactgggcctccgggagccccagcaggttgatgagctcgaaggagccatagaccttggcgcccgtcttctcggccagcgccttggcctcgcccacgtggtcgaaatggccgtgggtgaggaggatggcgtccagcgcctccggctgcgcggcgcccttcggggccttggggttggagagccaggggtcgatggcaatcaccgcgccgcctgggctgcgaatcacgaaggccgcgtgcccccaccacgtcacctccgtcttgccgcgggtggccgccgccggggccttggtggccgcgaccttgccgggcgccggggtgccctgcgccgctgccgttccgccgaaggccattgccgcgcccgccaccactgccatgagcttcgtccgcatatccatccactcctgctttcgaggtgaagacctgccgccaccgtggtgacacgccccccacggccggattgccacctgacactgaccgggcggccattcaagggcccgccatggatgcccaagtgcacgccgcgtctcaagctcgattcggctgtcgatacgacggggggcgtgcgctaacgtcggcggtacgtggaccaccgatttcaagtcagcctccgcggggtcatcgacctcctgtcacatcacctgtacagctccccgggcgtctacgtacgcgagctgctccagaacgcgaccgatgccatccgcgcccgccagctcctggagcccggccacgcgggcaccgtccggctggagctgatggagaagcaggacggcagcccgcccaccctgctcttcaccgacgacggcgtggggctgaccgaggacgaaatccaccgcttcctggccaccatcggtgagtcctccaagcgcgaggccctggaggcccgccgcaacgacttcatcggccagttcggtatcggcctgctgtcctgcttcatggtgtgcgacgagctgctggtggtgacgcgctcggcacgcggcgacgggcgcacgttggagtggcggggccggcatgacggcacgtacgccgtgcggccctccgagcacccgctcgcccagcccggcacccaggtgttcctggtggcccgcccggacatggcgcattggttcaccgccacgcggctgcgaaacctcgccagccactacggcggcctgctgccctttcccatccacctcaccacggaccagggcaccgagcggctggacacctccggcgccccctggcgccgcgagtacgacagcgcctcggagcggcgcaaggcgctgctcgcctacgggcgcgagctgttcgacacggacttcgtcgactgcatccccctgcgctccaccgcgggagacgtggacggggtggcctacgtgctgcccgcgtcgccgcacttcaactcacgccagaagcaccgcgtgtacctcaagcacatgctgctgtcggagagcgcggagaacctgctgccggagtgggccttcttcgtgaagtgcgtggtgaacgccaacgcgctgcggcccaccgccagccgggagtccttctacgaggacgacgcgctcgccgcggcgcgcgagtccctggggcagtccctgcgcggctacctgatggagctggcgcgtgaggacccacgcgcgctccagcggctgattgccctgcacgggctgagcgtgaaggcgctggcgctggatgacgatgacttctaccgcctcatcatccactggctgcccttcgagacgtcgatggggatgatgacgctggcggactaccggcgcgcgcaccccgtggtgcgctacacgtccacgttggacggcttccggcagattgcccaggtggccggtgcccaaggcctgtgcatcatcaacgcggcgtacacgcacgacacgtcgctgctggagaagctgccgcacgcggtgccggacgtgcaggtggagcccttctcctccgcggacctgccgcagagcttcgatgagctcaccctggacgagcgcgaggccaccttcccgctgctgcgcatggcggagaacgtgctggcgccgttccgctgcggcgcggtggtgaagaagttctacccggcggaagtgcccacgctctacagctcggacgcggagggcgcgttccggcgcgacgccgagcgggctcgcgaggagtcggatgacctatacgccggcgtgctggacagcgtcatggcggcctcgggcagcgagccggcgcagttgtgcttcaacctccacaacccggtggtgcggcggctggccgccgtggcggaccgggacatgctgaagctgtcggtggagatgctctacgtgcaagcactgctcttgggacaccatccgttgaacgcacaggagatggtcctgctgaaccagggcctgttgggcctcatctccgcacaactgggcggggatggcgggcgcggcggcgaaggcagcggcggcgcgggtccccgggggctgcactgatgagtggtgactggcgcgagcaggtggagtcgctcttcgctcaggcggacggcctggctgaaggcgagagcaaggtgcggctcctggaagaggcggtgcgcctggcggacacgcacaaggacgtgggcatgggctaccggatgcgagatgccctcatcgacgcggcgaccttcggcggcttcccggacaaggcgctggtggccttcgcgtggtgccggggacagcagaagaaggacccgaagcgcttcgacccggaggagatgttctggaagcagaagtgggtggtggggcgcatcaaggagttccctcacatcacccgcaagcagattctggacgcgctggacgacgtggagcagtgcttcagggccacggactccggggtgcgcgcggtgctgaagatgcgctaccaggccgcgcgggagatgggtgacgccgccgaggaagtggagcggctgtggaacgcgtggctggagacgcgccgcgaccacctcaccgactgccgcgtgtgcgagctggacgacgaactggaccaccacgccgacaagggcgaatggcagcaggtgctgcgcaaggcgaagcccatcctggacggccgcaagtcctgcgcggagattccccacctgacgctgggcacggtgctctacccgctgttcaagctgggtgagctggagcacgcgcgcgaaatccaccgccgcggctacgccatggtgacgaagaaccgcgagttcctctccaccgtgggcgagcacatggagttcctcgccctgacggacaacctggcgcgcgggctgacgctgctggagaagcacctgggctgggcgctggaccacccgagctaccgggaccgcttcaccttctacgccgccgccgccttcctgctggagcgggtgctggccgcgggagacagggacgtggtgagcctgcggctgcccaagacgttccccaatcaccaggcggatggcggctacgacgtccgggccctgcatgcctggacgctggggcaggcccgggacatcgcgaaccgcttcgacacacgcaacgggacggaccggttcgcgaagctgctggcgcgcaaccaggtgctcgcgggggaagtccgtcccttccccatcgacgcgaagtgaggcgacgccccgtcagcgcttgagcttgctgaacgggttgttgaacggctccgggcctttcttctcaccgggccccgaagccggcttcggccccgggccggaggcaggccgggcgccctgacgaggcccgccgcttccgccaccgcgctccgtcatgcggctcggtcccgtggccccgccgacggggggacggcccgacggctgcggcgctccaccctcctgcaccgcgcgcacggagagcgccagccgcttgcgcgccaggtccacggtgagcacgcgcaccgtcagccggtcgcccaccttcaccacttcggaggggtccttcacgaagcgcgtggagatttgcgacacgtggacgaggccgtcctggtgcacgcccacgtccacgaaggcgccgaacgcggtgacgttcgtcaccacgccctggagcaccatgccctccttcacgtcctccagcgagcgcaggtcctcgcggtgctggggcgcggtgaagtcgccgcgcgggtcgcggctgggcttctccagctccgccaggatgtccttgagcgtcatctcgcccaggtccgggcccaggtagcgcttcaggtcaatcttgcggaccagctcggcattgcccaccagcgcgctcacggccacgcccaaatccttggccatgcgctccacgacgccgtagcgctccggatggacggcgctggcgtccagcggctccgtcccacgcacgcgcaggaagcccgccgcctgttcgaacgtcttgggccccaggccactcaccttcagcagctcgcgccgcgtggtgaagcggcccttcgacgcgcggtgcgccaccagcttcttcgccagggacggccccacgccggacacgtgctccaacaactgcggagacgcggtgttgacgtccacgcccaccgcgttgacgcacgagtccaccacctcacccagcttcttcttgagcagccccggtccacgtcggctctttagagca

SEQ ID NO: 901 - DNA, 6739 bp, Myxococcus xanthus
tcgcccaacgacgtctgcagcccgtctggaagcgcctcgaggatgtcgagcatctcggcgctcttgagcgcccccgacagtgaccagccgtgcgcgccgtcgttgccataccggaggttgtcgatgaggctctggttccagagactgatcgccggatccacccaggccgtggtgcgccgcagccgctcgacagcggcctgatcgagcacctgcccgtcgaccttgatctcgccgcgcgccggccggagccagccgagcaaaaggccgaccagcgtcgacttgcctgctccggagacaccgaccacggccacgtgctcgccgggggcgatgttcaaggaaaccttgtcgaggatggtgtgaccgccgcctttcacgcggaccttctccatcacgatcgaaacgccgctcgcggcgtccgcgggcgcgacaggctcctgcactggcgcctcgggccgggccggaggctccttgatatcgccgatgacgtcgaggagccggcgaacccggttcatcgcattcgggaacgcgcggctcagcatcatcagccgctggccgaggatggggaaccgcagcgcccaatagacgaccaacaacaccagcgaagcccgatccgtgcccgcgaggtacgaatagacgagcagcatgacgaggccgtagctccccagcatcagcccgccttcgaacccgaccgacagcgtctggagccaatagcgcgccttgctccagctgacgagcaaggtctcctgcgcgcggcgcagcgaccgctcggcgccgtggatccggatcggcgtgagcccgacgagcgcgttcagggtgaatccgctgagcgcgcctgcgtgcatctgcacgcgcaggtcaggctcgaagagcagcttctgcgcgaccaggggcacgagcagcgtgaccgccgcgagcgcgagcacgatgcgccatgcgtgcggtgcggcccagatgagcgcggcagtgatgctcgcgacttcgagcgacaggaccagggcctgcgcgagcaggggcggcagcgaccgcatcgcctggatgttgtgcgtgcgagacgccatgtcggaggcgagccggctctggaaatagcggtcctccatctcggggagcttctcgaaatacgccttccgcagccgcacctcgagccggcggccgatgccgagcaatcccaatgaaatggggatttggatgagcatgaagcagagcgcgacgcccgcaagaacggccatgcccgtcgcacgctgcgcgaacgtgccgaggtcgcgccccaggtcgagcacgccacggagcatcagcgattgcaggatccgcccgaaggtggcgaacaccagtcccaccgcaatcaggcccggaacgacccacgaatcttcgcctcgcaggcggagcagcgttcgcgccggactcacctgcttggcgatgagctccgtcgccaggtcgctcgcgagcacggctctcggcgcgtcttcgccttcgcgcggagcctcgcgccaaccgcgaacccgcatcagcaccgcgccggtcatcgacagctcgccctccacctcggggttggggcgaacggaccaataggcagcgggaatgggcacttcgctggaatcgtcctttgcaatcatggattgcagcagacccgccgccatccggcctcgccggacggcgcccgcgcggatcatcgcttcggacgcccggcacgcggcgtcaagcctggcgatcgatagatacccagggtccttgagcgcccgggcaaccagcgcccgcgcctgcgtcgcacccaggttcagcaggcggcgctcgaacgtcgcgaccgcctcctcggacccagcccattcgcgccagccggtcgccggaacggacgtggtgtgctggtacaggtggctcagcagcgtcgaaatccgggtccagtgacgccccgccgccgggtccatgacctggatgaacgggccgacgcgattccacagcaccacgaagtgcggccgtcctcccgcgctgagcgtgacgatgatggcaggaagcgccttggcttcggggaccaccacgtgatcgagcggaagcatcacctgctcggcgtcgagcccgagctggttcgcgacttcatccaaggtgacgatcgaggtgccatcgacgtccgtctgacacacttcgcgaaggacgcgatagttgagctcggcgcccatccccgcgaacaggctcttgagtgaagcggggccgcaatccgtcgccgagatctggatcacctcgggaatgattgagcgccggcgcctgggaggagtcatggtcagcgggcctcggcttcgggccggaacacgttcgtgggccgttcttcaggctgcggattccattcgccgaccgcccgcatcagcagcgcgacaggcgacgcccgcgcgacctcgacctccaccgacagggtcatgccgtggcgcagctggatgcgcggatcgtccggcggtgcgaacttgagctcgacgcgcaccgtaccggggatggcctcgggcgtggcggtctggccgggctcggtcccgacggccgtcacccgggcggggaccgtcccgtagatggtcatcgggtagccgtcgagcttgaggcgcgccgtttgaccgggctggatcaatccgacgacctccttcgggaaacgggcgcgcacccgcacctcggcattgctcgcgacgatggtgccgacccgctgcccgtcggcaatgaacgctcccgagccgagttccgccacgtcgaccaggtggcccgtggccggcgcccgatacagcttccgctcgatctggtactcaaggcggtcgatggtcccctggagctcccggatccgcccctcggcgcccagcgcctcgcgctcgagttccagcaactgcgcggcgagggcttgacggcgcacgttctgctcgcgccgcagtcggatgagcgccaggccctgcgccgtctgcgcgaagcggagcgcgtcgacatcggtcgtgcgctcgagcttctccatctccgagaccgcgcccgccgggctcttgaaggccagctccgcgcgttccaccgcgagccggtgcctgggcgcgagctcctgttccctccccagcgcctccttgactgcgacctcgtccacccgtgccgtcaaagccgcctcttcgtgcttgttggtgatctgctggcggatgatggcgagctccttctcggtcgcggcgagcgtcgcattgctccgctcgagctcgaggcgctcggcccgtgcgtcgaactcgatgagaaggtcgccttccttgacctcctggtcgagtttgagcagcgagagcacgaccctgcccgcgctgggcggctcgatgcgatggacggcgttgtgtggctcgatccgggcctgtgagctggccttgacgagcgggaccttggcgaacagcgaccatgcgatgagcccgccggcacacaacaccatcagagcgacgaacacgaggcgcgtgtccgactcgtagttcagggaacgaagggtccgctcgaagggatatgccatggtccgctaaccaaagtcgccttaatggtcttgccctgtcaacacctcggccactgctttgtgattcacgttcccattgcctgaatacgagcacctcgatgcgacgcgggacgtcgtccgcatcgccgcaatgcgccacacattgtttttggctcgatttgacatccaacttcgagttcacttagcgtttaactcgaaaggaggcacgacatgaagatcaagatccacgttcgcggcggcccgaaggcgcgttagtagtcaggcgttttgatgccagctgttaaggctggtcgttcctcgttttcgatcaccagaggggggttgatgaggattttccatcagcccctcctcttatttctggttctggcaacgtcttgatcttgcaggtgctcgttcctgccaggttgctccagaacctctcatgcgcttgaaccgaatatgcgctgcatgcgggcgcccccctcccctcctgcgaaggtaggcaggatggcgcggcagcgacaggtctctgaggccgttgctggaggggccgagattctatgccgctcggcgctcgtatcggtgatggagcccgaagacctcgctcaactctagcaccttggctccacgctccgggccgtgcacctcacgccgctcaagtgcatccttaccgagcgacaggtgcgttcagctcgcgttgtagtagcgcttgtactcgcgcagtaggcgccgtgcgtgggcttcgttcaggatgacgacatggtccagcagctcccgacgaattgagccaatgactctctcggcataagatgtctgccacggacaacaatatgtttttcgaagaagtggctgcgccatttcgtcggcgtctgcgaccaggttacctcgagggcactggtgctcgcgtcgacaccaaggccagagtttgagccattgcgccagtcgagcccattgttcgatgaaatgggcacttcgattcgctcgccttgtctccactcatgccctgcgctcctcgtttcggtttcggccagctgtcacagaagggccacgacctgctcctccccatcgacggcttcgaggaacagcacctcctcctggatgtcgggcgccagcaaccgcaagtccagcaggtgcgtcacacgcgcccaggtaaagcccagttgaccggcgacgtccgccgcgctcgccacgagccccctctcaatggcggactccagatggtgcgccagggccagcattcccgcgacgtgtgccggccggcgcgacacctctcgcggcgacggtggtgccccctctcgaaaacgcaccttcgagcgacgcacgcggtggacgtgtgcgctgacgaggccggcctccgcctgctgggcttcggggctcgcgctcacgccgccgcctccgagccgttgctgtcgagaggaaggcgctcattctcgacgaagcgggtgagggcctcccactgcgtcagtgcgtaggaaatggcctggccgagcggactcttgggcgggtggcgcggggcctgcgcctccagccaggtacgcagttgcgcgaggacgggggcgctgtgcaattggcggacggcggtgcgcaccacgtccgcctcacgtgcctgtgcctcgacgcggacagcgggcgcgcactcctctacgtcaaccgagggggccaggagacgcgcctggccgaggtgctccgctccgccgctggcacccgcgacgacgtcggcgagttccgctcgctcgcctcggacaggcagttggccgaagtcggagtgggattcccgccgtaccatggcctgtgccgcaccacgacgctcggaatctcttggagcgagatgaagtccccagcatttcgaagtgagcatgcaggcgcatgcggtattcttcggtgcagccatccctacgttggggggctctgacagggaggtagttggtggagaccgaggtgacagaaatcgctccaagactctaccggctctccacctacatcagcggcgccaacctcctctacaaccagttcctcatcgacgctgaggagccgtcgctgttccacctcgggcccagggcgttgttcccgctggtgtcggccgcagtgcgcaaagtgcttccgctcgagcggctccggtggctcaccttcgggcatgtagaagcagacgagtgtggggcgatgaactcctggctggccgcagcgcctcatgcacaggtcgcgcacggcgccatggggtgtctcgtctcggtgaacgacctcgccgataggccgccacgcccgctgcaggacggcgaagtcatggacctgggcggtaagcggctgcggagaatcgagacacctcacgtaccgcatggctgggacgcaggactgttccttgaggaagctaccggaacgctgttgtgtggagacctgttcaccgcgatgggcgacgcgccggccctgacagcacaggacatcgtcgggcccgcactcgctaccgaggatggcggccacgcgacctgtctgacgcctgcgactggccccacgattcgtgctctggctgcgctgcgaccgcgaacgctcggcctcatgcacggcccctcctatactggagactgcgcacgggcgctgcaggacctcgctgcggcctacgacgagaggctcgacgccgacctcgctcgccggcgtggaacgcggctctgacaaacaccgcatgcggtagacctgtgcctacccaaaattcggtcgctgcgtcatggcgtgcgtcaaggcgagtgattgaggcgccccggccgccctcgtaccgcgggtacctcggcagcaggcccctcctcgcgtgcggagtgtggctcgcgtcctcgcccctgaaagggcaagccggatgctccgggcctgtcggccccttgcacgggctgggggcgctcgccgtcaggcgcggtgtcggtgggcctcgaaaaatgctgctgggagggctgctgctcgtcctgcttcaggcgtttcacatccaaccttctgcccctccgccgggggccaagcccatcggtttcaaccttggggcgggggacaccgtaaacgccgccttcgcccggctcacccgcaagcccctgcccgccaatgtcctccaggatgccttctcccgcatggagcccagcctggccccggtgccctccgcgctcgccaccgccgcggcccacgcgaaggagccggcttcaaccccgacgccggcatccagggcctggtcgacctgagcgtcctggacgaggtgcgcggcgcggcgaagcaataggcgcgtgctacctcttgtagagctcg

SEQ ID NO: 902 - DNA, 7562 bp, Myxococcus xanthus
ccgcatcctcgccgttcccatcaccccgtcccgcgccggacacctgacggactatcagcaactgccacagcgcgagcgagaggagttggagcacttcttcctcgccgccgtgcgcttcgaggacaagcacgcgcgcatcctgggctggcaggggccgcagggtgtcgagcggatgctccgccaacacgcacgcacggaggaatagatggctcaacccacgcccatccgagggctcgggcccgacagccgcctgggagacgccgcgcgccgcatcctcgcgggccggctcgcggacgttcgcaaaccggaggccggcttccaggacgccgtggatgacgcgtccgtccatgacatgcgcgtggccacccggcggcttcgcgccgccctcaaggtgttccgctccctgggcggcatgaagaagctggagcgcgacgtgaagcgcatccaggacgcgctggggggcgttcgggacgtgcacgtccagtccgcgtggctggagagcgtggcccggaaggcgagcaagaatccccaggtgcgcgccggcatccagaccctgcgcaagaagcgactgtccgagctggagacgcacgagacgcgcttgcacgcggagctggagcgctggatggacaggacggtgccccggctcttgcgcaagctggatgggctcgatgacgggcaccgcttcgccggccgccgcgtccgggacgcgctgcgccaacgcctcaagcgcgtgcagaagggaatcgacacatacgtggacgcggccgacgcggcatccgcccatgagctgcgcaaggagctgaagcggctgcgctacgagctggagatcttccagcctgccatccgccgcaccctggacgcgctgctggaggtgctcgtgccgctccaggatggcctgggcgagctgcacgacgccgacgtgcgcctggagctgttcgagcggctggccgcggagtcggcgccgcgcgagcgcaagtccgcgcgggccctgctccccctggtccgggaggaacgaacgaagcgcgcggcggagactgcccgcgaggtccagcggtggcgcacggaagagattcccaagcgcttgcgccgcatgttgacctgagcccctgtcagccgccgcgcctcacggctcctgcgggcacccagggcccgtacagtctgtctaatcattcatcgcgcattccgttacatgtaattgaagggcatggcgacggagagcgtatggatgagctgctcggtctccgcatagggcctgcgcgtgaagacgttgaggtagcccacctccacggaggagtggtccccgtacttccagcccgcgccaacgaacacgcggttcatgtcgaagccggcgctggggccattcgccaccgagctgaggtggtagaagacctcatcccagacaatcaacgacagccgcccctccgcggccacggggtgcgcaccgcgcaacatgacgcggccccggtgggagacctccgtcgtgccgggcaggaagcgctgctccagacgggcgcggagcgtgccccggacctgggcgaacttcggcgtgtagaggaactgctggaagagccggctttcgccctgacgcaaggccgggtcgccctcccagcgccacgatggaaaccagccctgccccagccacagcgacatgtcctgggccaaccggacgcctcccgccgagcggaggatgccgcgggcgtcgtccttgccgaagcgcggctgggcctccaggtaatagaggaggtgttccccgatgcccccctgcgccgacaccgtgtaccagagctgagcttccgcgcggacgggccgggcctccacggtgtgacaggggatgaccagcaacagaccgatgagggggagccaattctccgtgcgcatgatgcgaatgcctagagcacgacacgtacaccggctcaactgggcaaagcgcgagtgcggtctgaccgacgataccgcggccgcttcgcacaccccgaggccggaatggcgcgtccgcccttcaccgtgggggagggacggacggtccctgtcgcctactgcgtgggctgctgggagcccggggtggactggccactctccggcgcggccggcgccgtgggctggacctgtgaggtcgcctcgatgcgcaccgcctggggctctccgctctgctcgtcggtccggtacgaggcccggacctgactgccctcctggatttccccagcgctggcctggcgcccatccaccatgacctgcgtctgcggtgacacctgcaggcgcagctgcggctcgccctgtgagctgagcagcagctcgtcatcattggcgctcagcacctcaccgacgatttgctgctccgagccctgctgggcctgggcgccctgcggctcgggcgccacggcccctggctgctgtgcctgctggcgaagctgctcggactgctgacgagcctgctggttctgctgcgccagcgcgtcgctctgctttcgctgcgcctcctgctgggcctgcggcacctggtcgttcaccgcggactgcccgcttgcctgcccttgggtcccccggtcgcgttcttcacacgctgtccccagcatcagcgccgcggcgcccgccaacagccatcccgcgcgaaatctcattggacgcctcccgtctccatgcacgtcccagaaggaagatggcgagcggcgtcctcgcgccaacccgcatccgatccaggcgtccgccctcccggccgccctcctcccacttgttggtgcacgaagcgctacccatggctggggtttaacggtaaggggcgccccccatgcgtgcgtgcggactcgatttcggaaccagcaacaccgccgcggccctgcctgacggcacggtgctgtccctgcaacccaatacctcggaggcccgtctcttccgctccgtcctcttcttcccggacgacgagcaggacatctacgccggcgccggcgccatccagcgctacctggaggacaacaccggacgcttcatccagtccgtgaagtccttccttcactccagctccttccgcgccacccaggtgaaggggcgcacctacaccatcgaggagctggtggccgtgctgctgcgccgcgtgcgggacgccgccgcgagcgccatgggtggcgcgcccgaagccgtcgtgctcggccggcccgccgtcttcacgccggacccggaggcggatgccctggcccagcagcgcctgctgcgcgccgcggagctcgcgggcttccagcacgtccagttcctcatcgagcccatcgccgcggcgctcgcctatgaggcgcagctcacacgcgacgagctcgtgctggtggcggacttcggcgccggcaccaccgacctcaccctgatgcgcctgggccccagccgccgcggcaacccggaccgccgccaggacgtggtgggctccacgggcgtgcgcatcggtggtgaccgcttcgacgcggaaatcatgcgccacaagctgctgccccgcttcggcgccggctccacctaccaggtgcgcggtttcagcgacaagcggctgcccattccccagcacatcatggccaagctgctcacctggcacgagatgtccttcatccgggagaggtcgacccaggagctgctggagaccatgctcaacacgagcgaccgcaaggccgaaatccaggccctgtacgacctcgtcatggacaacctgggctaccgcctgttccgcgccattgaagcggccaaggtgcgcctgtcccaggaagacacggccacggtggacttcgaggaggcccgcatcaccctccacgagcccatcacccgcgaggagttcgacaccttcagccaaccgctgctggacgagctggacgcgtgcaccgcgggcctgctggagaagcacgcggaggcgaaggacatcgacgcggtgttcctcaccggtggctcgtcacagattcccgcggtgcgccagctctacatgcgccgcttcggcgaggggcgcgtgcgcaccgcggatgccttcacctccgtggccgaagggctcgggcgcgcggcggcgcacctctccgtctgagcctgacgcccggggcggggcctacgggcccacgtccacggtgcggctgagccaccccaccccgccccgcccatcccgcgccaccacccagaaggtgacgcgctggggcgtggcgggggtgtcgtacgccgacgtcgggtcacccggccggccttccacgggctcctgggagcggaactccttcacctcgccgtcgccagtggcgaaccaactgaagaagacctgctcggggcgcgagccttcgtccgtctcttcgatttcgacgctgccctcggccagcaccggcgtgaaggtcacctcgcgcgacacgggcagcgggccggtgagcggcgcgccgtcccacaggacgtccgacaccaccgggttctggttgggcgtggtggtggcccgcaacgtcacccggcgcacgccgcgctccgtgccttccggtgtgccgctgccgtccgtggcctcgtaaccgatgaagagcggaatgccccgggccagcgcctcgcgcagcgccgggtcctcggggtccagcgttccaccgccccccggattgcccgcggccagtgcctccagcaacaccgcctgcacgtccgggtccgagagcgacaactcgccgtccggcaacggcacgctgtcgtcccccgggcaccgcccgtcatagggattgccagtgaagcggcacagcgcgtagcggacggtgacggggcgcgcgtccggcgtcaccgccagcgcgttgaacgtcatgggcccgggcagcgtggaggcgtccgggtccaccaccagctcggcgggctccgcctggatggccagcacgcgcacgcgccggatttcgctctgaagctcgaagtcgggcccgcagccggcgagcagcaccaccacgagcgcggggaggatggaacgcatgctcagaagctcccccgggcgccgatgatgggaaggatgggcagtccttcgaagaaagcgctttgggtgtagttgtagttgtaggcgatgccttccaccgccgggttgttgtaggcgttcgtgaggtccaggtagacgttgagcgcccacttctcgaaggcgaagttcttgtccacgcggatgtccaactggttgaaggacggcagccggcgcgagttcaccgccgcgtagagcgggatgaagacgtccgacccatcgtcgcgcaccgagcccaccaccggcgtcgtgggattgcccgaagcgaagcgcatgcgcgcacccacctcccagcccgccggcagcttgtaggacgcaatcgctgtcagcacgtgcgtctggtcattgtcgaagaggcgccagcccacgcccggcgcgtcctggcgctcgctgcggctgagcgtgtaggagacccagccgaagagccggtccgtcagcgcgcggcgcaccagcacctccaggccatagatgcggcccacgccgccgttgctcaaccgctcgggcacccgctggccgttgcgcaccaccgtggcgttggagcggacgatgagcccgtccaggtcgttgtagaagacctcgccgcccacgaaccactccggccgcgcctgccactccgcgcccacgctgtactggagcgaccgcttcgcgcgcaggtccgggttgccgaaggccacgctcggctcatcctgcacgggtggcccgtgatagacgcccgcgccgcccttgagcgtcagcgtgtccgtcaggccgtagcggaccgccagacgcgggttgaaggtgcgacgggcctgggtctggtcggtgaagatgtagctctccgcgcgcaggcccggcaccagcagcaggcgcggcacggggcgccagcgcgcctccacccaggtggaggggaagtactggaggaagtcgccgtccgcggtgagcacgtcatcggtgacggtgggcgtgggcggctccccctcgcgggagaggccctggatgcgcgcggtgacgcgggcgaagttgctcaccacgtcgatgccgcccgccagcgtgagcgcctccccgaaggcgtactccacggtggagcgcaggttcaggtccgtggaggcgatgcgcaggccacggtcgccgatgccaaactggaccagcgtgttgcccaccaggccgtgcgtgtccagggtgagcgcgtccgcgcggtactggtgccgcaggcgcaactggttgaagccggtggtgacgttcagcccaccggtgacggtggggtcgtcgtccgccggccggtcgaagacgagccccagcctgtctctggaggtgagtccctgcagcgtgaaggtgtggcgcgacctcggcttccacaccagcttgagctgcgcgtcgtagtaacgcggcgccacctggaggctggggccgttgtcgccctgtggcaccaggcccagcaccaggtcgatgtacgaacgccgtcccgccaccgcgaagctcagcgtgtcggtgatgggcccctccaccaccgcgttggattcgatgaggctgacgcccacggtggcgtggagccggtccgtgcgcggctcgcggctgcgcacgttgatgacgccgccggtgatatctccgtagtacgcggagaagttgccgggcaggtagtccaccgcctccagcagctccgagttgtagacggaggtgaggccgccgaagtggtagagcagcggaatccgctggccgtcgaggaagacgccggactcctgcgggcccgtgccgcggatgacgagctggccaccgttgaaggcggggcgcgccacgccgggcaggttctgcaccaccttcagcgtgtcaccctgggtgccggggacgcgctgcacctcggccagttggagcgtggtctgcgtcacttccttgcgctcgcgttcgctgcgcaccaccgtctcgaacgcgccgaagatgcgcttgcgcacgtagtacgtggcgcgcgtctcctggccttccgtgaaggtctcctcggtgcggaagcgctcgtagccgctctgcaccaccagcacctcatacgtgcccagggggatgccgcggaaggagaagcggccttcctcgtcggtgacggtggagcgctccagcgcgggcagcaccacctccgcgcccaggagcgcgtctcgcgtgccccgctccagcgcccggccgctgaagttcactggagcctcgggctccacggcggcggcgtcctcaccctccggcggcggcggtggacggaagacgaactggtaggcgtattcgatgcgcaccggcgcggggacatcgtccacctcggcgggctcgaactgaaactggcggaccgcctccacggcggcctcgtcgaagccgtggccggcgggttgggacacctcgacgttggagacggcgcccgtctccgagatgtcgacccacatcaccaccgtgccctcgagctgctgggccgcggcttccggtggatagagtgcctccacctggcgcatcagcgcggggggcttcgtcagcacgccctggggcgcgccggcgtcggcatccgtgacgcccgcgtcctgctgagcggcggcgccagtggcggcgaggaagcagaggacggcgaggaggattttcatgaggggcgccg

SEQ ID NO: 903 - DNA, 9325 bp, Myxococcus xanthus
  unsure (1)..(9325): unsure at all n locations
tctaaagtcgaatgctgtttaatctggagttcctcccgtggagctggaacacccgcatctggcggtcctgctgctcaccaccgaggccgacctgcgcgatgcgcgcgaggccttggatggcagcgaggagtcacgccttcgctacgtcgccgcggagagccgcgcggaggccgcgtacttcctggcgtgggacctgctggaagtcgacccgcgcatgggccgggcctgagcgcctggcacgcgtgtcccgcctttggacggcgcgtccgcgtgccggacgacccgtgagcagggtgctgctgtagggaatcgtggtccaggatgtgcacaaggcgcggtgcgtgcgtcgggtgctctgggtgggatggtgtttgggttggtggctggcgggggcgctgcccgtgcatgccgcgccgtatgaagtggagcccgagtccgtgggcgcgcaggacctgctcgcgctcgtggaagagggtgccatctccgccgagacactctccgcactgctggccttgcggcggactggcgtggacctggggctggcgtcccgtgcctcgctctacggcttgccggggctgacttactcggacgtggacgtgctgctgcggtcgcgcggagaaggcagcgccgcgggtggcgcgttgacggaggcggcgtcgcggcggctcgcgccgttcctggacgtgcggacgccggggcggttgtcgggtgatgcacggttgatgatggccttcgcggcgtcggatgggctgccgccgccgctggcattgcaggtccgcgctggagggctcgcggggcttcgagcggggctgatgacgacgctggcccggcggacgctggcgcctccgcgcagggacgcgcggcgacgtgccttcgtggtggaggcacccgggacatccgtcacgctgcccaagctgtacgtgcagtggacgggagcgcgcgcgtcgctgctggcggggacgtatcggctgggcttcgggcaacggctcacactggacaccacggcgctgccgtcacccgacgggttccttcctgatgatgacgtgcgtcctccggcgggattggagcgctcgtgtctggtgggcagtgcgggttgtgagcccgaggaacgcctgtcggacgtcaccccggacttccgctgggacgagggcttccggggcgtcgctggcacggtgcgaggcccgctggggacgtgggccgcgctgtcgctcaccggcttcggctcgtatcagtcccgtgcgctggcacggcatgcggtgctggaccgctcgctgtgtccgtcgtccgcccgtggcgcgtgcaaggcccctgacgtctgggtgtccgtggcggagggccggtgggagaagctgacggcgcggacgctgtcggggatgttccgagagctggcgggcggtggcaacgcgacgctggcgatgtcgtcgcggagccatgtggggctcaccggttggatggctcgacctatgtgggggcaggagggggcgaagctcgacttccagcccaatgcccgctacccggcgggcggtgcctttggcgcattcgggctcgacgccgcgtgggggcgtggcgcgctggacgtcttcttggaaggcacgcgcagcttcgatgccgcgccgggtggcggcggggacttcggtgcggtgcagcgcaccgtgctgtcagggggggcgcgcgagctggagctgtcgctgcgctactacgggcgcggtttcgccaatccctacagcggcgcgccgtcaggcccggatgcgctggaaggcctgcgcgttcgcaacgagctgggcgcccggctgcgctacctccaccgtgaggaaggcgcatggcggctgcgagggcaggtggacgcctggacgctgcccgcggatggggcggtgtctgggagcgcgggcacgctgcacgcgcgtgcctcggtgcgcggggaccttcgggtgcggccctggttgcagccctcgctccaggtggagttgcgtgacaacggcgtgggcgggatgggggcgtgcgcggatgactcgctctccgcgcaagatgtggcggacctgtgcgccagcgcgcggtacggcgtcaccgcccgggtgcgctccgacgtcgcgaaggggctgacggtttcgctccagtacggacacgcgcgcgtgcaggcccccgagacgaagggacttcgctacgacgcgcaggccgtgctggatgtccgcgcccagccgctctcgtcgctgaagttgcatgggcgattggtgtggaaggaccaggacctctccgagcgcagccggctccaacaggagctgcggaccgcgctggatgtcgcgtggagggtgtcgagcgccgtgtccgcccggggccggtacgcgtgggtgctcgacttgaaggacgcgcgcgtggcgcgtgtgcctcccgacccgccgcgccacctcttccacctggagttggagacgcgcttttgacggagctgaacgtgagggggcagggaatgaagggttggggcaggtacttggggtggggctggttgctggggttggcgggcgcgtgggcgtgtgggggaacgcccctggacgaagacgtggacgcggcgtgcgcggggctgttgcccggtgatgtcgccatcaccgagtacctcaacgacccggtggggacggacacgggccatgagtacgtggagctgcacaaccccacgcgcggccccgtggacctgtatgggctgacgctctacgcgtcccgcgcggatggctcgcaggagacggcctatgccttcctcgagaagatgacggtggcagcgggagactatctggtgctgggcgacgtgcgcgacgggccggtgcccgcgcacgtggaccacgcctatggcgacgggctgggggcgttggggaactcgggcggacggctgggcatccgatgcggtgagcgggtattggacgaagtcccgctctccgcgcccgcgaagagtggggcgtcgcgcatctacgacggccgcctggtgccggacatggcggggaacgacgacctggcgcgctggtgtgactcgcccgacgccggtgccggcgggacgttccaggggagtcctggcgccgcgaacgcaccttgtggccccgtgggcgacgcgggtgtccccgaggacgcgggcgtggtggcgacgtgcaggcccgcgggcggcgatgccgtgagacctgtcctgcttccggcgcctggagacctggtcatcactgagttcatggccaatccgcgtggcgacgacacgttgggtgagtgggtggagctgcgagccacggcccccgtggacctcaacggcgtgacgctggtcgccgaggcgggtgaggcgacgctgaaggcggggggttgcctgtcgctctcggcgggggagtacgcggtgctggcccgtcgcacggatgccaccctcaacggagggcttcccccgcccgtggcgacgttcaacatggacctgcgcaatgcgggtggtcggttgcaggtgaaggccgggggcgtggtggtcgacgcggtcgattacgctctggcggtggatggcgtggccacgcaggtgtccgcaccgctcgcggatgctgtccagaatgacgcgccctccgcatggtgcgcagccacggccgcctatggctcgcgcggcaacgtggggacgcccggtcgtgggaatcgtgtctgtgagggagacgggggcacgctgggcggcgttggcgacggtggaaccttcgatggcggcgtggatgccgggacgctcgaggacggatgtattgaccggaccactggaaggacgcgtgcgcgcaggggggcccgatgggggctcgcttgtcctcaccgaattcatggcggacccacaggcggtagcggacgccatgggggagtgggtggaggtgctcgcgctgcgcgacgtggacctcaatggtgtgtcgctgtccaatgagagcggaggccgctcgactttcgattcggcgctgtgtctggccgtgaaggcaggaggccgcgcggtcctggcgcgcagtgaggatgcgtccctcaatggtgggctgcccgcggtgctcggcaccttcaacttcaacctggcgaatacaacgggcagccggaagctcgagctctcggtggacgggcgcgtgctcgacgccgtgtcgtggaccggcgcggccatcccaggtgtgtcctcacagctcgaccccgggcgcagtgatcctcaacgcaatgactggcccgggagcttctgtcccacccccgattcggcccgctatggccggggagaccggggcacgccgggaggggtgaaccgcgcatgcgcgctttgatgaaaggtgcgttggcctgtttgctggcggcctgtggtggaggtgacgcggaagtctcttgcggccccgcttcaggacgggtggcggaggtcctggatggggacacggtcgtcctggagagcggcgagcgtgttcgttacctgctcgcggatgcaccggagcgtacgggcacgggcggtgactgcttcggtccggaggcgcatgccttcaaccggggactcgtcgagggcaggcgggtagcgctgacctatggcgaggcgtgcgaggatcgcttcggccggctcctcgcctacgtgtccgtggaggggcgcgaggtgaacacgctgttggtggagagaggccatgcctgcgtgctccacgttcctcccgcgggccgttcgagacgcgcggagttccaggcactggaggcgcaggcccggctggcgaggcgcggtgtctggggggcctgcgcgcccgtctcctgtcagcggtgagccacctgtcggacgaggctccgccgtggctgtctctcccgcgaggcatcatccgagcccgactcggagacgggcagtcccgccgggggatgggatgtatcccaatgataacagccacgcgcggcccgcatggagagggcgggcgttcctggttggggggctggtgaggacatgccagggcaatcatcgaccatgaaggcgcgcgcatgagtccaagcgtcacgccgacgctctcgctgccggacgtcttggatgtcctacgggaggacatcacccggcgcctgatggcgggggtgggcgccgcgctcggagcgctcgcacccctggcgatcgcagaggcgggggccctccacaagctcgtggggcggctcggggcgctgctccgaatcccctccatggcggcgcggctggcggaggctcgcaccctgggccgtgactatggacgtgagcgctacctggcgggcttcggtatcagctcgctggtgctcgagtatggcgcgctgcgcgaggccatcctcgagagcctggaatccgtgggctgggtccccgagctcgcggggctgcgcgcgctggcccaggtgctcgacgcggggttggtggaggcggtgggccagtcctccctggaggacgagcgcaccgcgcgggcgacgggggcctggctgcacgggctgctcgaccacgcgccgacgctcatctacgccaaggacacggcgggccggtacctctacgtgaaccatggtttcgagagggcctccggcaagctccgccgcgatgtgatggggcgcaccgacttcgacttgttctccgcggaggtcgccagcaccttcaccggcaatgaccggcaggtgatggactccggccagcaactcaccgttgacgagcacgtgccgctcctcgacgggttgcacgtcttccagaccctcaagttccccctgccggacgcgcaggggcgcgtcgttggcgtgtgtggcttctccaccgacttcaccgaggcgaagcggctggagcgcgagcgggacgaggcccgcgagcacctgcgccgcatcgtcacccagttgcccgtcatcctctgggccacggacgcgcagggcatcatcaccctcttcgagggcgagcggctgagcgcgctggggctggaccgaggcgcctacgtgggacgctccgcgttcgacgtgtaccgcgaccggccggacctcgtggccgccacgctgcgcgcccaggagggccagtccttcaccctggaggtggagatggcgggctcctatttcatgacgggcgtctcccccgtcatcgggcccgacggcagcgtgatgagtgtggcgggcgtgtcgctggacatcagcgagcggcggcgcgccgaggaggtgctgcgccagtcggagatgcgctaccggctggccacgctggcgaccagcgacgtcatctacgactgggacctggacgctgggaccatcgagtggagtgagctggccgccgtccagttccggctggcctcgcgcgccccgccgcgggacatcgcgtggtggacggagcacatccatccggaggaccgcgagcggattgcccgggagatgcaggccgtcatcgaccagggcgcgagccattgggcggacgagtaccgcttcctgcgcggggatggcacctgggccgtggtcgccgaccgggggcaggtggtccgggacgccgagggccacgcggtgcgcatggtgggcgccatgcaggacatcaccgagcggcgggccacggagctagaggcgaagcggcgcgcggagttcgagcagcttctcatcggcatcgtcagccacgacctgcgcaaccccctcgccgccatcagcatgtccgccaccgcgctgctgcggcgggaaggcctggatgaacggctccgcaagggcctgggccgcatcctctccagcgcggagcgcgccacgcgcatgttgagggatttgctcgacttcacgcaggcccggttgggcggcggcattcccatggagccccggtggctggacctgcacgagctgacccggcaagtggtggaggaggtccggctcacccgcccggagcggacgctgaagctggagtgccggggagacggctacggactgtgggacgcggaccggctggctcaggtcatcaccaacctggtcaacaacgcgctcagctacagcccggagcactgcccggtgcgcatccgcacgcatgggctgcgcgacgacatgctgctgaccgtccacaacgcgggtgggcccattgagccggagctccgggcccgcatgttcgagccgatgaagcgcccggagcgcaagggcgcccgtggtggcggactggggctgggccttttcatcgtgaagcacatcgtggatgcccacggcggcgtggtccgcgtccactccacggagcaggagggaaccacgttccaggcccgcctgccccgccagcccatgccgcctgctcgcccggacgtcgacgctccgtgacaccgtgacgcttgctccagggggcccagcccggctagcacggggtccgtggtgacacgtcttccctggagggtttcatgaagaaggtcctcatcggactgggcatcggctgcggtgtcttcatcctggcgggcatcggcttgatgctggcgggtggcatctgggccaagaacaagttcggcggcagcatcgaagccatgcagtcgatacaggcccaggagcaggagctgacacagctcaacgccagcaatccattcaaggcgcccccggaggggcaggtgctgccgttggacgagccacggctgctggcctacctgacggtgcgcgagtcggcgctgccggccttcaaggccttcgaggcgaagtccaaggagttcgaggcccagcacgcgggcgacggtgacgagaagccgggcttcaacgcggccgtggacgccgcgagcctgttcatggggctgatggcggacgtgcgcaaggcgtacatcgccggcctcaaggcgcaggggatgtcgcccgccgagttccagagcatcaccaccaccgtctacgcctccatggtggccgacagcctggagcagattggcgccgcggcggagcaggggcggaagatgatggtgacgcagctggccgaggtcgacaagcggctggcggacgactcgctcgccgacgaggagcgcgcgcagttggaggaggcccgggcgcagctccaggatacgctggacgcgattgaggagcccggcgcgaacgaggagcagccgctgtccgaggcatccaagaaggcggccgccgccaacgtggagctgctgaagaagcacaaggagcgcgtggagctgatggccaacgtggccttcgacggcttcgtgctgggtggtgccggcgccgacggtcaggccgcgggcctggagtagcagttccgccgtgtcaggggcgttcccggctcaggcctcccgttccacgggggcgccgggccgggacgccgccgccgcgcgtgcatccctccgccgcgcgcgctggcccacaccgcccctgtgttgagcttgacgatgaaggacttgtcgtggaccgcctgtgtcaccggcggtcgcctggcgagccagcggaagaccgtgttgccggactgctcggccgggtccaccgcgagcaacaccagcaccccggctcagaagacaatccacatccagggcggcacgctccgcatggcggagtcaacccttgcatgcctgactccgcgcgggcgcgagcacnctggttgtgcgccgcgttgcagttgcaggcgtttttcacatgcgcaatggattgcgcccgccaaaggtaggcgcgtgtggccttccgtccgcccggcctctctctttgcggccagccctccgtgagatatgcaagccattgaacatgtcgaaagtcacttcgcgcgaggaggggcgcgtgaacctgtgaggaatggagttggacgtctgatgaacaaggtcatcttcgcctgtgtacgcaacgctggccgctcgctgatggcggaggcgttcttcaatgtgatggtagacccccagaaggcgcgcgccgtctccgcggggacgcagcccggcgacaaggttcatcccgaagtgctcgcggccatgcgggacattggcatcgacctgcacgacgtgaagccccgcctgctcacggacgacctgacccaggacgcgcaatggctcatcaccctgggatgtggcgaggcctgtccccaggtgccggggctccagcgcgaggactggccgctggaagaccccaaggacaagtcggacgtcctggtccaccgcatccgcgacgagctggccgcccgcgtggcgggactgctggagcgcgaagggtggatgcgcgccggctaggggctgtccctgatctcgtgttcgagagtcgacccggcgtgccggcctttctggcacgttggggcagggcctcaatcggagttgctgcctggcgctaggcatgatcaacgcgggctgtgcgccgacatgaactgagcgatgtcgagtggagccgcatcgagcccctgctgggctccaggacgggccctcgctcgaagcgaggggaccgtgacttcatcaacgccgtggtgtggcgggtgaag

SEQ ID NO: 904 - DNA, 11382 bp, Myxococcus xanthus
ctcggcgcgcatgtgcgaatggtccaggccgcagtactccgcgcacagcacctggtagcggcccggcctcaggacctccaaccagatctccgtgtagcgcccgggcaacgcatccatcttcaagcggaaggcggggacgaagaaggagtggatgacgtcgcgcgacgtgagcagcaggcgcacgggcgtgccggtgggaacgtgcagcacgcccaccatccccggcccgtccgggtaggcgaacttccacatccactgcttgccagtgacgtagacgtccagggcgtcccgaggcggcgtgcgggcccacacgtagtcccggaagcccagcgcgccccagagcaggaagaaggacagcggcacgccggcgaacgcggcctccatccaggtgggcgcggccatcgccggcgcctccgagggcgcacgtccacgccggtagcgcaccaggaagaagagtccggtgaggccaatgccggcgcccaccacgaaggtggtgcagatgatgaagaaatgcagctggtccacgcgtgtggccagcgacgaggccgcctccgggaggaacaacatgcgccgcagcaggtcactcatggccgcgccccctcctccgtggagaggacctgctccagggcctgctccaccggaatgtggatgaccccggcgtcccggtccacccaaccgtacccccgcagccgcgcccgctgtgcctcgcgcagccggggcgcggcgtcctcccgtttgaagagccgctggttgacgtccgcgacctcggagacgccaagcgtcggtggaaagcccgcgggcgcccagggcgcgtactcgcgcacgctccatcggatcaagagcaacgcgatcccgaccacgaacagccacgcgcaccccacccctgcgatgtgccgcgtggggagcatccggggctctggcggcggtggaatgaagccctcgctcatgaccggggcacccgcagcgaatgaggcaggaacgggtctctcaccggcaccgtgtagccgccgcgcgagagcagccaccacgcggccaccgtccagcccccaacgccggcccacgcggtgacgctggtccagtggaacgacgccgtcccgggatgaagcgcgggaaacaccagccagtagacgtccagcgcccgcatcaggagcagccacgcccccacgacggcgagtgcccttgggtcctgcttcaggcgccggagcagcagcaggaagaacggcacgacgaagtgccccacggccagcaccaccgccaccgcgagccagccaccgtcgaggcgcgcgcggtaccacgtcacctcctccggaagcgacgcaatccatatcagcaggagctgcgagaaggcgccgtacgcccacaggcagacgaaggcgagcagcagggtccccagccggaggaagtgcgccggtcccatcaacgcgccgaactgtcccgcgccccgcgccgtggccgcgacgacggccaccagcgcgagcgcgcccaccacggccccacagccgagcgttagggcgtacacggtggactcccacagcggctccagcgacatcagccagtccaggctggcgaaggacaggcacagcaccatcagcggcagcgagcccgctcccagcttccgctggtacagcgtgaagcgcacggcccgctcggtgatggccggctccgcgtcctgccgcaccgaccaccggtagagcaggagccccaccacgctccagacggcgaagtagaagaccgcccggcccaggaagaaaggcacgttgaggtacggcttcttgtgggccagcaggtgcacgtcatgcgcgctgaggtcggcgggaatcgccacccacggaaacaggtggggcatcgtcaggaccacggggacgaacaacagcacgaacaccgggctgctcgcggccatgacctccagcggccgccgcagcacggtgggccacctggcgcgggaagcgtgaaacgaggccaggatgatgagggcccccagactgagggtcagccagaacgcgaaggcgaacaaatagccgtacgcggcctcccggggcgcggccacgccccccagcagggtggcgaggagccccaggcctcccaccgtgacggcgccccacaccacgcgtcgccccaggttcaggcgcgtcaggaccgtggccgtcatggcgtgccccccctcgggtgcccgcatgagcgactcgcgcgcgtcgtcgggcgcggcggacaacggcgcgcgctggctgtacgcgagcacccgcagccaggccacgaccttccagcgcgcctcgggcgtgagcgcatccgcgtaggaaggcatcaacccgtaacctccggtgatgaccgagtagtagaagcccggtgagtgcggcagcgcatcccatccaggggacaccgggcgagcgccctcccctgcatccgcgggcatcaccgctccatgctcgggatgcgagtgcgcctcgccatacagcgaagggggcgaccgggcccccatgttctgcgcgacgatgctctgcccatctcccagcagtccgtgacacggcgcgcaccaggtctcgaagtgggcgcgcccctcccgaagcgtgtcgggtgtgatcggcacggggagctgctccacctccacccagcctccgtccggagagccccggcggatgtacgcggcctcctggaagtaccactcgcgcgccaccgtgccgggcacgaggggccgcatcgaccgcgcatccgcgaagtacgggttggcgacgaacgccccgtcacgcgcctgcacccgcatcgggtccaggtccacacatgcgggcacgcccacgagcccgaaaaccaccaatgccagacgtccgctcatgaacgtccctccaccgcgagcacgacctcggcgccgagccgccggagcgcgccttgcgccgcgtccgcgccctccgcgtcgtcgaccgcgaccgccagccagaacccatcgatgctggcgcttcgaaacgcctccaggccgaggaacggatgggtcacccgcggcaggccacacgccacgatgacgcccatgaagagggcgcacgccgacgccaggaccccggactcgaaggtgatgggaatgaaggcggggccgctgtgcaacggacgtccgcccacgttcagcggccagtcgatggcctgcgtgaaccactgcacgacgtaggcgcccaccgcgccccccaccccggcgatcaaccccaacagtggcaggcgcgatgggggcagtcccagcaccgcctccacgtcctccacggggattggagtgtgcgcatccaaccggaggaagccggacgcccgcagcgcccgggcagcctccaccatccgctccgacgagcggaactcgcccaacacccagcggctcatcgcgcccctccttcccgcgccgacacttcatgggcgaaggcctcggaggcctcgacctggtgctgaagctccttcacctcgctgatgggcaccggcggcaggaagcggaggaacagcaggaagcccaggccgaagagccccacggtgcctgacagcaggctcaggtccacccaggtgggcgcatagtgccgccagctcgaaggcaggaagtcctcgctgagcgaagacacgatgatgacgaaccgctccagccacatgcccacgttgacgagcagcgccgcgaaccacagcaccaacggccgggtgcgcatccgggcggaccagaagagctggggcaccagcacgttgcaggtgaagacggtccagaacgcgggcgcgtaggggccggtgcgcagcatgcccatcgcgtgcatctcgtaggggtctccgctgtaccagccgaagaagtgctcctgcacgtagccgtaggccacgaagaggccggagaccaggagcagccgcgccagcgcgtccaggtgcgcctgtgtcaccacggtgtacaggtggagcgcgcgccgggcgggaatcaacagcgatagcaccatggccaggccggataagatggcgcccgccactaagtacggtggaaagatggtgctgtgccagcccggcagctgcgccacggtgaagtccaacgagacgatggtgtgcaccgatacgacgagcggcgtcgccaaccccgcgagcatcaggtacccgatgcgccagtgacgccagtggcgggcgctcccccgccaccccagcgacagcacgccccagacgcggcggtgccagagctgcttcgcggtgtcccgcgcggtggccaagtccggcaccatgcccaggtaccagaacagcaccgacacggtgaggtacgtggtgacagccacgatgtcccacgtcaggggcgaccggaactgcggccacatgcgcaacgagctgggatacggcaccaggtagtagaacttccacggccgccccagatgcagcagggggaacagcgccgcgcagatgagcgcgaacagcgtcatcgcctccgcgatgcggttgacggagctgcgccacttcatgccgaacaacaggaggatggcggagatgagcgtgcccgcgtggccaatgccaatccaccagacgaagttgatgatgccgaacgcccaggccacggggatgttgttgccccacgtccccacgcccgtggcgaacgtgatggtgatggccaccaccagcagccccgtcagcgcggcgcatacgccgacgagcgcccaccaccccttgcccggcgcggtgagcaccgggcgcagcaacgcctcgctgagctgcgcgtccggacgacgctcctccagcaaggggtggacgaccagtgggtccgccgtcaccggggccaggggcagaggctcgctcatccggagacctcgctcggattcttgaggcggatcaggtggacggtgcgcggccgcgtccccaggttgttcaacagggcatagtggcgcgggtcctgatgcagccgcgtgacggggtcctccggctggctcaggtcaccgaagacgatggcctccgtgggacaggcctgctgacaggcggtgcgcacctccccctgccggatggcgcgctgctccacgcgcgcagtgatgcgggcggattcgatgcgctgcacgcagtacgtgcacttctccatcaccccgcgcgagcgcaccgtcacctgggggttgcggtacatccggtccagcaggccgccgcggttgtactccaggtagttgaagcgccggaccttgtagggacagttgttggagcagtaccgcgtgccgacacagcggttgtagaccatctggttgagcccctcgtccgagtggacggtggcggccacggggcacacgtactcgcaaggtgcgtactcacagtgcacgcacatcagcggctgggtgatgacggacgggttgtccgcgtcccccatgaagtaacggtcgatgcgcagccagtgcatctcccgaccgcgccccacctggtccttgcccaccgcggggatgttgttctccgcctggcacgccacgacgcaggcgctacagcccgtgcaacggtgcaggtcgatggccatgccccagcggtggccagcctcttccggcgcgggccgcggtggatacaggtgttccttcggagcctggaggtcggggagtcgcgcatcgccctgtgccgcgaaccgggcggcggtcgtctggagcgccacgggccggccctccatatgccagtgctcctgcgtcagcgcgaagtcgtggtggccctgcacgcgcgtgagctgtcccccggcagcccaccagggcgagtcctggaagcgcagcgcctgtgcgtcgaagcccacgccgcgcgccactggactgcccatgcgctggccgtaccccagcggcaaggtcagcgtgtcatcggcctgcccggggaccaccagcacgggcgcatccacggcgcggcctcgcagctccacgcgcacgcggttgcctcgcgccagcgacaagcgcgaagccgtggcggggctcacccacacggcattgtcccaggtgagctgcgtcaccggatccggcagttcctggagccagggattggcgccgtagcggccgtcatggaccttggtgtccacggcgaagtgcagctccaggccgtcccccgggggtggcagcgcccgcaccgccgcgagcaccgccgcggtgtccacggcaacctgttgcacggggagctgcgtcccggggatgacgccctccgcgagccaacgctcccaggcatcctcgaagcgtcccgtagcgcccgcgtgctcacgccactgggcgcgcagccgctcgtaaggcgtggtcgccagttcaccggtgaaggccgccagcacctccaacggcggcacggcgccctccagcaacggcgcgatgaggggctgcaggatggtggcggtgccatccaccgcgcgcccgtcctcccatgcctcgaatggatgcgtggagggcacggaccaggacacccgcgcggtggtttcgtcgtcatggcgcgcgcagtacacggcgtcctccaccctgcccaggacctccccgagcggaaggtccgtgggcgcgcggtagacggggttccacgcggtgatgagcagcgtgtccaccgcgcccgcctggatgtccgccacgagcgctggcagggccgctgcatccggcgcgggcgccaggagcgactccacgcaccgcaccttccccccgtgcaacgtcgcgttgagcaggtgcgccagcgcatggaccgcggcgggttgggactcccccaccacgatgaacgcccggcgcccctgctccatcaggtcccgcgcggctcccaccacccagcggcgctccgagtcctccagcgccgacgctccacgtccgagcgccgtccattcctcgcgtcccagcatccgccccagctccaccgcgagcgcctgggccacccacggcacgcgggacgggcgcgcccggagccgttcgtccgcgaaggcccccgtgaggctcaagcgggtctccaccacccacaggcggttgagcgccggaggcatgcgcgcggagacgaactcacgcggggcgcgaagacctcctgtcagcgtggacaggaagtcgtcatccagcgacaccacggcgcgcgcggcgccccagtcgggcatggcgcacagcggccggccccacgcgagccgggcgcccgcgagtgcgttccccgtctgcgtggagctgaagggcaccacccgggccttcgggaagcgtgcctggatgcgctcgaaggtccgggtccagagcggtgacgcggtgggctctaccaacaggcgcagccccgcccccgcgtcttgccgcgcggcgcgacggcgcatcatctgtaagcactgggccagggaggttggcgccccgcgatggcagcatggtccgggcacggtgcgggtcatagagccccagcgatgacgcctgctactgcgcgcccgccgcgcccaggctcttcggatgggagggattgccctgcaccagcgtgggccgtccctcctggctgcgcaccagcacaccgcgcacgaacccgcccagcgcgatgcccgtggcgtagtgaaggggaatgcccggggtgatctccggctgcggccgggaatacggcagcaccttctccggcggcgagcggaagcagcccgccaaccccgcggcggcgccgccaaacgcggccaactccagcaacacgcgccgggacagcccctgggggggcgcatcggcctcctggggaaactcgcccggttcgggcgcgggcgcgatgccctggcgctcctccaggctgcgccagggctcgggctccgtcaggacggggagcggatattcctcggtcagcggtggcatgtggagcactcggtccggggcgatacatccagggtccgcatcaccacgagccctacctcccgggccgggccggccgggctccacgtcatgtccgcgacgtgttcaggaggccgcaggtggggcgccgggtcgcggtgacactccaggcaccaccccatggtgagcggagccacctgctccaccagcggcatctggtccacgcggccgtgacagctcacgcaccccacgcccttgtggacgtggatggcatgattgaagaagacgtactgcggcagccggtggacgcggttccacgggatgggccggtcctcgaagtagctctggcgcacgggcgccaggagcgcgctctcgttccaaatctgcgcgtggcagcccatgcaccggctggtgggcggaatgcccgcagaaggcccccgccaggccccgtcatggcagtagcggcagccgatgccctcgtcccccgcgtggtggcggtggtcgaactgcaccggctgctgcacgggctcgaaggcgccggtccccagcggattgcgggccagcagcagcaacgccatggacgttgccaccggcagcacgaccatcaggccgagcacgccccgcagtactccatcggtcgctggtggaaagagacccatacaccgcccaggcagtcgcaggcctgcccctagcggaccggcgactcagggcgataggacggacctcacgacctgtccgttactccaagtccgggaggacacccgtcggcgaacccacacgcgcgtgcctcccggaccgaggagactcagtccaccttcaccgcgttctcctccaacgcgacagcgggggatgcgccgttgtagacggcggcatccagcaggccctcttcgcgcgccaccagcaccgggaccagcatctggcccgtgacgtggtcatcgtgcgcatcatgtctaggatgcggtcgatggcgagcaggtagcccagcccctccagcggcaagcccgtggagctgagcaccgccgtgcccatgaccaccaccgtcccgggcacgcccgcggtaccgaagctgcccagcaccgaagccagcaggatgatgaagtactgcgacgcggacagctccaggctgaagtactgcgcgacgaagagcgacgcgatggccgggtagatggcaccacacccatccatcttgatgctggcccccagcggcaccgcgaaggccgcgtagtccttgttgacgcccaggttgttcgtcacggcgcgcagggccaccggcatggacgcgaagctcgacgagctgacgaaggccacctgcatgccgggcgcggcgccccggaagaagcgcagcggattgagcccgtgtgtcatcaggaggccgccgtacacgaagacgatgtgcagcgcgcacgccacgtacagcgccagcaccagcttgcccagcggcaacaggcgctcgaagccgtaggtgcccaccagtgcggcgatgaggccgaaggtgcccagcggcgtgagctccagcacgaagcgggtgacctgaatcatcgcgtcgctggcctcgcggaccagctcgcgcagccgggccgtcttctcgccgagcttcaccagcgcgaagcccagcaggccggcgaagaagatgacctggaggatcttcccattcgcgagcgccgcgaacgggttggtgggcaccacatccagcagcacctggatggggccgggcacgtcccgtggcttgtaggtttcggtggccatgagctggcccactccctccccggggcgcagcagcgcggcgacgcccaggcccacccccaccgccagcgcggcggtgacgccgaaccagaggaacgtcttgccgccgagcaccgccatgctcttctgcccgtgaagcgccgccaccgcgttgatgaccgcgaagaacaccagcggtgtggcgatcatcttgatgaggttgacgtagagcgtacccagcggctggaaccagggccccgctggctctcccacgagccacccggccacggccccgagcacgaacgcccccaggacacgttgccagaagggaatgcggaaccaggcggagacgagcttcttcacgggggagacctctcgacaacgggcggcggacgataaccccaggccccaggccgcgcagggcgaggcgcagaatttgcgccagggatgcccgcgccggggatccgggttttgccgcgtccgaccggccccggcaggacgccacagagcaacagggcctcccatttattcccgaggagcggtacacctgggcccatcatggccgagacctcttcgctcaacatccccactgtcgacctcgccgacctcgcgtcggatgactccgctcgcgtcgagcgcgccgccgcggcgatccgcgaggcctttggcgtctttggcctcgtgtacctgaagaaccacggcgtcgacacccaggcgctgaaccggttctatgacgcgttcgcggcgttcatcgcccggcccgccgaggagaagaagccctacggccgcgcggacatctggtaccagcgcggctggacgcctccgaacaccgaggtcgcggtcgccagcaatggccagccggacttcaaggagtgctatttcgtcgcgccctaccccaacgacgcgcagtccgcgctcgagttcccggagctgtacccggagaacgtgtggccccagaacgcgccgccctacttcgaggacggcatcatgacgctggaccgctccctccatgaggccggcctgaagctgctccgtggctccgcggtggccctgggcctgccggagacgctgttcaccgacctgtgcgaccgggctgcccacgtcacccgcgcgctccagtacctgccgctcaccaacacgcaggtgaacacggacatcgtctggggcgaggagcacaccgacttcaatctgctcaccctgctcccgggcggccgcttcctggacccggacggcagccccgcgcccggccccgacaacaagagcggcctctacctccgcacccgcgcgacgcccgaggccccgaacggactcaaggtgcggggaaccgcgcccgcgggttgcatcgtggcgcaggtgggccagcagttggagatcctcacgggtggcaccttcctcgccacgccgcatgtcatcaccgccccgggcgtgccgggttggcagcgccagtccgccgcgcacttcatgcacgtgcacacgaacaccgtgctcttcccgctggagaagttccgcagcgcggatgccgtccggaactacgcgccgcccgtgctcgctgggacgtatgacatcaagacgctggtggacatcggccttgcgcccgcgagcgcgctcgacaagctgggttaccggcactacgaccggctgaaccgccagcgcgctggcacgtaaacctggcggtaccgcttgaggccccggagacaaccggggcctcgcgtgaaacacagccatcaatcacagacagatagacacagacgtatattgaatgtctgtgttttatccgatccgcattggcaagatctgtcattggcgaagccccttggcgtccgcgcatggcctgtcagagggtgccaaaaaccactgaaaagaacttcatgtaggcattgccttcccggatgcggcgcatttccttccgaggaggcaggccagcggcttctgaaaaaccactgatgacctgttcatg

SEQ ID NO: 905 - DNA, 9081 bp, Myxococcus xanthus
ccactggcgcagggggggagacgctggtgttcgtctccgccggccaggtgggctccatgctggcgcgggcggcggccgtgcccgcctggcttcccgtgcccggcgagctcgcggagacgcgcaccgtgaacttcaatctggagggcgcctcgcaccacgtggtgacgggccagctccaggcggactcgccggatgcggcggcacggcgctacggtgccctcttccgtgagcgcggctggcaggtgggaacgctcgcaccggtggcgccgaacggcatcgccttcgaagtgctcaaggagtccgtgagcggccgcgcggtgctgcgcgacctctcgccgggcccgggagtcgaggtccagctcacgctgctacgccggagcgttgccccatgaggaagtccctgcgtccgtcgcggtccgcccgcggccagtccatggtggagtacgccatcgtcaccgcggccctgctgggcttcagcacgatggggtggcccttcctggtgcagttgctcaacgcgctgcaccgctacttcaactccatctactacgtcatccaggcccccatctgaggcacgggggcctgggcgccgcggttacggcgtcaccgtggtgacgaactccgccttgccgccggagaccttgagcaccacggcctccttcaccgcgtcgcggttggcgtccagggtgattttgcccgtcacgcccgggaactccttcgtcgcggcaatcgcgtcgcgcagcgaagggccgctcaggtccggcgcgcgcttcatggcgtcgatggtcacccgcgccgcgtcgtacgccagcgcggccacgctgtccggcacgccgccgtaggtggccttgtagcgggccaggaacctctggagcaccgggtccgggttgtccggcgagtagtggttcgcgaagtagctgccctccagcgcggagccgcccagctcgtacagcttgtcggagtcccagccgtcgccgccgagcagcggcaccttgagcccgatttcacgcgcctgccgcgcgatgatgcccacgtccgtgtagtagccagggacgaagacggcgtccggcttcagccgcttgagggacgtcagttgcgcgcggaagtccgtgtcgcccttggagtagctctcgtcgcccggcacctcgccgccgaactccttgaacctggcggtgaacacgtccgccaggcccatggagaacgcgctcttgttgtcgcgcaggaccgcgacgcgggacagctgcaggttctcccgcgcgaacttcgccatggcgagcccctggaaggggtcgatgaagcagacgcggaagatgtagtcgcccttctgcgtcacttccggcgcggtggacgtgggcgtcaccatgggcaccttgcccgcctgcgccttctccgccatggccatggacaccgacgaggccgcctcgccgagaatcgccaccaccttgtcctgggtgatgagccgcgtcacggcctgggcgccttcctctggccggccctggctgtcgtagacgcgcacctggagcttcttgcccttcacgccgcccgcctcgttggcctcgttcagcgccagctcgatgccgttgcgcgcggacaccccgaaggtcgcctcgctccccgtgaggctgccgacctctcccagcagaatcgtgttcgagtccaccggagcggccggtaccccggtcgcctgcccctccggcgagggcgcggcgggcgcgttcttcttctcgcaggccaccacggccagggccagggtcgcgagcagcatcaggggacggcgcatcggcaaggttcctccgggggacggtggtgtcaccctatccctctcccccccgccctccaaccagcggcgcttcagggagggattcaaattgcaatgtggactgaaacggtcctgattacatatgaggtcctccgtggcccgagttttttcggcgcctggacccagagaggagacacccgcacccatgctccggatgagcaagatgaccgactacggcatcgtgctgatgaccgagctggctcgcgcggagggtgacacgcgcaccacccgtgagctggcggcgcgcacgcgcgtgccacttccctcggccagcaaggtgctcaagagcctgctccaggcggcgctcgtggtgtcgcaccgtggcgccaacggcggctacggactggcacgcccggcccatgagcttccgctggccgaactggtcaccgcgctcgaagggccggtcgccctcacggagtgtggcgtccacacctccgggggtgcgccctgtgagctggagtccgtctgccaggtgcggggccactggcgcctcatcaacgacgccattcaggaggccctggggcggctgacgctggcggacctcatcgcccccgcgccccgcgtgccagagcgcctcgtgggcctggggacaccctctcgcccggcgccttccccggccgctggccacccccctcccgcttccgcgacaggagtccgctcatgagcaccgaaaccctccaggaactgacgcgccgcccgtatgcggcgggcttcgtcacccagttggaatcggacacgtttccccccgggctggacgaggacgtcatccgccagatctccgcgaagaagggtgagccggagttcctcctcgactggcgcctcaaggccttccgccactggaagacgatgaaggagcccacgtggcaggccgtcacctacgcgcccatcgactatcaggccatccgctactactcggcgccgaagcagaagccggtgaaggccagcctggacgaggtggacccggagattctgcgcacctacgagaagctcggtatcccgctgcatgagcagaagctgctgcagaacgtggcggtggacgccgtcttcgactcggtgtcggtggccaccacgttcaaggacaagctggccaaggcgggcgtcatcttctgctcgttctccgaggccgtgcgcgagcacccggagctggtgaagaagtacctgggcaccgtcgtgccgtactcggacaactacttcgccgcgctcaactcggcggtcttcagcgacggctcgttcgtctacatccccaagggcgtgcgctgccccatggagctgtccacgtacttccgcatcaacgcggcggacacgggccagttcgagcgcacgctcatcgtcgcggaggagggctcccacgtgagctacctggagggctgcacggcccccatgcgcgacaccaaccagctccacgccgcggtggtggagctggtggccttggacaacgccaccatcaagtactccacggtgcagaactggtacccgggcgacgcggaggggcgcggcggcatctacaacttcgtcaccaagcgtggcatcgcgcaccgggcggcgaagatttcgtggacgcaggtggagacgggctcggcgattacatggaagtacccgagcgtcatcctcaagggggatgactcggtgggcgagttctactcggtggcgctcaccaaccacatgcagcaggcggacacgggcacgaagatggtgcacatcgggaagaactcccgcagcaccatcgtgtccaagggcatctccgccggccgcgggcagaacacgtaccgggggctggtgaaggtgctcaagagcgcggagaacgcgcgcaactacacgcagtgcgattcgctgctgctcggtgacaagtgtggcgcccacacggtgccgtacatcgaggtgaagaacgcgtcggcgcaggtggagcatgaagcgtccacgtcgaagattggcgaggaccagctcttctactgccggcagcggggcatctcgcaggaggacgcggtgtcgatgatcgtcaacggcttctgccgccaggtgttcaaggagctccccatggagttcgcggtggaagcgcagaagctgctcggagtgagcctggaagggagcgtggggtaggtatggcgcttttgactgttcgcaacctgcacgcccgcgtggcgggcaaggacatcctcaagggcatcgacctggaggtcgcgcccggcgaggtccacgccatcatgggccccaacggctccgggaagagcacgctggccagcgtgctggcgggccgtgacggctacgaggtgacgcagggcgaggtgctgttcgacggcaagccgctgctggagctgtcgcccgaggcccgcgccgccgcgggcgtgttcctcgccttccagtacccggtggagattccgggcgtgggcaacatccacttcctgcgcaccgcgctcaacgcgcagcgccgcgcgaaggggctggaggagctggacgccatggacttcctccaactggccaaggagaagtcgaagctggtgcagctcgacgcggccttcatgaaccgttcggtgaacgagggcttctccggcggcgagaagaagcgcaacgagattttccagatggcggtgctggagccgcggctggccatcctcgacgagacggactccggcctggacatcgacgcgctgcgcacggtggcgggtggcgtcaacgcgctgcgctcgcccgagcgcggcatggtgctgattacgcactatcagcggctgctcgactacatcgtcccggacaaggtgcacgtcatcgcggcgggccgcatcgtccgctccggtgggcgcgagctggcgctggagctggaggagaagggctacggctggctggggttggacggtggaaaggccaaggcgccggtggcggaggcgcggcgatgacgacggccctggcgcactacctggatgtggccacgcgcttccaggcggcgcccgaacaggcgtccgcgccgcagtggctcaagcgcctgcgcgcagatgccctggcccacttcgagcggcagggcctgcccacgacgcgtgacgaggcgtggaagtactcccggctgggggccatcgcggaaggaacgttcattccacggacggatgtgtcccgggacaccgcccacctgtcggcggtggtggagcggctgggcttgccggggccccggttggtgttcgtggatgggcggctggcgccggagctgtcgtccgtggcgggcctgccgcgcggactgacgctgaagccgctgcgggacgcggtgcgtgaggacggcgagctgctggagtccgtgctggggcagcgggccctggcgaacgagcacgccttcaccgcgctcaacgcggcgctgctggaagagggcgtgctgttgcggctggcaccgggcgcgctgagcgaggtgcccgtgcaggtggtgttcctcacgcgcggcgacgcgccggtgctgtccagcccgcgcatcctcgtggtggcgggggagagcagcgaagcgacgctggtggagacgtatgccagcgcgggccccgcgggctcggcggcgacattcaccaacgcggtgacggaggtgacgctgggcgacaacgccagcctccaccactacaagctccaggtggaggcggacgcggcgctgcacgtgggcgcgctccatgcacggcaggggcgggacagccgcttcgcctcgcatgccttcgccttcggtggggccatggcgcgcaacgaggtccacgcggccttcgcgggcgagggtggcgacgcgacattgaatggcctgtacgtggggcagggcgcgcagcacctggacaaccgcacggcgctggaccacgcggtgccccggtgcaccagccgcgaactgtacaagggcgtgctggatggtcactcacgcggcaccttccacgggctcatccgcgtgcggcaggacgcgcagcgcacggactcgcggcagcagaaccgcaacctgctgctgtcggagtcggcgcaggcggatgcacggcctcagttggaaatcttcgcggacgacgtgaagtgcgcgcacggcgcggcggtggggcggctggacgcgcaggcgctgttctacctgcgctcgcgcggcgtgccccaggcagaggcggagcggctgctcacctacgccttcgctcgcgaggtggtggaggcggtgcccgccggccctgtgcgcgcgaacatcgaagcgctcctggccttgaagctgccaggcgcggcgcagcgcgaggtgacggcatgagcggcttcgacgtgaatcaggtccgtaaggacttccccatcctcgaccaggaggtgcggggccggccgctggtgtacctggacagcgccgccacggcgcagaagccgcaggccgtcatcgacgcgctggtgcgcttctatcagcacgacaacgccaacgtgcaccgcggcgtccacgtgttgtccgagcgcgccacggaggcctacgagggcgcgcgtgagacggtgcgccgcttcatcaacgcccgggacgtgaaggaagtcgtcttcgtgcgtggcaccaccgaggccatcaacctggtggcgcagacgtacgggcgcaagcacattggcgccggggacgaggtgctcatcacccagatggagcaccacgccaacatcgtcccctggcggatgctgtgcgagcagacgggcgccgtgctcaaggtcatccccgtggatgaccggggcgagctggtgctggacgccgtggacgcgctgctgacggagcgcacccgcatcctcgcggtgacgcacgtgtccaacgcgctgggcaccgtggcgccggtgaaggagctcacgcggcgggcccacgcgaagggcatccccgtgctggtggacggcgcacaggcggtgacgcacttccccgtggacgtgcaggacctgggctgcgacttctacgccttcagcgggcacaagatgttcggccccaccggcatcggcgtgctgtacgggcgcaaggagcgtctggatgcgatgccgccctaccagggcggcggcgacatgatcctctccgtgacgatggagaaggtgacgtacaaccgggtgccgtaccgcttcgaggcgggcacccccaacctggagggcgcggtggggttggcggcggccatccgctatctggaggcgctggggatggagaacgtcgccgcgcacgaccgggagctgctggcctacgccacgcaggcgctggagtcggtgccggggctgcgcatggtgggcacggcgcgcgagaagtccggcgtgttgtccttcatgctggcggatatccacccgcacgacgtgggcaccatcctggaccgcgagggcatctgcatccgcaccggccaccactgcgcgcagccggtgatgcagcacttcaaggtgccggccacgtcccgggcgtcgctggcgctctacaacacgcgcgaggatgtggacgcgctcgtccgtggcctgcacaaggtcctggaggtgttccagtgagtgcgtcggatgacttgaaggacctctatcaagaggtcgtgctggagcactccaagcggccgcgcaactaccgcgtggtggagggcgccaccgcggaggcggcgggccacaacccgctgtgcggtgaccagttggtggtgacgctgaaggtggagggcggcgtcatcaaggacgtggccttccagggccagggctgcgccatctccaaggcgtccgcgtcgttgatgacgggggcggtgaaggaccggacgcgcgcggaggcggaggacctcttcgagcgcgtccacaagctggtgacggaaggtccggagtcggtggacgtggacgcgctgggcaagctggcggtgctgtccggcgtcagtgagtttcccgcgcgggtgaagtgcgccagcctggcctggcacacgctgcgcgcggcattggagggacgcggcgaggccgtgtccacggagtaggggtggagggccacatgcgaggaatgatggcggtgctggagcgcgacgtgtccgcgacaatcatccccagcggggaccgggtggtgctgcccgaaggcgccgagctgcgggtgacgcagacgctcggcggcaacatcacggtgcaggacccctacggtcagctcttccgcatcgacgagaaggacggcggcgcgctgggcgaggagtacgcccccaaggagaaggccgccggcgacctcagcgagttcaacgaggagcaggtctgggagcaactgcgcacggtgtacgacccggagattccggtgaacatcgtcgagttgggcctggtgtacgcgtgcaaggcggagccgctgccggaaggcgggcagcgggtggacatccagatgacgctcaccgcgcccggctgcggcatggggccggtgctggtggaggacgtgcgcaccaaggtgggctcggtgcctggggtggcggagacgcgcgtggagctcgtctgggatccaccctgggggcaggagcggatgtcggacgtggcgcggctccagcttggttggatgtagcagcgggacgaaggccctcggcgagctgcttcgccaagggccggtgacgtctcagcgcagggccagccgccgcgcgcccaatccgagcgccgcggtggccagcgttcccgcgagcagcttcggccaccgggaaggcgctgcctggcgcacgggcaccatcggcgcacgagcagagacctccggcatcttctccgcgaagagctccaccatgcccttgatgaacgcgaacatctgtcgcggtcccgggctggagacccagttgccatcgcgcatcaccggctcgtccacccagcggccacccgcgttgcgcacgtcgtcgcggatgcccggccacgcggccagcgcccgtccctccacgagtcccgccgaaatcagcacccaggggccatggcagatgacggcgatgggcatgtccagcgcgtcggcgtcgcggacgaagtcgagcgcgagcgcgctttgccggaggaggtccgggttcacgaaacctcctgggaggaggaccgcgtcgaagtccgccgccttcacctcacgcagggacgcgtccacgctcacccttttccctggaatgagaaggttcatcccgcggatgcggcccttgtggggggacacaatcgtcacgtcggcgccctgacgctccagtttcttcaccggtgctgtcagttccacctgttcgaagccatccgccgcgagcacggccactcgcaaccctttcagcttcttcatcgcgcacacctcgctgtgtcggaacggtttgtcgtctcgacactgtgcattcccgctgggccccgcgttgtgcctgtagagctcg

SEQ ID NO: 906 - DNA, 6682 bp, Myxococcus xanthus
cgctctcaaggatgccggtgttgctgggcggcttcctggtggtgctgttcatgccggtgcaggactccctgtgccagaagctggggggccgcaagtctctcagcgccggggtgtccaccgtcaccgtgttcgtcctcatcctggcgccgctggcgctggtcgggtggatggtggcgcgcgaggtgttccagttcgtgggccaggcgcaggtcttgctggagcagcagcacctgcgtcacccgttcctcgccagcctgccgctgggcttggagcgctatctccggctgggcgtggacagcgcggagacggagcgggcgctcctggccgcgatgacgggcggcgcgtcgttgctgcgcgacgtggcggcggcgggcacggacctggtcatcaacctgttcctgatgtccgtggccatgtactacttcttcctcgacgggcgccggctggtggccgaggtcatgcggctcatcccgctggacaggcgctatttcgaggccttcgcgcgcgagttcaccgacgtcgcctacgccatcatctatggcaacaccgtcaccgcgctcatccagggcgccgtgggcttcgtcgggctgctcatcgcgggggtgccgcatgccggcgtgtggggcgcggccatggtgctggtggcgctggtgcccgtgggcggaacggccctggtgtgggggcccattggcgtggtgctcatcgccgccaaccaggtgagcgagggcgtgttcctcctggcctggggcgccttcctggtgggcagcatcgacaacgtcatccggccccggctgtgtggttcgcgcatggcgctgcacccgctgctcgtcttcctgtccatgttcggcgggctggccgtgttcgggatgatgggcctgctggtggggccgctcatcgcctccatcttcatggccatggtccgcatctaccgccgggacttcctgggcatcggccgcgccgagcacctgtcggcccatgatgagaacacgtcggcgcctcccatgtccgagcccgcctcctcccgcatgtctcccgcggcgccggcgatgggacctgccgcgacgctcaacgcctgagcggcgggagaaccgccgagcctggacttccccgacggggtgggtgaacctccctggggaatgacgaccgcccgacactcgatggttcgctgggggctgtggtgtgccctggtggtggcgctggcctcgccgcaggccctggctgccgcggcgaagcggaaggactcgggaccggcgaagccgagcgtcgtggtgctggaggtggagggagatgcgcggcagcggcaggcccctttcctggaggtggcgctggatacgggctctggcggcacggtgggagacgcgccggcgcgcccgcccctggcgcggctgacgttggggggcacgacgacgtggcgcaacttctgcgcgcggcccggcgtgaagtcctgtggcgaatatgaccggctcccggcgaacgagcgcctgggggacacggtgagctatgcgtcgtcggtgccgtacctgggcatcgccgccgaactggagctgctgccgctggcgaacagcgaatccctgctgcgcggcctgggcctgtcgctggggtatcggcgtgggtattcctccaccaacgtgacgctggtgagtgacgccggccggtcgaccacgcgcgaggcggtggccaccgactcggtgctcaccgcgcaggcgctgtaccgctacttcttcggcatgggggaggcgaacgcgtcgctgggccatgcggggctgcgcgcggggcttctcacccgcgccttcgacgtggacgcgtcctccaacagcccgctcaccgggacgcaccgcttgttccccgccgtggggttggaggtgtcggtgccgctggtgcgctgggtccggctggagggcgcgggtcagttcttcctgagcccgaagccgggcaagggcctgggcgccggcagcgcggcgttggacgccgaggtcagcgactacggcacgtcggtgtccagcttcggctgggaggcggagctgggcgtcgggggcgacatctgggggcccttcggttactcggtccgctttcgcctgtcccgcttccaggacacgttctccggcgccggcacgaagctgggctgggatgagggcggcgtggcggcggagacgtactccagtctgcactggggcatcaccgcgtcctactgaggcgcgttgtcggctcccactctggcgcggcggaggcgtagggtgcggacatgtctgagcacgtgtccccccaggagctgcgtaggaagtggaagctggcgaacgcggagccgctggagggcggtcaccggctcgaggcgtaccgcgcgctggcgcagagctgtcccgcgttcgttcccaatctcctgtcgttgagccgcacgttgctggccggccggaacgaagcggcggacccggaggccgcggtgtctgaggccgagcaggtgctccgctccgcgtcggacgtctccgcgggggccccggagcccctgctggcgctgggacatttcctcgtctcagtgcgacaggcgcccgatgaggcggagcgcgccttctcctccgcggccagcgccgcgatggccttgctggaggaagcgtgggcgggctggattcacgcgctgggcgcgcagggacaactggaggcggcgctggaggtggaggaacgggcgcggagcctctttcccagctccaaggcgatttctcaggcggtggcgttcgcgcgagcgcagtcgggtacgcgctgacgcggggcccgccacgtcagggcaggcgctccagcgaactccggccgccggtccgcacggcctgacggtgctgggcaatccggttgcgggcccactccggggccagctccagctcctccgggaagaagaggtcttcgcccagcccttcgacgagcacctggatgagcgggtcatcggggtactgcgtggccgggtcgtcgaacaccagccccacgacgattcccgtctggcccaggaagcgctggctgatggtgccgtcctcggagtgcggaacgaccttcaccttcgcgccaatgcgcaccggtgcgccgtccacgtcatggcagatgatgagtgaggggtcctggatcatggcgcgtaggaacggggtttgagcgacttcgagatgaccaccagtacgacggtgatgacgacccatgcgagcaggtggtgggagaggacgtgccgccagtcctgctcacaggcgagctctccgagcagcgcgcccgtcgagcccaccgacaggcccgccaccacggcgcgcagcggctggaagaaggccccgcgcagcgcgaacagcgccaccaccagcggcaccacgccgatggccaggtgactgacggtgcagacccagcccgggaacgatgggggactgtgcggcgcgccccgggcgagcaccagggccgccgcgctgaccaccgccagccccacgcccagccggcgcatccagcggcccttgggagacagcgcgccccaggcgcacaccgcgctggttcccaccagcatcgccagcaggggcgcgcgcgccaggagcagggggccggtgaccgcgcccaccgcgagcagcaccacggccgccagcaggcccagtcccgccgacgccgccatcaacccgacggcctgcgtgcgccagcgccgcaccggacgacgaagcgccagttcaccccgggccgcggcgagcacgcgctccagcgcggcgttgtccttcgcgggcgtctgggtgagcaacgagtccaggtccatcggtggcttcatcgcgccacctccagctccagctcgcccagcagctcgcgcagcttctcgtagccccggtgcgctcgcagccgcgcggcgccagggctgatgccccgcagcgcgccaatctcctcgaaggaccagccctccaccttgctgagcaccacggcttcacggtggtccgggtggagttgttgcaaggcgtccagcaggtgcctgcgcagcgacgggtcgctgtcatccggcgccgcggatgcgggcgtcgcggtgtcctcccgggaggcataggcgtctacgtgccgctgatgcctcaacgcgtcgcgcgcggcgttcgcggcaatggtcatcagccaggggatgaagcgggtgccgggctcgtagcggccccgcgagcggatgacggacaagaaggtggcctggagcagatcttccgcgagcgcgccattgcgcaccatccgggccaggaagccttggacccgcggcgcgtgccgcgcgaagaggtcctcgaaggcgtcctgtgctccgtcgcgaaaccgttccatgagtgcttcgtccgtttggctccgcatcacccgactcctctacgggccacctgcgaaagtgtttccggcgctcgcgcttctcaaggttcggtgaggaaagctctggaaagtcacggggttgcgaacgccagcagcatcccgtcctgccctggagggcgaggccgttagtgttgggcgcggaggcacctcggacgcgtggaccattggagcatcgaaggcatgggggcggggttggtggcaagcctgctggcgggcacggcgacgggactgggcgcgctgcccgtgctcgtcacctcggagctcagccggaaggcccaggaccggatgttgggcttcagcgcgggcgtgatgctggcggccacgtccttctcgctggtcatccccgcgatggaattggtgagagggcagggccatgacgggccttcggcggcactgcgcgtggcggcgggtgtgttgctgggtgggctgttcctgcgcgtgtggcacgacttgatgccgcacgaacacgcgctcaagggccacgagggccatggcggcacgaagtggaacagcgcgctgctgttcgtgctggccatgacgctgcacaacttcccggaaggcctggcggtgggcgtgtccttcgccgcgccgcagccggagctgggcctgtcggtggcgctgggaatcggcgcgcagaacattcccgaaggcctggtggtggcgctggcgctgcgggcctcgggggcgtccgcgtcgcgcgccgcgttcctggcgctgctcaccggcatggtggaaccggtcggcgcgctgttcggcgtcctggccctgtcactcagctccgcgctgctgccgtggggactggccttcgcgggcggggcgatgctctatgtcatcagccacgagatgattccggagagccaccgcggcggcttcgagcgcgaggccaccaccggcctcatgtggggcttcgtgctcgcgttggtgctggacatgtcgctgggctgacgcggcccgagggctacgcgggcagcagcaccagtcgggcaatctccgggggcgcgcccacgcgcatgggtgggccgacgaagccacaaccccggctgacgtagatgagcgagtcgcccgtgcggctcaggcccgcgttgcggtctccccagatgaggtcgcccatcaggttgcccgggaacatctgtccgccgtgcgtgtgccctgagacttggagccccacgccgcgccgggccacctcgtcgaagttggacggctggtgtgccagcagcacggaggcacggtcgggccgcacgtcgcgcagcgccgcgtccaggtcatagccgcgctcgcccatgcggtgcgcgctccagtcgtccacgcccgccaactggaaggaggccgcgccgtcgccaatggacacggagcggttgcgcagcgcgtggatgcccagcccctccaggaaggcgacccacgaatcggcgcccgagtagtagtcgtggttgccggtgacgaaccaggtgccgtaccgcgcgcgcagcttccccaggctggcggcgaagccccccagcgcattcacggagccgtccaccaggtccccggtgatggcgatgacgtccggcttgagtgcgttggtgcgggacaccagctcatccatgaagcggcgctgaatcacccctccgatgtggatgtcggtgagttgcaccagcgtgaggccttccagctcgcgcggcaggtggggcagccgcacggggatgtctcgcacatcgggtgggtggtatgcgcgccagccgccgtaggagctcgtcgccacgcccgcgagccccgcgcccaccgcgagcccctgacccagcagcgcccggcgctccggcgacgcgggcgcggtgggggccgtcgtctccgcgcgtgccttgcggcgctcacgccacgcggccagggcccgcaccatgtccaccgccagggtgaacatgagcaggtagaggaccaggccaatccacaggaggaagacgatgcccaggcgccgggcgccctccgagggcagcacggagccaatggcccgcgcgctcagggctccgacgaagcccacggcgaacagaccctgggcggtgcgccgcagccacttgcgcttcgtcacgtcacggacgagccgacggtagagatagacatggcccaccgacagtacggcgagcacgggaatgaagaagaggagcaggctgacccagcgtggcatcgggaatcctgcataacgaatgcgttcccgccgcgctccaggattccaggggggcaggcgggaaggcggcatgggcacacccctggcccctttcccacgccgccgcgccggggcaggcttcgccatcccgcgaggccgattcccggttcacgcaccccttcgaggtcgtcatgctccgctccctgctggttcccatgc

SEQ ID NO: 907 - DNA, 6821 bp, Myxococcus xanthus
  unsure (1)..(6821): unsure at all n locations
aggactcggcgaggccgaagtcgatgaccttcacctcgccctcgtaggacaccatgacgttgtgcggggacacgtcgcggtggacgatgcccagcggcgagccgtccggccccgtcttgcggtgcgcgtagcccagaccctccgcgatgcgctgaccgaggaacaacgccaccggcaccggcaccgccacgccctgcgagcgcgcctgctccaacaggtaggccaggtccacgccggccacgtactccaacgccatgaagtacgtgccgtccgcctcacccatgtcgtagacctgggcaatggacgagtgcaccaggtgcaccagcaccttggcctcgtggtggaaccggtccaggaactgacggtccttcagcagcgccggcagaatcgtcttcacgatgcacggcttctcaaagccggccgcgccgctgattttcgccaggtacacctcccccatgcccccctggcccagggggtggacgagctcatagcgcccaaggaagcgggaggactctgtagggacggtactcatggcgtctggaggcagcgaagcacccgaaagcggacggaatcaagcagcgggcaacttccttccctctgataccgccagggccttggacggaaactcgccctccgacagtgcacccgccccgtacccgtcgggcggggtgggtgttcaggagcgcggcgagtgccgggtgcgtgcgtgaaggcaaccctgatttggggtccccatccgccgctcgacacatgcggtgtgcaccgccgcacctcaggcaggggggcgccccccagtccattgccacgctttcgcgaagtgcgctccctgggggatgcgcgcccggtgtctccgccgggtgccgttcgagaaggagcggctcatgaagcggtggggactcatggggctgttggcacttgcggcatgtgggccggacgacgcctcagacaagggagcccagagccaggtctgcccgaacatcatcgcgggctccctgtccgaacccgtggagacacggcacgtccgggcccccctgacggatgacgacggccggcagcgggtcatcatccgctatcggaatcagggggtgatggccaccgcccgcgtgcatcaggtgggtggacaggtgacagccaccttccgctccacgcccgcggtggcggcgcgcatgtcgctccaggaacagcgagcgctcctggccgaagacccgacagtggagagcatcgaggaggaccaggagtggcacgccctggcccccgccaccgcgccgattcatcccgtcctggcctcggtggcgcgaggcgccacgccgcgcgagttcacccccgggctgcgcaaggtccaggcgcacgaggtgtgggacgtggatggggacggactgccggacccggaccggcccacgggcgcgggcgtgcggctgtgtgtcatcgacagcggcttggatttggagcacccggagctgcgcgacgcggtggtcgccggccgcgacctgctggagaacgatgacgacccctccgacttcagcagcgacaacggctggggcaccggccacggcacgcacgtggcgggcatcatcgcggcgcggccaggccacggcgggcgcggctcgccccagttgtcggacaccggggtgatgggcgtggcaccgggcgtggagctgatcatcgcccgggtgctggacatccacggccgcacgcacatgagcttcgtcctggcggcggtggagtactgcgcggagcagggcgccaaggtcatctccctgtcgctgggcggcggcgtgccctccaaaacgacgctcgaggtcttcgcggcggcccacgctcagggcatcctggtggtggccgcgtcgggtaacagcaacgcccagcgggtggactaccccgcgtcggacccgcacgtgctggcggtgggcgcggtggattccctggaccagcgggccaccttctcctccggcggaagccaactggccctggtggccccgggcgtggacgtgctgtccaccttcccgcgcggacagggcgcgttctccacggtggacgtacgggacacccggccgctgtcgcgctcactgctctatgcccccatcgagaacaagtggggcaagctggtggattgcgggggcggcgcgacgctggactcgtgcaagggcagcacgtgcagcggcttcgtcgcgtacgtgcggcacggcgaggtgcccaccgacatggccatggtcaacgtgatgaagcagggcgcgcgcgccgtcatcttcggtaactcgagctgggagggcggcgtggacatcctcgccatgcctcggcgagggcagtgggtgcccgccgtcaccatcacccaggcggggggcaccgtgctgcaccggatgctgggagagctggcccgcatcagcatgagcccggcggactacacctatatgtccggcacctccatggccgcgccctacgtgagcggcgtggccgcgctgctcttcagcgcccgcccctccgccacgccggaccaggtcaaacacgccctgttgtcctcggcgaaggacctggggccttccggccatgacgaggactttggccatgggctggtgcaggcccgaggcgcgctggaggtcctcacccagctaccctgaggggtgggaaggacagccgcaccaggtgccccacggcccgcgtgggcctgattgccaggccctcccgcgcgggccacgttgcctttcagacgcgaaccaaggagtccgtcatgaaggcactcgtacgtggcgcgctgtgcgcggcggcgctctggggcggcgccgcgctggcccaggcggaggaccgccccatcgcggagccgcgcatgcggtccgcggagacggtggagttcaacgccagcgggcggaagcgggccgacaccggcatctatgcccagttgggcggcggcctggagggctacaccggtcagctcgccccggaggttacgccgggcttctcctatggcgccgcagtgggctaccggccgcacgccttcttcgccgtcgagctgggctacagcggcggcctgagcgacatcgacagccgcatggggctgctcgacgacggcgagggcggaccggacatcgtccgcaacgccggccaggccgtcgtcgtgggcagcttcaccgacacccggctccagccctacgtcctgacgggcatcggcctggaccgctacaacgtccgcaacgacgcccggggcgccatccgcggcttctccgatgacaccagcggctacgtgcccgccggcgcgggcctgcgctaccagatgggcaacctcatcaccgccgacgcccgggtgaactacaacttcctgttcgaccaggacttcgccccgggcggccgggctcccggtgcgctggacggccgctactcggcgatgctctcgctgggcggaacctactgacggcggcggtggaagcggccggggccctctccccccggtgccccgccccttgcacggcctcagtagggccggtcgacatgcatccgcgcggcggcccacgtcccctggagccaggcggggagctgctgctccaacttcttcgcctccccttcggtgatttgggcatggagcgcggagaagactccgtggagcaccagccgaacgttctccggttcggcgttcaggtggttggccaccatcaagtagaagtcgtcgcggtccagcttcgcgggcgcctcgccgcggtgcctgtgacaaccgcgtaacagctcgcgcacgtccggcgagagctgctcgcgcaggtgcgccacccacgaaccggacaggcgctccgacaacgcacagaacaccgcctcggcggccttgtccgcctcgtaatccggaatctgggaggatattgcgtccagaaacgatttgcggtccgtccccacgcccagtcccgtccacgaaggcgtgcgctcctgcttttgtatcgacatggtgtcgtctcctctccctgcccttcaccgtgggggtgcgcgggagcgctgacagcagaccgcgcggcggtggcagggccgcccgttacgtggggagaaccgccgcgcgccaagaccagacatgcccggaatcgggatttccgtgtccgtctttgggaccgaggtgacagccaaacgcgtcaagcgtttgtgtttgattcgaccgatgattccatctgatggagcgcgacgcggcgtgctccgccggaaatacatggcgttcaaaactgcccggaactcctagggaactgttcaaatcccggccccgagaagaatgcgaggggtggctggaatgaattcccatcgcaattgtcttggtcgcgcatcgtagaccgcttgcacggcgaccttgccgccatctcaaccaccaagaattgaggatttcatgtatcgcattgccgtagccgccctggtccttgccgcgtccggttgcgccaccacgggcggtggcggtggccgtgagggcaacgccaccatcgccggcgtcatccgcctgccggagagcgggctgcgtgccgatgacgcttgcgggcagctccaggtcatcgtggcctcgccggacgcgcccaccaacgggctgggccggacgatggtgaagccgagccgcggcaaccgctgctccttcacggtgtcgggcgtgcccagcaacaccgacctccaggtcgggctcgcggcgggcggcggcctgaagtgcgagacgggcgccacgccgaccatcaccccggagccttccacggtgaaggtgagcgactacggcacggccacgcgcgatttcgccctgagctgcggcgcctgaggttctgaagcacgcccgtgacgccgcccgtccagccctccccatggggcgggcgtagcggcgtcacgccatcagcacgaactcgtccggcgggcaagaggcccttgtggattgattcgcgtcgaaggggacgcgaagcttcccgggtccttcgcagaaagacgagttggtgatgaatccgtaccgcttacgcgccgtgacgctcgccctggccctgggcgggtcgggcatggcgtgtgaatccgaagagccgttccccaacctcgacgagctggaccagctccgcagcctccacagcctggggcggcagccgccgaaggacagcaccaaccggatggacgggctcgctcgcgccgaggcgctgggcgacgtgctgttccacgacagcggcctgtcacgctgcggcacggtgtcctgcgcgagctgccatggcggcgagggcctgacggtgcccaccgccaaggccaagggctgcgacggacacctgtccgagcgcaacccgcccaccctgctgaacgtggcctacaaccgctggttcatgtgggacggacgggcggaccggctctggaaccaggccatcctgccgctgctcaacccggtggagatgaacgcggacgcgcaggtggtgcgcgcccggctcacctcggtggagtcgtacaccacggagtaccaggccctcttcggcaaggcgcccgcggacgagacggactcggcgctgctggccaacgtgggcaaggtgatggcggcctaccagcggacgctcgtgcgcatcgacgcgcccttcgacacggacgtgcgacgcttcatcacggcggccgaggccggccaggcggaggcggacccggcgtacctggggctgaagacgttcctgcgcaagggccagtgcatcgtctgccacaagggaccggcgctcaccgacgacctgttccacaacatcggcgtgcaggacagcagctcgggcgcgggcgggcagtggagcgcgctgacgccgctgctggactgggagttcaacgccgccagccgccacagtgacgcgcccaccggcaccatcgcgacgcggctccagacgatgcgcacccaggcggacccggcgacgctggaaggcgcgttccgcacgccgtcgctgcgcaacgtggccctgacggcgccgtacatgcacaccggcgcccaggccacgctggagaaggtcatcgacttctacaacgagggctggcatgcggcacggagttttatgggtcagaagacagtgaccatggcgacgctggagctgacgaacgatggagagcgtgcgctggtgacgctgctgaatccatgactgtggcgacgcccccctgacggcggcggagggccccgggccccccccttggaagggggcccaacccggggaccgattttcgcacgggaanaatgtcccagttttcccagggcccgtgtccaaggtggcgaagatgccacccgggttgagccccaaggagctccaggacctgtacgaccggtatgcccctggcatgtaccggagggccttcgccttgcttcagcgggaggcggacgcctgggacgcggtgcaggagtcctgcatccgcgtcctccaatccgccgccgccttccggcgggaggcccggccgatgacgttcatctaccgggtgacgaccaacgtctgcctcaacatgctccgcacccgggccctgcgggatgtcgccccggaggatgccggaagcgaaggcgctgtggacgcgctcgccgccaccgagtgccgcgacttcctgatgaagctggcgcgcgagctggacgagcgggccctcacggtggcgacgctgcactacctggacgggatgtcccaggaggagattgcccaggtcctggggctctcccggaagaccattgtccgcgacgtccagcgcatcagcgccctggcccgcgcgctgggtgagcccgaggggattcgaagaggtgccggatgagtgaacacctgtcggacctcgtcttggacgaggtggtcgcgggcggcgcgcagcccgcacacctgacgcactgcaccacctgccgtgcgcggctggagcagctg

SEQ ID NO: 908 - DNA, 9007 bp, Myxococcus xanthus
tggagccgcgccatggggtagcggcggtgcggcatcaactcctgctcatgcttcgcgacctgctggatgagctccatccatgtgccgccaggtagcgtcactgggaaaggcacgctgttgaggaacaggccaatcatccgctcaccatccacgacttccggacgaccattggtgacgatgccggtgacgacggaggtgctgccttcgacgaagccccggacgcgcagatgcacggccagcagcaccgtcttgagggacacacccgcctcgtgggccacgcgtaccaatgcctgctggagagaattggggatgcgcacttcgtggttgtgcagcacgcgttcgccgtccctggcccggttcgggcgagggcctggcgagtccatggcttccatgcgcttcagccagaagcgctcactctccgcggactgttgggcctcacgctccaacgcgatgaactggcggtaggtcgcagccaggggctgtgccgggggcgcgttggagtcgtcctgcaattcgaggtagcggccgaagagctccgagaacagggtcgcggcactccagccatcgaggatggcgtggtggaagacgatggtcagttgaacgccgcgatccgtgcggcgatgcacggcgacatggagcaagggcgcctgggtccactcgaagggcatgatgcgctccgcttccacccactcccgcaggaaagcgtcctgctgggagggttccagatgccgaaggtcctcgattcgcagcggtggcctgacctcacggtggacgagttggaggggctcctcgtagccatccagatggaaggaggttcgcaggatggcgtgacgcgcaatcagttcctgaaacgcctgacgcagcagcggctcgtctagcttcagctccagatggaagctgaacatgtcgtggtagattccggctgaggcatccagcgcgctctcgaagagcatgcccgactggagcgcggccagcgggaaggcatcctccacgtcttccggcagccgcttgcggtccgcttcggacacgaagccgaagggggccacgtcatgtgcggcaggggaggactctccggcgtgcttcaccacgccggagagctggcggatggtcgggtgctgcagcagctccatgataggcagctccaggccccgttcgcgtagcttggcgatgacctggatgctgcggatggagtctccgcccagttcgaagaaattatcgtcgatgccgagctggcgcaggcccaggaccgcggcccagatatcggcgatagcctgctcggaggcatctcgtggtgcctcgaaggatgcgcccgtcagcgctcggtccgcgtcgggggcgggcagggccttgcggtccaccttgccgtttgccgacagtggcagggactccatcggaatgaagatggcggggaccagatactcgggcagcttgcgcaggacgtggtcgcgtagggcacgtgcatcgacagactccacgccgtcttcgcccacgacgtaggccaccaggcgcttgtctcctggagagtcctcacgagcgaggacgacagcctcctggacgcctggagcctgctggaggacggattcgatttcgcccagctcgatgcggaagccgcgcaccttcacctggaagtcggagcggccgaggaactccagcgagccgtccgccctccaacggacgcggtcgccggtgcggtagaggcgagcgcccggggcggaggagaaggggtgagggaggaacttctcagccgtcaactccgggcggcttaggtagccccaggcgaggccgtcgccaccgacgaagagttcgccagggacgccgacagggacgggctccatgcgcgagtcgaggacgtaggccgtggagtgccccaggggcctgccaatggggacggaggtgccgaaggcctcccccgcgcgaagggagtgggtggcggagaaggtggtgttctcggtggggccgtagccgttgacgaggactgcgccgaggggaatgcgctccaggtgctgacggacgcgcagaggcggcaacacgtcaccgccagcgagcacctgccggacgccggctaaggcgttgccctggtgaagcaccatctgctcgaagagggcagcggtgagccagagggtggagacgcggtggtgagtcagcagtgcggcgagttcatccagagaaggcgtgtgaggcggagcgaggacgaggcgagcaccgtgaagcagcgcgccccagagctccagagtggacgcgtcgaaggcgacgggggccagctggaggaagacttcgtcagggccgaagtggatgaaggggttggcgaggacgaggcgagagactgcgcggtggggtatgcagacgcccttgggccggccggtgctgccggaggtgaacatgacgtaggcgagatcatcaccgcccacgtccgcggatggaggcgcgccatgtggcaaggcggcgatgaggtccgcgtccgtgtccacgcacaccatcaacccgcccgagctgggcagctcatcggcgagcgactcctgcgtgacgaacacgctgacgccggcctcctgaagcagcaaggaaatgcgttcagcggggtagtggtggtcgatgggcacgtaggcgccgcctgccttgagaatggcaagcaggcccaccaccatgtccggcgaacgttccaggcacaggcccacgcgggtgcctcgggaaacgccatacgcgcgcaggtggtgcgcgagctgatttgagcggcggtccagctccacgtaggtgacgacgctctcaccgctgataagcgccatggcgtctggcgtgcgagtcgcctgatcggagaagagaacgtgagtcggtgtatcgcgcgggaacacggcggacgtcgcgttccagtcgaccaggagctgctgacgctcttctgtgcgcagaaggggcaactcgaccagacgctggttctcatccgtgacgatggcttccagcagcgtgcggaagtgccccatcatgcgcgcggcggtggaggcatcgaagaggtcggtgttgtagttcagtgcgccggagagcccttccagggtctcttccagcaagagactcaagtcgaatttgacggtctccagctccgtctccagcacatgcaacgatagcccctgcaactcaagtcgcacgggcggcgtgttttgcagggtgaaggtgacctggaagagcggcgagcggctcgggtctctcgcgggttgcagcacctcgaccagcttttcgaacggcacgtcctggtgttcagacgcacccagcgccgccgcctttgcctgagccaacagctcacggaaggggagctccggcgacatgcgggcccggaagaccagcgtattgacgaagaagccgatgagcccttccagctccggccgggtgcggcccgcgatgggcgaaccgacgcagaggtcctgctgaccggagtagcgcgaaagcagcaactgccaggtcgccagcaggaccatgaagggcgtcgcctcctgacgacgcgccagtgcagtcacagcctcggagagcttcgcgggcatcctcaccgggaggagcgctccccggtacgtctgcaccgctgggcgcggcctgtcggtaggcagctccagggccgcgggggctccatcgagctgttcacgccagtagttcagccgtgagtcaagcaccggcccctgcatccattctcgctgccagagggcgtagtcggcgtactgcaccgaaagcgggggcagctgtgcatcgcggccctggacggcggcttcgtagccctccgccacctcccgtaccagcacgcccacggaccagccgtcggacacgatgtggtgcatcgtgacgaacaggacgtgcctgtccgaagccagcctgagcaagcgcgcccggaagagcgggccgcgcaccaggttgaacgggagatgggcctcctcgttcgcgagctgacgagcccgggcatcacgctcaccttcgggcagggtggagatgtccgtgatgggcaactccagcgtcttgatcggatggacgacctgtacgggcaggtccccctcgttccggaacgtcgtgcgcagcgcctcgtgtcgctgcaccacccgcaacagggactgctccatcgcgcgagcgtcgagggctccgtcgatggccaccgccgcggggttgttgtacgtcgcggtgtcgggcgtcagttgctccatcacccacagccgctgctggacgaaggactggggcagtggacgatcgcgtggcgcggcacggatgggcggcagggcacttgcggtgccgcgagcccgctcggaatccagacgcgcggcaagcgccgccaccgtgctctgctcgaagagggcccgcagcggcaggtctacgtcgaagtcctgccgcagccgcgttaccaactgggtggccaggagcgagtggcccccgagtgcgaagaagtcatcctcggcgttgactgtctcgacatgcagcagagtggcccagtgagcggcgacacgacgctccgtttccgtgctgagcgggcgtgtggcggcactccgaggggcttccggtgccggcagggccttgcggtccagcttgccattgggggtgagtggcagggcctccaatgtgacgaaggccgagggcaccatgtgctcgggcagccgctccttgaggaacgggcggaacgtaccggagtccacgacggtggtggcctccgcctccgcgaccacgtacgccaccaggcgttgcagccctggcgtgtcttcgcgtaccaggaccacggtgtcgcgcaccgcggggtgttggcgcagcgcggactcaatctctcccagttcgatgcggaagccgcgcaccttcacctggaagtcgagccgcctcaggtattccagcgtgccgtcatgccgccaccgggccttgtctcccgtgcggtagaggcgggcccccggctgtccactgaaagcgtccgggatgaagcgctccgccgtcagccctggcctgccaaaatagccccgggccacaccttctcccgcgatgcacagctcgcccgcggttcccagcggagccagttgctgtcgcgagtccaacacgtacacccgcgttcccacgatgggacggccaatgacggggacgggactcgggttgccctgaacgcgcgcggaggtggcgcacaccgtgctctcggtggggccatagacgttgaaggccgtcgtgcgctccgtgctggccagtcgattccagagcatgggcgacatggcctcgcctccacagaaaatcctggcggggacgtggcttcgctcgaggagcccggcctggagcaggagtgccagttgcgcaggcgtgcaatccagcatgtcgacgcgctgctgctccagccacgccaccatcgcctccgggtccttccgcgtggcctctggcaccagacacaggcagtggccctccgcaaggtgcatgagccgctccacggtgccgtcgaagtacagcggcgcgttgagactgaggcgctgcccggcgggctcggccatctccagcgactccgtcattccctgcagcaaccacggcagcgagcggtgctgcaccatgacgcccttgggcgtgcccgtggagccggacgtgtagatgatgtacgcgaggttctctccgcgcacgttcgcggggacgttgtacgtgggcagtgacgccagcctcgcggcctcggtgtccaggcacagcacatgccggacctggggccgccaggcctcggccaggtgctggacggtgagcagcacggtggccccgctgtcctccagcatgaaggaacgtcgctgcgagggcgccatcgggtcgatggggacgaaggcgcctccggccttcagtaccgccagcaggctgatgatggcctccagcgtgcgctccaggcacaggcccacgcggacctccgggcccacgcccagcgtgcgcaggtgcgcggcgagctggttcgccttcgcattgagctgactgaaggacagcacctgctcatccagcgccacggcgggcgcgttgggcgtgcgtcccacctgctgctcgaagcgcgtgtggaagatgccaccgcgctggacgctggaggtggtgctgttccagtccaccatcaactggtgctgctccgcctccgtgtggaggggaagggtggacacggggtcatccggtgacgccacggctccttccagcagcagccggaggtgctcaaccagttgctccgctgtggcgggctcgaacagctcggtgctgtagatgagcgcgccctggtagccctccgggaggcgggccagcgccagctccagctcgaaccggctgacaccatgcgtcggctccagctctcgcagggagaggtcctggagggccagatcggagcccggtgcgttctgcagggcgaagatggcctggaacagcggcgtgcggctcaggtctcgcgagggctggagttcctccaccagccgctcgaagggcacgtcctgatgctcatacgcgcccagcgtggtgtcgcgcacttgcgccaacaactggcggaaggtcgtctccggggagattcgggcgcgcatgaccagcgtgttgacgaagaagccgatgagtggctcggactcggcctgacggcgcccggcgatgggcgatcccaccagcacgtcgtcctgtcccgagtgccggcacaacagcgcctggaaggccgcgagcaacagcatgaacggcgtgacgccttccttctgggccaacgcctccagcgcctgactgagcgcgaacggaagctgtacctgcacgccagcgccttggtgcgacaccaccgcggggcgcggcttgtccgtgggcacgtcgagcgcgtgcggcgcgcccgcgagctgctccttccaccagcccaggtgctgcttcagcgtctcgccctgcatccacccgcgctgccacaccgcgtagtcggcgaactgcacggggagctcaggtagggacgcgggctgtccgcgaaggactgcgtcatagaacgcggccacttcccggacgagcacgcccatggaccagccgtccgagatgatgtggtgcatgcacagcaccagcacgtgttcggtgggggtcagcgtcagcagggtgacgcgcagcagggggcccgtggacaggtcgaacggctgctgtgcgtcgtgggtggcgcgcttcaacgcctcggattcccggtacgcccgcccctggagtcccgagaggtccaccaccttcagtggcagcgctcccggtgggtggatgacctggcggggctcgccgccctgggcctggaacgtggtgcggagtgattcgtgccgctccaccagggcattcgcggcgcgctgcaaggcgttgacgtccagcgtccccgacaggcgcagcgcggacggcatgttgtaggaggcgttgcccggctggagctgatccaggaaccacaggcgctgctgggcgaaggacaacggcgccggcccgtcacgccgggcccgggtgagcggtggcagccgggagccgggcgtggcggagcccagacgttctgcgagggccgccacggtgggggcctcgaagaacgcgcgcaggctcagctccacgttgaagtcggcacggacgcgggcgaccacgcgcgtggccaacagggagtgaccccccagctcgaagaagttgtcgtggcgtcccaccgtggggactcgcagcagctcctgccagacctccgccagccgggcctccatgagcgtcgcggggggcatgctgtcgcgcttgagggccagttgtgaggcctccggtgcgggaagggccttccggtccacctttccgctgggcgtcaggggcagggcggccagtgacacgaaggcgccgggcaccatgtactcggggaggttccctcgcaggtgttcccggagagcggacgcctccagttggcccgcgcttggcgcggacgacggcacgacgtatgccaccaatcgcttgtcgccagcgacgtcttcgcggacgtgcaccacggcgtcgtggaccgtgggatgcgcgcgaagggcggcctcaatctctccaggctcgatgcggacgccgcggaccttcacctgggtgtcgccgcggcccaggtactccaggttcccgtcccggcgccaccgcgccaggtctccggtccggtacagccgctcgctgtccacgaagggcgaaggcacgaagcgctccgccgtcagctccggccggcccaggtagcctcgggccacaccccagccgccgatgaacagctctccgggcacgcccggggggacgggctccagctcgcggtccagcacgtacatccgcacgttcgtcagcgcccggccaatgggcacctcgcgctcggcgcccggggacgccagaactccagccgctgacaggttcacggacgtggccaccgccgtcacctcggtgagcccgtacgtgttcagcaggggcagctcgaccccgacgctccgctgccactgggccacccgctccggcgccacgcgttcgccgccaatcaccacccacttcagccctggggggagacgggcggtgcccgcatcgaggctcgccgtcacgtcatgccagaaggccgtgggcaggttgagctgcgtcacgcccgccgctccacacttcgccaggaacgcaccgggctcgtcgagcatgtccggggtccggaggaccaacgtcccgccgctcgtgaggcacgggtagatctcctccgcgctggtgtcccaactgatggaggcgaactggagcacccggtctcctggcgccaccggaaaggacgtccacgccgcgcgggtgaagttcaccagtgactggtgctggacgaccacgcccttgggccggcccgtggagccggacgtgtagagcacgtacgcggaagcctcggggggcaccaggacagcgggggcctggggcacgccggaggaggaggtacctccgcatccagccagacgcagcccgccgcggcacccaggcgctcgcggaacgccgcacgggccacgatgacccgagcgccgctgtcctccaacatgaagcgcaggcgctccgccgggtacctccgagtccagcgggcacgtaccgcccc

SEQ ID NO: 909 - DNA, 6961 bp, Myxococcus xanthus
ctgtacaggcgtgacgtgcacaccgctcatgggtcgacgggtggcacgtcgggccagggccgcggcaaggagggcgcggccacgtgtgtcagccgtaacaagccgcgccccaggtcgagctggtagcggacgcgaaaacccgagtcgagcaccaccaacccaccctggtccgacatcaaaggcccgtcgagcggaaggcccgcggcgagagcgcccagctcacattggagcttctctcgcaccggagtcgaacatcctgccagggtccggagggcccggggagcgagctgaagtcgaagggccatggtcgtttcagactgacgagccgtggcgatgacgacaagctgtaccggaagtgcatatttgacgtcggcttccagccccatgaggggaccacccctcacttcgctgtggagtgccagacacccaagacggtgaagacgccgcccgggccgagattaccgctgccgcgcgaggatacgccgcccttcgacatcgatggcgtaggtcgcttccatgtccatgatgatgttctgcttttcacagacatccggacgcaatgtcacacggacgaatgtcacgccttcggggcccggggatgcaatcacttcgtacgattcacgccggtagagacagcgctccacgtcggtcgcgccgtcgtggggcttcacgtccaggggcaggaagtcgtcgagcgcaagctgcatggccgtcaccagcgctcctgtgagcgtcgtccgcgtctccgccggaaggtcgagcgggaactccacccgcgccgcttcctcagcagacgcgtgcggtgggcgatacggacgctggaagagcgcacatgcgggcaacagcaggcacagggcaaggaggcgtccgcgcttcaagatgtctccaggtcgacgaggctggtccatggctacccatccatccaggtcacgatgcccgcggccttatgctcgggcttgatgacaccgattcgcacccatttccgctcgcgccgctcgaacaactcaccgggtcgggcctcgccaatgtagggtaccagtttcatcacccggcaccccgtgtcgaattgaatccggatgctgaaacgctggcgggactgccgtcggtccgcactcgacatacgggagttggcccacgaatggctgtgatagtcggccaacaccaccgtgcgcccacgcgaatcattcacgaagcgcggcgcgaaacaggccttctgcggctccggcgtcgccttgagcaacgggcccagcgtagacggcaggctcgcgtagtaggtgccgtcgcccagggagtagatggcgccgcagtactcctgcccgtactcgcggccctgcgcgcgaggcagttgcatgatggcggggcacaactgatcaatcaccgcgtccacgtccgccgaaggtatgatggcgtcccaaggaccacgaacccagacatcaccgttgcggtagccgtaatccgccccctccacggggccagcgggcgtgctggaacacgcagccagcaatagccccatgaacgctccctggaaccgcaaccgccgccgcatgcatgcccccatgcgccagaactcgcgcgtggaaacgccagctccagctgagcagtcaactcttggctagcgcgattagcacccacactaaatgctgacaataccgcaatttcctgcctttcataaaacgggcctcatcccgacttcatccaacctatccagccagcatccagcaggaaaacccatcaggtgggtatcagcacatcccacaggcccctgggaagcaccggaggccaagggtgtcgggcatcggacgcggagtgcgctggcccctggcgactccctcgggtccggggtatccgagccccctcgcctcttcttccaccatgtcccggccgctccagcacctgcttctcgtcgaggatgacctcgcctggcgcgagcggctgaccgtggttgctccctgagtttcccgcgagggactccgccaagccctacgcactgcgcctgcccgaggacgtgtccctgccgctgcgccccctgccaggcgccctgagccacgcggtgcgcctgcacctgctgcgcgccgcggagctgacggggatgtagctacccctggcctccacctggttgatggcgctccccgggacgcccccctcgctcctggtgacggtggacggcgtgcaggtggagctggaagtggatgacgcgcagcgacggctcaccgtcagagacgtcaccctgtcaccgaacctgcgccacggcgcctgacggctcaaggcaccggcaagtgccggacctcaccgctctccaaatccagccacacgccccggccaccctcgtcgaatgccagcaagatgctgtccgtaagccgcaccctcgggcggacattcccttcgaacgtcaacacggcgcgggaaaatccgcgcctgtctgtcaaatgaagctgccaatccgtccccaaatccatcaactccaaaaaccattccctcgagagaaagatgcccttgagcgtctcgtggtcgcgctccgtccgaacccgattgcgaagtgtcacgggctgcacccaagccagcgaactcctcagattattccatccgcgtgccacatcctcggggttggagggatattccatgcacaggacagcagcctcaccatccgggaccacggactgatgccagctcaccattttcgggtccgacacctctggaggcagctccgaacggtcgcgcaatgtgggcccgtccgcgagcgtatacgtccaccgctcctgtgttccgacgatgaaactcatgtgtgtggcatccgccgcaatgggaaacgcacggcttgcaagttccgggactcgccagagcgcgcggcagtcagcggcgagcgcatccaccatcatcaccatgttttcagaggacacaaaccagacattgccgtcgtagctgcgggaccagtccgtcaatgacatatcgacccaggggctgcacctgcgtgcgaccaggtccagccgggacaggcgccacacctcgtcccgccgcgcgagtgccaggacccggtccccatggatggaaggcaccaggtggaaggccggcacgtcgaagtgcgccaccgtccggccgtcctcgcgaaccagccgcgcccccgcttcccccagtgcgtacagcagccggccgtctggcagcaccaccacgtcatgaagcgtgaaggtccccgcttcagaggcccgcaccgtgacgtcgatgcgcggccgttcgtgggtatcgcgccacgcgcggtggatattgtcggccagcgacggcaggtccgtgcgcaaggtgccgtcgggcgcggcgcccaacaagcgcttgatgaggctcaggtccgaggtgaaacgggcattgcccgccgcccggtcccgaagcaacgcgcgcagcgtgggcaccaccagcgcggtgcggttggcggaaggaggctcttccacgagcgccagtccaaagacgaagcgctcggacgcgcgttccggcgcgtcatcgtcgagcaactcacgcacccgcgcacccgccaccgtcagcccatccgcgaacgccgtggcccacatcgccagcagccgagcgcccgtcgcgccaccactcgccacgccccgctccagccattcgcgcgccggggcacgattcttcgccaccggccacaccacctgaacggcgcgcgcgtagtcgccggcctcggcgagcgtctccgcccacagcaggcggagcgcaagggcctccggtggattcgaacgctccagccgcgccaccgcgtccccgaaggcaccactgcgtcgggcgatggcgacggcgcgcgctacgtcctgagccaggaaccactgacgcaccacgagccctggagccagcttgcgcccctcggccagctccgccgccagcttgaagcggccatgccgctccaggaaggacacggcttcctcgacggcgcccagcagctccgcgaggacgaacgcggcttcgtcgatgcgtccctcgcgctcgaagcgacggaaggcctcgcggtagcgctgctggagcgcggagtagaggttagctcctcccccgaacacggaccccgccgctccccgcgcctccgtctggagggtgagttgcgcacgaggccctggcagccccaaggcctcgcgtgcgtcctcgctcagctccttgctcagtggaatggcgtgccgcaaagcctcgtcgaggttgccctcctcgaacatgtcgaagaggcggcgcacgtactccgacttccgctgccgcacccacgcgccgagcagggtgttgcgcatcatccagtcggacagccagctccagggactcgggccctggagtgctccgggggccaccgatcccaagagcgcggccccaagccgcgccatccaccctggccagccacgcccggactcgccgcctccgcgcaccgccgttccctgacgggagaacttctcgcgcagccgtgcccaccatcccgggcggcgcgccccagcggcgacgggagcgcggcgcccctccatgcccgcgagcattttctgtgcttcaggtgacggctcgggcacgccgggaccgaagcgttcgcgcgacggcggaggcacaggctccagcacgggcacggggggcggcggcgcgcccagcgtctccggggctcggagcgtccacgcggacacgtcgagccatgtcgacacatccacccgcggcatcgcaccggcagagaacaccagggaccgtcccctgagcaccagcaacaccgcgccttcatggagactcgggtgccgacgctccgctggagacaagggcgccgaggagaggaccccgtactcccgagtgagcggcagccccagcgcggcttcgcacaccaccgtgcgtggcgcggacatctccacaagatatccacccgccacggtgtgaacggacatgtcgggcgtccacaccgccagaatccggcgccgagcctccgcctcaccgagcagggccggatcgagccagaaagccgaggcccggaccgtgccccgatgcacctgctgccggggccgtagccccgcacgtgccgtgctcatcccccgccccccgtatgaatacggcacagcaccgcttcatgctccaggtggtacaacaccagctcgccttccgtcgtcagccacccgagcacaggcaccgcatggctggcctccgcgtggaccacgtcagcggcggccaccgccagcctgaactggtgctggagccccacgttccagaaggtccgctggtccgcgtcgagcgccaacagtccggcatcccctttcgcctgcggacagaccccgacgcccacggctcgcaatcccgagcgcagcgccacgagttgcaccgagtcccgatggtgcaaacaccacatgcctgggattttgttcaccgcgagcaacccagcatccggatgccccgaatggtgcgatgcaccgaaccagagggtgtcgcccctcgagtcctgcaggcgaacctggcgcacctccttcgcactcacgatgcccagccgcatgcaactcgcagcccccccattttcgtcgcgcgtcacgacgatgctggagcccttcacgtgagcggcggcgatgacccgctgagccacctgggcggagaccacgcggcgggaggaggcgtcctcctcgaagaaatagagcctgtcgtccaggccggacaggagcacgcactcccgattgaatgcatcgagatacgtcgtcagccggccggggggctgtccacgagcaggattgggtggatgcgcctgcgtatcgcgcagcgtccaggggaacgccttgggcccacgagtcctcgactgatgttgcagttgcccccggaaggcataggcataggcgccctgccgccgcatcagcacgagcagccccccctgccgccgccaacccgcgcccaggaaggtctcatcactccgaggcatcatccgctggggccgagcgagggtggcgcgaggagaattgggcagcgccatggcgccaacgcctcccccctcgtagaagagcatcaaccggcggccatccgcggagaaggcaaaccccgacacccgcgagtgctggactgtcttcacgggcacggcgacgcgcgcgcggaacgggtctctcaacagacgcacgctgtcgtccggagacggcaggtcgagcaacacggagcgcggagcgcgcgcggcgggatgcacctccaccgcgagctggcgcacctcgggcgccaggacttcggagacctcgatgcgcgagagcgtctccgcccccacgagccgggacaggcgggaagaccccacgagccaggcgtccgccgtccgcgcgccgagctcgagtgcctcacaccaggccgagagccgctcagccgagggcggcgcggtgtcacgcgcgttcaaccaagcgcccagcgtggcgggcgtcacttccgtgaaccagccacgccgcgggtctgcctgaagcacgccccatgcgaacgtggcgcccgcggcctccgccctgcgcgccatgacgatgagcaacgcgaggtgcgcgatgcgcggagcgccaagctggtctggccccgcatcgagcaacatcaccgtgcgatgcgcgcgctggggctggcggaacgagggcttgagataggacagctctccgaaggcggcacggcgcaccagttcgtcgggtgcctccatggcccacagccattcactcaccagcagccggtcgaaggagcctcttcgcgacaggccgtcatacccttgaggctcaccgccctccctctccgagggcgcccgcagcggccccagcgccacggacaaccgggcaaccagcgggcccaggttcagcgccgcctccagcgggatcttagctaggatggcctcccaggggctgtagcgcataaggctacgtgcacgcggcctgtcccccgaagtccccgtgtccacacagaacacagtagtggtaacattatacgcggcccgcgaggagtccatacgggtcagcggcatgtttgcggacaa

SEQ ID NO: 910 - DNA, 7659 bp, Myxococcus xanthus
gtgctctaaggtccggcaccacccgggggtccgcgctgaacacgccgtccacgtccgagtagatttcacacgcctccgcgtccagcgccgccgccagcgccaccgccgtcgtgtccgagccgccgcgccccagcgtcgtcacttccttcttgaaggagacaccctggtagcccgcgacgatgacgaccttgccgcgcgccagctcgtcgtggatgcggtacggccgcacctccacgatgcgggcctgcgcgtgcgcgtccgtggtgatgatgccgctctggcttccggtgaagctgatggccggcacatccatctcctggagcgccatggagagcagcgccatggagatgcgctcgccacacgtgagcagcatgtccagttcgcggcgcggcgggtccaccgaaacgcccttcgccagcgccagcagttcatccgtggtgtcgcccatggcgctcaccaccaccaccacctgatagcccgcctcgcgcttgtccttcacccgctgggcgaccttgcggagcttctccacgccggcgaccgacgagccgccgtacttctggaccacgattggcatgattcgactcactacccttgttcggcgtgtccggaaaaccacactggtaggcctccctgcagaagtctggccagccgcagaacgccgcccacacccggagtcggtgtcgccttgacacgccaatgtcgggtttaataccgcgcccatgccgatgatcgaggtccagcacctcacgaagcgataccgagaccgggtggccgtggacgacctcaccttccaggtcgaggcgggtgagattctcgggttcctgggccccaacggggcgggcaagtccaccaccatgaaaatcctcaccggcttcctcccgccgtcggagggggtggtccgcgtcgggggctatgacgtggaggcccagccgctcgaggtgaagcgccgcatcggctacctgccggagatgccgccgctctatgtggagatgacggtgcgaggctatctgcgcttcgtcgcctcgttgaaggggctgtcggggagcgccctcaaggccgagttggagcgggtggccgcactcatgggcgtgacgcacgtcatggaccgcgtcatccagaacctgtccaagggctacaagcagcgtgtgggaattgcccaggcgctgctcggctccccgccggtgctcatcctggacgaacccaccgaaggcctggaccccgcacagcgcgccgagctgcgcgccctcatcaagggcctggccggcaagcacaccgtcatcctctccacgcacatcctcccggaggtcacgatgacgtgccagaaggtgctcatcatccaccagggaaagatggccgcgtacgacgacatctcccaactggcccgcatccacgggcaggcggagaacgcgtcgctggaagaagtcttcatcaagctgaccgccgcctgagcgcggcccccttttcgaggaccccgcctccatgcgcaccgccctggcgattgcccgcaaggaactgtccatctacttcaccacgccgtgggcctacgccgtcttcacggcgatggcggcgctgacggccttctacttcatggacctgctgcaggcgttcaacgacgtccagggcgtggcgcgccgggtgggctgggcgcagatgtccccggacttcaacatgtaccgcaacctcacggacggggtggtggtggagctgtggggcagcgtcctggtcatcaccctggtcgtcacgccgttcctgtccatgcggctgttcgcggaggagaagcgcaaccgcaccttcgagctgctgatgacggccccggtgcggcccattgaaatcgtgctgggcaagtacctgggcggcctgggcgtcatctccgccacgctggcgctcacgctcgtcttcccgctactgctgtccgtgctgggccacagcgagtccgggctggcgctggagtggtccaccgtcctgctgggctacggcgcgctgctgctgtggggcgccacctgcatggccgtgggcctgttcatctccgcgctgacggagagccagatgctggcggccttcctcaccttctgtgtcctgctggcgtggatgctgctgggccaggtggcccgccgcgcggaggagccgctgcgctccgcgctgtcctacgtcgcctgcgacctccagttgcaggggatgatcaagggcgtgctggacgcgcagtcgctggtgttcttcgcctccgtcatcggcttctcgctcttcctcacccaccgcacggtggatgcgcagcggtgggcctgacatgaaggcggctcatgtcggcaaggtcctgggcgcgttcggactgctgctgttgctgtcgagtccgttcaccctgttcatcacctcggacagcgccgtcaccgccgccgtgaaggcgggcgcggggctggtgctggtgggcatctacggcgcgacgaactaccggcagttcggccagttcgccacccgccgctccagcagcttcttcgccaccacggtgctcaccacgctgggcgtgttcgccgcgctggtggcggtgaactacctggccttcaagcagaaccggcgctgggatttgacgcaggcacgcatccacacgctggcgccgcagacggtgtccacgttggccgccattcccgaccaggtgcgcgccatcgcgttcatcaccccggcgcatgcccagtacggccagttggaagcgctcttcgcgctctaccatgccgaagcgccggggaagttcgagtacaccttcaaggacccgcgccgaagcccggacctggccgcgaagtaccaggtgcgtgagggccagacggcggtggtgctggtacgcggcgagggcgagtacgccacgcacacgctgctcgccaccgtgtccgagcaggagctgacacacgcggtcctcaagctgaacgcggtgggcacccagaaggtctatttcgtcaccggccacggggagtggccactggacaaggagcaggcgccgccccaggacccgggcgccagcctgtccgaattccggaggcagttgctccaggagggctacaccgcggaaccgctgaacctcgcgggtgtccaagacgtgccacgggacgccgcgctggtcatcatcgcgggggcccgggggccctacaccgcgccggagaaggagctgctccagcgctatctcgcctccggaggacgcatgctctacttcgctgacgccggcctccgtgatggcctggacggactgctggcggagcacggcgtgcaggtggatgagggcatcgtcgcggacgcgcagtacaacagcggcaatcccttcgtggtgctgtcgctcttctacagcgaccacgagattggcaagccgctgcaccagcggggactcaacgtggagttccccaccccacgcagcctgaccctgctgcgcatggggatggcgccgggcgtccaggtgcagccggtggtcctcacgtcccagtacggatgggtggagagcacgccagaggagaacgcggtgccttcggatggcgagaagacgggccagttggtgctggtggccgccgtgacgcgtgatacccaggcctcgccgggcaagcgctttgatgaagcgcgcctggtggtgatgggagactcggagctcctcctggacccgaactggggccatgagcccaaccgcaacctggtgatgaacgcgctgggctgggcgtccaaccagctcacgaaaatcaccatccgcccgccggaccgcgaggtgtccacgctggagctggacgcggcgacgctcagccgcatccgattcttcgccacggacctcatgccgctgacgctgctgggcgtgggcctggccatctggctgtcgaggcgcaacaagtgatgccggcccgcggacggtggcggtggaacatcctcaccgtcgtcacggtgggcctggggctcaccgcatgcaccggtgagaaggcgtccgaagcgagcgaggcccggcggaaagccgacgcccagcagcgcctcttcatcacggggatggaggagacgcgcggacaggacaacggggcgcctgccgcgaagcctgtcttcacacacttgacggtgcgggcccggggcgacaccacagagctggttcgcgagcaggacggcacatggaagctgacagcgcccgtgtccgctcgcgcggaggcggccgtggtggagaccatcctcggcacactggcgtcttcgagcttcagcgccaccgtgaaggaggcgcccaccgacgccgacctggacgcgtacggcctgaaaccgcccctcttcaccgtcacggcccaggccttcgtgccagatgcccaaggccagggggcgcaggaccccgctcgccagcgcacggtgacgctgcactgtggcaaggagaacacctacgacggctccgtctacgtacaccgagacacggagccggcggtccacgccgccgcggggacggtgcgctgggccctggaccgggacaccttcgccctgcgcgccaaggacctcctgacacctttggacgagcgtacgctgaagggcatcgaggtgaaggcgccgcagggtgcgtatcaactggcgcgagacgcggacggcgcgggctggcagctggtcgcgccggtggccgccaacgcgaacgcgatgcgtgtcgcggagctgctgaaggccctggtggagcagcgggcactgtccttccccgaagacacgccggagtcccggaaacgcttgggtctggaggccccggtggtggacgcccgcttcaccggtggcccgggcgagccagtgcgcgtgcggatgtcccgcgtgacggacgacggcgccgtgcgcgcctatgcgttgcgcgagcaggggacgcaagccgtgttgggtgaggtgcccgaggacgccctcggcgtgctggacgtgagcgtccgggagctgaaggaccggcgcgtgctggagttccggcgccaggacgtccgccgcatcgtgttccacccgggcggtggcgcgcccgccatcaccgtggtgagcgcgtcggaagccaacgaaggcgccgggcactgggacatggaggccccgcagcggggcaaggcccagcacttcaagctcgcctcgctgctgcgcgcgctggaaggactgaaggccacgggctacggcgagacgaaccccaagaattgggcccggtatggcgtgacggaggactcccccggcgccgtgctgctaggcgcggacggacgcgaactggcgcggctctggctcggcactgaagtccccgacgaacccggcacgatctacgcccgcggctccggccccgacgtcctcaaggtgcccgagtcacgactgacgttgcccaccaggcccgaggacttgcaggaagcagcgaaggcccccgacgcaccgaagccgcccgcgaagacggagcaggctccctgagcccccgtccccgacttaccgtcagacagggcccatacacgccaggtcagcgtccgtcaccggcatcccttcacgagcgccggtgcggaacaaggacctggcgaggctcacagcttgatgacctccgtcccccgccggggcaggacgacgcggaacacgcgatggagtagctacacctccagcaacacataccgctggtccggggtgtgcttcgccaacaggggcatggccacgttgtagacggggatgccgctcttcgtctttccgttgcgagcgccgtggtgcgcgtgcccgtggaacaccgcctccgcgccgtagtggtcaatgggcatggacaggcggctggtgcccagaaaggggcgaatctcgatgttctccccctccagcgtgtccggcaccggggcgtagtgcatgatgaccaccttcttctccacgtcgaggtggctcagcgcggcctccagcttgagcgactccgtgacggcctcctgcacgaaggccttcgtctggccctcgccaaaggcctggagcgtcgcgttgccgaagccgccgccaaagcccttcactcctgccacgcccaggaccttctcgaagatgaagtggtccccgtccaacacgtggacgccgaccttggccagctcgctgcaaatctccttcacctggttgtgctcatagtcgtggttgccgagcaccgcggcgcagggaacgcggagcgcggacagctcctccgccagcaccttgccctcttcaatcattccgcggtcggtgaggtcgccgcacaacacgagcaggtccgccgtggcgttcacctgcttgaccagttgccggaagcgaccgtggtggtcctcccggcagtgcaggtcaccgaccgccgccaaccgaattttcgagcccggatcgcgcgccactctcgtcccctcgctgtcgttcgttctcgtcccaggacctcccgtcactgaagccccagtggtggatgtccacgtgatagttcacgcgggaaatcaggttgccgcggcacagcttctcttcccagcacccctcgcgcagggtgtgcagcgtgcggctcatcagctccgccatcacccattcgggaatggcgtcccgctcggacggataggcgaagcggaacatcatcaggtgactgagcaggacctcccagtaccggtcgaaccggcgcatcatccggtcccagtccatgttccggcccgccttcagcagcaggtggttcacgtccgcgccgtcataacgctcgcgctcgttcacgaacgccttggaccagatcatctcctcggcgggagcgaccagacactcgtgcccgaagatggtggcgcgcggggcgtgttcgaaccactcgtcgtccaccaccgccacgccgttgccggaggagaagatgaagtcgacgaagtagtcgcccttgaaggccttgtagagccagacctcgtccgcgcgctcggtgcgccaaccgtccttctccaggacttgcagcgcccggagcgcgtccgccttgcgggggaagaggtccaggtccttcgtgtcgcggtagatgccggtgtacgtcgcataggcgtaggcaccgcccacgacgaagggcaccccggcgtcgataagcaacccgacggccctggcccgggcgttgatttcgtccggggcccgctcacgctctgccagctgcgcgtccgtacccatctcgccgggatggttggggtgtctcttttccatggccgaaaggtagggactgagaatttcggccgtccgctggtgcggaatagatgcctggggagcgggcagccaacctacaagcattgtgattccggacgtttcgcgcaccctgcaggcgccttttccgttttccggccgagctgtgtccatgcaggcagacacgctgctgcacggcccgccgggggccgttcgaagggaacgaggaccatgctgcgcaagagcttgctgtgtgccgccctgctggtgacgggctgcgacaacgcgacgagcgacgaaggcaccttccgggaaggactgccctcccaggcgatggtggagatgcgctcgccctccaggaacaacgggcagggactgacggccttctacggtgaaggcccacaggccgagtactatcctgaaggccatggcgggcaggaggccatggagacgccggacctggtgcgccggttgctggtgcgcgtggacgtggagacacaggcggccgccatccactcccacgtcgatggaatgacgttggaagaagtggccgcgctggtgagccgctcggtg

SEQ ID NO: 911 - DNA, 7982 bp, Myxococcus xanthus
ttcatccgggcccgttgttccaggtcctccgcgacacggttcgcgagctcccgcagcgcggccaggtcctcggctcccaagacgagcgggcgcgtgtcgatgacgcacagcgagcccaggacttcgcccgtggaggtcagcagcggtgcgcccgcgtagctgcccacaatgccgtcgcgcaccagtgggttgtcacgaaagtagggatggcgccgggcgtccggtacgacgagcggctcgcgcccctgcaccacgtgatgacagaacgcccagtcgcgcggcgtgccccggtccttcgcgagggtgggtggcaggccgacgtgggccttgaaccactggcgctcgcccagcaccagcgtcagcagcgccacgggaacaccgaaggcctgggcgacctccttcacgagctgctggagctccgcctcgggcggtccgttgtcgaccaggtgcatggccgcgatgctcgccagccgttgccgctcctgctccgcggccccctccgccggaggcggctgtggtgcgagctgccctgcgagtacgcgacgcagcgtgtctcgcatcacctccgcggaggcccggcgactgagcaacgcatggatgcccagcgcctccttgagctgccatgcgcggacgcggagctcgtcgaaggcagtgaccaccacgacctgtgttgcggcggagtcctcctgttcccgaagccacgtcagcaacgcgaagccgtccagccggggcagcgccaggtccgtgacgagcagcaggggcgcacctcgctggcgcacgacatcttgggcatccgctccatccttggcgacgacgccttccaggccttcctccgtcatcagggacaagaggccagcggctcgctgtgggtcgggctcggcgatgagggcgtagcggagcatgtaggagcggggatgctgccacggctgctgcctggctcaaggcttcgtgtggcgcgggttcgcccggagcggttctttggctatccgctagtcctggtgcattgcgtcggcgcgggcgcgctgggcatctcgctgtggcgccgccggctccacggatgcctgggggtagcggatgaagagccgacggagggcgcctcgctgccggcccatctcctgcgcgcgcgacgccgcgtccaccaccagcatcagcaggaggcccacccacgaggggaccagcggaatgacccagcctgggtccgacgccagccacgccaccagcgccgtgtgcaggaccgccagcgtcaccgcccatcggaggaccgcgccggacgtgcgcgcgcgccggcaaagccagacgaaagccgcgagcaccgccgcggtctccagaacgcccagcagcgccaccagtcccgacgagcgcatcagccggcccgaccgcaggttgtccagggcgaaggcgtgaatctccacgccgggcaccgccacctggccgggcagggtgctctggccatgcagccccgtggcggtgacacccacgaagactgtcttgcctcgcagcgccaggtccaagcccaccgagcgcgggtccgcgtggagcaggtccgccagactcacccggggaagccagttgggtgcgggcagccgcatcaacggcgcgccgtggtcccatgccgccagctcacgcagaggctccgcccgttcgggcgtcaggtgcagcgcggtggccagtgccagcgaaggccaggcctgtccgctcacgcccacggcgtagggatatcgacggatgacgccgtcaccgtccaccagcatgttgagtgttccactgccccgagccgccatgcgcaggggcgcgatgcttcccgccacctcccgggcctggagccgcagtgcgtgggcgggcagggccagcggcgtgccgagggcgccatcctggaggggcgccatcaccgggacgtcgtccgtgagcgccgcggctcccaggacgacaccgttcccttccgaaatcgcttcggccagccgggcatcgccgtcgcgcgcgaggagccgtgcctccaggtccgccgccaaggcttcacccgcgggctgctccgtcagcccggagcggcggagcgcctccaggatgtcctcacccagttccagcgcgtcacgcggcccgggctggtcgaagacgacgtccaccgccactgcggcggggcgctgggcggcgagcgcatggaaggcgcgggcccacgtggtgcgtgacagcggccaacgctcgctcagcgtcgcgagggcgcggtcatccacttccaccagcaccaggtccgcgctcggaggtgcggcgggcagcagtcggctcaccgactgggcgcagagcgggcgctccaggaagccctgtgcgccaccggtggccgccgtcacccccgccagcgcgatgcccacgcatgcacccagtaccacgagaactgcgtgcgatggcacactgaggccgactgggtggcggtgctcgtcgggactggagtccatgggcgggggcctgctgggaggcagggcccggccatcatgcgtgtgcgaatgggcgcacgcaacgcaacagtctcagggctggacgtcgaaggcgtagatcttcgaggggaagcccacgaagccgtctccgtccacggccatcacccgccagaaccacttgccctggcggggcccgggaatcgccagctccgggctggcgctgtcatacgtctggacgctcgcggcgaagtccgccgtgcgagccacctccacgcggtatgtcgcggcgccctccagcgtccgccaggacaccttcggggccgtggcgaacgcgcctccccgagggcccaccagcgtgggcgccggcagcagcgggcgaggcggctccggaggcgagcccggcttcgcgcgcgaaccatgtccgcccgacacctcgacctcggcctgctccgcgctgagggccaccttgccttccagtgtttccagccggctggtgccgtcgtcctgggccgacacgcggaaccgggtgccccgcacaccggccaccgcgccgcgcgtgcggacctcgaagatggagcccgcgccacccggcgccgcgtccgtctccacggtgcctcgcagcaagtccaactgcaccttgcgctggaggttcgccatcagctcgatggcgcccaccttgatgagactgttctccaccacgcgcaccatgctgccgtccgccagggccagctcggcccgggcgtcctcgccggtgcgcagcagctcgcccgggtagagcgcgtcacccaccgtccgcgcgaggagttgggcttccgtcgcgccggcctccaccgcgccgctggccgcccgtagccgggccaccgcgggctgggcgggccgctccacgtaggcgaactggagctgtgcgggctcgccctccacggacggcggcgccatggcggacacgcgcgtgcggggcacgcccgccgccaccagcacatccgcggcccgtttcgccgcggccaggccctggccgtccagccgttctgcgtccggaagcttcgccgccaccgtcacggaacggatggcggggcgcgccaggagcgcttgggctacgtgcgccaggcacgcgtccgtctccgcgccctggggggccagcggccggccgaacacgatccggccgctgtcgaagcgcagcccgccgcacggcgcctgcgtctgcgcggcgagcgcgggtggacccgccagcatcaccgccatcatccaaggggctgtccgcatcaacgcgtgcctcctcccgtcgaaggctcggcgaccttcacgatgttgaactcgacgcgccggttgttctcgcgccccttggccgtctcgttggtgtcgaccggcttcgcttcaccatagcccaccgcgtccagccgctgcgccgcgatgccttccttcaccaggaaggccaccacattcctcgcccgccgctgggacaggtccaggttcttcatgtcgttgccctggtcatccgtgtggccttccacacggaccatcaggatccgcgggttcgccttgagcgtggcggccacctgccgcagcaggccgtgggacctggccagaatcacgtcctggcccgtgccgaagtacaccttgtccaggatgacgatgcgcgcgccctccacgcgcacctgcgccttgcccttgtccgggcagccgtcatcatcctgcacgccgttgatggtctccgcctccagcgggcactggtcctcggcgtccgggatgccatcctggtcgttgtcggggtcggggcaaccgtcctcgtcctcgaagccgtccaagtcctccggctcggtctggcacaggtcctccgaatcgacaacgccatccttgtcggtatccaccggcgcgggcggcagcgccaggggcgccggggccggtgcgggctggcccgcttcggtgggtggctggtgggcgttcgggtcatccgggcaaccgtcctcgtcctggaagctgttgaaggtctccggctcggtggggcacacgtcggtgacgtcggggatgccgtcaccgtcatcgtccgggtccaggcagttgtcgtcgtcctggaagccgtcgaagtcctcgggccccaggtcgcagaccggcgcggtggaggcggggccgcccttggattcaaacggcgtccaggccacacccgcgagcacgcggaaggacggggtgccatagccccgcgacaggcccgggcccgcgcccacatgcgcagccaaccccggggtgaagcggtatttcagcgcggccaggacttccatgggccgctcctcggcgctcgtctccttcaggcccagcgcgcccgccagggtggcttgcgccgtgagggcctgcgtgaggggcacctcggcgcccaccgcgtaggcgaactcgttgcccacgcggaggttgcgcaactgctcctcgcggcggacgttaaagcccacgttggccagcaggcggacggcggtggtggcccactccgccacgaagcgcggctggaacgtcaccgtgtccgagcccaggaacttcgagccgccgcccgtgggcaacgtcaggggcgccgtcaccgccaggtggatcccgctgtcggtggagagcaggcggaccttcggcaccagccgcaggtcacccacgcccgtggtccccacgccgttcgacaggtccggcgccaccgcggcggcgggttccgacgtcgtgtgggagatgggcagcgcgacgccaagctccacccggtcgaacagggagatggcgcccatcaggtccagcgtgagctggctgtccacgatgcggtagaggaaccggtccgctcgcgggtccacgaggttgagcggatcattcgcgtagttgagcgacgcgcccaggttccaggaaaggtgcggcgcgatgcgcgcgccgtgcatgccgagcacgtcataggcacccggcgccggcttgtactgctgcacgtcgatggcctgcgacgccgcgggttgggcgctggcggtggctgaagccaccagcaacaacggggcggcgagccgtgtcacgcggcgaaggaagctgcgcggtgaggaccgtgtgaagtgaggaaggcgcatggaaggtcgaggctgggacgggccccgccgaggagccgcgaaggttgtcatcggcggatgactgactcaagaaacgatgagccgtcggtgtcccagttgttcggggccgtcccggcgaaatgcaactcgatgacgcatcgtcgcgcggagccagggggctcgcacgcggcggcaggggcgcgaactacacggcggcggcggcgagcaggcgtgagacgtgctcagccaacgtgggcagcggctgcggcttggaaagcaccaggtccacgcccagcgcctgcgcgcggtcggtgagctcctgggtggcgaacgccgtcagcagcaccacccgcgtctggggcgtgtagcggcgcacgaagtccgccagcatcagcccttcttcggagagcgttccgctcaggcgcaggtcgctgatgaccaggtcgtagcggcccgtcgtcatcaggtccagggcctcgtccagcgcgccggccgagtccacgcggtagccggccccggagaagaactggcccaacacccagcagagggaagactcgtcgtcgacgatcaggatgttctgagccactgagcgggccctcaagcaagctcagggccagagacaggcttgtctcggttccaagcaaattcgggtgcttgctcccgcgcaacggctcaagactgcttgctgcgtccagactacggatccggtttctggaatccggaccggttgatgcccaggcgcttcagccgctcgtagagggatgaccgggggatgccgagccgcgcggcggcgcgctccacgtggccgtgctcgcggcggaggatgcgctcgatgtggcggcgctccaactcctcgagggtgaggtggtcgtcggcgtcggaggcgggctcgccggcggtggcctcgaagcgcaagtctccccgggacaagggcccgccgccggacagcagcaccgcgcgctccagcacgttgcgcagctcgcggatgttgccaggccatgcgtagcaggtgagggccatctccgcgtcgggtcgcagccccacgctgccgcggcctcgagccgcgcccagctctgccaggaattggtgcgccatcccgacgatgtcctcgggccgctcacgcagcggggggacatggaggatgagcgtgctgacgcggaagtagaggtcgctgcggaaccgcttgtcccgagcggccacggccaggtcctggtgcgtggccgcgatgaggcgcacgtccacgcggcggtccctcacgtcgcccagccgccggaagcgcttctcctccagcaccttcaggagcttgggctggacggccgagtccatgtcgccaatttcgtccaggaagagggtgcctcggtcggcgacctccagcaggccctgtttggcggccaccgcgccggtgaaggcgcccttctcgtggccgaacagctccgagtcgagcaagtccttggagagcgccgcgcagttgaggtccacgaagggcgcgtccttgcgcgggccgccttcatgcagccaccgcgcgagcacgctcttgccgctgcccgtctcaccggtgatgagcaccgggctgtcgctttcgatgatgcgttcggcctgcgcctggagcgcgcggatggtggcgctgccacccatgaagggattcaccgtcccacggaggatgcgcgaacgctccgccagcagccgctgccgctcgcggcgctgcgacaccagccggtccagcaccaccttgaggacggccagttccaccggcttggtgaggaactgctcggcgccttccttcacggcctggacggccagctcgatggacccatggccggtgagcaccaccaggggcaccgaggcgtcgatgtccttgaggcgcggcagcagctccagcgcggtgccgtccgtgagccggtagtccaccacggccacgtcgggacgcgaggtgcggaacgcctcttgcgcctcggcgaggctggtggcctcgtccacgtcgaacccatgggcggtgaggaagcctctcatgcccaggcggatgccgggctcgtcgtccacgagaaggattcgggtgcgcgtcatgaagtcagggagtctacgtgctgggttgatacacgcgaagaaacagcaggaagcagcagtgtgacttccgcgccgccctccgggtgattgcgcaagcggatgataccctgatgctcctccaggatgcgttggacgatggacaggcccagccccgtgccgccgcgccgcttgctgaagaagggctcgaagacgtgggacaggtcctccgcgcgaaagcccggcccaccgtcgcgcacggtgcaccgcacccaggcccggcccgcctctttcacttcttccgtcgccacccgcaccgcgctgcccgccggtgaatgctgcaccgcgttctccaccacgttgcgaaacacgtgaaacaaacgccgggcgtccattcgaacgcggggcagctccgccgccaattcgcgattcacattcacaccggcgcgttcactggcccttagag

SEQ ID NO: 912 - DNA, 7661 bp, Myxococcus xanthus
cgatgactgccagcccccctgctacaagcaccccatcaccggtgagtggatttgcggcaccccgtgtccgtaatccccggacacacgtgctgaaacacctggggcctcttccgcaccgcgcggaggaggccccgtttcattcccagccaccctgcggcacctgcgtggggtcagtccgtccgcatggcctccacggggtccagcttcgcggcgcgcgcggccgggtagatgccgaacagcaggcccacgccgctgctcatggccagcgacagcatcaccgcccaggccggcacctgcgcgggaagccccaccatccacttcgccagttgcgccaggcccatgcccaggcccacgcccaacgcgccccccaccagcgacagcaccaccgcctcgatggcgaactgcgcgaggatgcggcgcctcttcgcgcccagcgccttgcggatgccaatctcccgggtgcgctccgtcaccgccaccagcatgatgttcaggatgccgatgccgcccaccagcagcgacagcatgcacacgccgaagctggccgcagaaatcaccttcgagatgttgttgaacatctccgtggcgctctcgttggagaacacgaagaagtcatcctcctccaacggcttcaggttgtggcgccgccgcatcagcagcgtcacctcgtcctgcgcgcgctggagcacctccgccgactgggcctggacgctcacccggtagttgcgcaccccgaacagcgccttgtagacggacagcggcatcatcacctggttgtcctggctgcctccacccatgaagctgccgcggcgcttgagcgtgccaatcacctggaagctgcgccccaggatgcggatgttctgccccaagggctgcacgcccgggaacaacgtgtccgccaggtcctggccaatcaccgccacgcggcggccatccaggtactccgcgtccgtgaagggccgcccgaactccaccaccaccgagttcgtctggaagtactccggcgtgccggcccagatgaccacattgggacgcgactcgcgctgctgcgtggacaccttctgtccacccttggagtcctccgccgccgccagcagcaccgacggctgcagccggatggcctccaagtcgccctcgttcagccggggccgccgcgccagctccgccagggacaggttgccgccgaagggcagccgctgcacctggaagcagtcggagcccagctcggacatgctctcgttcacctggatgcgcaggccctcgatgagccccatcatcgacaccaccgtggtggcgccaatgacgatgcccagcagcgtcaggaaggagcgcagcaggttggaacggaacgttccgaacgccagccgcagggtgtcccagattgccatcatcgccgccgtctcccgtccgtcactcgtggcgaagcgcttccaccgggtccaggttcgccgcccgcgccgccggccagatgccgaacagcagccccaccatcgccgcgaaccccacgcccgccaccaccgtcagcggctccaccgccgccgccagcggcgtaatcaaggacacgatgcgcgccagccccaggcccaccacggtccccagggtgccgcccagggcggacacgcaggaggcctccatcaggaactggaggatgatggtgcgcttgcgggcccccagcgcccgccggacgccaatctcccgcgtccgctcgcgcaccgacaccagcatgatgttcatgatgccgatgccgcccaccaacagcgtgatgaggcccacgcccatggccgcgccatagagcgccccggtgagctgcgcgtacatgctggccagctggtccggccggttgatggcgaagtcgtccggcagccccggcggcgtgttgcgctcccggcggagcaccgcggtgagcttgtccaccaccgctggcgcatgctccggcgacgtgagggccaccgcgatgttgggcgagcgcttcttgccgaagtgcgccaggaaggtgcgggagggcaccaccaccaccaggtcctggttctctcccaggatggtgcccttggcctccagggttcccaccacgcggaagggcttgccctcgaagaggatgcgctgccccaccgggttcactccggggaagagcgagcgcacgagctccgcgccgatgacggccacctgcgcccggttgtccacgtccgcgtgggtgaggaagcggccccgctccagggcgaacgagcccaccgtggcgtagtccggcgtggtgcccaccagcagcaccgagccgattttgcggtccaggaagcggccctccacgcgctcgaagaagagcggcgccgcggccagcacgtgctcggacgcgttgaggatgggcggcaccaggtccgcactcaggtccttgcggttgcggtacgaccaccagtcgccgttgagcgtccaggggaacttcgagatttggagcgtgttggcgccaatgctcgaaagctgatcctcgaaggagcggttgatgccctggatgatgccgacaatggccagcagcgtgcacacgcccacgccaatgcccaccgtcgtcagcacggtccgcaggcggttggaacggagcgagaacagcgcgatgcgcgccccctcccacacatcgacccggatgctcacgtcagattctctccgctgcgttgcacgtcgcgctggttggtacgggccccggaacgggtgattgcacgcgacattccttcggtgcaaatccagtgtgctggaaatccgtctgggaccccgcgcgaggccgtcctcggcccgccagtgtaggtgtcccactcccagggcgtgccggcccccacacccggcatgcatccgtgtggccgcccctggcctccacgcgaggtgggaacggaagaccgctgggacaccgcgccaggacggcggcacggtgtcccgggcctcatgattacgggaccacggtcacggaatcgccctggatgcggacgttcaggatggcctcgttggggagcacgtccgcttcctcgatgatgtcctgctcatccacgcccacgcgcagggagtacgtgccgtccgtcaggtcggtgatgtcaatccactggcaggggatgtcggcgacgtagatgtccgcccagccggcggagatgctcattcggtccagcgggaagtggaagggcgccgcgtcatcgcactggcgctggtagtcgaccagatagaagccctgcttgcggccctccacgacctcgttgccctgcgcgtcccgcagcacgtactgggcgaagttggtgaggtgttcgtggccgtggcactcgtcccagacgtagaggtccggccgctcgtccatgttgggcaccgaggccgccgccgcgcccaggttctggatggaggtgctgaagcgcagcaggcgccgctcaccgggcgcgggcacgcagccctccaacatctcacaggagtccgcggcgaaggtgcggcgctccacgtacagcgtgcgggccagcacgtccgcgtccacggagaggtccggcttgccgtgcaccgggtccagcgtcaggccacagcccgccacgggcggcaggtgcggcgccgtagtcggctccgcgggcacccggccaccgccgaagatgacgacccggccccccggcccgtcgacgagccctggcgaaggcgcaacgcccgccaccaggtcatcgaatcggtcgccgttcaggtcccccggcgcgatgacggtgaagcggtggaagccttcgtacccctgcggcagggcgtccgcccgcggccaggaccacacggggctcagcgccgaggacaccccctccgccggcgaatagaagtacagccgcccctcggagcccgcgacgaagtcctggcgctgcccatccccgtccacgtcccctaccgcggtgatggtggcaccgaagttcgcgaagacggggtcacccatggcggtccacgtgggcgcggaggcatagccgccgcccgcctccgacaggtggagccgcaccgtgccaccgcccggccccgtgaagcgctctggcaccccgtccccattcacgtccgggaagaggctcagcgtccggctgtccaccgtccagaagggttgcgccgcgagcccgccgtcacacggcccggggctgccggccttgcagccatggagcagcgaatagacgtctcccatcgaatccaatagcaggaggtcctgtgcgccatccccgtccacgtcgcccgcgcgatggacagcgccggtgtagagcggctccgtgcgctccaccagggtgaagggccctcccggcgcgccgggcgtggccaggaagacggacagcaccagccccttcacgctgaccacgtcatccaggccgtccccgttgacgtccgcgaagacggcgttgttgtacacgccgccgccgggcaccacgaacgcgggctcggtgaagacgctggccaggtccgtctggcccttgaagacgagcgcgccgtactggccggagacgagcacgtccgcggagtcatccccgtccacgtcgcccgtgctcaccgtcatccgggtgccattggtccgcgagttcgcgttgcgccagtccatcaccgccgtcacgccctgcgtggagaagtacggcgcctcgcccgcgaagagcgacacccggccggggtctctcgtgagcgagaggcacggaggcgcggcgacgaccaggtccttctggccatcgccattcacgtcgcccagcgcgatggagcggccgaagcagccggtggcgtgcgcggggtcgtgctccacctgccagagcggcacctcggagaggaacgtgcctccgtccccggctcccgcgtcgcctccgtcgggctgcccggcatccggcgttcccgaatcagggtcccctggctccacggggtcatcacatgcgcagagtgaaacggccagcagcgaggtcagggcgacagcgctaatgcgttgcatggggtgtggtccgggaaatgcgtcgcgggcggtccctcgcgacgtctgggattggacgtccgcagcgtagaccgttcacttcacccagcgcgaagtgcttgcccggtgcggggcatctcccggcgcgcgccccctcgcggcaccggaacgggcgcaatcttgccgccgcacggaaacagctggtgccgcaaagggactctgccggtggccgtctggtaggaacgtccccacctttcccctggcgcccctgacccgggagccaccgcgacacatggccccgtccgccgctcccgccaccgccaatgcgccgcccgccttcccggcgttcacgcgctcccagaaggtcttcacgctgctgggcgcggtgctggggctcttgctcgccgcgctggaccagacgattgtcgccaccgcggggccggccatccaggcggacctgcgaatccccgcctcgctctacccgtggctcaccacgtcgtacttcgtcgcgtcgacgacgatggtgcccgtgtggggcaagctgtcggacctgctgggccggcgcgcggtgttggccgcgggcatcctcatcttcctcgcgggcagcttcctgtgcggggtggcgcgctccacggtggcgctcatcctcttccgcgccgtgcaggggctgggcagcgcggcgctgttcaccgccgcgctggcggtggtggccgacctcttcgagccccgtgagcgcggcaagtaccagggcctcttcggcgccatgttcggcctgtccagcgtggtggggccgctggccggtgggttcatcaccgaccacctgggctggcactgggtgttcttcatcaacctgcccgtgggcgcggtggcgctggcgctggtgctgtcgcgcatgccgcggctgaagccccagcgtgtttcccggggcgggctggacctggtgggagcgttcacgctcgcggtggcgctggtgccgctgctgctggcgctcagcctggggcagacggacggcggcgactgggcctggacgtcgtggcgcatcctgggactgttcgcgctgtcggcggtgggcctggtggccttcctctgggcggagcggcgcgcgcccgagcccctgctcgacctgacgctgttccgcctgcgtgccttcagcgcgggcaacgcggcggtgttcatcgtcggcggggcgttcctgtcgggcatcgtcttcctgccgctgttcatggtgaacgtggtggggctgtcggcgacgcgctcggggctgacggtcatgccgctgacgctgggcgtggtggcggggaacgtgctgagcgggcagctcgtgtccagggtgggccgctacaaggcgctgctgctgggctcgctggtgctgctgatggcgggcttcgccgtcatggccttcacgctgacgccggactccacccaggcggaggtgacggcgaagatggtgctggtgggcctgggcctggggccttcgattccgctctacacgatggccatccagaacgcggtgccaccggaccagattggcgtgggcaccgcggcggccacgttcttccggcagctgggcatgacgttgggcgtggcgctgctggggacggtgttcgcgtccacgctgtcctcggagctggaggcgcgcatggcgcaggccacgtcggcgctcccggactccgtgaaggccgaggtgacacgcgccgcgccgggcgtcagtggcgaaggcggtcccaccggacaggtgttccgcgcggatgaggtgaaggcgcgggtgcgcgcggagttcgacgccgagcggcgccgtgcggagacaacggccgctcccgaggcccgggcgaaggtggacgcggacgagagacaggcactggcagcggtggacgcggcggaccgggcgctgaagatggcgttcactcgcggcgtctccgccgtgtaccacgtggccctgttcatcgccggcgcggcgctgctggtgacactgttccttccggagcagcacctgcgccgcaagcgccggcgcatcgagtcgcgtgccagcgccccggagcagtagcgtcgcggcatggctcacgacgcggaacagtcacccgcgctcacggacgcggaggccgccgagcgcatccacgcgcgctttcccgcgctcgcgacggcgcgggtcgtccgcctgggggaaggcacggaccatcaggccttcgaggtggaggggcgctacgtcttccgcttccccaagagcgacgaagccgccgagcacctgaagtgggaggcgcgcctgctggcgtggctcgggccccggcttcccctgccggtccccgactaccgtttcctcgcgcaccctgccgccgacctcgctgcgggcttcgcgggctacgagaagctcccagggacgcccgcgctcctcgtcgagcctgagcggctggacctgtcggacctcggccgcaggctcggcgccttcctgagagcgctccatgcgctcgaccccgccgaagccgctgcgctcggcgtgccggcggacgacgacccggaactcgaagcgtggtcggccgccgccgtggacgatttgcggctcgccgtcgaacacagccatatggagccgcaccgggctgcggactgggagcagcggctcagggtgcgccccacggagggacgcggcgctccccggctggtccacggcgacttcgccgcggagcatgtcctggtcgattcccacggtgctcccacgggggtcatcgactggagtgatgcgtgcgtcggagaccccctt

SEQ ID NO: 913 - DNA, 8320 bp, Myxococcus xanthus
gccggggtgccgaccttgaagatctggcttcgatcatgcaccaggacggcgccagcgaccgtcccactgtagtccatggagagcaccttcccgaggaacagggtggcgccaggctttgcgggaccgcgctcgacgggcgccgcgcaggacgacaggagggcgagtgcagccacgagcttggagccacgggggaatgcacggggaggacatgaggcatctcgacgcagaggtccagacataggactcctttaaatgaggtgagacaccatacacagaaattcaatcaaacccacacacaccaaaggagcaaaaacagacgcgtcaagacatcgtccgacgcgtcagcaggtgtcactgacacgtcagacgcggcccgtccccagggagcatcagccgtgaggctgtgaactgacacgacggactgtccgttgacacgtcagcgccggaccgacgcgtcagcgcgagccgcgccctgcaaccgtccggtccgccattgggtgatacacgctagtagacgcgagcattgagtccctgccgtgagccccatccaccccacccgatccgtatcaacggactccgattcgggaggtgacggggccctcgggacacaacctgatacgggcgggtgcggcgaggccctgcgcccgagcgagggcctcaccgaggaacagcacaggcgtcccaggcgggcgcgccctactccagctcgcgctggagcttcgccagcaggttgagcgcgtccaggggcgtcatccggtcgatgctcgcccccttcaacgcgtccagcgccttctgctgcgcgggcgtcaccccggtgccaccctgcgccggctccatgccgaacagtccaagctgcccggtcgaagccccacgccggccgccctggggctgccgcacggccacccggggccggcccgcgtcatccagctccccggactccaggttctggagcaactcacgcgcgcgccccacgacctccggaggcaggcccgccagcttcgccacctcgatgccataggagcggctggccccacccggcaccagcttgcgcaggaagatgaccttgccgttctgctccttcacggcgacgcacaggttcttcacccggggccgctcgcgggccaggtccaccagctcgtggtagtgcgtggcgaacagcgcgcgagcccccaccgtgtcgtgcaggtgctccgccaccgcccaggcgatggagagcccgtcgaaggtggacgtgccacgtccaatctcatccaggatgatgaggctcttgttcgtggcgtggtggaggatgtggctggtctccgtcatctccaccatgaaggtggactgaccgcgcgccaggttgtccgccgcgcccacgcgcgtgaagatgcgatcgcacaggccgatgcgcgccgccttcgccggaacgaacgagcccgcctgcgccatcagcgccgtcagcgcgacctgccgcatcaccgtgctcttgccggccatgttcggaccggtaatcaccatcagctgcgcgtcctccgccggatccaggcggacgtcgttgggaacgaacgaatcccccgcccccagcatgcgctccaccaccgggtgccgcccggcggtgatgctgagcgccacggacgcgtccacctccggccgcgtgtagccgtactccgccgcgcaccgcgcgaaggacagcagcgcgtccccagtggccaccgcctccgcggcggaccggatgcgcggcgccgccgacaccacctgcgcgcgcagctcctcgaagagctgaatttccagcgcgcaccgccgctcctcggcggtgagcacctgctcctcgtactccttcagctccggggtgacgaagcgctcggagttcaccgttgtctgcttgcggatgtaatccttgggcacccggtcgaggttcgacttcgtcacctccaggtagtagccgaagaccttgttgtagcggaccttcagcgaggagatgccggtgcgctccttctcccgctgctcgatctgaagcagcaggtcctttccggacgtggacagcgccaccagcttgtccagctccgcgtggaagccggcgcgaatcatgccgccgtccttcagcgtcaccggcggctcttccgccacggcgcgcgacagcagctccgccagctccggcagcgcggaaaggggccccgtcagggacttgagcagcggggactcacaccgcgccagcaccgccaccacccggggaagctgcgccagcgacaagcccagcgcgcgcaagtcccgtgcattgcccgcgcccagcgacagccggccgcacagccgctccaggtctcctacttccttgaggatgccagcgagctcctcgcgccacacgctgcgcccggacagctcctccaccgcgtccagccgcgcgtggatttccggcagggagcccagcggagacgccagccaccgcgccagcttgcgcgcgcccaggctcgtcaccgtcttgtccaacacgcccagcagcgagcccttgcgcccaccgtcccgcagcgagcgcagtacctccaggttggcccgggaggactcatccatgaggaggttgccgccgcgctcctgccggctcagccggtccacgtgcgccgccgccgtcttctgcgtgtccttcaggtagcgcagcgcagcgcccgcggcgcccgcggccaggggcgcgtcatccagcccgaatgcggacagcgactgcaccgcgaaatggctgcgcaggtagcccgccgcccgcgtgggttcgaatgacgcggcctcgccctccgctaccgccggcgtgcgtaccagccgggcgagcagctgcgccacctccggcgcgtcccgcttcccgtccggcaccagcagttcacggggctccacgcgcgacagcgactccgccagctccgcgatgcccggggcctccagggccatgaactcgccggtggacgcctccagcagcgccgcgccccagcccttgtcgttccaggacacggcggccaggaagttgctggcctgcggctccagcacctcttcgtccagcaccatgcccggggtaatcacccgcgtgacttcccggcggacgatgcccggcccgttgcccggctcctccacctgttcgcagatggcgaccttcagcccttccgacacgagccggccgatgtagcgccgcgcggcatgatagggcaccccacacatgggcaccttgtccgcgcccttggacctcgcggtgagcgtgatctggaggatctccgaggccttcaccgcgtcctcgaagaacatctcgtagaagtcacccaaccggaagaacagcagcgagtccgggtggagcgccttcacctccatgtactggcgcatcatgggggtcagggaggcaatctcccgggcgcccgcaccctcgttcaccggccccacctcgggcgtcatgtccccggggagctccaccgctacggtcctgcctgccttcgcctgctgcgtcacggccatccttgcccttctctcatggccccacccctggatcaacgaaccggcgccctacccgccgagttcccttaccaccccccgccgacattccacccaccccaccgctgaaaacgggtgtcagacccggcgacgcggggcatcgtgcgcgccgcatggcgcagacaccccctacctcagaggcccggccccggcctccagtccccacgctcttccgcgtggccctggctcccatccaggccttcttccgcctggaggcggccagcggcatcctgctcgcgctgtgcgccgtggccgccatggtgtgggccaactcgccgtgggccgccacctactccgccgtgttcgacgcccgcatgacggtgggcctggcgggcgtccacgcgggcttcaccatccgcgagttcatcaacgacgggctgatgacgctgttcttcttcgtcgtcggcatggaaatcaagcgcgagctgagctcgggtgagctgcgcaccttctcccgcgcggtgctgccgctcatcgccgcgatgggcggcatgattgtccccgccgcgctctacgccgccttcaaccaggggacgcccgcgcaggcgggctgggccatccccatggccaccgacatcgccttctccattggctgcctcacgctggtcaagacgcgcgtgagccacgggctggtcgtgttcctcacggcgctggccatcttcgatgacatcggcggaatcctcgtcatcgcgctcttctacggctcggggctccacgtcagctggctcgtgggagccctgggcgtgcttgccgtgctggcgtgcctcaaccacttccaggtgcgcaacggcgtggcgtacgcgctggcgggcgcggcgctctggtacacgatgcaccacggcggcatccacgccacgctgtcgggcgtggtgctgggcctgttcatgcccgcccggcccctgcgtccgggccgccacgtgctggaggaactgcgcctctacgtggaccgggcgctccagacggcgatggacgaggcgacgcggggcgcgcagattctctacctcgaggagcgcctggaggagctggagccgccgctcaaccgcttcgtccacctgtggcacgtgcccgtggcgtacggcatcgtccccctcttcgccctggccaactcgggcatctccctggagggcatgggctgggcggacctgctccggccgctgccgctgggcatcatcgccggcctcttcgtgggcaagcaggtgggcatcttcctgttcacctggggctcgctgaagctgggcgtggccgaccggcccggcggtgcgacgctgccgcagcttcacggcgtcgcggtggtggcgggcattggcttcacggtggccctgttcgtggcggggctggccttccccacccagccggagctgctcacggaggccaagctgggcattctggtgggctcgctgctttccgcggtggtgggctacgcactcttgcgcttcgtggcgaaaccggccgtcccggcgtaacgtagaggacaggaacgctcgtgattctccaagacctcaaccgcgtgcggcaaatcaccgtcatcgcggcacgccacggctttggcgagctggcggagcgcgcggggctgtggcgcatcctcggccgcaaggagaaggtggaagtctctccggaggcccagcgcgcctccaccgcgcggcgcttccgcatgctgctcaacgacctgggccccaccttcgtcaagctggggcaggtgctgtccacccgcgccgacctgttgcccgccgagtacatcgacgagctggccatgctccaggaccacgtggagcccatctccctggaggatgtccgcgcgcagattgaaggttcgctcggcgccagcgtggagagcctcttcgccaccatcgactcggcgccgctggccgccgcgtccatcgcccaggtgcaccgcgcgctgacgttggagggcgaagaggtggtggtgaaggtgcagcggccaggcatcgccgagcgcatcgactccgacctgggcgtgctgcgcagcctggcgcgcctgctggaggccgtggtggaggagacgggcgtgtacacgctcaccggcatcgtggatgagttcgaccgggccatccacgaggagttggacttcatcaacgaggccaccaacatccgggccttcctggagaaccaccgcgagcggccctacctcaagattccgcgcgtctactccggcctgtccagccgcacggtgctgaccatggagttcatccgcggcgtgaagctcaaccccgcggagctgagcgagcccgagcgcaaggccattgcccagaacatcctggacgcctccttccggcagctcttcgaggacggcctgttccacggcgacccgcacccgggcaacctcctgctgctggaggaccaccggctggcgctgctggacttcggcgtggtgggccggctgtcgcgccccatgcaggagacgctggtcatgctgtgcctggcggtggcgctcaaggacagcgaatccgtggcgcgcatcctctaccgcgtgggcgtgccggacgcgcgcgccaacctggtgggcttccgcaacgacatcgaggcgctgctcggccagcacctgaccacgacgctgggacaggtggacacgcgctcgctgctgagggacttgctggacctggcggtgaagtaccgcatccgcatccccaaggagtacgcgctgctcagccgggcctccgtgtccacggagggcatgctgcgcagcctgtacccggagatgaacatcatcgaggtggcgctgccgtacgccaaggagctgctcgccgggcgctacgatccgatgcagctccagggcgggctgatgcgcacgctgctgcgcttccaggccatggcgcaggacctgcccacgcagttgtcgcagatcctgctggacatggagtccggcaagttcaccgtcacggtgcgcgcggaccagttcgaaaagctgaatgagaacctgcgcagtgcggcggtgattgccttcatgggcctgtgcgcgtgcgggttcatcgtgggcgcgttcatctccttcgcgcccaagccgtggatgtacggcaacgtgccggtgctcggcgtggtgggcatcgcggtggcggcggccttcttcggcgcggcgattacctggtacctcttcggcggccggggcctgggcaaggtgcgcttgagccgcttcctcaagaagcccaagcgcaagtagcccgccgcctctacacgggccggcgccacaggtcggcgaggtccgccgggagctgcgaggccacggccgccacctcgtcgtctggaatccgatcccggatggcggtgaacaccaccgtcaggacgcgcagcgcctgatccccggggatgcggaggtggtccgccacgtcggtgatgaactccgcgcggcccatgcgcttcgcgtgggacgggccccggtggatgttgcacgtcccgaggagggtgccaatgccgcccttccccagcgaccagagcagcttgaggtcctctccgtcggacaggcgccgcgcgagcgtgcagaacaccgcctccgcgcccttccgggcgtccacgccattcacctggaactcgcggctgttgccgagctcgtccaggaagccctgaaggtcctggggttcgtcgcgctccttgaccggcgtggcgttgttgatgggggggtcggtgtactcagccattgggttgcctccttgaatgccagtgcggccgtgccgcgcgcctgtcatggtggccacggcaggtgcacgcttcagccggagcgcgccgcgcgccttggcccgcctccccgggggcgggtgcccgaaaggatgctcccaggcgaagcgcgaatgacgaatcgctctctgaataacaagcaattcaccctgaacccgtgggaggatttccggcggacacaatccctctcccaggagaaacaaggtgcttcgttccgctgctccgaggccgtccatcctgctgccgctggccaccgtcctgatggcgctcggcgtgctgctcgccgcgccgcccgcctgggcggagaagccggccaagcccacgagcaggcccgcggaccggcactacatccggaagatccttccatccaagctgccccccaaggacaagaacaccgtcatcgagtcacgaatcgatgtcagccgggatgtgaaggagatcaacgagggcaaggccaagaagggaaacgagtccgggaccgtgacctggaccatccacaagcggacctacggtgcccacacgaatggcacgctgtttcccatccggggcgtcgggttccatgaactgaatcgcggtggcttcaaagcgctggaggtctacaaccagttcaaagacacgccacgcgccacggaaatcatggacaaaatcggcatcccgcccgcagatagaaaggcagcgctcaaggctcacaaagccgggtgagagaggaccatgcatcccgaacgactgattcttggatttctcgtgcgcggcgacgtgagcgaagcacgcctcttcgagggcatcgcgcgcgcgcttggcgttcctcccgacggaacagcccgcttcgacatcgaccgcccgtccgacgcggccgtgctcgtcgatgtcacgctccggcccgcgggcttccgcaccgatgtgtccctctacgtggatgtctcccgcgccagcggcgcccgtgggctcacctccgtggcggtggcgacgcgggtagctgccctgctcggggaggaggtcatcgtctcgcctcccgcggacgaccccgctgtcgccagcacctggttcctcgtcacccccgacggcaagcgcttccgggccactgaagcctcgctgggcgaggatgaggacgccgtcgatattgaccgagccaccggcg

SEQ ID NO: 914 - DNA, 7201 bp, Myxococcus xanthus
gcagcctgccggccacgaagaggaagtgggagttggtccggtccgtgaggtcgagctggtagcggtgtccacaggtgcacgcccgtggggtacgcgaacgacgcgggcgccacgcccaccaccgtatagggctcgtcgttgaggacgatggagcggcccaccacgtccggcgcgccgccgaagcgccgccgccacaggctctcgctgaggacgaccacgcgaggcccgcccaccacatcctcctccggcaggaagccgcgtcccagcctcggcctcacgccgaaggtctcgaagaagtccgccgtcacgcgcatgcccggcaatcgctccggcatgccgtcgcccacggcgctgaagcccgaaggcagcacctcgtaggccgcgacgcgcgagaagggcgacccctccgcggacatccacacgtatccggcgatggactgcgacgccgaccgcccgtggtccttggtgactcgcaccacctgcatcagccggtctggctccgggtacggcagcggccgcagcagcactccgttcaccacgctgaagatggccgtgttcgccccgatggccagggccagcgtcaggagacagaccagcgtgaacccacgattcttcagcaagagccggagagagaaacggacatcctcgataagggcggacacgggggaacctcggggggcgtgtgtttgccctacggcgcacgatgagggccattgcactggcggctggacaagcggtggacccgcaacttacctgagtgtggcgcttccctcttcgcggaagaggaaggtcaccttgccattcggttcgaggaatgccgcgtgtacggcactcaggtcgccacggccatgcgcgcgcaggtggctgagaagctccttgtgggagatgcgcgtcttgcgcaggttgccgtgcaccagggcaaggtcgaagcttacgtagcggctcagctccttgcgtccaaccaaccgcaggacgaactgcacgaagaggaacaccagcgagacgcggatgatgacctcaaaggggtgcaggtccggcacccagaggccatgccagtcaataggcttcatgttggaatgctgcccacgcgcgccccctccggttggcgtgggagctctcacccagacatccccagggcagccggagcgggcaaggactctctcaaggatgatgggggcgggggctgatgcacggggagagaccatggtccagaggctcagcgaggcggtgcccatcgagcgctgcgaggtttctgcgtacgaggtcccaacggacgcgcaggaggcggacggcaccatcgagtgggacagcacgacgctcgtggtggtggagttgacggcgggaggcacgcgcgggctcggctacacgtacgcggacgcgtcggcggcgagcctcatccgctgctcgctcatccgggcgcttgagggacacgacgtgatggacgtgccggcgcggatgcgctcattgctgaggcaggtccgcaacaaggggaggccggggctggtggccatggcgctctccgcggtggacgtggcgttgtgggacacgaaggcgcgcttactggacgtgccgctggtgcggttgctgggcgcctcaagggatgcggcacctgtctacggcagcgggggctttacctcgtactccatcgagcggctccaggcgcagctcgccggctgggtggagcaggggattccacgagtgaagatgaaggtgggcagccaccccgaggaggacccagcccgggtggaggccgcgcggcgcgccatcgggccacgcgcggagctcttcgtggatggcaacggtgcatacacggtgccgcaggccctcttgctcgcggagcgcttcgtagcgcacggcgtctcctggttcgaagagcccgtctccagtgatgacctggaggggctccaccgcctgcgagctcgcgtccccgccggcatggccgtggcggcgggcgagtatggggacagcggcctctacttccggcgcatgctggaggcaggcgcggtggatgttctccaggcggacgccacgcgctgcctgggcatcagcgggttccttcaggcagacgcgctgtgcgatgcgttcggcgtgcctctctctgcccactgcgcccccgcgctccatgcccatgtggcgtgcgcggcgcggcgactggtgcacatcgagtactttcacgaccacgcacgtttggagcggatgctcttcgacggcgtggcttcggtcaggcatgggacgctcgcgccggacctgtcacgtccgggcctggggctggagttgaagcgggcggacgcggcccgctacgaggtgggcgccccctcctgaggcacgtcatcctgggcgggctgctcgacgctctctacccgctgtagacacggctcagacggcgccgtggtgccggacgggcgcgcgaggtgctcagccgccgcaggcccaggagcagcaggccccccagcaccaccgcggtgcgtgggcgccgaagcggcggccgccccagccccttcgtcacccagccgcgctcggggaaatcgcccgaggggcccgtgctcccgtacgccttggccatctgcaccacctgcgcgatgtgcagcgcccggcggttcgtgttctgcgcaatctgctcccggcaactgaagccgtcggcgatgacgagcgcgtcccggggcgtggcgcgcaccttgggcagcagcacgcgctcgcccacctgctgggagaccgtgaacttctctccagcttcaaagccgaacgagcccgccatgccgcagcagcccgtctccgggaattcgtaatccagccccagcttgtcgagcacggccttctcgtccgtcatctggaagagtgacttgtgatggcagtggccgtgcaccaccgccttcttcgccatgtggggcaggggcacgtccttcgcgtaccgggtgaggaactcgctgaagaggaacgtctgacggcggagctgtgtggcgagctcccaatccgggaagaggttgcgcagctcatctcgaaagacggacacgcagctcggctccagacccaccagtggcacgcccgcctcaatctcccggcggaggctctccagcgtgcgtcgcagcatccacttcgccgtcgtcagcatgccgaagtcgtagagcggccggccgcagcacaggaacccctggggaaccaccacctcgaagcccgcgtcctccagcacgtccagcgccgctgccgccgtctccggaaagaagtggttgttgaaggtgtccggccacagcatcacccgctggtggccatgctggttcgacaccggccggcgcgccacccatcgctggaaggactcgggcgcgaagcgcggcatcttccgctgcgtcgacatgccggccagcctctggagcagcatacgggtcggtgggaaaccggtgaggacattcaccagtcgaggggcccgcatggctgcgcgggcccagagcatgatgaggcccatggcgtaggcgggccgcgggcgcaggtgcccctggtagtagtgcgacaagaactccgccttgtacgtcgccaggtccacctgcaccgggcagtcgcccttgcagcccttgcacgccaggcacagatccagtgactccttcaccttgtcgtcgcgccagccgttcttgatgacctcgccctggagcatctcgaagagcaggtgggcgcggccgcgcgtggtgtgcttctcctccttcgtcaccatgtagctggggcacatggtgccgccgccgtcccgccggcacttgcccacgcccacgcagcgctcggtggcccggtacagcaggccgtcgtcgtccgggtacttgaagtgcgtccgcggcttccaggtgcgcgcccggaagtcccggcccaggcgcaactcctggtcgatggggttcgggtccaccaccttgcccgggttcatcttcccctgcggatcccagatgctcttgaactcgcggaaggcctgcaccagctccaggccaaacatgcgcgggaggaactcggcgcgtgactggccatcgccgtgttcgccggacatcgagcctcccatggacacgcagaggtccaccgcttcctcgatgaaggcgcggtactgctggatgcctctggatgaggtgaggtcgaagtcgatgcgcgtatggacgcacgcctggccgaagtggccatagagcgaagcatcatacccgtacttgtcgtacagcttgcgcagggcgcgcaggtaggcccccagcttctcgggaggcaccgctgagtcctcccaaccgggaccggagtctggcttgcctggcactcgcgcggtggcgcccagtcccgcctcgcgaaccttccacgcgtgttcgatgtgttccctgtccgaaaacagccgcatgtccacgggagcgccgcggcccgtgcgcagcgcatccatcagctcgcgggctcgctcgagtgcctcctcccgcgtgtcgccgccgagctcgagcatgaggtagccctggccctgtgggaggatgtcgaggaactcggcgtgcgagctcatgggatggagggactccatctggctggtgcggcccttcaggacgacgttgtggatgagttcgtcatccagcccctccagcgcgagcgggtggaagcgctcggcgagctcatgggcgtggtctccggcgatgtagatgtccggatagccgagcatcaccaccacccggtgcggcgggctgggcacgagcttcaacgtcgcctccaggatggtgacgcacgtgccctcggtgcccaccagggcgcgcgccacgtcgaagccgtgctcgggaagaagtgcgtcgaggttgtagccggagatgcgcctcggaatcggcgggtagcggcgccgaatctcctccgcgtacctgtctctcagctcgcgcagcttgcggtagatgtccccgcgccggccgccggcgcggatgagggcttccagctccgcgtcgctggtgggacccaccttcaggcgcaggccgtcatgggtgagcacgtccagcgcccgcacgttgtgcgagacggggccggccatctgggcatgagagccgcacgagttgttgcccagcatgccgccgagggtgcagtggttgtgcgtggcgggatccgggccgaaggtgaggtggtactgctcggccgtgtcgcgcaggtggtccaggatggtgccgggctgaacgcgggccgtcttcgtgccgggatccacctccagcacccggcccagatacttcgtccagtcgatgacgacggccacgttgcagcactggccggcgaggctcgtgcctccgccgcgcgacagcaagggggcgtcgtattcacggcaggcacgcacggtggcgaggacgtcgtcgaggctgcgggggacgacgacacctagggggacctgccggtagttggaggcgtccgtggcgtagagcgcacggctcccattgtcgaagcggacctcgccctccacggagcggcgcagcgctgcctccagcccttggacgtccacggcgacgtcaccgccctgtgtgcctgggagcggatgggcggcgggccgcttgcgcgagagccgcgagagggtgcgttggatggcgtccgtagagcgcattatgggttcctctcccgttcaggtgcgtgcccgaggcggaggcacgcagagaacctgcgcaccgcgcgcgcggcacggacatgccggggcggcgcggcgcacgtcttcccgcctcgtctggtacggctgggacgagggcccccgggcgggactgccgcgtgccggttccccgcatctccaggggatgcccagcttcgagaggcaccccttcgctcccagccccgaggagtttcaatgagcgccaccgtcgccgattatctgctctaccgcctgacccagtggggcatccgccggctctatggctatccgggcgatggcatcaacggcatcatcggcgcgctggggcgtaccaccgagctccggttcatccaggcgcgccacgaggagatggccgccttcatggcgtgcgcgcacgcgaagttcacgggagaggtgggcgtttgtctggctacctccggccccggtgccatccacctgctcaatgggctctacgacgccaagctggaccaccagcccgtggtggccattgtcggccagcaggcacgctcggccctgggcggccattaccagcaggaggtggacctcaccacgctcttcaaggacgtggccagcgagtacgtcaccatggtgacgaagacctccgccgtccgccacgccatcgaccgggcagtgcgaatcgcgctgaaccaacgctctgtgacgtgcgtcatcatcccgaacgacttgcaggagctggagtaccagaagcctccgcggaaacacggcaccgtccactccagcgtggacttcagcccgccgtacgtcattccccaggagaaggacctgcgccgcgccgccgccgtgctcaatgccggcaagaaggtgtccatcctcatcggcgcgggtgcgatgaacgccgccaacgaggtggtggaggtggccgacctgttgggcgctggggtggccaaagcgctgctgggcaaggcggtgctgccggacgcgctgccgttcgtgacgggcgccatcggcctgctggggacgaagccctcgtgggacatgatgatggactgcgacacgctgctgatggtgggcacgagcttcccgtactcggagttgctcccaccagagggccaggcgcgcggcgtgcagatcgacatcgacggtcgcatgctcgccatccgctaccccatggaggtggcgctcgcgggggacagcaaggagacgctgcgcgcgctgattcccatgcttcagcgcaagcaggaccggagctggcgcgagcagctcgagaagggcatccgccagtggtggaagatgctggaggcgcaggcgatgaattcggccgaccccatcaacccccagcgcgtcttctgggagctgagccccaagctgcccgacggcgtcattctgaccgcggactcgggctcggggacgaactggttcgctcgcgacttgaagatgcgcaaggggatgctggcgtcgctgtcgggcaacctcgccaccatgggctgcggcatgccgtacgcgattggggcgaagttcgcattcccacaccggccggtgctcgccatggtgggtgacggcgcgatgcagatgaacggcaacgcggagctcgtcaccgtggcgaagtactggaaggagtggaaggacccgcgcttctttaga

SEQ ID NO: 915 - DNA, 8914 bp, Myxococcus xanthus
  unsure (1)..(8914): unsure at all n locations
ctctatgccgctggcacgcctgtcaacggcagcgaggcgtcgctgcccggcctgtcccgcgaggacgtgctcgcgtacgcgaagaaccacctgggcgcggaccggctcgtcctgtccgtggtgggtgacttcgacgcgaaggcgctcgcgaagaagctggagtcctcgctcggcggctgggcgcgcgccgccacgcccgcgcccaccgtgcccgccaccgccgcctccaagggccggcgcgtgctgctggtggacaagccggacgccacccagacgtacttctggattggcaacaccggtatctcccgcgatgacccggaccgggcctcggtgcgggtcgcggagacggtgttcggtggacgcttcacctcgctgctcaacacggagctgcgcgtgaagtccggcctcagctacggcgccaactccgtgttcatccgtcacacgcgtccggggcccgtcatcatcgcctcgtacacgaagacggagtccaccggccgcgccatcgacctggcgctggagacgctcgccggctaccggaagtccggcatggatgacgccatgctcgcctccgcgaagtcgtatgtgctggggcagttcccgcccacgctggagaccgggacgcaggtggccggcaagctgtcggagctggccttctatggcctggatgccagcgacgtggatggtttcgccagcgccgtctccgccacgacccgcgagggcgtgcacggcatcatccagcgcaagctccccgcgccggaggacctcaccttcgtcctcatcggcaaggcgtcggacatccgtgaggcggctcgcaagtacggcaccgtcacggagatgaagatttccgacaagcacttcgcgccgcccgcgaagcgctgagactcgccgcgcaccgccggacctggaggttgtcgggccggcggtgccttcggggcggaatcctctgtcccgaacgcagcccatctggccgcccagcaggagatgtcagaggccctcggtagggtgctcggcgcttcatcctcgatgggggtcatatgcgtttgcgtcactggtcgctgctgctggtgcccacctgtgctgcgtggcttggctgtgcgggtggcgaaccgggttccgcttcggacttcggcgacggacagtcgcccgtgagtgaggaccgtccctcgggcgacggaacgggcacggacgagccgcggtccgacatcagtgagcccggcgattccgacgacgtggtgtttgtgacgcagaccacgcgcttccacacggcggtgggggtcgcggagcgccaggaagacctctccgcgaatcctcctgaaatctacgttccctccgggaacacgttcagcgtcgtgtcgggctcggcgtctccggaaggttggcgctttacgggcatcccgtccggtgcgtactacctgcgaacgggcaacagcttcgtcgtcacgtccgcgcgcgctgtcgacattggcagcaaccggctgggccgtcccgatacggtcttcagtgatttgttctggtcgcccgtccaggtgaacctcgtcaacctggcgccatgggtgccctacggaggcgtgacgcagccgggctcgagcctgcaggtcgcgtccgcacaggtggacctctatggcggcgtgaatgtcttcgacgaggtgcttgaaggacagacgcacctgctcagcaacaacgccgaggtgttggtgagcagcggctattcgctgcctgtcttcgaggctgaccggggagaccgtctatacgtgagccagcacggccagatggacgcggggacgctgccggacgggaccccgctggcatattcggccctggtgcgcagcgtggagatgggggcgttcgacttcgtcccggatggcatcacccccatgccgttgacgggcgtcatgcgctccgtgccgatgacggagttccccatcgagtggcgcctgccggacttcacccggtacgtacacgcggtgcacccgctcgccacggccagctacccctccttcttcgtcatgcccgcggcccacggcctgagcgacggctgggtggggtactcgggggaggcgctctccctgacgttgccgcggggcacttcgttcgacttcacccggcgcttgtcgtacggaaacccgttcccatcctcgtgggagatggtgggcggagcgcagtactcattccgcgtccaagcggaggtgccggggggctccgggctccggctctacctatccggcagcatgtatacctacgagcgactggatagcctcgtcgcaggacccatcctgccgcgcgtgtctccgcctcgtgagctgaccattgacggtctgcccgccagtgattcccgtgaggtgggctccgcgagtcccgtcatcgcgtggctgcctcccacggtggggtcacccgccgcctaccggattgccatctaccggttccgggaggacttccgtaccacggtgctgcatggcaccgtgaacgtgcccggctcggtcacccaggtgcgtctgccgcccgggacgctggcgccagagggcatctactacctgcgtgtctcggccgtggatgctccgcactacgagatggagcgcttcccgttcagcaccgtggaccggttgcctcaggcgcgcgcggacactctcagctcgttcttcaccaccccgtgaggcgtggtcgctgaatccggggcccgctacttcgccgtcagcgcgcggtagcgggtcatgcacttctggaagcgctggtccaccgagcgcgcgaaccacgcggtggtcagctcccgcttcagcttcgggctctggagcgtcacccggggaagctgggcgtaggacggcgattcgcccgtttcccgctggtagacacgtttcaccgcgcggaacgtgtcggtggattcgaagtccggctccttctccttgcgcacgtcgcggcgcacctgacgctcgctgagctcctccggggcgaagcgctgacggaaggcgagcagcgccagcagcgacttgctgtcctcgctgcgcggctgcccctgcttgtcgtagagctggaggtctccgtcgggcgccagggggtggccggtgagacggctcacctgtgactggagcgcggcgttgcgggaggcatagacgcccgcgttgtagtccgcgaagcggaagaggggctcggggtatgcggcctcgtaacccagcagccgcgcggtgccgtagcgcacgccgcccgcgcgggtgtacatcgactcgcgcacctcggccgggtccgcgtcctcgcccgccttctgcatcgcatagcgcacgctcacctgcatggagccggcggtggtgacgggattgaactcgtgcaggttccccgaagcgaagacgccgctggcgaagtccacgaccttgaaggcgctcgggaattcgttctcgtagtacgcgagcatgtcgcggaagagccggtccaggtcgcgctcggtgcgcagcgcgcgcagccgttcgtcgaacgtcttcttgctccccttcgcccgcccttccagcaccgacgccaggaccttgcggcccagggggcccagcttgttcgcgtgctcctccaggcgcgtgcggaccatcttcggaagccccgcgacagccgggtcgaccttgtagccggactcctgttcgatgacggccagcaccgagcacaccgcgggcggtgacggggcaatctcctccacctccagcgcggccagcacgtcgcgcgcccagccctcgcggtcctggagctgcggcggcatcagcttcgcgacctgagacgcggagagccggggcggtggtggaatggacggctgggccgagcccgctccgcgcggcgcgcatgcagtcatcgaacccagtgccaccagcatgcccagccatgcgcggccacggtatggggaccccgctgagggcggtcgcacatcggctgtctcgtgggcaccggggcccgagtcgcggcggggcgcctgcgtccaggtgggcttcgcagtgagtgtcacccacaggccgcgccacgcacggcgccagccggacgtgtgggaccgcggtggaatgggctcctgcatgcgctcgcctccgaggcttgggccccgatatctcaggaggcgcgcggcgctggcgaaagccatgggctcttgcgcttgcccggtgtgcggacgagcgaacgggcttcaggcggtgatgacgccgggtaggngagcggcgcgctcgctggcgaagctggcggcggcttgcagtggaccgtgcaccgcggtggatgcgctggaggccttggcggcccgagccaggcgcgttgcccgggtccctgtccctccaggggtggggcagcgtcggcgccggagggcgcgaaggcgccggtggagacgttggcgcggtcgtcggaaggacacgcgctgctggcgctggcgcagcagggtctgcccgccttcggccgtcccgtcctggagtcgctgcggctcgcgctggtggacgcggagcggggcgcggcctcggacgtggcgcgtgcggacctggcctggctggactgccggctggcggcggcgatggaccggcaggagggcgcgccgaaggaagtcctggggtgcgggtacggacgcgtgcccgaggcgcgccggttggcgctggggctgcgcgaggtggctcagacgaaggggcagggtggggcgggcttcgcggtgaagtacctgcgtcaccccgaggcgcgtgtgcgcctgacggcgctggaagccgtgtccgcgcggcccgtgcccgaggcggcggcgccggtgcgtgagctcatcgaaggcgaggatgaagtggtggcgggcgcggcggcggcgaccgcgggtgtgctcaaagacgcggccgcgctacctgccgtggaggcgctggcggcacgtgtgccgcggacgccgggagacctggccgagccggtggcgggcgcgttggtggcgctgcagggcacggccgccgaaccccgcctgcgtgaatggctgatgcatccgcacgccaacgtgcggcgcgtggcggcgcaggccctcacgcagttgacggggcagcgggtgcgctcggcgcgcgtggagctgcccgcgaacaccttccggcccgtggccgccccggcgcgcgcggggctcgtgctgcgcaccgacaagggggacatcaccgtgcggctggacgtggacgaggcgcccctcacgtcgggcaacctccacgcgctggcgcgcaagggctatttcaacggcgtcaccttccaccgcgtggtgccggacttcgtcgcgcagggcggagacccgcgcggggacggtgagggcgggccggggtactccattcgctgcgagatgacgcgtcggccctacggccgaggcaccctgggcatggccctggccgggaaggacaccggtggcagccagttcttcttcacccacgccccgcagccgcacctggacggccgctacacggcctttggcgaggtggtgtccggcatggacgtggttgacgccctcctggaaggggacgtcatccgcgaagcgcgcgcggtggagctggcgccctgaagcgtcgattcaggcgccgctggcacgggccaggggcgcgggaggaccgagcgggtcgctgttccagcgctcgttctccgccgcttccaaggcctcgacttcctggcggatgcgctgccactccgtctccggaatgttgaggaaggcctccgccagcgccgggtcgaactgggtgcccgcgcagcggcggatttcatcccgcgccacgctcatgggccggcccttgcggtaggggcggtcggacgtgatcgcatccaccgtgtccacgaggcagaagatgcgcgcgcccaggacgatgtcctcgcccgccaggttctgcgggtagcccttgccgtcccaccgctcctggtgctggagcacgatgagcgccgcttcgtgcaggtagggcatcttcgccagcatccggtagccgaactccgggtgcttgcgcatctccacccattcctccggcgtgagcggaccgggcttgagcaggatggagtcgcgcacgccaatcttcccgatgtcgtgcagcagcgcgccttgctccaccacgtccagcgctgcgcccgtcatccccacctcctgggccagccggcgggagtagagcgacacgcggcgcgagtgccactgcgtctccgtatcgcggtagtccagggcgctgatgagcccgtcgagcagccccgcggtgcgctccaccacccgccgctccaggtcgcggttgatggccaccagctccgcgttcttctccgcgacctcgcgcgacagccgctcgttggcgtccaccaggcggtagtgcgcgaaggcctgccggacgctgttcgtcaggtcgctgagtgaccagggcttgcccagcagccggaagacctcgccgcggttgaccgcttcggaggcggtgcggaagtccgccgccgccgtcagcatcagccgcaccgccttggggttcttctcccgaagggcgctgagcagttcgatgccgttgaggtacggcatcatgaagtccgtcagcacgacctggaagccgacctcccgggcggccaccgccgggtcgctgtgggtgacgacgtcgtacccctccgcctggaggatgcgtgacagggcggccaggatgaggacgtcgtcgtccacgacgaggatgcgatccatgcccgaggtgcctccaggacagcgtgcttgtacagctttatacacgccgctacgcgcccccaaaagaccccccaggcaggtgatgggcttctaagccatggaaatccttgggggttcttccattcgggaagagagccggaaccacgtcacgcttgcctggccgccaaggtgtgatttatggtgcgcggcaacgctggactgtatcgctaaccccttggaatcgtggagcaatctccgatggcaaaagccccggaagggcccgtgccggtggtggtgatggggctggggttcatcggtcaggaaattgcccgggctgcgatgtcttcacctgaggtggagctcatcggggccgtggacgtgcaatccggcctggtgggccgccccttgggtgatgtcctgggaagtcccgcccctcgtgtgaaggtctccgcgtcgctggcgcaggccgtgggcaagcgcaagggcgtggtggtgctgcatgccaccggctcgcggctgcccaaggtgttcgaccaggtgatggaggcggtgaagctgggactgcccgtggccagcacctgtgaggagctggccttcccgtatctgaagtacccggagctggcggacgaactggaccaggcggcgcagaaggcgggcgtcgccgtggtggggaccggcgtcaatccgggcttcgtgctggaccgtctggtggcggttgccggacaggtgtgcggtccggtccgtcgtgccaccgtcacccgcgtggtggatgcgcggacccgccgcccgtccttgcagcggattgtgggcgcggggctgtcggaggaagagttcttcgagctggtggacagtgagcaactgggccacgtcggccttgttgagtccgcggcgctcgcggccctcggcctggggctggattgcgacgacttcgaagaagaagtagcccccgtgttcgccgaggaggacatctccggcggcgcgtttcccgtcaggaaggggagggtggctggcatgttccagtccgtggtggggttggaggacggacaggagcgggtgcggctggagctgaccatcgcgatgggggcggatgaccccaaggaccgtatcgaaatcgacgctgacccgaagctggtgttggaaatcccggggggagtggcgggcgaccgggccaccgcgaatgcgctggtgaatgccgcgccacgcttgacggccgccgaagctgggctcctcacggtgctcgagcttccggccggacgctagagtcaggagaggaaatgctggacaagaacgcgatcggtcgcgcctcgccgccgacgctgaacgaggtcgaaaaggcgccatccgtcggttcttttaggtcatcggggattacaaccccatctactacgatgaggagtatgcccgggcgtcggggtatcccaccatcatcgcgccccccacgttccccgcgtccttccactcggcggcggacctgcgggagctgctgggcgtgggcatcaagagcctgctccacgcggagcagggcttcgactacgagcggcccatcttcgcgggggaccgcatctacgtctccacgcgcgtctccgacgtcttcgagcggccgggcatgtccgggaagatggacatcgcggtcatcgaggacgaaggccgtgacgaggaaggcaacctcgtgttccgcgcccgccggacgctggtggtccgcgccgccaaggagaccccgtgatgcccgcgcgcaagttgtacttcgaagccatccgcgtcggggacgagctgcccgcgctggccaaggcgcccgtcgaccgcgtccaactgtcgcgctacgccggggcgtccggagacttcaacccggtccacgtggacgagctctacgccaagagcgtgggcatgccgagcgtctacgcgcccggcatgctcgtcatgggcatgctcggccagctcatcagtgactgggcccggggcgggcagatgcggcgctacaacgtgcgcttcatcaagatggtgtggccgggtgacaccgtcgtctgcaagggccgcgtgagcgaccggcacggctccgggggccgctacttcgtcgaaatcgacctctgggcggagaaccagaagggcgaactgctgatgaagggctcctcgcagatccagctcttctattcgctggaggacgagaaccggcagcgctccggccagtcccccatcgtggtggaggtgcctcgggagagcctgagcagcgccgncgcgcccgcctccgccaccagcgccgttcccagcgaggggggcgaccaggcggacgagcgccgcgagggcgtcacc

SEQ ID NO: 916 - DNA, 8604 bp, Myxococcus xanthus
gcctccattcgggcttcatcgccgacgcggaggcagtggacgcccgcaccggtggctggcccgacgtgcgcgtcccgacgctcatcatccacggccgtcaggatgacacctgtgacgtccaaaactcgcgccagtggtcggagggcaagcgccacgtccggctggtggaggtggacgatggccacgagctcaccgcgtcactgccgctgatcctggaggagacggaggtgttcctccaaccctggggcgcccggggtcctcgtgctcaaagctcgatgccgtaagcggcagccacctgcggcatgaagcggaggatgtcgggcggcgtgtcgctgtccaacgtcagacgcgtgcgccgaccgtccacggtggattcgaacatcgtcacctgccggtcatgtgcgacgggaggagggcgctgtgatcttccttgtattcgtccaaccggcgcgcggcgatgagcagcatcgtgagccgatgggcgtcggccgcgttcgctttggatagagacgagccgttgcgcttggaacggccatccccgaaaacctcgagccagaagtgccgtggattgggtatgcccggcgacttctggagcctgagcatgagcgagtcctcgtgatctgctccccaattttcggacccgttgaagagagagagtactcgcgttcatgaggaacgagcaggacgcggcaccgggactccagtgctctgggtggtttcaacccacgctcctcgcgttcacgagaagcgaccgcccacccgtccaccacccggtgcgcctcgcggtttcaacccacgctccccgcgttcacgaggagcgactggcccaggtacgcgaggtccacggagtcagcggtgtttcaacccacgctccccgcgttcatgaggagcgacccctccggtactcccccacgttgctgggtgagtttcaacccacattccccgcgttcacgaggagcgacacctcgaaaacagcacgccggcggcggcgttcaggtttcaacccacgctcctcgcgttcacgaggagtgactatccggtcgggcaaagactggtttgagactgcacggtttcaacccacgctccccgcgttcacgagaagcgacgctgtggcgccaggccgttgcggtgcgcactgacgtttcaacccacgctccccgcgttcacgaggagcgacccgctggcggccgggtccttgtccacgagcatcatgtttcaacccacgctccccgcgttcacggggagcgacgacaaggcccagaaggccggcgaggcgaatgagtttcaacctacgctccccgcgttcacgaggagcgacgaagccgcccgaagcagacttggtgatctgcgacgtttcaacccacgttccccgcgttcacgaggagcgactgcgctcgccgccgccgcatacctcgtctacaagtttcaacccacgctccccgcgttcacgaggagcgaaaggccgccatcaccgaccgtagcaacctggacgtgtttcagcccacgctccccgcgttcacgaggagcgacgttctccgcgctcggcgcaagcatcagcgaccagtttcaacccacgcttcccgcgttcacgaggagcgactccacacgaccgtgacagcagccgggtgaatgctgtttcaacccacgctccccgcgttcacgaggagcgacaacgtgacgttcgaagcgctcgacgtcgattgtacagtttcaacccacgctccccgcgttcacgaggagcgacccggcaaccttcgtctagcaggcgatcttcgcggtttcaccccacgctccccgcgttcacgaggagcgaccgcatccaggtggcgctgttgtcctcgctttacgtttcaacccacgctccccgcgttcacgaggagcgacacggaatcggccatcggagtgcgacaggaatcgggtttcaacccacgctccccgcgttcacgaggagcgacgcgcgtgtggcgagcagcagacgcccgtgggcgggttcagtttcaacccacgctccccgcgttcacgaggagcgaccaagggcttcaagctgaacctgtccgcgctccatgtttcaacccacgctccccgcgttcacgaggagcgacggctggattgtcgtgggtgtgctccgacccctgggtttcaacccacgctccccgcgttcacgaggagcgaccgcgcgacatggatgtggtgcgccagcgactcatgtttcaacccacgctccccgcgttcacgaggagcgactgcggacgttgcccgccgtctgcgcgggctggagtttcaacccacgctccccgcgttcacgaggagcgacccagtcagccacgccgtccctcccgggccactcgtttcaacccacgctccccgcgttcacgaggagcgactgagcgctgcgcggtctgctgggtcggcatcaagtttcaacccacgctccccgcgttcacgaggagcgacgctcgggtggcggcgctcggcatccccgtggtgcagtttcaacccacgctccccgcgttcacgaggagcgaccctcctcttggacgaatcgacgcggattgcgtcgtttcaactcacgctccccgcgttcacgaggagcgaccagctcccgggctggcccaagcccagcgacgtggagtttcaacccacgctccccgcgttcacgaggagcgaccacgtaggcggcctcaagagcctctgctggggagtttcaacccacgctccccgcgttcacgaggagcgactacgcgccactgggacgggcttgccgtgggacggtttcaacccacgctccccgcgttcacgaggagcgacgatcgtgctcttcccgttgagctgctcgatcaagtttcaacccacgctccccgcgttcacgaggagcgacgcccgaacaggtcccccacaaccgacggctcgaagtttcaacccacgctccccgcgttcacgaggagcgacgcccccgcgctcgcccagtcctacgacgtctatgtttcaacccacgctccccgcgttcacgaggagcgaccgaagaggagctcgcccagggcatccgctgggtgctgtttcaacccacgctccccgcgttcacgaggagcgaccgcgcgagccgcccaggtgctacgactcgcgaggagtttcaacccacgctccccgcgttcacgaggagcgacctgctgcgcggcagcctcgcaggaggcggtgcagtttcaacccacgctccccgcgttcacgaggagcgacaaggggacagatggggtgccggtgaatatgcacggtttcaacccacgctccccgcgttcacgaggagcgacaaggggacagatggggtgccggtgaatatgcacggtttcaacccacgctccccgcgttcacgaggagcgacgccctccggagcaccagcgcagacggccgcgctggtttcaacccacgctccccgcgttcacgaggagcgactcccgcgttcgggagttggagtcccagctcgctgtttcaacccacgctccccgcgttcacgaggagcgacctggtggtggggaggatgggacaggaggggatgtttcaacccacgctccccgcgttcacgaggagcgacaatgccccgtggttctccaggcgggcccggacgcgtttcaacccacgctcccctcgttcacgaggagcgacgtcagacttcagggccctgcgcagcccctcctcgtttcaacccacgctcccctcgttcacgaggagcgacttgaccgtgccatccatgttcccgaggtagttgttgtttcaacccacgctcccctcgttcacgaggagcgacagaatccgctgtcacaccgctgtcacagcttggtttcaacccacgctcccctcgttcacgaggagcgactcgacagccaccaacgcggtccacagcacctgcccggtttcaacccacgctcccctcgttcacgaggagcgaccgcgatctgcgcatggagctgcgcttgggcctgcgtggtttcaacccacgctcccctcgttcacgaggagcgacgatggcgctggctctcgccgcgtgttcgggcccgtttcaacccacgctcccctcgttcacgaggagcgactctgcccttccaacataccgttctgactacggaatccggccgaacttcgcgaaccggcccgcggggccacgaaagcgcctcgccgttcctgacgcccactcacccaactccatgattctattcgggatttcaatgagcgcgaaccctcggcggagcgtacaccgggacgggttcgcggaggcctacaggaccagcggcccctcgacgtccaagggtgctctggcgccatgatgctccgtcttccgggcatcgtcctccgacaggaagtagaagcgcaggctgtcgcattccgaatcgaatgcgccgagcaggcgggcgcgcaggacgacccagtccttgggctccaggacacactcgaagacggagtattgcactcgcacgccatggtctctgcaagcccgcgcaatcttgcgcaggcgccgaggcccctgtgggtccgacacccgcacgtcgtaacaaatcagcacggtcaatctacgcatcagcgcatcgcgaagggagggtagccgtccagctcccctcggagatggcgtgccaacagcaacgcttgcaggtgaggcgccatgccccaggtcgtctcctgccccaggaacgcgtgccgcacccccacctgcttcgcctcctggtacgccacgaggaacgtcttgcgcgcatcgtccttcagcaacacggcccccgccgactccgtgcggaagtccccgggcttcagttgcccccggttcaccagcgagaagacgagccggtccaccaccggcgcacggaactcctccatcaaatccagcgccagcgacaggcgcccagggcggtcctcatgcaggaaccccacggcggggtcgagcccaacacccgtgagcgctcccgcgcaatcctgcgccagcaacgcatagccaaacgagagcatcgcgttcagcggattcctcggaggccggcggttgcggccatcgaactcgaagccctgggcactcttcttcagcagcgcgggaaaggactcgaagtagtcgcgcgccgcgatgccttccagccctcgcacctgcaccaagtcctccacgcgggtcagcgcgcgcaggtgctccgacagccgccgcgccgtctccgacagggcctcctgtcgctcgggcgccgcgtcacgccgcgcatgcaacacaaactgccgcgcattcccgagcttccccaccaccagcgcccgggagatggccaccgagcgagcgatatcatccgccgcccgatactgctgccgccgcaacaagacgttgccgcccggcacgccctccaccctcgccaggaagcgccccgtcatcccgaagaaggagacatggatgcccgcctccaggcagctctccatcaactccggcgtcagccacgcgcgcgtcaggcacaccaccgagcgcaggtgccgcaagggaacctccgccttcttctggtcttgaaccgtcaccaccacgcactcgccttccttgttcaggcgagtcccttccgcggtgatgaacagcgtgttcagcgcagtcgtcatgcgttcctccgctcagccgtccagggccatccactgcatcaggaagtcctgagcgctccgctgccccgccgtcactccagggaggcacagcggctccagcgagcacttgtcacatcggggcgcgcgcgccacgacagggacctcctgccggcgcagcacctcgtgcatgcgcgcgatggcgtcctcggtccgctggcgcagctccgcgtcgaagcgcaccgcggcacgcttgtgctccacaccgtagaagagcgccccttccgggacatccacgccgtgcatctcctccaggcacagcgcctgcgcgcagagttgcacgcggtccgcctcacccgccttgcgccggccgcgcttcacctccaccgggaagggccgccagcccgcccccttcgcgtcccgctggtactcgaccatgtccgcgcgcccggacacgcgcagccgctgcgagcccagcaacacggcccgctccacccgccgtcccagccgcgcgtcatgtcccggcaggtccacgcgctcgtgcagcagtctgccggaggcggtgttgacgtcctcgcgccattgccgctcgacgtggatgagcgccgcctgccgctcgcagtacagcaggtgctggagcgccgacagcgccacccacgtctcgcggtccgtgctcatcccaccagctccagcacctcgatgccctggggcagccctgccttgtccacacggacctcgtagtcggagaagcttcgagctggcttctccggctgggcgcgcaccgcaaggacgcggtcgaacagcgcgtgggccggcgcgttgccgagctccgagccatgtttgaacacaaccaccttccgcatggacatcagcccccgcgcggcgctgcggtccagctcgaacatgtgcgtgaaggactggaagagcagctccaggtccgccgtgccaaaccccgtctgcttcgccaggtgcggcgagacgaagccgtgggcccggtagagcccatagggcacggtgttcttccggcccatggtgcggttgtcaccgccctgcttttccgcttcgtcctcagtcgccaccgccatgcgggtgatggaatgctcttgcgaaacgatagggtccaccgagcgggcgaaggtgagctgcaccggcccacgcacctgccccgcattgggccccgtggacatcaccgcgccaaatgtgcggacatcgaagaacgtcttgcacatccacgcgcggcccttctccacctcggagccctgggccctgcccttgtcgttgcgcttcttgccatcctccgcgcgagcgggtttctcgttcaggtcgatgcccaggctcttgtatccatccgcgatgcggttgttcaggatggccttctccttgacgaagatgtccagcccgggctttccctcctgcgtgagcaggacgaagtttcgcaccttgcgcttgaggctcacgtccgtcaccagcccatggcccgtctccgcatcaatgcggggcaggttgccggcgtcgggatctccgttggggtttccatctaacacgtcgaagaacagcacgaagtcatggcgttgcttgaggtcggtcatggcgctttctctggaatgggtttggaggcggtgaaggctcacgtggaggacgctgtcgaatcagccggagccgcggcggcctcgcgcttcgtgaagaacgcttcgcgctggtggtagtaacccacggcgaagaggccctgctgctcgggctggaacacaggcggaaatgggtccttggaaggcagcagggccatcacctcccccttcgtccgctccagccacctgccgttctcccccgccttggaggcgtggtgaacggagagctgaatcagccgggggaagacggtgacggggtttcgagacgcggcgccgaagtagcggtcgcggatggtggcgttgaggtccttcagcgccacgccctgcagccgctccagcacagcgaagaggcggccgagcacatagggctgcgaaggattgtccttgtccaatgacacggtgacctccaggggagtggatccacgatttcgatctcgcaacaggtacgccttgatgagcgcgacgcggagccggagctgctcgcgctcgaccccgccgtcagcgggcggcaaccgcagccggtccagcgcggccaccaggagctggcgagggaagggctgacctcgcaacgccgcccccagcatccgtgcggcgatgtccggcgtcaggccccgtcccgagggcgcctccacggccttgagcaggcgatagacggggatcggccccgcgggcgcgtcgcccatgcgcaggtcgtcgaaatagcgccggatgttctgcttcacctcgcccacgcgagactcgaaccaatcacgcactgcgacacggcccgcgttccccgccagcgtcacggcgtagaaggcgcggtcatccagttctcctggctcgacgcccttgcgcggagactcaacgaagcgcttgaggtcatcctccgtcgggtccaggagagacagcaggaagctctcttccgaaggagaggcgcgcgtccagaacaccatcaccgagccatccgccaactgaatgccttgacgaaaacggcgctgctccgtcctccgcagcatgtcgttgagggccagcacgtagcccagcgacgcctcctgagagatgggcgcgttctccccctgctccaaaccatgcgacgaaaacgcgggcgcgttgaaggacaccagcgacgccccggacggctgggcctcggggacgttcttcaacttggggtgcgtgacggccaccacgccctcgcggcccgtcaccagacacaacgccctccgacccaacgcgcgctgcgcacccgcgcgacgctcccagcaggcacggatggcggggttctggtgcacgggcgtcgtggcctcaccaacgacgaatgcgagcatctcggagcccgtccactcctcggcccccctgtccgccagcgccttgctccgctcggcctcgctgtccaggaaggactccacggcccgggcctccgcgtcct

SEQ ID NO: 917 - DNA, 8544 bp, Myxococcus xanthus
  unsure (1)..(8544): unsure at all n locations
cgccgaattgggcaccggccccacgggcgcagcagggagcgcaggtccggacgcggcaagggacggcgttcgggcaaggcacggtcgatgcgcgcatccacccaactgccttccgccagcagccgggcgtactgacggaactgtccggccgcgcggcccagctctccctggatgcgcgcggggggaagtccggtctcctttggtgtcacggcgaggaagtccgcctccgccgcgaggagcgcctcggcgacgtgctccaggaacacggcgcgctgacgcgagggcagcgccgcgagcgtgggggcggcctgctccgcgagcacgcaggcccgctccacctcctggggccgcgcgccgtggaagcgaggctcgagcgccacgccctccgcgggattccatccggtgaacgtcggcccaccgggctcgccgcgttcggcgccaatcaaggacagtcccatccagctcattcagcgacctcactccgggaggggcccatcgcccctccagcttcgctacaggacacttcgcgacggggcactacaacgcgggccggttcgccagggcctcgcgcagcacgcgcaggcactcctcgcgctcggcacccgccagctccagccgaggcccacgcacccgctcgtggccccagccgacttcctgctggaccagcttgatgagctggatgaacttggtgacggtgtccaggcgcaagagcggcaggaaccagcggtacagctcgaacgcggcctgcttctttccggcgagggccagctcgaacagtcgcacggactcggcggggaacgcattgaccagccccgccacccagaagcgcgcgcccgcgtccacgccctcgacgaggcagtcgtccacgcccacgcccacggccagccggtctcccaggagggcgcggatggcggtgacgcgacgggcgtcggtggaggactccttcacggcgaccgcgttgtcatgctcggcggccagctccgcgagatgggcgggggtgaagtccgtcttgtaggcgacggggttgttgtagagcaggcacggcagcttcgtggcgcgcaggacggcggagatgtgggccttcatctcgcgccagtcgctggaatagacatacgggggcaacaccatcagcccggcgcagcccgcctcctccgcggcgcgagccagctgcacggcctccgccgtggacagggcggcgatgcccgggatgacgggcaccttcaccgcgtccacgcacgtgcgcatcaccgcggccttctcctcctggctcagcgtcgcgccctcgcccagtgagccgcaggggatgatgccagtgcatccctgcgacaccagccagcgcacgtgtgagcgcaccgtgccgtggtcgacggacaggtccgtgttgaagggggtggtgatggcggggaggacaccagtccagaggttcatgactctctcgtgtgggtagaggaaacgtccgagggaaggcgcaggctgccgatgcgcgcgggaagacatggtgggcgcacgtcctcgcccgaccagccgaagagggtttgcgccgccgtgccgcaggtgcggccctgacaggcgcccatgcccaggcgggcgtacagccgggcctctcgcaggttctgacagccctccagcgcggacaggggcacgtcctcgcagcggcacagcagggtgtcgggcgtggccagtcgtcgcagctccgcgcgtggcgcgtcatgccgcgcgagctgggcggcgaacgcgcggacgcgatgccaggtgcgctccagctcgacggggatgggttgctcggcggcgacgagtccggccagctctccggtgacgagcgcctggtccatgccgccgatgccgagcagctcgcccacggcgtggaccttggggacgcgcgtctccatgcgctcgttcacgaccaccgtgccggccgaggtctcacagcccagcagccgggccacttccagattgggcacgagcccgtaggccgcgcccaggtagtcgcaccgcaactgttcctcgcgaccgcgcacggacaggcggaccgactccacccggccctcgccttcggcggcgatgacccaagcgtccgtggacgtgggcacgcggatgagcgccgcggacatcaaggcgccttggagcagcttggtcgggtgtcgccagagctggagggcgaagccccagtgactctcggcggaggcctgctcggcgatgtagaggacctcgccaccgtgggcgtgaatcgtcgcggcggcggcgagcaacagcgggcccgtgccggcgagcaccacgcgcttgccgcgaatggggaggccatccttgatgagcacctggaggccgctgacgcccagcacgcccgggagtgtccaaccggggaacgggaggaagcgctcgcgcgcgccagtggcgagcaccgcgcggctgtagcgcaccgcgaacgaggaggagccctcttcgaccaggagcactcccggctcgggcgcggcaacgacgcgggcgcctggacggaagcgagcgcccgacgccgcgaagcgggtgagccaccgacgcgcgaggcgattcgcgccctttcgggcctcgcctctccagacctgaccaccgggctcgggctgggtgtcgaggacgagcacctccagccccgcctcggccgcgcggcaagcggcagcgagtccgccaggtccggcgccgacgaccacgaggtcacaggcctcacgcatcggtcaccacctcctggtcctcacggcacggtgtcagacacatgaggacctcgggcacaccatcgatggtggctcggcactcgaagcagacacccattccgcagaggggcccgcgggggcgcccgctcaagtcggcgcgactgacgaagctgtccgtcatcgccagcgcagccgcgaccgacgttcccgccggcaccgtgacagcacggccattgatgcgcagggtgacgcgcgtggtggccttcgacgtgggctcacgcatgagcgagctcccgagaggacaccgtcaggaagcgcgcgggtgaatacggacgcgcatcgatggcgctggtgtgcccgagcagttggtccgccaccagtcgcgcgctgcccgtggcggtggtgataccgagcccctcatggccacaagccagccagagccacggcttctccggatgaggccccagcaagggcagaccatcgggtgtcgccggacgcagccctgtccagacgcgcagcgcctgcaagccatcgagccccggaaggaacatggccgcgcgcttcagcatgcgctccaggagcgccgcgtccacttcgcgcgtcgcatcgcccggctgtcgcgacgagcccagcaaaagttgccccgtgacacgcggctgggcattgaaagccacggaagcgccgtccgtgccgtgcgcgctcttgaggtagcccaactccaccagttggtgatgcaccacgggagccccgcgccgggtgatgagcaggtgtcccttgcgcggagagatgggcaacccagggcagagcgcgggactagccacgcccgccgcgagcacgatgtgccgtgccgtcaatacctccccatgggagagcacgacgcttcccgggcgcaactcccgaaccggactccccgtcatcagccgcgcaccccgagcctgggcacgcagcgcgaaggtccgcgcggcgagcggtggatacagcacggcatcatccacgacacgcagcgcccccacgagtcccggagcaagcgcgggctcggcctcatggagcgccgcgctgtcgagcacctcggcacggacccccgcggcgcggtagttggccaccttcgcggagacagcggccatctcctcgtcatcggcggcgagccagagggtgccacacgcgtcgtactccaccgcgcgaggcaatccatccgcgagctcacgccacagcgacacggaccacgacgtcagcgcgagctccgccgcgttgtcatccattgcgaccaggtggcccatgccgcacgccgtcgtccccgcaccgatggaccgcgcctcgacgagcgccaccgacacgccgtcggcactgagcacatccgcgagcgccgcgccgacgatgccaccgccgacgatgacgcagtcgaaggcgctcatccgatgccccaggcaaaggggtccgtcgggtccaccagcaacgtggcctccgcgttgacggacgcggtgccggtgatggtgggcaggatgcgcgcaccgtcacggacgtagcgcgcctcgaagcgactgccgaggatgctctcctgcacccacgtcgcgccttccgcgagcacaccctcggcggccaggcacgcgaccttcgcgctcgtcccggtgccacatggcgagcggtcataggccagccctggacagagcacgaagttgcgagcatccacccccggcgtcggagagggggcgtacagctcgacgtggtcgatctccgcgccgccctcaccggtgatgccctggtccgagagcgcctgcttgatggcggaggtgtacgccaggagcgcgggagtccgcgacagctccagcggcaggtgcgtggcgcgggagaggaagaaccagttgccgccccaggcgatgtcgccgcgcacctcgccatgtcccggcacggacaccgctacgtcatgcgcccaccggtagctcggcacattggcgatgctgacgcgcccatccggatgcagcgtggccttcaccacgccaacgggagtctccagcgagtggacgccaggaccgatgcgccccaggtactccagcgtcttcaccacgccaatggtcccgtggccgcacatcccgagatagccgacgttgttgaagaagatgatgccggcgacgctcgacgcactgacaggcggacacagcagcgcgcccaccatgacgtcggacccacggggctcgcagacgatggccttgcgaaaggcgtcgaacttctcgcggaagcgctcgcgcaggctcgccaggtcgcccgttcccagctccgggcctccgtccgtcaccacgcgcgtgggctctcccccggtatgactgtcgatgacacgaatgcgccgcatgcgagccgttcccgctacccgggcctcccatgcgccaccctaggagtcccgaggcgctgtttcttgggagattcgaccgcactcgcgaggcaatcacgcaaatgcgccagcgagcagtcgccctcggggacacccgccagtgacacgcgcgcccgcggggaggtgccgatggttggggctcaccacaggccctgctggcgcagcagctccgccagcgggtgtgcgcccagcccgtgcgcgtcgaagagccggcccgcgacctcgtgtgtgggattcttccacgcgatgcgctccggtccgtcctctcgcgtgttgccacacagcaggagcgacgccctcagtgcctcggcggacggaaacagcgtgtgctngaaaaggagcggattctggctggtgagaaatacctgccgcgcccccagctctcgcatgctcgcttccacccagcgcggatgcagcccattgcccagctcgtccgcgatggcgaagtcctcgttcacgtccaggtaatagagcagtgacagcagccgcttctgcccgaagcccaacgcctcgtgcgtcaggacccggccatcgcgccgcgtgaactcgaagccaaagcccccaaagcccacgcgcccgccgttctcgaacgaccgcttctccagcacctccacgcggaagcggcccgcctcaaagcccgccagcgccacgaacttcgccaggaagctgccttcgcgcgcgtcgtgcgtcagctccagcacgtccgtaacggctggctgctccatctgctcacgcagccaccccggcatccacgtgggcagcgccatcaaccccagcgggaacacttcgccgtcccgcacctccatggcgtagcggatggcgccgatgcgttcaaacatccccagcgcttcatcgaagcgctggggcgccagcaggaacgtgcggcgcagcagctccttgagccgctccttcatccccgcgtcgatgtactgcgccgtcatgaacagcagggtccacaccgaccggtccagcagcgaccagtgcatgctccgcgaccacacggcctcgccgtccaccttgcagtccatgcccgccgcgtccgcacgcatcaccaaccgggccgacggcgaatggagctgcacgtccacttcgatgcgcgggtgcagcgaggagtccagcgcgggcgtgcgcagcggcatcagcgcggagccctttctcggcggtgcctccgtgtccggcgccggcgcgttctcctcgttccggacgaagacgtgcagcttcatgcccggaaacgccaggtcgtactccagcgcgaacggctcgtggatgcggccggagaagtccgagccgagcaccgtggagatgagctccagcagcgtcgtcctgccggtgccgttctcccccagcaccagattgtacgacgggctgaacaccagggaggtgccagggacgacgttccggtagtgatggacctcgagccgcgtgagcttcatgggcctcctcggcgcgcagcatggccagtgtggacgcgcgggggaatcgcgcaatgtcacggaatgtccacctcctttcgtgtgtagggggcgcccgagcccctccctggcaggtcgccgcatgacgcggtgcaggccaaggtggaacgtgaggtggagcgagacctcgtctatacactccgccggctctgcgacccttccgggtcggaaaggacgaagtgaggacgatgaagaaccagcttctcagctgtatggcctccgcgctcatgaccctgtcggcgatgcccgcgctggctcagctcaaactgccggcctccagccccgccgcgaaggtgacgcaggaggtgggcgtctccgagatttccgtcgaatattccagccccgcggtgaagggccggaaggtctggggcgagctggtccccaatgacaaggcctggcgcagcggcgccaactcggcgacgaagattaccttcagccaccctgtcaccttcggcggcaaggccgttccggcgggctcctacgccatcgtcagcctgccctcgcagaagggttggaaggtgatgctgaacacggacctgggcctgtggcggggcggcgcgccctacgacacctccaaggacgtggcctcggtgagcgccaccaccacggagattccgtcgcgtgagcgcctgacgtacctcttcaccgacaccacggacaacagcacgcggctggacctggagtgggagaagctgcgcgtctccgtccccatcacggtggacacggcggccatcgcgaaaggccaacatcgaggacgcgcagaagggcattgccggcatgcacgtgagcgccgcctcctacgtggcggaggccaccaaggactacgccgccgcgctgaagcacgccgacgcggccgtggccgccaacggcacctggtacaaccactgggttcgcgcgggcgtcctgtcgcagatgggcaagtacagcgaggcccgcaaggccgcgcagaccgcgtgggacctggggcagaaggacaagaacttcttctaccgtgaccaggtctccaaggcgctggcggagtggaagaacaagaagtagccagccgctcccggggctcctcagcgacggaggggccccgtcaggagccggcggtagagcgcctcgtagcggtcgatggcgggttccttctggaagcgttccaggacctgtgcccgcgcgcggtgtgagaagccctgccaacgctccgcgtcctcgaccaatgtgagcacgtgccgggccatggccgggacgtcacccagcggcgccaggaagcccgtctccccatgcgtgacgagctccgggattccgcccaggtcgctggccaccacgggaatgccgcagctgagcgcttccagcgcggcgagcccgaagctctcctgctcgctggggagcaggaagacgtcggaggcggcgaccagttcctcgaagcggtcctgcttgccgaggaacgcgacgcggccctccaggcccatctcccgcagcatccgctccgcgggcgagcgctccggaccgtctcccaccatcaccaagcggcagggacggtgacggtggacctcggtgaagatggcgaccacgtcggtgatgcgcttcaccggccggaagttggagacgtggatgagcaccggctcgtggtcacgcagggcggggaagagcgcgcgcaggcaggcgcggtctcgcaccggggcatagcgggcggtgtccacgaagttggcgatgacgtcgatggggacgctctcgggaatgtcgaagccccgccacgtcgcgcggcgcaggtaggccgacggcaccgtcaccgcgtcgcttcgcgtgatggagaagcgcgtaatcggcaggtagctggggtcgattcccaccagcgtggtgtccgtcccgtgcagcgtggtgacgactcgcggcgccttgtggcccagcacctcgcgcgccatccacgcggcggtggcgtggggcaccgcgtagtggacgtgcaggatgtccaggcgctcgtagctggcgacctcgatcatcttggaggccagcgcgatgggatagg

SEQ ID NO: 918 - DNA, 9191 bp, Myxococcus xanthus
ctgaagtcgatcgagggcgcggagcgtctcgcggtcaagagtgacttcgtcctacgaggcatggaggtgacgtccgacctgggcgaagcgctgaaggactgcgtgtacgcggtgggcacgacttctcgtacccagctcaagggacgcaccgtgctgacgccggaggaggccatgcagcggctggcggaggagagcgtgcgcggacgcgtggcgctcgtcttcggtggcgagcagcgcggcatgtccgacgaggacctggcgcggtgcacggacgtgctcgcgattcccacgtcggcggtgcagccgtccatgaacctggcgcagtcgtcagcggtgctgctgtacctctgtcaccgtcaggggctgacgcccacggccgcggtggaggaggcgccaggcgcgaagctgggcacgctgggggcgctggcgaagcgaatgagggacgtcatgctgcgcgcggagttcctcaacccgcaggcgccgcagcatgtgctgaacgagctggagcagacgttgatgcgtgcgcggctgacccagcgcgaggcggagctgtggctcacggccttcaagcacctggagcgcgcggtgacgcggggcgcctctacctgaggaagaggccgccccggcgccgacggcgagtcgcggtctacgccgcgtccttcttgaaggcctcgccgtggtgcttctcgcacaggccgcccttgaacgtcttcacgcggcaatccggcttggagcaggtgcggtaacggctgtgcggcaggtcgccctggcgccactgcttgtagtggaagtagcagtagttcttggcgcggtacgggcgcttgcagccctccacggtgcacgccttcttgccattgctcttggcgaaacgcggccaactggtgcgcttctgggtcgtctgggtctcggccattgcgaagctctcctgcgaaacggtgcgaagtcgcggcgccacaccgaggtggacccgccgcaagggtacggaaaaaggcgcactgtctagcgcccatgacactcgaacgcaaggagcccgggaaaccagggttcagcgcggacccgtccggacttcagggcgcgggggcgtcttgtccagaaccccccgtcccgggggctgcttccccggagggcggagtcgcccggcggcccttcgagcggggcaccggcgacagcaggtcgtccaacaccggctgaggggcccccgcgtgccgcccaggcgcggtgctcgccacggtgggcaggggcgtctcctcggagggcatctcgtccagcttcagggtcagcttcatcgggcgccccaaccggtggacctggaacttcacgtcgcggcccacgccccgggcggccacctgccagcgcagcgcatgcgcccggcgcacgctccgctggtccaccctgacgatgacgtcgcccacctgcaggcccgcgcgctcggccgggccgccttcgacgatgtccgtcaccaccaccccgcggccgcgccgcaggttgaaggcctcggccacctccggagagaagtcctgcacgctcatgcccagccatccgcggcgcacgcggccgtgggacttgaggtgcggaatcaccgtcttcgcgatgtcgatggggatggcgaagccgatgccctggcccgcaacgttgaccgcgttggccaccgccaccacgtcaccgtgcaggtccaacaccggcccaccggagttgcccgggttgatggaggcgtccatctgcatgtagtcgaagtcgccgtcgcgcccgttgggcgtcacgtccgtgcggcccatgtagctgaccacgcccaccgtcaccgagtgggtcagcccgaacgggttgccgatgacgacaatccaatccgccgagcgcacgtgcgacgcggaggccagtttcagcacgggcagcttgcggggcgcggcgattttcagcagcgcgcagtcggtgcgggcgtcctcgcccaccacgatggcctcgaactcctccacgtagccgcgcgggtgcaggacggagacgatgacctccgccgcgccctccaccacgtgcgcgctggtgaggatgtagccgtccggatggatgatgaagccggagccgatgcccttctgcgcttcttctccagcggcgacggcctgcacgtcggcagcctgctgtgtggtgatggacaccacggcgggcatggcgcgccgggcgacgtcgctcagcgtggagcgttgcttctggagggcgcggttctgtgactccacccacaaccgatttcgctcgcggccggtggcttgcgctggcagcaccagcgcgcacaccagcgcggcgaacaggatgacactcttgcctcgcgccctgcccatggccccgcctccaccccgaccagccgcctcccgtgcaacctaaggaggaggggaggccaggggaagcgggcccggaggcgaactacttcttctgcgcgatgatgcggttcaccgcttcacggtcctcggcgctgatgcgctcacgaggcgacgaatccttgtttccggcgacggcgtccttggcgtcctcgtacgcgtcctccagcccgtccttgagccgatcaaccgtggaagggctcaccgagcggctccatgctcgctccatgtggttcaagggcgtgcggccatcgaccttgcccgaagccaggaagacgccgagccccaccgcacagcacgtccagacgatgaacttcaatgcgttcacgctcacagcctcctacctcttcgtacaccaaaggagagggcgtggccagtttccgaccgccgaggtgtccaatgcgctgacagcgcggggtggggcctttaatgtccgcgcgcttgcaacccgaagaactctttcaggcggcccgtgagcgggcggcgcagttggacgtagggcgtggcgacgcggcggtggagcgggtgcgcgcggcagcctcggcccttttcgttcgtatccccgaaccgccggtgtaccgccgcgcggaggacccttcccgcaaggcggcccaggccctgctccccgaagtcgagcgggtgctggcggaggcgctggccgcggggcgggatgtctcggcggtggccccgctggagaagctggtggccgcgctgctggcccacggcgaggcgctctgccacaccgcggccggacgtctggaggccgcggagacggcctggcgccgggcgcaggagctggagcgcgccgcgcacccgacgcgccatctggtgacgtcgccgccgcgtccgccgccggtgttcgacaagggctcgcgtgtgtcgcgctatgacccgcggcccgcgcctcaggcgagcgtgaagctggtgtgcccgaacatgggctgcaagccggtggaggactacgcgtttgtcaccagtcacgcctacaaccggtgcatctgatcggtctgccgcacactcttgctggcgtacttctgccagctgcgccgactggacgttgaagtcggccgaagctgcaaacggaacttcttcactggggactagaggggcaccacgggcagcacgcgcatcgagttcgaggaggccagcggccaggagttcccctccgcgcggcgcgacttgctggcgttcgtctacacggaggcgcgcgagctgaaggcggtggtgaacctcaccaaccagcggctcatgtgggtgagcccggcgtcctcgtgcttcgtggccacggtggcattcggcgcgggcgcgccggagctcgtggccttccgcgcctaccgcgacgacgtgctgcggaagagcgcgccgggtcgggtgttcatccggggctactatcggtggggccctgacgtggccgcgtgggtgtcgaggcgcccggcggcgcgtgagggtgtgcggtgggtgctgcggcgggtgcatggccgcctgaccaggagtggattcgagtgacggatagcatcggagctccgcctccggccccgaagaaggtgggcggcggaacgaagctggtactgggactgctgggggcgcttggcgtgggcggcgtggtgttcctgggcgttctggaagcgcagcgagcccggctggtgccggatgggacgaccgcgccgaccatggagatggcgcgccatggcggcggcacgatgaagctggaggacctgaagggccaggtggtgatgctggacttctgggccacctggtgcccgccgtgccgtgaggagatgccggcgctggtgaagctggccaaggagtacgagccgcaggggctcgtcttcgtggcggccagccgggatgacggcgaccgcgcgcccaagctggtggaggccttcatgcgcaaccacctgccggaactggcgccgtacgtggtgtacgcggacgacaacgtggcgcgggccttccaggtcagcgcgctgccgacgctctacttcctggaccgcgacggcaaggtgatcgacgcgcagcgcggcgcgctgtccgaggacggcatccgccgccgcatcgagcgcgcgctgaagcagccctgacgcctgagcacggggggatttcacatgtcctggttcctggcgctgtccctgctcgcggccacgccggagggcggcgccgcgaagaaggcggaggacgccgagtcgctgcgtctgcgcgccacgaagctctaccgggcgaagaagctcggcgaggcctgccccttgttcgagcgcgccgcgaagctcgcgccggagcacggcccaacgctagcggacctggggctgtgcctccagaagcagggccgaaaagagcaggccctggccgtctacctgcgcgcgctcaaggcgagcggcgcggacgccaagacgcgcgccaacgtctacttcaacctcgccgcgttccatgacgtgacgcctgaagccctgacgctggagcaccagccgacgccccggggccactacctggccatccgcggcgccgggccgtgcgcggacctgccctcctcggagccgagctgcggcaccgtgctgcaggcgtgcctcagcgaatgggtggcgcccgtcgaggctgtctacgcggagacaccaccgatgttctacgcggagacgggcttcaacatgcaagtcaacaggaccggagcgcggaagaaatcgtccgtccccactaggcgtggagaggcagggtagtgcctctacgcgcattcaccgtcgaatgggggctccccggcggcggggcactccctttagtgggatagcaacgagctggtcgtagagttccattacaagaaacacgtctgcgagtagcagcgggatccgtggctgaagaatgaaggcaaaagcaagttcgtctacgtgaacccttgtgagggccacgtcgccgtcgcgtgaaaaagagcccgcttatcacccaatcaggtctgggtaggcgacgtgtgggtgacccccgtccgctgagtaggacgtgcgcgtcacgggcgctccgccccagctcgcgtggactacggcttgccgtccttgtccggggccgcgttggccggcgtcgttcccggcggcggcggctggcccgcagggacaacggtctccttcttctccgtctccagctcggcgcgcacgagccggaagtcgacgcgccggttcttcgcgcggccaagcgccgtgtcgttggtggcaatcgggttgtcgaagccgaagcccttggagctgaggcgcttgcgcgcgatgcccttggccaccaggtactcgagcacggacttcgcgcggcggtcggacaggcccatgttgagggcgcgcgagccgcgattgtcggtgtggccttcgatgaggaccggacccagcgtcgggttcttccgcagcaccgtcgccacctcgtccagcagcgggtacgactgcttctggatgacggcggagcccgtctcgaagagcacgttgcccttgatgcggatgcggtcggactcgacgacgacatacggcggcgagtcgtacgggcagccgttgttctccggcggaccgaactgctcggggcagtcgtcctcgttgtcgggcacctcgtcaccgtcggtgtccgggcagccgtcgtagtccttcgggccgggcttgtccgggcacttgtcgagcttgtcggggatgccgtcgccgtccgcgtcgttctcgtcctccgggcagcccttgttggacttggggcccggcttgtcgacgcaggcgtcctcgccgtcgacgacgccgtcgccgtccgtgtcgtagttcgggtccgggcagcccttggtgtgcttggggcccttctcgttggcgcagccatcttcgccgtcggggatgccatcaccgtcgttgtccgggtcggggcagccgtcgccgtcctggaagccgtcgatgtcctcgggctcgttggggcagcggtcgcggatgtcgggcacgccgtcgccgtccgagtcgatgaacgtctcgtcgtagcgcaccgcgaacatcacccgcagggcctcacggccgtagccgctggacaggttgatgccgcggccgacgttgagctccatgccccagttgccccagaccttggcgcgggcgcccaccagcgcctcccacggcgtcttgagcgtgtcggcctggtcgaagttgaaggggcgcaccagcggggtgcccaggtgcatttccgccacggcctccacgtccgtgaagcggcccaggttgggcagctccgcgatggcgcccgcccccagcgtcagctcgtcatccacgagcaggttgaggtactgcgcatggggccgcagccgcacgcccacgttgccgagcacgcggatgggcacggggagggcggtgaatcgctgctccagcgcgatgcgaggcgcccagagcactccgcgctcgccggtgaagctggaggcgctgcccgtgggcagccggacctcggcgacgagcgacacgcccactgggaactgctcgcggtccagcaggtggacgcgcggcagcaggcggatgtcgcccagcgtggtgcggcccacgcccgcggcgcccgggaagttgggcgcgttcagcgcgtcgcgcagcaactggaagttgtcaccctggagcagcgtgacaggcaggtccaccgccagctccaagcgctcatggagctgataggcgaacagcaggtgcgcatcgagccggtagggcaagaggtcgcccagcttctcgtcgcccagcttcagggcgaggatgcgccagttgaagtcgaacaagagcgccgcgcggaagctcccagcgggcagcgcgttgctcgtgccttccagcgcgataccgctgtgctgagccgcggtggccttgacgggaacggcgtcgaatccgcgagcgaacgggtcgtggtcggcgtgcgcagccaccgaggccagaagcaggcccaggacggcgagtcgggtggctgaaccacgcaagctgaagccttgcatgtttcaggctcatagcacccgactccggggggtggaaggaaatgacccaccccccggcactgctgattacagccgtgtgttatttctccatgaactgctgcgcggggatgacctggatggcctccgggcgcaggggcagcttggacgaggagatggcctggtcctgtgtcagcaactcctctgacttgggtgatgcgtaggtgatgggcgacggcgcaccggagcgcagcgcctgggcgagcccctccgcgtcctcggtgacgaaggcgaagttgagggcctcgggctgcacgcggcggcggagcgcctcctggacggactgcggcgtcattttcgacatggcctggcggtactgctccaggaagtcgggcgtgccgtagaagagcccgtcaatggcgtagcccagccggcgttggtccgtctgttcccacaggcgggtgtagccctggaggaagccgcgcatcagctcgaagcgctcctgcgggatgccctccttcaccatctggtccaggaagaacaccgcgccgcgcgtggcgaacacgccgttggtgggcaccacggggcgaatccacagggacaggtcctgctgcgtgcgcgcgatgttggtgcggttgtacgtggtgccgggcgactcgatgaagtgctcggcgtaggcgtagtcgccgtagttgaggccgcgcttctcgcgcagctcggtgaagagcacgccaatggactggcggtgctcgcccaggttggacatggcgaaggccaccgggaagaagtccgggtcgccgcggcggatggtgctgacaaagcccatgctgacggcggtggagagcgtgggcttctggatgatgacggtgcggccggccgtcgtcggaacggcgggcagctccacgcgcggagcgcccttcgcgggcaacgcggacaggcgcgagctgagcgcctgtgcgagcgcgtcatccaccgcgcccgccaggccgatgacgagccggtcctgcgtgaagacgcgctgggcgtgggccttcacgtcgtccagcgtaatcgccttcaggccctgtacggtgccgccggtgaagtgcgcgtaggggtggccctggtagagcagggcgtccagcgcgaccttgcccagtgcctcgtcattggcgctgcgcaggccgttctccacgtcgctgatggcgttggcgcgcaggcgctccagctcggccttgtccaggcgcggagccaggagcacgtcggtgaagatgtcctggaagcgcgtcaggaagtccttgtggacgcggccggagaacgtcgtgagctccttgtccacgaagacgtccagctccgcggccatggggtacagggcctccaggagctgcgaggccgaaagcttctgcgtgccgccctccgccatgagctgcgcggtgagggcggtgaggccctccttgcccttcgggtcgtccacggagccggtgtggaacacgagccggaaggagacgatgggcgtgtccggacgcgccaggacgaccaactccatgggcttgggctggcgcagcggcgtcgcgggcacggactccggacgcgtgggctgcggagcgggctcgggcgccgccgcctgggcgggcaccgcgggcggcggcgcgttctcgtcgggaggcggcgcctggggcgtggtggcgcagccggcgagccccagcagggcggtgagggacaggagtgctcgggtcttcatcacttcgtccctccctgggcgtccgtcttgggggtgaggctgagcaggatgagcttgttggcggtgaggtagcgcttggcgaagtcggacaactgggcgggcgtcaccttgggcaggctctgcaggtggcgctggaatccgtcgggcgagcccgtgacaccggcgtaccagccgagctggatgcccacgtcgc

SEQ ID NO: 919 - DNA, 7229 bp, Myxococcus xanthus
ggggtggcgccgctgtggccgttgctgtccttgggggtcaccaccgccacggccgccgcacggttcaccttgcacggcctcttcctcttcttcgtcaaggtgggctctgtgctgtacggcagcggctacgtgctgctggccttcctccgcaccgggctggtggagcgctacggttggctgaccgaagcccaattgctggacgcggtggcggtggggcaggtgacgccggggcccgtgttcaccacggccaccttcatcggctacgtgatgggcggcccatcgggcgcggtggtggctacggcgggcatcttcctgcccgccttcgtcttcgtggcgctgagtggaccgctggtgccacggctgcgccgctcatgggtggccggcgccttcctggacggcgtcaacgtggcgtcgctcgcgctgatggcggtggtgacgtggcagttgggacgggccgtgctggtgagtccgttgccggtggccctggcggccgtggccgccgtgctgctcatccgctatcgcgtcaattccgcgtggttggtgctgggcggcggctgcgtgggagtgctggccgccgggggcctcagcgcggggtgagcacggcctcgcaggcgctcaccggctcgttggcgaggtccgccctgcgcgcggtgcacttcagccggaggacctcgccttcgcgcaggacttcgcacgcgcggttgacctcgaccgttgttccggtgcccgcatcgccaggcagagtcccaccatccgcgtccacgatgatggcgacgttcatgtccgccaggtaccagttgtcgccctggcggaggtccacgctgccgtcgtagacgtcccccgtcatgggcaggcccgttcgttcctccgcctccacgtcgaggcggcaggtgtcttggggggtgctcacccggaggatgcccggcgctccgcacgtgttgtggcccacgtcgaaggtgacgctctgggcgggctggtggcagcccttctctcccgagtccgcgacgagcagcaccgccgtggtggcgagcgcgcccgtggccgcgaggttcatcaggatgactttcacgtgctgactccagtggagggtgcggcggggagggacgacggttcacgggcggcggcgcggctgtaacgcaccgccgcccagacaagcggcaacgtgacgaggtcggtggggtcggcccaggctcggaagctccggatgccgagcggcaagcccaaggggcgcagcagctcacagaagaggtccgccgcgggctgggagaccttgagcgcggtgtagaggcacgcggtgaagcccgcgcccactgccaccctgcgcgccctgggccagcgcgtcaccagcgccagcagcgcggacacgtagagcggcaggaagaagcagatggcgacgtcggacagcttgccggtgagggcgttgtggaaggtgggcttgagccagcggtcattcaccgccatcagcgccacggcgaacaggggcagcggcgcgaggaactccggcatggagggaaggcgcttcattggagcttctccccactcgagagggcccgcaggaggatggcgtctgtgagccactccaccggggccttgtcgtccgtcagtggctcgcctgcgggcaccggcttcagctctccggccacgcgctccgccagcgggcgcagcgatgcggggagcgacgccgtgcgttccgcgagccgctctgcgagcccgggggccccggcgaagagcagcgtgttgctgtggttgcgcgcgtcggcggcccggacctccgggaagacggtggccagcgtggcgcccacggcctccaccaccgcgcgctcctgcgcgtagcgccccacgttgaagcaggccacgccaccgggattcaggcgcgcggccacggcggcggcgaactcgcgcgtcgtcaggtggaaggggacgtaggggaagcggaacgcgtcgaccaggatgacgtcgtactggcgggtgtcgcttgcgaggaaggcgcgcgcgtctccgacgtggacttccacctcggagggcaggtcgaagtgcgcacggcccagccgcaccacctccgcgtccagctccacgcccaccacctccacgccggggtacgtctcccgcaggcccctggcgctcgtgcccgcgcccaggcccaggaccagcacccggggcgctcgtggcgctgcctgggccatggcggggaccagcaggtagtgcccgaagacttctccgcgcacaggcaggccaggccggtggacgctctgcaccgcgtagccctcatcgaagacgagtgagcgggtgccgtgttcgtccttcaccacctggatgaaggcatagggggactcggccacgtccacggccttgggggcgcggggcagggcgtgggcgcccagggccagcgccaccatgggcacgcccacggcgggcagccgccaccgccatcccaggcgccaggatgccgtgagccccagcaccgccgcgaagagcgccatggtgcgcgcggtgcccagcagcggcagtacgacgaaggcagccagcagcgttccggtgatgctgcccaccgtggatgcggaggacagccgtccggcgtgcgcgcccgctgactccactcccgccagccccacgcgcagcacgtacggccccaccgcgcccagcaccagcaggggcggcattgccaccaccatcagcaatgccacgcggcccagcccctcgatggggcgtccccccagcaccgcggccgtggcgccgggcagcagcacgcgcgcgaggaagggcaacatggccagggcgagcgcggagaggcagagcgcgctcagtagcagtgtcaggcgaccccgagcggtccgccacgcggcctcccagatgcgcgcccaacgcgagcccacccaggaccagggagatgagcgcggcccagacgggcgtgctgctgccgaagtagggcgccatcaggcgtgacgccgccatctccgacgccatgacggtcgcgccggtaatgaaggacagccatgtcagcgaagacgtgggtcgcatgctcggacgcttgcttcagcaaggtccgttccaatgcgaagtcctcgaaataattgatgcggagggacagcaacggcaggggcaccatgacagacgtgccagggggtgggcgttatcgggcggcgacgccccgccgcttccgggcggcggtgaccgtcagcagcagcaccaccatggggacgcccagcaccagtggccacagccagagcggctcgccgccgtggatgacggcgcggaactcgcggccctcggcgggggcgtccatcagctccgcgaggttgagcttccactccacggtgtccttctgctcgttcaccgtgccgttcgtctcgccaattccagggccgtggatgcggagggtgaggcggttgttgacgagcatggccttcaccatgcccttcgcgagctcctgggcggcctgctccgcggcctcgtcaccgatgccgaccggcgtggcgaaggccttttccgggttgaaacgctgggtgtagacgtagtccccgccctggcgctcgatgcggaaatcccacgcatccttcggcgaagacggttggccctgggtgtgctgctcggcggcgcggcggtagagctccgggagctgggtgacgtccttcaccgtcacgtcgtagacgagatggacctggccgtccttctcgtagtcccggagcatcacctgggagacttccgggtcctggcgcagcgcctgttcgaccgcgcgcgcgctcgcgagccattgctccttggagaccggcgcgttgcccagccgcgccagggccgtcagggacctgggcactcccatgtcgaccaccagccgcgccgaacctcctggctcaatccagacgtcctgctcgacgttgaagcagcctgtcaggaagagggacagcgccgtgagcagcagcgcggggcgaagcagggtgctcggtgagccatggaacatggctcaccagtatgctgggactgtttcacgcggagaaggggagggacgccaccttcaccgtggcggggcccgccgccagcgtcagctcggtgcccggctccagcgagtcccggtgcacgtagcccagggccacccgctgccccgcgacaggcgactgcaccacgctggtcagccagcccaccttcttctccccgcgccgcagctcggtgccgggggccacgtccgcgtcgcccagcagcagccccgtcagcttgcggttcatgtggccgcggaaggtggctcgggcgatgacctcctgcccgatgtagcaacccttgttgtaggagatggcgttcgccaggttggcttccagcggaatggtggtgtccaccatgtcctggccgtaccgggggacgccggcctccactcggagcaggtccagggcctccaagcccaggggcttcaggccgtgggcggcgccagcctcggacagggcccgccaggcgtcctccaggccggtgcgcggcacccacacgtcgaccccatggggctcgatggcggtgctccccagcagccacacctcctggccggccagcgtggccgtgcgggcggcatggtgcgacagcggcgcatgggggctgcccagggcggccgacaggacgtcctccgtccgaggcccgagcagccggagcagggccagctcccccgtggcctcgtgcagctcggcgtcctcggaaatgaggtatttatccaggaactcccgcaccttggcgccggtgccgggctccaagtccaggaggaggtctggctcccgcttgaggatgcgggcatccgccaccatggcccccttgacggtaaccatcgcggcataggccgcggtgcccactggcaggttgttcacctcctgggtgaccatcccgtgtaggtaagaggcccggtcttctccagtgattcggagggtttcgcggtaggaggcatcatggagggccacggacgccttcgccgcccggtactctccctccgagtctccatacccggccacggtttcccggccgcccacagcgccaaagcgggcgcccgccttctcgtgaagaaaatgcagagacagcggttccatgtccgtcgctatatagaggcgaaggagcgaatgccacgatggatgtgaagcacctgtcgtccttccaggacttctcaccggagaagctcctgaagcacaatgtcttccagtccggccgtttcttcctggacgtgtactgcctccagccgggacaggcccagaagccccaccgccatgccacgtcggacaaggtgtatgtcgtcctcgacgggcgctgccgctttcgcgtgggcgccgaagaggaagtccacggccctggcgccgccattttcgcccccgcgggcgccgaacacggcgtcgccaacgacggccccgatgccgcccgcctcctcgtcctgatgtccccgcccccggagcatgcatgagctcgacgtcttccccttcgcccacccccgtggcgactcgtggcgcgctggcgctgctggtcctgggcctcgcggagagtggcctgtccatcttccagtggatgcagttgctcaccctacgcggtggtggctccaccgtgtgcggcgtctccgacacggtgaactgcgagacggtatggaactccgccttcgccagccgcgtgcatgacctggtgggcctgcccgtggcggccctgggcctcgtgtgggggctggtcgcggtgggcctgtccgcgctgttcctggagtgggctcgctcggaccgtccggtgcgtccggcggccaacgggctgcggctggtggccgccgcgggcctggtgtccgtggtggtcttcgccgtggccagcgcgcagtcgggcgcgctgtgccccacgtgtctggcgacctatgcgctggtggtggccttcgcgggtgtggcctggaagggcctgcccggaccgctgctgcccggcgcgggcgagtggggcgccacgctgaagtggacggcgggtgtcactgccgcggtcttcctggcgacgctgctgcccggccgggccacgcccaaggcgtcggatgcgtccggtgccgcgctgctgccgcccgcgccgcaggtggccagcacgcagacgccgggcgtgacgccgcagacgccgccgcctccgcccgcgtcgctggaggagttcctgcgttcgctgccgccgcagcaccagcagttcatggcggacgcgctggccgcgtaccgcagcgggacgccgcagcccgccgcgtcgcccgcgcgccaccgctacggaccggtggatgcgccggtgaagattgtcgagtggacggacagcaagtgcccccactgcaagatgctggtggaggagctgtccgcgctgaagaagcgggttcccgaagggaagatgtcgctggaggctcgccagttcccgctggatggtgcgtgcaacccggcgattccgcgccggggcccggatgcgcccagcgtgcgctgcgtggcggcgcgtgcgcagatctgcctggagggcgcaccggactactgggagctgcgggagaagatgttcgccgcgcaggccgtgctggacacggagcgggcggtggagattgcgtcgtcgggctcggtgccgcgctcgcagttggaggtgtgcatgaacagcccggccacggcggcgaagattcaggaggactcccgctacgccatgcgccaccacatccagggtacgccgctggtgctggtgaacggccgcgagacggcgccctccgcgccgttcctctacgcgctggtgatggcggaggggaatccgagcgcccctggcttcgacgtgctgcctccgccgcgcccgcgcccggtcggtggtcatggccacggccacgacgaccacgcgggccacaaccactgaggacgcggcacccgcaccatgggcaagcgcgacaagaagggtgagccgccggcggcaccggcggctccgttcaacaatccgttcgccgcgctcgtggcgcagcgggaggccttgccccaggctcccgccgcgcccgtggctcatgcgcctgtgaaggccgagcccaagggccccgcgcgcgcggtggttcgcatggagcgcaagggccgtggcggcaaggaagtcacggtggtggagcacctggagctgcccgcggcgcagcgcgaggtgtggctcaaggcgctgaagaattcgctcggctgcggcggcgtggtggaggacgacacgctggtgctccagggcgaccagcgtgaacggctgcccgcgctgctccaggcgccgagcgtgcggaaggtcac

SEQ ID NO: 920 - DNA, 7553 bp, Myxococcus xanthus
tttaaacgctcaccctcctgaatgtcgatggcgcgcctgacattgccttcaaggctcgagttgaagagctttgaaggatcttccagggaagcgcccttgaagaaggtcagcttcacggccgacttgtatgcctcacccgtgcagaggcctgctccgtgggaccagaccggggtgccccgccacttgcattcctccacgacatccgggacggcctccttgatgagggcacgcaccctggccagcgcctcgcctcgccagtcacccagctcggcgatcctgtcgctgatgagcttcgaggccgactcgccatctgtcttgggttgactcttcatgttcctgccttccggtggggaggccacgatgcccacgtttcctacgtcccgatagcactccgatgggacgtaggaaacaggagcacgcgcggtcaaccggagcgccttcgagccgttccgacatggagtggcccgcgatttcacttcgcgtttgagagcggcacgcaggttatggggtggcctgcgccgggggcgtctggggcacgacggagaccttgccctgctcctgctgaagggtgtgcgtgctgccgggcgcgaagcgctggaactcctcgagtgtttcaggggtgtaggtgatggcgggctggtcgtcgccgtggaagaccacgctgtaccgcgcgtcgcgcgcgtttcgttccttctcgcccttgcccaaggccttggcgggccgcagctcggcgtcggtgggccagcgcgcctcgagcgtggtgccgttcgccttcacgtcccggtcgtgcatccatcgccactccttccaggtgtaccaggtcgcctggcgcggcacgctccggtagcgcggctcctggcgtgagcgctgctcgtccacgtagcgcggctcctggcgcttcttcgtcacggagcagtagcgggtggtgcagctccgacctcctccggtgcaggtcgtcttgcaggtcgcgaagccgttcctgttgctggtgcactgctcgctgcacttcttgggcgtcgtggtgcagtcctcaccgcaagcctccttggcgcggtaggtctccgtggtgaagccccgctggacgcgctccgtgtagcggacggtcgtgtagccggcgagcacctggtcgtcatggtggtggcgcttgccatgcgccttcaccaggagggcgccttctggccggtcctcctcgaagccctcgtcattcaccaggcggtagcgctccacgctcaccgtgtgctcccaggagacctccttgacctggagcgtccgcgtcctctccggctccgtcttgggcgctgtcgtggccgccgtcgcgggggcggtccccttcttgccggaggacatccacatgggacagcagcagccgaagaacgcgatgatggagaggatgtagcagcccaggcgcctgttgctcttcgcccccttcttctcgtctggcgtggggcgcgtgggctcggcgggaatcgagccttcgacggcggacgcgccgcagtgcttgcagccgccgtccagggcccgctggtcgctctcgcaataggcgcatcgccagttgggaccggcggtggccatcctcagcagggcctcgtcggtcaccgtgacggcggacgcggtgtcctccggcatctcatactgctcgctgccgtccttggcgttcttgcagccctggcacaccatgtagcggccgaggttgcggtggctgcagctcgaacaacgccagaacatctcaatgtgccgctcagacatcctctgttttccccctcgggtgcgtaccgccgagcggtgcggcctatagcacggagcgatccggacgggcggcacggcgaagcccgtgccgctcccgcgtcgctcggagtgcgtggggtgacagccagggagaagaaccgcgtgcagagaagtattgagacgaatcgacgcgaggcaatcgcaacctgctcgcgcgggaagacagtttcggaccggattgaacggcacgcctgggcgtttggagtcttgaagaaattgcctacactgccagcccgctggcgctccgaggacgtgcttggagcgccagcgttcatccccacatacccctggagtgtcatgcgtcgcatcatcgccctgcttgccgcgctgaacctggttgcatgtgcccacggtggtggcgccgcgccggaagccgcctcggtcacgaagcccacggcgccaaagcccgtcgccacgcccgaagcgaaagcggctgcctccgaggcatccggactggccatgaagggcgacaacgcgcgcgcccttcccctgttccgaagcgcttgggaaggcggggggcgcagcaggaacctggcctacaacgcggcctgcgcggcgtccttgctggcggagcgcgaggaggcgctggtctggctggagcgcgccgtggaggagggcttcgatgacgcgaagcacctccagaaggaccctgacctgagcaacgtccggagcctgcccggctacgcggcgctggagcagcgagtcatcgccgccgaggcgaagcagtacgaggccgcggaccctgtgctgcgggacgagttgctcaagcgcatggaagaggaccaggcggcgcgcggtgccctcgtcgcctcgaacttccaggatgaggccgccaaggcgaagatgatggacgtcgatgcccgcaacaccacctggctcaagggcgtcatcgcgaagcatggctggccgggaagcgccctggtgggccggcgcggtaccttcgccgcgtggttgctggtgcagcacgcggaccaggatgtggccttccagagcgaggtccttccgatgctggagaaggccgtggcgcgaggggagggcaccgcgaaggacctcgcgtacctcacggaccgggtgctggtgaataccggcaagccgcagcgctacgccacccagttggaggaggtggatggaaagacggtgcccaaggcgctggaggaccccgagaaggtgaacgagcggcgcgccgccgtggggctcgatacgctggaggagtacatcgcggccttcgagcggatgaaggccgcggccacccagcagaagccctgagccgcggggggctgatggcggccgcgccgagtggggcggccgccaggcgctgcgccattcatctgctgccctgcaatgcttcgcgggcacgagacgcttgcgcgccagcaacggctgcgctggacggaggtggacgtccggcctcctcccaacaagcaggcgcggtgcgccttgctggagggtttctccctgcacgccaacacgctcctgcatgccaacgacaggcagggactggaacggcgatgccgctacgggcgcgcggtgcgctggcgctggagcggctgtcacgagcggaggacggccgcatcgcctatcggatgacgcgaccgctgccggacggcaccacgcaccttctcttcaccgggttggagttgctgcgtcgcctggcgtccctggtgcctggtgcctcgggcaaacctcacgaggttccacggcgtcttcactccaggcgccaaactgcggccatttcaggtccctcaagcaggatcgcaggaagcgagcacggggcttgaggcagcggccaggaaggagcgggcaccgcgagtggactttcgcggagttgctcaggaggacgttcgacttcgaggtgttcgccagcgtgaggagtggaggcaggcttaagggtcttggcgtacgtgcggagtctcgcggcgccctcccgcccagccacgtgtggctcggcgggagggtgccgctcgtgagtccgaggcaggcttgccgcgcgcgcgtcagagcgtgcgcatgaacgcgaccaggtccttcttctcctgcgcgttgagccgggtctccagcacgaggttgaagaactccaccgtgtcctccagcgtcatgagccgcccatcatggagatagggcggagagtccttgatgcctcgcagggggaacgtcttgatggggccatcggagcccatcaccgcgccgtttaccagccggggcttgtagaagcgctccgcctgcaggttgtgcatcaggttgtctgtgtaatagggcgggaggtggcacacggagcactgcgccttgccgaagaagagcgtctgtccgcgcatctcctgctgggtggccttcttcgggtccagcttcccgtcgaagcggagcttgggggccggcgggaagtcgaggagggcctggacctccgccatgaagtgtacctggctaccccgctcgaggatgttgacccctttcttcgtcgcgatgaccgggtcgccatcgaagtacgccgcgcgctgctcgaactcggtgaagtcctccacggtcttcagggcccgctgtgagccgaacaggcgctggatgttcactccgcggagcgtcggcgtatcgatgcggtggcggaactcctggggccggatgtcgcccaccaggtgcgtggcgccattggagtggccgttgacgtgacagtcgaagcagctcacgccccggctgggcagctcggagcggcggtcggcggtctgattgaactgctgctggggaaagggcgtgacgagcagccggaggccttccagttgcttcggattcaggaggccgttgaacagctcctggacgttcatgatggtcaccagcttcccctgcgagacatcccccaggtccgggcgcgtggtgaggaagatgggcggcgggaactccggcagcaggtggtccggcaggtcgaagtcgaggtcgaaccgtgtgaggtccctcccttcctgccgcttgatttcatcgatgtggaacttggggaagaccatgccgccttccggatgattcgggtggggcaatggcatgaagcccgcggggaagagccccctgtctcgaatcgcctccgggctcatggcggcgagggactcccaggtcacgccctgtgggagcttcacccgcacgccttcctggacggctttcccccgggacatcgtgacgccccgggccggacggtttcccaggtcatagcggtgttccaggagctgctggtggcgcgcggtgattttgggcttctccgccttcatccgcgccatgacgtcagcgaagggctccgtctgggccacgggcatgtagctggtgctgccacgccgctgcacttcctgggcgtgggacatgcctgtgtccatcatgaaaaggcccatgactgcgacagcgatgtgtgggattcccccctgcggcttcatgcaagtcctccttggggctgacttcacccggaatggtgtcctgctgttcaggcaaggtattcaattgcggcgggggtttgtccgaaccgttggcgaaccgttggccagttcatacgttggcgctggtccacacctgcgcagccgggggccgcacgcgcgcgaagcggcggcggtctccggctccgctcacggcatcgggggcgttcgggggtgtgtcctcgtcctccctaccggacaggggcctcgtgtccctgggccggcggtgtgcacggcgcgcacacgggaggcacgtcgtgccaggcagaagcgagaggcgctcagtgcctggaccaccacgtgtccggcgcgcgtcaggtgcggggtgtcgccctgtcgcagcacgtggtccttcacgtccccttcgcaggtgagccacagcaggccctcctgacatgtgcgcgtcaggggccctccgccctgcgtgcgcacgctctctcaagcaggtgcgcaggaggcgggcgcggggcttgaggcagcggcgaggaaggagcgggtgaagaagaggacaccgcgagtggactttcgcagagttgctcaggaggacgttcgacttcgaggtgttcgcctgcgtgaggggtggaggcaggctcaagagtcttggcgtacgtgaagggggccccggggggcgggcaattcaggagcacctgggcttgcccacgggatgtgcgaggtgggcccctgcacgagggccaccccaggccgcggggtgttgaggctcaagaggcgccaagaggaccaagcccctggtgcgcacctgaagggagcgcggtctgggcaggcgtgtacccaaagggggctcaagcggcctgtccactggacgggagcaccactcgggcggccccgtcagcggtcctcctcggcccctctgcacctttcctcccccctcaacagggcccccatccctctgatgcgtaaggtgcgcggcaacacctgccgtcacgcgcgcaggctctcccatccaacagggaaactacggattcgccaggacgggcccgtccgagccatagacggggctgtacgtcgtgacaccgcagcgggaagcgttatccgcgatcgaggtgctgaagtcgttcaggaagacgacccgcagcgagtagcctggggcggcgccgaagatgccgcgaaggcgctgcgcatccgtggccgtgtcattcacaccgaagcgcacggacgcttggccgaacttgttgttcgccttgaacgtacagccgggcgtgtactggtacgtcgacgtggagacgaccgtcggcgacatgcgcgccagcaagcgggcgatgggcaggccattccaaacggggttggtcgcacggctcaacgtctgtgcattcggccacatggtggagccgtagcgcggaacgccattggggcccgagtagagcgtcgtctggggcgtcacaccggcgacgtagtcattcacgcccaagccgctcgcgagcagcgtcaggttttcgcccgaggggaagagcgtcgcgctccggttcatgtcgaacgcgtcgtacgggacgttgatcttgatggaaggcgccggcagcttgagattgacgagcagttcgttgttgcgcgtcgtcgagccatcgaggaacagctgcacgtctgccgtctcgggcagcgaatcgatgatggaactttcgatggtggaagtaatgctgttcgccgcctcgctctcgatgatgtcgtagatgagggcgggaatgaggccgagaatgggaacgacctgaaccgcctgacacaggaacggccaatcgaggctcgcctggggcgcattcacccattgcaccgaaatgccggagaagttcgcattcagcttgaaggtgccataggcgcgaatcgtcgggtcgcaccaattgttgatatccgtcttgaatttgaacgagaagcccacgccactcgaggtgacggagagctggaggctattcgggtcgtagccgtagatgcggcgcgtggagccgtccgacgacctgaggacggtcgaattcgtagcgccattgaacttcgtgtagagcgccttgccgaacatgttcaacagctcggcacgagagaatccgatgggtgcggggacgtagctcgcctcgacgctatcgacttgcaccatcgggaagctgtacgtcgcggtgccgctgccgaaggtgcgccccacggtgatggtgacctggttcgtggagccatctcccagataggggaagaatatccacaagttgtagccgtagcggctggggtccgcgggttggtacgaggagtcctgggcggaataccaatagccatcggtatacgtcggcgtcacgacgcgcgagccgactttgacctctttgatgtacgtgcacttgtcag

SEQ ID NO: 921 - DNA, 7530 bp, Myxococcus xanthus
tgtgctctaaagtgcctgtcgtcctgccgcccgaggcgcccgaggcggtggccgcgctcaacggcagcggcggcacggtggagttccgctgggcggcgccgccggccaacccggatgaggagggccgcgacgcgcccacgggttaccgcgtctaccagagcgcggacgggctgggctgggacgacggcacggatgcagcgggcacgtccttccgcaccacgctggcgccgggcaccgtgcgttacttccgcgtggccgcgcacaacgcgggcggcgagggcttcccgtccgtcactgtgggcgttcggacgccgggcggcgcggagtccccggtgctggtggtcaacggcttcgagcggctggatgcatcccaggcgtgcgccgagccgctggacgcctatgacctccatgcgcctgtccgcctgctggtggagacgatgaacgatggcacctacgtgcgccgccacggcgccgcgctggcgcacgcgggcaccgccttcgacagcgcgacgcgcgcggcggtggcggcgaacctggtgacggtgggcgcgccgtaccggctggtggactggttcaccggtcggggtggggcgggaggggcccgtcctacccgtgaggagcaggacgccctgcgcgggttcgtgatgcagggagggcacctcctcctgtcgggcagccatgtgacgtcggcgctggccgtgggttcggcggaggaccaggccttcctggcggacattcttcgcgcggcgccgggcagcggaacgcccccgttctccgtggagggcatgccgggcgactggctggcccagctcaccggggtggcgctggatgacggcacgcggggcggctacgcggtgggcgtgacggacgtgctgacgcccgcgtcgggtggcacgtccgtgcttcgctatctgggaactgacctggcggcgggcgtgatgtcggcgcccaacgggcgggtcctgctgctgggcgtgcctttcgagggcatcgtcagtccggtgcagcgcgccgggctcatgtcctcgttcctggtgcaggcgggcctgctcacggagctgcctcctccgccggccgaggaatccggcgccgcgagcctgctctccgcctgtgtggcggcgcggggcgtggacccgcacccgccaccggagcccgagccggagcctgaacccgagccccatgtggtgggggtgctgccgcagttctatccgctgggagattccggctgtggctgcggggcgggtgggggaacgggcaccgccgtctggctgttgctcggggtgattgttcagcttcggcgtgcgcgtcgtcgcggggatgtcgccgggcgttgactcggcgggtcgcgatgcctacggtcggccgccctcgattttgacgtgacgacccgtgggtgcctggcacccactgctcaaggagacgacgaacatggctacccggattgccatcaatggttttggccgcatcggtcgctgcatcctccgcgcggtgctcagccgcaaggaagacctcgagattgtcgccatcaacgacctcgacaagcccgcggcgctggcgcacctgttcaagtacgactccgtgcaccgcacctggccgggtgaggtgaaggcgacggagaagggcatcgtggtggacggcaaggagatcaccgtcaccgcggagaaggacccgacggcgctgccctggaagagcctgaacgtggacgtggtgctggagtgcaccggccgcttcaccgcgcgcgacgcggcggagaagcacctgaaggcgggcgcgaagaaggtcatcatctccgccccggccaagggcccggacatcaccatcgcttacggcatcaaccacaacgagtacgacccggccaagcaccacgtcatctcgaacgcctcgtgcaccaccaactgcctggcgcccatcgccaaggtgctggtggacaacttcggcatcgagaagggcctgatgaccacggtccacagctacaccaacgaccagcgcatcctggacctcacccacgaggacatgcgccgcgcccgcgccgccgcgctctccatgattcccaccagcaccggcgccgcgaaggccattggtgaggtgattccgcagctcaagggcaagatgcacggcctggccgtccgcgtgccgaccccgaacgtgtccctggtggacctgacggtgaacaccgagaagaaggtcaccgccgaggccgtcatcgaggccttccgcaaggccgccgaaggcccgctcaagggcgtgctggagttcagcgacgcgcagacggtgtcggtggactacaacggcaacccgcactcggccatcttcgactccaccaactgcttcgtgatgggcgacaacctgctcaaggtcatggcctggtacgacaacgagtggggcttctccaaccgcatggtggacacggcgaagttcctcgtctccaagggcgtctagtcccaagggcgttcagggcaccgagagggaaggaccgagatgatccgttacatcgatgatctgcagctgaccgggaagcgcgtcttcatccgcgtggacttcaacgtcccgatggaaggacggcgcgtgaccgacgacacccgcatccgcgaggcgatgcccaccatccggcgcgcgctcgaaatgggcgggaaggtcatcctggcctcccacctcggccgccccaagggaccggacccgaagctgtcgctggagcctgtcgccgtgcggctcgccgagctgctcggcggcaagcacgaagtcatcctcaccgacgactgcgtcggtgacggcgtgaagaagcaggtgaaggagctcaaggacggccaggtggtcgtcctggagaacctccgcttccacaaggaagaggaggccaacgacgagacgttcgcccgcgagctggcggcgctggcggacgtctatgtcaacgacgccttcggcaccgcccaccgcgcccacgcgtccaccgcgggcatggtgcccttcgtgaaggagaaggcggccggcttcctgatgcggaaggaaatcgagtacctgggcaaggtgctcaagaacccggacaagcccttcgtggccatcctgggtggctcgaaggtgagcgacaaaatcaaggtcatcgagagcctgctgcccaaggtggacgcgctgctcgtcggtggcgccatggcgtacaccttcctgaaggcgcagggcgtcgaggtgggcaagtcccgcgtcgagggcgacaagctgtcgctggccacgcgtctgctggaggctgcgcaccggttcaagacgcagctggtcctgccggtggaccacatcgtgggcaccgagcccacggagaacagccccgccacggagacgccggacaacgcgattccgccggacatgatgggcctggacatcggtcccaagacgcgcgccatcttcgcgcagcacatccgcgatgcgaggacggtggtgtggaacgggcccatgggcctgttcgaggtccccaagttcgccgagggcactcgctccgtcgccgcggccatggccatcaacacgcaggccaccaccgtcatcggcggcggggacagcgcggcggccgtggagcagatgggcttcgcggacaagatgagccatgtgtccactggtggaggggcgtccttggaattcctggaaggacgcgacttgccgggcatcaaggcgctggagacgcggtaggctccgcgtccgacacaccacacacccctgggggacaccatggccaccgcgcgtcgtcggaagatcgttgctggcaactggaagatgaacaagtcggtaccggaggcgctggccctggtgcgcgacctgcgagggcaggtggcttccctgggggacaccgtggaggtggtggtggcgccgccgttcgtggcgctgcagccgctgcatgtcgcgctggaaggcgcgccgctggcgctggcggcgcagaattgtcactgggagtcctcgggcgccttcacgggtgagatttccgcgccgatgctggccgagctggggtgcgcctacgtcatcgtggggcactccgagcgccggcagctcttcggggacacggacgagcaggtgaacaagcgggcgaaggcggtccgcgcggcggggatgacgcccatcatctgcgtgggcgagacactggccgagcgcgaggcgaaccagacgctggcggtggtggagcgtcaggtgcgcggggcgctggagggcttcggggccaaggaggtggcgggtttcgtgctggcctacgagccggtgtgggccattgggacggggcgcaacgccacggcggcgcaggcgcaggaggtccacgcggcgatccgggggctggtcgagcgcctgtatgacggggagacggccgggcgggtgcgcatccagtacggcggcagcgtgaagccggacaacgccgcggaattgctgggccagccggacgttgacggggcgcttgtcgggggcgcgagcctgaaggcgggcgacttcgcggccatcgtcaaggcggccacttagagttgatcctgggggcgggcggaagatgttgtcacccgatcaccactttggtgtagggtgcgcctccttttcacggaacgtctgaaagagtccacatgctgaccttcgtcacgatcgtgcacgtcctggtgtgcgtgttcatgatcttcgtcattctgctccagccgggtaaggacgccggtatgggctccgcgctgggcggtggtgccgccacgagcgccttcggcggccggggtgcggtgacgttcctcagcaagctgaccggcgtcttcgccgcgctcttcttcttcagctcgctcggcctgtccttcgtggggctgcgctcctcggtggcggcgggtggctcggtggcttcgcctccggcgcagtcggccccggcgacctcgggtgacgcggctccgggcagcatggagcagccgcgcggcgagcagtcgactccgcccgccgagggtggtggcaacccggcgacgggtgagccggctccggcgcagtagtcgttcgcggtacgtggttcgtaggaagaatctgattcacgcagcggttgagattgtcgttgcgtgaatcagaaagctccggtagatggacgccgcagcaaacgcccaggtggtggaactggtagacacaccatcttgagggggtggcgccgaaaggtgtgcgggttcgaatcccgccctgggcactccgaatcaggcctccgagtcgaaagactcgggggcctttttcgtttctgaggccaggcttcctggtgtgccgcaccaggttgttgagacaccaggttggtcgtcatcaggccgcttgcttcagcctcagctcccgtcgggcctgactcggcgaaaggaagtcgtggcgctcaagtagccagtgctcgttgtactggtaggcccattccagcagggccagccggagttcctccacggtggcgaaggcgtgcgcccagggtagttgctccttgcgaccgaagcgcgccttgatgccctgccgaatgggctcgagagcctcgaagcggcttcccaccttggcggcgtggatgcctacgcactcggcagtgccatggttgccggcgatgaagacggttgcctgtccttccaaggttgtctccgtgcaggtggcatcggcgcccacatgacatcgggcctgtcggtggtaatcgagccgtcgtggttgtgcggccccagcagccggcgggtgcggcctggtgccagcagccccgcttcgtgcatgagccgcaggccgcgcgccttcgaggtgcgcacgccctgggcacgcagccgagcccacaccttgcggtgcccctcgcccaggaagggcgccgccgccagcacgccgcggatggcctccagcagtgcctcgtccgtcagcgccgtcttggggccgcgccgagctgcaggcgtggccacggtgcgtaggcgggcacggcgccgggacatcgtggcacggggcacgcgccaggtggccgtcatgagcgccagcccctaccgcttgccgctgcaaggcgagaggcaggcgctcatcctctcgacttccttcagggaaaacccggcgcgttgccctccaggagacgggccttctcagcgagcaactcgttcttcatcatcaactcgcccaccatggccttcagctgcagcaccgcatcgtctgtcggctccggctcttgaggttggcctcagcgccggccatgaaattctcccgccattcgctcagcaccaccgcggtgacgcccagttcccgcgacagcgcgtcgagctcctcgcccctgcgcaaccggggcacggcctccttcttccgcctcactgttcctgtcggacttgaggggggcaactccaggggactattccacagcacagcgcgtccggatgaactggaaacgaatgaaccggctcgtcgtgcggtgaagccccctgctcgcattcagccccgtggcccaacgagaggctccacgttagaacccatgccaagcgctcagagcggtagtgccgcgtctgggcgctgggcgggggagcagcagtgtccgtttctaccgcgaccgccccgtgcgcggccggagcaggccgcccaccgccagcagggccgcgactgtggccaccagaaggtgctcagccccgcgcggaccccttcgccgccgcgtccacgccaacttgcactgcaggtgcggagagggcgcctggtccgcgtgtcgtgtcgcagcgaacgtccttcgtccaccagaatacggaatagggtggtcaacatagccggttgacagaaaacgcggtggtggtacaagccgcgcccctcgcaaagaagcccgcgcactggcgcggaaggcacttcgagcgagtcagtacgacaatatggaatacggcagtcaacgcagcgagttgacaggagacgcggtggtggtagaagccgcgccccgacgaagaagcccggaagaaagggcggacgagtcgagggggtcaacgaagcagcggttgacagggagggcggccaagcggtagaagccgcgcccctctggaggaaatcagcggaagccactgggcggcgctgaagactccggaagccagcaggacggcgaaaacagcagcttgacagaagacgccgaactgaaatagaagctgacaccccgccgggcagaaaaaagacggcgaggcagcaacgaagaagatggtagcaagaagtcgctggcaggacaagcgactcgctctttgaaaaccaaatagcaagcccaagaagaagctagattgcggaaaccgcagtcaatttcttaagacggtgccagccaggtcgcgctgcgaagcgcagccggcagcactgtaacgaatcagcgagtttcaggttccttagccgggcctgggactgacgccggttcaaatcttcaaaaattcaattggagagtttgatcctggctcagaacgaacgctggcggcgtgcctaacacatgcaagtcgagcgcgaataggggcaacccttagtagagcggcgcacgggtgcgtaacacgtggataatctgcctgagtgctcgggataaccagtcgaaagattggctaataccggataagcccacggtttcttcgg

SEQ ID NO: 922 - DNA, 7109 bp, Myxococcus xanthus
gtgctctaaagcccgccaccgcggcgtcgatgaagtagcccagcggcttgacgcccagctccttcgccttggcctcactcatcaccaccgcggcggcggcgccgtccgtcagcggcgacgcgttaccagccgtcaccacgcccttggggttgaaggccgggcgcagcttggccaggccctcctgcgtggtctccgggcggaggatggtgtccaccgtgacggtgacgttctgcgccacgccgtcgtcgtcgtagtacgtcgtggtgacggggacgatctcctccttgaacttgccctgctcgcgcgcggtggcggcacggcgctggctctcggcggcgaacttgtccgagtcctcacgcgacacgccgtagcgcgacgcgatgttctccgccgtggcgcccatggaggtgtagatctccggcaggcgctccatggcctcggggttggcgctcgccttgttgccgcccatggggaccatcgtcatggactcggtgccaccaccgatgcccacgtcgtacatccccgcctggatggcctgggccacctgggcgatggcctgcgaaccggaggaacagaaccggttgatggtcatcgcgggcaccgtgacgggcaggcccgccagcagcgtggccacgcgggccacgttcatgccctgctcggcctccggcatggcacagcccaggacgacgtcaccgatgtcctccggcttcaggcccgggacctgggcaacggcctccttgatggcgacagcggccagggtatccggccgggtgtccttgaactctcccttgtgcgcgcgggtgaagggcgtgcggaccgcgctggcaatcacgactcgaccagccattttgatgtctccttgcccggggggcacccgggcattcagcgaatctcaggttcagtagcctatggatactggccggccgtcagttccgcagcggcttgcccttctcgatcatgtgctgcaggcggtcctgggtcttctcctcgccgcacaggctcaggaaggcctccgcctccagctccagcaagcgctcctccgtcacgagcagcgacgggctggtgttgccacccgtcagcaccttcgccagcttctgggcgatcttccggtcgtgcgcgctcacctggccgttgagctccatgtcgtagagcatcatgtcgatggtggccgcgccgctggtgcccggcaggcggaagcgcgtgggacggggcgccttgaagccggcgtccgccatgcccagcacgcgggccttcgcgtcggacagcaggaagtcccggttggcgctgatgccatccgcctgcgtcaggaagcccgcctcgcgggcctcctcggcgctggtggcgaccttcgccatgccgatggtgaggaagatcttcttcaggaaggggaagaagtcgaagtccttgtccgtgccgaaagggccgtacacgttgcgcagcaactgcatgttgccgccgccgcccgggatgaggcccacgcccacttccaccaggcccatgtacagctcggcgctcgcctggatggcgttgccgcccatcgtcacctcggcgccgccgccgagcgtgaggttgaagggcgccgtcaccaccggcaccgggctgtagcgcatgcgctgattgacggcctggaagcccgtcaccagcttgcggatggactcgaactcgccgctcttggccgcccacagcagcgccacgatgttcgcgcccgcggagaagttggagccgtcgttaccgatgacgaggcccttgtggttcttctccgtctcgtccagcgcggtgttcatcatctcgatgatctggtcatcgatggagttcatcttggtgtggaactcgagcagcgtcgcgccgtcgcccaaatcccacagcgtggccccgtcgttgccggcgatcttcttgttgccgcgcttgaggtactccacgcgctgcgtgcgggcgttctccggcaccaccttcacggacttggacgggatgtcccagtacgtgtccttgccgttctccacgccgtagaaggacgcgcggcccgcggccagcatctcctccacccacgcggctggcttcaggcccagggccttcatccgctccacgcccttcttcacgccgtaggcgtcccagacctcgaagggccccaagtcccaaccgaagccccagcgcacgccgcggtccacgttgaccacgtcgtcggcgatctccgggatgcggcggctggtgtaggccagcacgtccagggtgacgccctcggcgaacttcgccgccttgtcctcggcgttcatcaccgaggccacgcgctcgcgcacgtcctcgatgtcccgcgcggcgcccagcgactcgtagcgcaccttcgcctgcggccggtactccagcgtcttcaggtcgagcgcgaggatgtccttgccctgcttcttgtagaagccgccgccgctcttgtcgcccagcatgcccttctccaccatcttctggaggaaggcggggctggcgaacacgtcacgctcttcgtcgtgcgtcagcgtgtcgtaacagttcttcgccacgtgggtgaacgtgtccaggcccacgatgtccgcggtgcggaagacggcggacttgggacggcccatggccgggccgaaaatcttgtccacctcttcgatggatagctccgccttgtccatggcggcgatggtccgcatcatcccgtacacgccaatgcggttcgcgatgaagttggtggtgtccttgccgtagacgatgcccttgcccagcacctcttcgccaaagcggtgcagcgtcttgagcacctccggggcagtctccttgccggccaccagctccagcagcttcatgtagcggacggggttgaagaagtgcgtgaccaggaagttcttcttgaactccgcgccgcggccctcggtcatccccacaatcgacatgccggaggtgttggacgacacgatggtgcccgggcggatgagcttctccaccttggcgaacaggtcctgcttgatcttcaggtcctccttcaccacctccaccacccaatcgcactcggcgatgcggtgcaggtcgtcctcgaagttgcctacctcgatgttggtgaagacctcaccagagacgatggggctcggcttctgcttgcgcaggttggccagcgcgccctgggcgaacttgttgcgaaacgccttcgaggaggtgtcctcgcccggcgcggccttgggcggaacgatgtccaggaggagcgcacgcacgcccgagttggctaggtgcgcggcgatgccgctgcccattactccggcgcccagcacagccactttgcggatccgcgtcgtcatgtggaaaaggctccctgttgggaaggaggggattgcacaaatgtaggcgattgacccgaaagtcaatcggttcggacggccaggacactcgccaccagaggacaagccgactagataccggccctccatggctcgcctcgacccgcactcgtacaacgacagcacgcagcctgagacggaaaccctggactggagggcccgcgtcgatttcaagacgcagcggctgcacgcggaggtcacccacaccctcaaggaagcctcggccgggccgctggacctggatacccgggatttggaaatccgtgacgtcatcgacgccgcgggtcgtcccttgccctacatcctctccccttccgagccgattctcggcagccggctgcgcatcgagctgccggtgggactgcggcaattcaccgtgcgctaccgcacggcgccgcacgccagcgcgctccagtggctgacgccctcccagacggccggggggaagcaccccttcctctacagccagtgccaggccatccacgcccgaagcgtggtgccgctccaggacacgccgcgcatccgcatccgctacaccgcgtcgctgcggattcccaaggcgctcaaggccgtcatggccgccagcttcctgcggcgcgaggagcatggcgtggaggcggaggagcactacgagatgccccagccggtgcctccgtacctgctggccttcgcggtgggcagcctggcgccgaaggagctggggccgcgctcgcgcgtgtgggcggagccggagctgctggaggacgcggcggaggagttctccggcgtggacgacatgctgcgcgccgccgagtcgctcttcgggccctatgactgggagcgcttcgacctgctcaccatgccgccatcgttcccctacggcggcatggagaacccgcgcctgacgttcctcacgcccacgctcatcaccggagacaagagcctggtcaacgtggtggcgcacgagttggcgcactcgtggacgggcaacctggtgacgaacgcctccgcggagcacttctggctcaacgagggcttcaccgtcttcgccgagcgccgcatcctggaggtcctggagggtccggaagtgtcggcgctgcacggcgcgctgggccgccgcgcgctggactccgcgctgcagcacttccgcgcgcacccgcagctgacgtcgctgcgcacccacctggccggcgtggacccggacgaggccttctcccagattccctacgagaagggctacctgctgctgcgcgccatggaggacgcggccgggcggcccgccttcgacgagttcctccgccgctacctggccacctaccgcttccgcgcgctcaccaccgaggagttcgtcgccttcgcggagaaggaactgcccggcgtgctgaccaaggtggacgcggaggcatacctgcaccggcccggcgtgccccccggggcgccgtcaccgcgctccctgcggctggaggccatggacgcgctgcgcggcaaggtgcccacgccggagcaggcgaaggactggacgccggccgagtggcagctctacctggagtcactgccctgggacattccacgggacgtcatccagcaactcgacgcgcgcttcagcctcaccgagagccgcaactcggaggtgctggtggcgtggctggtggtggcgctgcgcgcggactgggagccggccgtggctcgcaccgagacgttcctcggcgaggtgggccggatgaagtacctcaagccgctgtacggggtgctctccgcgtcgcatgcgcaccggagtctggcgcgcgcgctcttcaagaagcacggggagcgctaccaccccatcgcccgtcagggcgtggagctcatcctttcgcgcgcctgaggacgcgcgagcaggacgggactacttcgaggccgccgcgttcaggcgcttctccgacagggcgaggtacttctcgtccatgtcgatgcccacgtaacggtggcccagcttgagggccgccacgcccgaggtgccgctgccgttgaaggggtccagcacgagcgcgtccggggggcagctcgcctccaggatgcgctccagcagcgccaccggcttctgcgtggggtggctgccgaaggccttctcctcgccgccgcgcgggacggtgagcgtccacatccggccctcgccgtccgccgtcagctcggcgtcaccggagggcggcagcgcccaggcgtcgcgcatctgcttgccgccgttctccgccttcatgcgcgcgtagttgaacgtgtgctggagcttgccgccggacttcggcgaggcccagatgagcagctccgtggagtgcgtgaagtagcggcacgccaggttggggctcgcgttgggcttgaaccaggtgacggtgttgagcagcttgtagccgagcttctgcatcgcgaagccggcgttgaagatgacgtgctgcgtgccgctcacccacaacgtgccggtgggcttgagcaggcgctggcaggccgcgagccactcggtggtgaacttgtggtcctcctccacgccgcgcgacacgtcccagccgcccttggccaccgagacgcgcttgccgcccttgcaggtggtgccgccgttggagaggaagtacggcgggtcggcgaaaatcatgtcgaacgtctggggctcgaactgcgacatcagctccaggctgtcgccgtgcagcagcgtataggcctcccctttcgcgtagacgctctcgttgagcgaacggcggacgactttcagggaaggggctgctgcagcatgcgcggacatctcgcctccgtcggactcttcgtcgtggacgcggcggactgtgcggtcgcttcggtgctacgtctaatttctggcctgtagcaccctgaaacttgacgggtgattcaggccgtagaagcgccgcgagcagggcgggagcgcctctcgtggaggccctccgacaccctgctcgacgggtactgcctggactgtggcggggcccctgaaaggcccccgcggcctacgccttcttggcggaggtcggcgacgcgccgtacttcttgcggaagcggtcgatgcggccggccgtgtccacgagcttgtacttgcccgtgaagaaggggtggcagttcgagcagatttccaccgagaacgagccgcgggtggacttcgtctccacgacgttgccgcacatgcaggtcacgcgggacggcgggtagacgggatggatttcaggcttcatgacacgctccagtatgccttgcccccacccgctgacgggtaggaggtccggcgctgagggatggtcggcgcttataatggcgcttggaccgcttcacaaggccagcacggctcaatgggccgccgagccggggggctcgacgcgttccacccatttctggacgaccggatccgccgggacgtcactgccaagctggatgtacgacaacagatgcgtgcgcccggcgtccgttgcgccgccggccagcgccttctggtaggccgcccgcgaggcttccaggcgagcaatcgtcgcctccaggggctgcttctccgccgggtcctgggtccccgcgagccgcgccttcgcccgggtgaggttgccttcgagcaggcgcagctgctgccgcgtgcgctcctgcacggaggcgtcggcaaagcggcccgtcccctccaactggagcagcagcttcgccagctcgcggcccctggcaccggaaggaatcaccgtggccagggcctgccgctgggcgatgccctgcccccggccctcgtgggactgcaccacgaagtccacgccctccacctcttgagag

SEQ ID NO: 923 - DNA, 7732 bp, Myxococcus xanthus
gcgctcaagtcaggccgcgtgaggtcgggcgaccgggcctcgagcgtcagaaggccaaaggtgctcacagaggccaggcccagcacgggcaacaaccaccggcgccagcgggacggcttcggcgcggggcccgcggcggcgcggcgagcggcctgctgggcataggccatcagcgactccagccccgcgtccggagcgggctccaccgacagctgggacatggtggcgcgcaccccgcgaatgtcgtccagggcctgggtgcagcgggcgcagctctccaggtgggcttccacgaggcgggcctcgggcaccggcagttcgccataggcgaagtcgagcagccggtcctcctgcgcatgcggattctgcggcttcatcccaccaccgtccttccgtcctcggcgaggtcgccgtcgacgcccatctccgccagccggcggcgaagcccgtcgagcgcgtagcgcatgcggctcttcaccgtgttctcggacactcccgtcacctccgcgatgtccttgaaggggatgccgctgtactcgcgcagggtgaagacctcacgctgctcgtctgggagcgtcgccagggctcgctccaacaggggacgcaaccgggcgttgtaggcgccgcgctccgggctggcccccgcgtccggcaggccttcccccagggggcgcgactcgtcccgctccgctcccggggcgggtgcctccagggaagacgcctggcggtagctctctttgcgcgcgctgtccacgcagaggttcctcgcaatcgtgtagagccaggtcgtgaacttcgccttgggcgtgtagtcgccggcgctccgaaccaccttcagccacgtctcctgcagcacgtcctccgcccgtgcccggtgccccgtgaagcgaaggatgaagttgaacaccggcgtccggtgcttgcgcaccagcgcctcgaacgcgcgcgcgtcccccgcctggaaggcgagcatcagccgctcgtctgaggtttccggtcccaacactcccccaactctccttggagccaccctcacccggcccactccgccacccgtgcacagtgaacgtgcgacgggccgccagggtctatccccggcgaggtctctggtaagtggcgagaatgacagggacggccaccgctgtcacgagcgcgccttgcgccaggagcaccgccggcagtggctgctgcaggtgcacgtacagggagcggccgagcgccgcccccagcagcacgcccgtcagggtgcgcaccgcgttgcttcccgacgccggccggaagcggcccaccgcccagtccgccagcgcgggaacggtgagcgccaggacggcgggcacgtccagcgcccacctcagcggggcacgcacggcgaacaggcccaccatcacggccagcagcaccggataggtccccaggcagcgcgcgcacacgcgcacgccgccgaacaggtaggtgcggttgtactcatccggatgatgatggctgagccagaacaccgggacttcctccagaaggggctgcggccggggcctcgcgcgcatcggcctccgccaggaaacacgcggcgaagtggccaccgcccagcgcataggacgggggcgactcgcgccggcaccgctccatggcatgcggacagcgcggatggaaggtgcaaccggggggcggagccaggggtgatggcggctcgcccggcaccaacaggcgcgtccgggcgtggtccgggtccgggacgggcaccgcggacaacaacgcctgggtgtacgggtggcgcggctgacggtacagcgacgcggccggggccagctccacgatgcggcccaggtacatgacggccacccgggtggacacgtactcgacgatgttcaggtcgtgggcgatgaagacgtaggtgaggccccgcgcctgttgcaggtccaccaggaggttgacgatttgcgcctgcacggacacgtccagcgcgctgatgggctcgtcggccaccaccaggtcgggccgcagcgccagcgctcgcgcgatgccaatgcgctgccgctgcccgccggagaactcatgggggtaacgcgccagggcctcgcgcggcagccccatggcgtccaccaactccgccacctcgcgctcccgctcccccggccctcgggccagcccgtggatggcgaagggctcctccagaatctcccggaccgtcatccggggattgagcgaggcatacgggtcctggaagacgaactgcatccgctggcgcagcggccgcaactggcgctgggacagtccggtgagttcctgtccgtcgaaacgaacggagcccgccgtgggctccaccagccgcagcaccgcgcgccccagggtgctcttcccgcagccactctcccccaccagccccagcgtctcaccgcgcatgacgtcgaaacccacgccgtccacggccttcaccgcgccgcgcacccggccgagcacgccgcctcgcaccgggaagtgcacctggaggtcgcggacctggagcagcggcgtggagttcacggcgcgggcaccgggttgtgacaggccgcccactgcccttctcgcggcgaggtcagcgcgggcttcacgtgcgcacagacgtccagcgcgcgctcacagcgctcccggaaggcacagccgacaggcaactgccgcagcggtggcaccctgccgggaatggcccgcagccgcgcccgggaggctcgagcgccacccacgtcgcgcctggacggaatcgagcgcagcaggcccgcggtgtacgggtgcgcgggctgggaaaacagcgctcgcaccggggcgcgctccaccacccggcccgcgtacatcaccaccaccgcgtcgcagctctccgccaccacgcccaggtcatgcgtaatcagcagcaccgccatgccccgctcggcctgaagccgcgcgagcaggtccagaatctgcgcctggatggtgacgtccagcgcggtggtgggctcgtccgcgatgagcaaggccggatcacacgccagcgccatcgccatcatcacccgctgccgcatgcctccggagagctggtgtggatacgcgtccacgcgctcggccggcgcggggatgcccacctgccgcagcatctccacggccttgtcccgggcctgcgcgcgcgaagcgcccaggtgcagccggacgccctcggcaatctgctcccccacggtgaacaccgggtttagcgacgtcatcggctcctggaagatcatcgccgcgtgacggccgcgcacccggcgcagctcggcctccggcagcgtcagcaagtcccggccctggaagcgcacctctccgcccaccacgcgcaccggcggctcgggcgccagccgcagcagggacagcgccgtgaggctcttgccacacccgctctcccccaccacgcccagcgttccacctgggggcagcgcgaaggacacgtcgtccaccgcgcgcaccggcccttcctccagcgccagctccgtggtcagccctcggacgtcgagcaacagctcctggcccgcgggcgtcacggcggcggtcacttctgggccagctcctccaggaactccccttcctggatgacgcccttgcggatgagcaggcggatgaggctggccaccatgcgggccggcttcaccttctccgtgtccagcgaggcatcctcgccgcgggagatgcgctcgatgtcgtccaggatggccaggtcctcgtcggagaactgaggcgtgggcgtgagcggcaccgacggacgcgagccctgcgccgcccctccgaacatcaccaccggcacgcgcggccggccctccgcgccgtctccctccgcgtcgggaggcggaggcggcgggggccgcaccgggggcgaggccttccggcccaacaggtcatccagcgcgtccgcgccggcgtcgccgtcggtggcttccgggggcggaggcgggggcgaagccgagcctcggagcgaggggggacgggcagcggggggcggagaaggcggtacggacttgggcacgggcttcggagcctccgggaaatcccattcgagcggcgcgccagcggccacgggcggaggcggagcaccgtcctcgtcctccagggccacggcttccacgatgtccagcggctcgccccgagcccgcgccagcgcggcgtccaggtcgtccgaagccgccacgaagacgcgcatctgcttgcggagctggaagcgcagctcgtccacgagcgtcacgtccgccgggtcatccaccgcgacgaggatgcgctcgctgcggccttccacttccatccggaacggcaggatgcggtgctcggactggaagtccacggacaccaaacccgcgacgttcgccggaatctcctccggcagcgccacgaagggaagcgcgtgctgggcggacagggcctgcgcgatgtgcgtgggcgtgcacagcccctgcgccaccagcacctcacccaggcgatgactgccgaatgcgccccgacgtcccaatgccacgcggacctgctcctccgtcacgacgccggcctcgacgagcagctcaccaatcttcttgcgcatgggggactaccgcttgaccttcgcgagatactcctcgcgggtgaacacgcccttctcgatgagcaactccaccatcgccttgagggcggcgacttccttgcgctgcacttcttccacgttgcgaagcagctccgccgggctgccagaggccgccgcgggacgggcggcgggagcctcggacgcaggggcgggacgggccgaggccggagcgccgcgcggcgaggtcgccgcggccgccgggtccaggtccttgaggttcttcaccaccgtgcggccctgggcgtccaccaccttgaagttggtgtccgcgtcctccaactcgtggttctgctcgtagatgcgcgcgaaggcccgggcaatggaggtccggcccgccacgttggggatgatgcggcacttggtgatggcgcgcagttcgtccagcatgcgcacgttgagcggatccgacatcgccaccaccagcgacttgccgtcatcccgcacctgcagcggcagcacggagaagtcccgcgccgtctgggccggaatcttcgccttcacgtgcggctgcaccatctgcaccgcatccaggttcaccgccggcattcccagttgcttggacagggcgcgcaccaggatgtcctcggagacgaggctcatcctgaccaggatttcgcccagcttgccgccccacttcgcctgttcggcgagcgcggccttcagctggctctcctgaagcacgttcgccttgatcagcaattcaccaagcttgatctgtgccatgtcgtggcgcgcactctagactgtctcggcagcgtgcgccccttcttccgcgcctgcttggtcaggaacccggtgccaggggcgcggacgacccggaggcgggcgccccggcgggcagctcccggccggcctcatccacctccaccacccgggctccctcgggggggaccaactcgtagagtgtgaggtccggtcgcgcgttgagtttgatctgctggtagcggacctggagcttcgtcttcgcctgcttcgcctccagtgacacccggcccgggaagatgagcccgccctgctccaggaagtcctcgaagcccaggtcgtaccccgggatgccccgcacctgactcttcatgatgcgcaggtacttggtgtggacgtcgagaacctgcgtcgcctggccccggtggagcgtcagcacgtagacgcccttcttgcggtccagctccagcgtcatccgctccggcgggatgagcggcacctgcccgagcatgatgggcaccagctcctcgcccggcagcatgaccggcaggaagcgggacacgttggcggggctggcggggccctggtaccaggtgttcgtatccgcctgatacagcccgaagcgctgtccgtcggacaccagggaggcgagcggcctgttgaagaagtcgaacgtctccaggtgcagcatggccggccgggtgacggcgatgaacatgctcagcgtgccgctctggtcgggcagctcggcgcgcagcttcgcgtccccctccagcgtgacgacgttctcctggttcttcacgacgcgctgatagacggtgtccgcatccgtgagctcgccctcagggccgaactcgattcgcttgggacagccagaacagagcactaccaggaagattgcgacggctgcgcggttcatatggcctagtctgggccaagccgccctgcccggtcacccaccaatgagcctgaacgacatcctccattacctccgcctgggtggcgtcaccctcgccatgctcatcttcgcctcggtcgcggcgttgattgtcgccgtcgagcgcatcatcgtgctctggggcgtgggcgagcgttcacgcgccttgggtgagacagtgaacaaacacctgctgcgcggggacgtcgccgcggcccgcaccgccgccgagcgctccgacgcggtggccgccgacatcttcctggccgggttcgaccggatggagcgcagccgcaccgccgggggcgctggcatcgaggcggcggtggaacgcgagcgcgcccaggtggccctcaagctgcgccgctacctgtggatcctggccaccatcggctcgattacgcccttcgtgggcctcttcggcaccgtcgccggcatcatgcgctccttcaaggacctgggcctggacgtggaagcgggcggcaccggcggcagctcggcggtgatgacgggcatctccgaggccctggtcgccaccgcggtgggcatcctggtcgccgtgcaggcgatggtcttctacaactacttccaggcccgcctgtcccgcgtgctggtggagctgcgcctgattggcgacgagttcgtcgagctgctcaaggagcgggccgccggcctgccgccgtccgagcccatgcctcccgagccgcaggccgcccccgccacgcgcacggacgcacagcccgcctaggccggaggagaacgcaccatgggcatgggaaagactccgggcagcgacgacggctccgaggacggcgtcttcgctgaaatcaacatcaccccgctcaccgacatcttcctggtgctgctcatcatcttcatggtgaccagctccgtcatcgtgcagcagggaccgggcggcggcgccaaggccggcctcaaggtgaacctgcccaagggcggcgccgcggacgtcaccgcgcgcaccacggacctgtcggtggcggtgctcgcggacgggcgcttcatgctggccggcaacgtcgtctcccaggacgagctgcagcaggccttcgatgacgccaggcagaaggacgaagagacggtggtcatcgtccaggccgacgagggcgtgccccacggcaccgtggtgcaggtgatggagctggccaagaaggccgggctcgcccagctcgccatcggcgtgcgcgaaggcgaataggcaacacctccccgctgggaacacgaaggccacccagggcagcgcgcccgggtggccttgatgcttcaggcgccccgcctttcagcggggcgcgggctcagacggacgcgaaggcggcgtccgagatgtccatgggcgaggtgtcctcgatggtgagcatcttcgccgcctgctccacgttgggcagcacgttccgcgcgtaccagagggcgctgtacttcttgccctcgtagaaggcgtggtccgggtggtccgcggagacggagcccttcgccttctccgcgatgac

SEQ ID NO: 924 - DNA, 7295 bp, Myxococcus xanthus
gaagcgtttacgtcccgtggtcatgcagggccagcttgagggccacggtgtgcgtgcccgtgatgtgccgggcccggtagacggcgccgtaggtacctcggcctcgcaggtccatgaggcgccacgggcccacccgggttccgggtggaagtcgggccggattcaggaaagggagccccatgcatgcagaggctacttcctgagtagtcagtttgcaccggaatctgtcaggtcaatgtggctcgctgggaagaaatctggaaggcgcagcgcgcgaaaagcgacgcaacccgtggccgcggggcggcggttgccgcgcgcctcacttgccatcaccttgacgcaatgtgccgatgccgggtggagtgtcggcctggtctccttccgggggagggcgtgttcatggcgagtgtggtgcctgcttacgcggagtggtccaatctggagcgccgaatccgggcgctcgttcccgaggcgttcgacccgacgggccgagtgctcaacctcatcgcgggtgaatgggggcatcccggaaaggggaagccctacctgtccccggttgacggcaccgtcctgggccgcctgcccatgattgatgcgaacaccgcgcgcgtcgccgcgagcgccgccgccgcggaggcacggacctgggcccaccaggacctcgatgcgcgcaaggagcgcgtcacccagtgcctgtccctgctgcgtgagcagcgcgagctgttggctctcatcctggcctgggagattggcaagccggtgccacaggctcgcgtcagcgtggaccgctgtatctctggcgtggagtggtacgtctcccaaatcgagcccatggtggagggccgccgtccgctggggctcatctccaacatcgcttcatggaactacccactgtcggtgctggtccacgcggtgctggtccaggtgctcgcgggcaacagcgccatcgccaagacgcccacggatggtggtctctactcgctgacgctctgcatggggctcgcgcgccgctgcgggctgcctgtgtcgctcatcagtggctcgggcggacagctcagcgacgcgctggtgcgcaatccggagatcgcctgcctgtccttcgtgggcggcaaggcgaacgggcgggacatcgccgccagcctctatgaccgcaacaagcgctacatgctggagatggaaggggtgaatgcctacggcatctggcacttcagcgactgggacgggctggcgaagcagctcaagaagggcttcgagtacggcaagcagcgctgcaccgcgtacccgcgcttcgtcgtggagcggagcctgatgccgcgcttcctggagacgtacctgcccgtcgtctccgccctgaaggtggggcacccgctgctggcggagtcaccggatggcgagcctcccgcgctcgacttcggcccgctcatcaacagccagaaggtcgaggagcttcacggccatatgagtgaggcagagggccgcggcgccgtgcccctcttcgccgggcggctggacgcggagcgcttcctgccggaccaggacgtctccgcgtacctggccccgcacgcgctgctgcacgtgccgcgcaactgcaagctctaccacggcgagcccttcggccccgtggacacgctggtcgtcgtggacagcgaggaggagctcatcgcggagatgaacgtgtccaacggctcgctggtcgcctccatcgcctgcgacgagcccgacacgtgcaagcgcgtctccaccgagctgcgggccttcaaggtcggccacaacgggccgcgctcgcgcggagaccgggacgaggtcttcggcggcatcggtggttcgtggaaggggtgcttcgtgggcggcaagtacctggtccaggccgtcaccgagggcgaacccggcgagcggctgcacggcaacttccacgactacacgcagctccccgacacgcgctgaagcgggctcatcgtctgctcgggcgtctggcgccgcgcacctcggccgcgaacagttccgcggcgggcgtgcgcggcgcgccttttcgccacaggagcgccgcaagttcggcccggggcgcaggggagagccgcttcaccgccagccccgcggcgtccgcgagttgaggctccgggagcaccgtcaccgcgagccccgcgcgaacggtggccagcaccgtggccacggcgttcgactccaacgcgacatgcggcgcaatccggatggcggcgaaccaggcatccacgcgggctcgcacgcgcaaccctcgggagagcagcgcgaagggctcctgggccaggggcttcgcgcccacggtctccagcttcgccaggggatgtcccttggcgaccaccagcgccagcttgctgtcgaagacgggctccgcctccaggtccggtgagcgcgcgggggcgtagcccaaccccacgtccagacggccatccgccagccgccgctccacccgccgcaccacggcttcctccgcgctcagcaccaagcccgagtgccttcgcagcacggcggcgagcgcgggcagcacgacgcctcgcatgctgggcgggtagcccacgcgcagggcgccggtggtgaggcctcgcagcgcgcccacggcgaccctgcccgcgtccacgtcctccagcgctcgtgatgcgtaggtgcggaacagctcgcccgcctgcgtcaggcgcacgccgctccgggcgcgctcgaagaggggcgcgccgagctcctcctcgagctggcgaatctgctgcgacagcgtgggctgtgagacgtggacgcgcctggcggcccgcccgaagtgcagggtgtccgcgacggcggagaagtagcggaggtggcgcagttccatggcgtcatcataggcattgcctatcgaagccatgggaacaaacgaatgtaccaatcatggcccgcgcgtaagtgttctcccatcgcgaggtcgtgaaggaggcacccgatgaaggcggcagacctgttcgtcaaagcgttggaagcggagggcgtgcgcagcgtcttcgggcttccgggagaggagaacctggacgtcatcgaggccatgcgggccgcgggcatgcggctggtgctcacccgtcatgagcaggccgcgggcttcatggcggccacgtatgggcggctcaccggccgcgcgggcgtcgttctgtcgacgctggggcccggggcgaccaacctcgtcacggccgccgcctacgcacagcttggcgccatgcccatggtgatggtcaccgggcagaagcccatccgggccggcaagcagggccacttccagattgtcgacgtggtggggatgatgcgccccctgacgaagctgacgcgcacgctcgtgtcggcggagcatgtcccttcggccgtgcgtgaggcgttccgccgcgccgaggaggagcgccccggcgcgacgcacctggagctcccggaggacgtggcccgggagtcgaccgacgccgtgctgctggcgcccagcgcccatcgccggcccgtggcggatgaggcgtccatcgcgctggccgtggaggcgattgcttccgctcgccggcccttgctcatgattggcgcgggcgccaaccgcaagctcacgtcggagatgctgcgcgtcttcgtggacaagacgggcattcccttcttcagcacgcagatgggcaagggcgtcgtggacgagtcgcatcccctgtggctgggcacggcggcgctgtcggaaggggacttcgtccaccgcgccatcgaggcctcggactgcatcatcaacgtgggccacgacgtcatcgagaagccgccgttcttcatgcgcgacagccgccgcacggtggtgcatctcaacttctcttcggcggcggtggaccccgtgtacttcccgcaactggaggtgacgggcgacatcgcgaacgcggtgtggcgcatcggtgaagggctggggcctcgcgcgcactgggacttcgtgcccttcgagaagttccgcgcaggactcgaggcgcagctcgcgcacggaggggatgacgaccgcttccccatctaccccgcgcggctcgtcgccgagctacggcgcgcgctgccggacgacggcatcgtgtgcctggacaacggcatgtacaagctgtggttcgctcgctactaccgcacgcgccggcccaacacgctgctgctcgacaacgcgctggcgacgatgggggcagggctgccttcggccatcgcggcgaagctggtgcatccccgccggaaggtggtggcggtctgcggagacggcgggttcatgatgaactcgcaggagctggagacggccgttcggctgggcctggacctgacggtggtcgtcgtgcgcgacgacggctacgggatgattcgctggaagcagggggagatgggcctgccggacttcggcatggcgctggggaacccggacttcgttcgctacgcggaggcatatggggcccatggccaccggccgaccagcgcgacggagttcggcgcgacgctggctcgctgcctggcgtcgagcggcgtccatgtcatcgacgtgcccatcgactactcggacaacgcacgggcgctcggcgcgggcgcggaggaactcgccgcgctctgagggggaacggcggttcatgaacactggaggaacaccatgctggctgaacgttatccgtactacctggccaaccggccccggcagcccaacgcggagctggccgtcacccacaagtactcgggcgaggtcgtgacgcacgtcgcggtcgcggacgccgcggctgtcgaggaagccatcgccgccgccgtgcgcgccgccgagcccatgcggaagctggcgccgtacgcgcggcaggcggtgctcgaacactgcgtgcgccgcttccgcgaacgcgcggaggagctggccctggcgctctgcatcgaagcaggcaagccgctgcgcgacgcgcgaggagaggtggaccggctcatcgacaccttcaaggccgccgccgaggaggccgtgcgcggcgggggcgaggtgctgaacctggaggtgtcgaagcgcgccgcgggctaccggggtttcacccagcgcgtgccggtggggccgtgctcgttcatcaccccgttcaacttcccgctcaacctggtggcgcacaaggtggcgccggccatcgccgcgggctgcccgttcatcctcaagccttcggaccgcacgccggtgagcgcgctcatcatggcggagatcctggcggagacggagctgcccgagggggcattctccgtgctgcccgtgcggctggaggacatcgggccgctcatcgaggacgaccggctgaagctgctctcgttcacgggctcggagaaggtgggctgggagctgaaggcgcgggcgggccggaagaaggtggtgctggagctgggcggcaacgcggcgtgcgtggtggacgaggcgccgggcgcgccgctggacttcatcgcggaccgggtggcgcagggggccttcttccaggcagggcagagctgcatctcggtgcagcgcgtgctggtccatgcgtcgctgtacgacgcgctccgggagaagctcgtcgaacgggcgaaggctttgcggccgggtcatccgtcggacgaggccacgacgctggggcccatgattgacgagcccgcggcgcggcgcctggagggctggattcagcaagccgtacagcgtggagcgcgggtcctcgcgggtggcggacggcggggctcggtgctcgatgccacggtgttggagggggttccagaggatgcatcgctgagcagcgaggaggccttcggtccggtcgtcctgctccagccctttgacagcttcgacgaggctctggcccaggtgaacagcgggcgcttcggactccaggcgggcctcttcacgcaggacctgtcgcgggcgatgaaggcgtgggacgaactggaggtgggcggagtcgtcgtgggcgatgtgccgagcttccgcgtcgacaccatgccctacgggggcgtgaagggctcaggcatcggccgcgagggcgtgaagtacgccatcgaggacatgacggagcttcggctgctggtgctgcgtcaggcgtgagcgctcggagacgctcccttcaaaaggggacgaagcagtcgcgtgcgaaggggcatgcacccacttcagtgagatgagtcgacgggccaaggaccccgcggagaccgcggggccacgggcgccacgtcgagtttcagactcggtgacgaccttacgtgcagccttcttcggagcgctgcttcgtgaagtagaaaccacccacggggggaacgtcttccccgcgcgcgctcagcttcgaggcgtgagcagcaccgagcccgaagcaggcattgccacctcgagccgcgtcccctcggagcggatggggatatctcgttcgcccagcaggtccttcagggacgtatgcttggccaagcttgcgtaggcctggggagggacaggcgcagcgtcctggcgggcccgaagttcagcacgacgagcgcgggctcgctcgctccgtcctgatggcgcaacgcggcgccgcctccggattcttccttcgcgttgacctgtggcggcgggacggctgctggcgatatgagacactgcgtcagttaccgcacccatggacgagaagcgctaccccatcccggccgggctccaccgggtggagcaggacatccagaagagccgcttcatcaccacggccgcccatgcgcccaccgtggaagaggcgaaggccttcatcgcccgcgtccgcgaggagttcgccgacgccacccacaactgctgggccttcgtcgtcgggcctccgggctccaccgcccaggtgggcatgagcgacgacggcgaaccccatggaacggccggccggcccatgctcaccgccctgctccacgggggcgtgggcgacgtggccatggtcgtcacccggtatttcggcgggacgctgctcgggaagggcgggctggtgcgcgcctataccgctggcgtccagcaggcgctcgaaagcctccccaccacggagcgtgtgcgcaagacgcgactggccgtcgaggtggagtacacccacgtcgatgggttgcgccgcctgctgccgtcctacgaggtgcaggtcctggcggaggagtattcggccaccgtgggataccggctggagctgcccgtcacccaagtggaggccctgcggaccgcgttgaacgacctgaccttgggacaggtgctcgtcgagccgctcgattcggacgattgaccctgggccacggaggggagagcctgcggcccgatgagcgctggacccgacctcttctccgcctctgtc

SEQ ID NO: 925 - DNA, 8207 bp, Myxococcus xanthus
aacaccgggagccggaatgacgccgaccagtgggacatcgtccatgtcgatacgggcgaccgcgtgacgctgacgatggccagcttctggtccaacaaggtgttcgcgtgggtggacaagcgccggcccatctgggagtcccaggggggcatgccgccgtgcggcgcgagttgccgctgaagcgtccagggagccagtctgccggttgatgctcgagctccagtggctccaggttcaccagttccgcacggtgaagtccgggacgcggttgctggtcagcccgtccctcaacccagggccaatacgaaactggcccacgcccgcgccgtcgtcatcgcggatgtctgcggcgcgagggtgggagctcgggccgcggggcttgctcggcgctgggagacacgcttcccgggaccgccgtctggaatgtgcggtcccgagaaggtgggcagcggccccctccggtggggagggggccgcctacggcatcatcagtgcggctctccaatcatgaggccgcggtccgacgtcggcagggtgtagtcatacccgtagatgtgctgccggtacgtgtggagcgaggtgatgctccagttcgtacaggtcagccccatatccgtgtacccggagcggcacgcggagtggcagctcgttccgtcatcgcggtcgcccgttttgcactggctatgccaccacgtgggcaccgtgaaggaccagtgggcggcgttcatgcggcaactggggccggagcgggtcgggtgggtgctgacgccatcgtacccccacacgaagttgccaatgcggtcggccaccatccagggctctgcgtcggtgtcgaggctcaccaggttcagccagctatccaggtgcgtgccggtcgagttgttgcggtactcctcccagggcaggcagttgtcccccacgccgctcccgccttgcttgtagtgggcggcatgcgagttcttcccgacgtaaacgacggggtgcgtgccgtcctccacctggaagcctccgcggctggcgagccgcgtgtagcgcttcccgtgcatggagaaggtgacggccgcgatggtggacttgtcctcgctcaaggtcaccgtgacgtcttcccagtcgccgtggtgggtgccgcggccgtattcgtcgcacgcggactgatagccgtagaaccaccagtacttgatgcgcacctgctggccgcactcgatgagttggtagtaggtgggaatcgtgcccgtccccagcgtggaggcgtccgtgttctggatgatgccctgctgcgggttcacgaccgccgcgtcgtagaagacctgggccgacatggggtagccgcgcgcggacccatcaaagcgcagtcgaggcgcgaacttcgattggaggggctcgcagatgtacaacgggttgtccgtgccctgggctcccgacacctgcgtgggggcaaacccgcgagggcaggacacggcgcttgtcgtggggttcggcgcctggacgccattgacatggccccacatccccgcgaacgcatacggcgagcgttgtccggggacatgggggcggtagcacgcgtggaggtcgtagtcctgtccgtgggtcccgagcaccttctgggattggaaccccgccggacacgcttgcgcgttcgtatacgggttgttcacggcgttgtggttgacgtagccccagagaccgccgaagtcgagcgccggctcggtgtctccccagttgggccgcgtgcagacggagagcggccagtcaaccgagtccgtgcccgacacctgcgtctggacatggccgtccggacacgtcgccgtgcccgtcacggggttggggaccgtctcccctccattgatggagccgatgaagccgccgaagtcccagccgggcgcgtgggccatgcagaagtagagcgggtggtcgacgttggaggtgccgagcacctgggtcttctcgaagccgctcgggcactccgtggtggccgtcgcggggtttgggaccggggcggcctggaccgttccatacatgccgccaaaccgcgccatctccggtgtgttcgcggcatgtggccggtagcagacgtgcagttcatgatcgagccggttcgtgccgagcaggcgctggtcggcgtagccggccgggcagttggcgctgtttgtgattgggttcctcaccagggtgttgttgacatagccccacatgccaccaaagtcgtagagcggagcccctccctccagggacggcctatgacagaagtgtacgctccagtcgcgcccatgggtgccatacgcctgtgtcttggtatagccctccgggcaggaggcggcgccggtcgccgggttcggtgagagcgtgccgttattgaagaagccaaaggctccgccgaagtccaggctcttggccggcagttcgcagaagtacactgggtggtcgatgtgcgcggtccccagtatctgccttgggatgaagcccgtggggcatgaggtggtgctcgtcgtggggttcgacgccggagcgtcgttgacgtggccccacatgccgccaaatggatacggaggcactgtcccgggcgcgtggtgccggtagcacagatggagctccgagtcctgtcctgctgtcccgagtattttcagcgcggcgaacccagccgggcaggacctctcattcgtgtatgggttgttcacccaggagccgttgacgatgccccacattccgccgaagtcgagcgcgggctcagcgttgtcccagctcggccgggagcagaggaagagcggggcgtccatggtgctggagccctgtacctgggtctggacatatccgtccgggcaggacgtggcgcccgtcgctgggtttgaaacagggctgccaccattgagatagccaaagactccaccgaagtcccacttcggcgcgcgcgtcatgcagtagtacacgggatggtccacgccctgggtccccagtacctgcgtctccaccgcgccaggcggacatgccgtcgtgcccgtcgcggggttggccacggggagctgattgacatggccatggatgccgccgaaacggttctcgggaatccgccccgggacatgcggccggtaacacagatgcagcccgtaatcctggttgtacgtgccgagcagttgctgcgctgtatagccagccggacaccgggccgcctgagtgatggggttgacgaccggttgcgcgttgacatacccccacatgccgccgaagtcgtagaggggcgggctcccctcgcgtgagggccgctgacagatgtggacatcccagtcgcgcccccaggtcccaaggacctgcgtctgggtatagccgtccgggcaggaggcggcgccggtcgccggattcggtgagagcgtgccgttgttgaggcggccgaaggctccgccgaaatccaagacatccgaacgcggctcgcagaggtgcagcgccgcgtcgacaccggatgtgccaaacacctgcttcggagtgaatcccttgggacatgacgcggtggccgtcacggggttcggcacctggctgccctcgacgtgaccccacatgccgccaaacgggagcgtcgggcccgttccggggacatggggccggtagcaggcgtggaggttgtgatcttgccccatcgtcccgaggaccgtctgggccgtgaaccccgccggacagttttgcgcattcgtatacggatttttcacggcggtgtcgttgacgaagccccacagtccgccgaagtcgagctccggctcggtgccgtcccaattggggcgggcgcagaggtggagcggttggtcgacggcgcccgtgcccagcacttgcgtccgcgaatatccgtccggacagttctccgtgtccgtcacggggttcaggacaggctcaccgccgttgcgtgtgccgatgaatccgccgaagtcccaatgggacgctcgggccatgcagaaatagagtgggtagtcgacgttgtgggtgccgagcacctgcgtctgctcaaagccctccgggcatgacgccgcaccggtcgcggggttctgcgtggccgcggcgttgacaaacccatgtgcgccgccgaagcggtaccctgagagcactcccgggacatgcggccggtaacacagatgcagcccgtaatcctggttgtacgtgccgagcagttgctgcgctgtatagccatccggacaccgggtcgcctgggtgatggggttgacggccggttgcgcgttgacatccccccacatgccgccgaagtcgtagaggggcgggcttccctcttgtgagggccgctgacagatgtggacatcccagtcgcgcccccaggtcccaaggacctgcgtctgggtataaccctccgggcaggaggcggcgccggtcgccggattcggtgagagcgtgccgttgttgaggcggccaaaggctccgccgaaatccagccctcgtggcacctctagcgccgcccaactctggctcacggcctcgtccgaggtcgctggctcgtctgaggtggctggctcgacagcgcacgcggcgaacagccccagggtggccacccagcccagcgtccactgcctgcggggattggccgcgacacgtgtttgtgacagggcgcgcgcgctcgtgggcggatgtattgatgcttgtgtttcgtgagggattcgcaggtcgacttcgctcatgtgctttcttcgtcgctccagtagcgcggtgtcagttcgtgatggactgagtgtggaattgctgctctatcgtttttattcgacttggctggattttggtggcttttcggtgtggacatcccgaggtcggagcggactcagtcactcggtcttttccagaaaggtgttcgcgtgggtgggcgagcgccgggcccacctggggttcccaggggatgtgtcaccgtgcggcgcgagttgacgctgaatcgccccgggcgtcagtctcccgactgatgctcaagctccagtggctccaggttcaccagttccgctccgtgaagcccgggacgcggttgctcttcagcccgtccctcaacgtgctgctcggagagaacggcaccggaaagtccacgctgctggacctcgccgccgccgtggtcagctcggacttcacgccgctgcggcatgaggccttcgacctcgaatatgcactggccgcggacaccggccgcatcaccgtgcgcgtgcgcaacgtgccctcgggcgcggaaggcacgagcggcctgtccatggacatcaccgtggccccgcgcgacatggcctggccgctggtcatccaccgcgagggccagcagctccgcgtctctcgcgaggacgacaccaccgacgtcgtgcatgagcgcattgcccccgaagtcggtggccggctctggctcgtcttgatgacgggcggcatcgcctgggtggagaagacgggcgagggcaccgcttccgtcgagccgatgctcgccatggcgcgcgaggtctccgcgcaggccgacctccaccgcttcgacgaggggctcgcccacttcgaccagctctggcgcgccgagctgcggctctcccgtcgaacggagggcgtgctcgccacgggcacgggcgtggcctcggaggacctgctcgacggcctgcgcaaggtcgccgccgcgcagtggggcgcctcccgctacgtgctgtcgtcggagaacgtccccttcctccgtgacgccgcccggctcctcggcttcgcgtccgcggaggcgctcctgtccccgctggagacccaaccccagggcaaatacgaaacgctgtccctgggaaacctggacctctgcttcgtcaccgccgccggccagcgcctctccgcccgtcagctcggctacggacagaagcgcctggtggccttcctccactacctggcccacgcccgcgccgtcgtcatcgcggatgaggtcgcgcacgccttccacccccggcaggtccgcgccatcctcgaacagctcgaaccccggcaggccctgctcaccagccagagcccggagctgctcgacagcctcaccttcgactcgcccgagcaggtgcgctccaccttcgtgcgctgccgccgcgaggaggacaccggccgccttgtctgggagaacctgtcccctgaagccgctggggacttcttcaccgcctggcgcgccgagccccgccgcgtgggcgagctgcttcaagccaaggggctctggtagccagtcgcgtgggccccgcgggcagcgggacgtcatccggccaacggctccgcgaaggggggacccgtccgtgcgtgtcgctcgcctatcctcgccagccggggagggtgccgcgcatgccgatgctgaccgtcaacagaacggacctgtactacgaggactcgggtggaacgggcgtgcccgtcgtcttcagccacggcttgctgtggagctgtcgcctcttcgatccgcaggtggaagcgctgtgcggacgttaccgctgcatcgcctatgaccaccggggccagggccagagcgccgtgcctccggcgcgcgtcatcgacatggagacggtgtacctggatgcggtggcgctcatcgagcggctgggcgtagggccctgtcacttcgtgggcctgtccatgggcggcttcgtcggcatgcgcatcgccgcgcggcggccggacctgctgcgctcgctggtgctgatggagacgtccgccgaccgggagccccttcacaacgtgccgcgctacacgctgctcaacctcaccgcgcgcctggcgggcctgcgcccggtggcggacccggtgatgcgcatcatgtttggccgcagcttcatgaccgaccccaatcgggccgaggagcgcagccgctggcgcacgcgcctcatggagaaccgccgcgacatctggcgcgccgtcaacggcgtcatcgaacggcgcggcgtggcccacgaaatcccacacatccgcgtgcccacgctcgtcgtcgtcggcgccgaggacacggccaccgtccctgccaaggcgcagcgcctgcaccggctcatccccggctcacgcctggtgaccctgccgcgcggagggcactcctccaccgtggaggagcccgcgctcgtcaatgccaccttgggaacattcctggacgcgcaattagagacgcggacctccagggcggtgtgacggattgccgcgagcgggaacgcgaatcccagctcagcgtggcgtattcctgctgtcagttgcccgcgtcacgggcgagaggagctgggcccagaagcgccggggaaacggctccacgagcccgagcggatactgctcgggcccggtgggacggtagtaggtgccgaagagccaatccgtccacggcgcgaggttgccgaagttgtgccgtgtgtgccgttcgcgcgcgtggtgccagtggtggagttcgggcgcgccgaagaggaagcccagcggccccagcggtagccggacgttggagtggatgaagatggcccacaccccgcggaaggcgatgagcatcgccagcgtcccgagcggaaagcccatcatcatcgcggggaggttcaccaccaactgcgtgagcagtccgtccacggggtgctcgcggtgcgcggcgagccagtcgaggtgctcagcggagtgatggacggcgtggaagcgccagaggaagtccacctggtgtgacagtcggtggaagccgtagacgagcaggtcgcagagcaccaccgcttcgagtgcctgaagccaccagggctggcgtgccacggcggcctggagccccgatagtaggtccaggtgcaagagcgcctgcacgtggctcagcatcagcagcgccagcggcgcgagcaccaggtactgcgccacgaagtaggcgaggtcggtgcggaacgcaggccgcagcaggggctggcccggccgcgcggcccaggccttctccaagggccagaagacacacgcgagcaccccgaaggaaatcgcggcccccccgcctaggacctccaggctcatcacggcgtggccgggggcgccgcgtcaccgtcatcgtgggcgtgcaggccgccctccggcatgccgaacagcgggcggatcttggtcccaccgaagaaggttccagccgccgtcagcaccacgaaaaccagcaggaggaccgcgaggaccaccgtcaccgtacgaagaaccttgctgccttgtgagtgcatggacacgcgtactcccgttgtccgggaggctacaccacgcgtgccattcgctttagagca

SEQ ID NO: 926 - DNA, 5993 bp, Myxococcus xanthus
gcgcatcacctgccacgtggggtccagctcgaacttccgcgccgcgaagttggggctgctgccgtacttatggtggttgttctggaagagctcccccatgcagaggaagtccatgggcagggagttgcgcgacttgtcggtgctgtcgaagttccggtagccgtacttgtggccgcaccagttgacgatggcgccgtgcaccgggcccatgaggaagtgcaggggcagcagcaggaactgccagggcgaggtggcgaacatcacgtagaaggcggagtagaaggccacccagcccagggtggcgaaccatgaggtgcgcagcgtggtgtccacgagcggccactccgggtagccgcccaggaagcgggcctcgggttgaccgcggccggccgcgtagtcgtcgtagcgcgccttggtgtgccacatcatccgcgccacatccttgaagaagtggggcgagtgcgggtccttctctgtgtcggagaaggcatggtgctcacggtggaggatggcgtacgccttgggtgacaggtaggacgagccctgcaccaggtaggtgagcaggtgcatcacccgctccgtcttcggccccatggtgtacatgcggtgggccgcgtaccggtgctggaagaagctctggaagaacacgcagagcagccagtgcgagacgaagaagatgaggacggccattcgagttccctggtcagtgactgaaccgggctaacaccgggcatgtcatggcagcgtcacgcggggcggaagagcggcggccctgccccacggggcgacacgcccgctcgctccgcttcagggggccatcagtagaacgcgccgtggcatgacatgacgcgcggcggcgcggcccactcttccggtacggaggggtacggagctccaggagaggagtacacgcgtgaagcgggcggacatcgtcggattggacaaggcgcacgtctggcatccctacacggcgatggaggcctacatcgcggagacggatccgctggtggtggtgcgctcggaaggggcgtacctccatgacgcggacggcacgcgctatctggacgccaacggctcctggtgggtgtccacgctgggccaccgtcacccgcgcttgatgcgcgcgctcgccgagcaggccgccgcactcccacacgtctccctggcgggcatcacccacgagccggcggccttgctggcgtcggagctggcggccatcgcccccggctcggaccgccccggccttccctcatccgagcggctgtcccgcgtcttctattccgacaacggcagcacggcggtggaggtggccatcaagatggcggcccagtactgggcgcagaatggccagccgcgccgcacccgcttcatcacgctgtcgggggcattccacggcgagacgatgggcgccaccagcgtggggggcgttcccctgttccgggaggtcttcggcccgctgctcttcgacgtggtgcacgtcccctctccagcggaggaggggggctgggcgcgcgccttcgagcaagtccagtccaccctgcgggcgcacccggaggtgattgcgggcgtcattttggagccggtgctgcagggcgcggcgggcatggtgatgtactcgccagacttcgtccgggcggtacgtgaggccacgagcgaggtggataccttcctcatcgccgacgaggtcttcacggggctggggcgcacgggcgcacgcttcgcggtggacctggcgggcgtggtgccggacatgctgtgtctggcgaaggccctctcgggaggaatcctgccgtttggcgccaccctggcctcggagcgcgtcttctccggcttcctcggggcgtcgaaccgggcgctgtattacgggcactcgtactgtgggaacccgttgggcgccgccatcgcccgggaagtgctggccgtctaccgggacgaggatgtgatggggcaggtggctcgaaaggccccccgcgtgaaagccgccttcgagcggatggccgcctcgattccgggcctggttcgcccccgcgccgtgggaatggtaggcgcggtggacctgggcggtggtggttacctcgctcggggagggtggcgagtgtacgaggccgcgcgtcgccgagggctctacctgcggcccatgggagacaccgtgtacatcgcgccggcactgactatctctgacgaggcgctcgaggagctgctgtccggagtggaagcgtcactccaagaagtcgccggcggctgagcctgatggatccgctgcctacgaatgtgtgggagcgaacggaacggtggttgacaggtcgcgcgtcgcagggatagaagccgcgccccgcccgacgcagatccgggcggggagctgacagcagaataaaagggtcgatgaggattgttgaccctggacgcggcggtggtagaagccgcgcccctccggacgggtggctgatccaagcacctcgacggagcagcagcaggaatagagggctcgactcagaaagttgatcccaggggcggtggtggtagaagccctgaatctcacgaagaagcccgcgcattggcgcggatccgctttgagtgggtcggtaagaaaatacggaatacggcagtcaacgcagcgagttgacaggagacgcggtggtggtagaagccgcgccccgacgaagaagcccggaagaaagggcggatgagtcgagggagtcaacgaagcagcggttgacagggagggcggccaagcggtagaagccgcgcccctctggaggaaatcagcggaagccactgggcggcgctgaagagtccggaagccagcaggacggcgaaaacagcagcttgacagaagacgccgaactgaaatagaagctgacaccccgccgggtagaaaagacggcgaggcagcaacgaagagaatggtagcaagaagtcgccggcaagacaagcggctcggtctttgaaaaccaaatagcaagcccaagaagaagctagattgcggaaaccgcagtcaatttcttaagacggtgccagccaggtcgcgctgcgaagcgcagccggcagcactgtaacgaatcagcgagtttcaggttccttagccgggcctgggactgacgccggttcaaatcttcaaaaattcaattggagagtttgatcctggctcagaacgaacgctggcggcgtgcctaacacatgcaagtcgagcgcgaataggggcaacccttagtagagcggcgcacgggtgcgtaacacgtggataatctgcctgagtgctcgggataaccagtcgaaagattggctaataccggataagcccacggtttcttcggagactgagggaaaaggtggcctctgtatacaagctatcacattcagatgagtccgcggcccatcagctagttggcggggtaatggcccaccaaggcaacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggaagaaaacccgttggctaacatccaacggcttgacggtaccgggagaagaagcaccggctaactctgtgccagcagccgcggtaatacagagggtgcaagcgttgttcggaattattgggcgtaaagcgcgtgtaggcggcgtgacaagtcgggtgtgaaagccctcagctcaactgaggaagtgcgcccgaaactgttgtgcttgagtgccggagagggtggcggaattccccaagtagaggtgaaattcgtagatatggggaggaacaccggtggcgaaggcggccacctggacggtaactgacgctgagacgcgaaagcgtggggagcaaacaggattagataccctggtagtccacgccgtaaacgatgagaactaggtgtcgtgggagttgacccccgcggtgccgaagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcagaatccttcagagatgagggagtgcccgcaagggaactgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgttgccaacccgcgagggggagctaatcgcataaaaccggtctcagttcagattggagtctgcaactcgactccatgaaggaggaatcgctagtaatcgcagatcagcacgctgcggtgaatacgttcccgggccttgtacacaccgcccgtcacaccatgggagtcgattgctccagaaatcatctcaccaagaggtgctcaaggagtggtcggtaactggggtgaagtcgtaacaaggtagccgtaggggaacctgcggctggatcacctcctttctaaggagaccgggcatcggacagcgtcttcggacgcagtaggcgatgccagcgactttcgagtcgcgtcaggtcaaccaggtcaacgtttccgaataacaatctagcgacttactttgggcttgctgtttggttttgaaggactgagtccatgcgacttggctctttgagaatgaaggacgctgtagggtttgccgacgcggtagccccctgggcctatagctcagctggctagagcgcgcgcctgataagcgcgaggtcggtggttcaagtccacctaggcccaccattttcctcccaaggaggagggaagcggtgacgcgcaccagcatggtagaatggccgtgggcaattttcccggggctgtagctcagctgggagagcgccagctttgcaagctggatgtcgtcggttcgatcccgatcagctccacacaagttttctctgaagtatagagaagcgttctttgacaagtgcatacgaagggtaagttcaatttctgctgagagaagttctcgcagaagccctgacgagagtaccccgccgacgccgtgaggcgaaggtgaggggaagaaagtcaggtgcttttaatcaagcgtaagtaacaagaagtcttccaggcttgctgcgaagagcaggagtctgggccttggtttcgagtttcgacaatccgccgggaggcgggcgtgaaacaagagattagggcaagtaagctactaagggcgtgcggtggatgcctaggtgccaagaggcgatgaaggacgcgggtggctgcgaaaagccccggggagctgtcaaccgagcgttgatccggggatgtccgaatggggaaacccagcgctgcgaatagcggcgttacctttcactgaatacataggtggaatggagctaaccaggggaagtgaaacatctcagtaccctgaggaagagaaaacaatgagtgattcccaaagtagtggcgagcgaaatgggagaagcccaaaccgaaaccacgaaagtggcgtcggggtagcgggtccacggtaggactctgacttgctagcggaagcctctggaaagaggcgccaaagagcgtgatagtcgcgtacgcgaaagcgagttggagctgagtgggttacccaagtagggcgggacacgtgcaatcctgcctgaatcagccgggaccatccggtaaggctaaatactccttggcgaccgatagtgaacaagtaccgcgagggaaaggtgaaaagaaccccggtaaggggagtcaaaagaacctgaaaccgcatgtctacaagcagttcgagcactacggggcaacccagtgcgagagcgtaccttagagcacgc

SEQ ID NO: 927 - DNA, 8532 bp, Myxococcus xanthus
tccaagtctacttctgcgacccccacagcccctggcaacgcggtagcaacgagaacaccaacggcctgctgcgccagtacttccccaagggcatggatttgagcggcctgtcgcgcgcccagctcgacaccgtcgccctccaactcaacacccgcccccgccagacgctcgactggcgcacccccgccgaggtattcgctcaaagcgttgcgatgaccggctgaaaccgccgccgctgcgcaaaacccccgacatttccgaacagcgacctcccagcctcctcccgggcctggggcccgaccccgatgaagttttcgaacagcgggctcctggccctctaccccgtcagcgcgagcaattcgcctcgcagccagcggttgcgcgggtccgcatccgtctgccggtgccaatagacgtgaagctccagcgggggcagggacagcggcatcggcaggaggtggttgcccagcagcgcgtgcaactccgccgcgcgccgcctcggcatcgtcagcagcaagttagagtccccgacgagcttgaacgcggcctcgtagtgctgacaccggacgacgacgtcacgctggtagcccaggcggctgagcaccaggtcctccacggccagcccggtgcggcgcgaggacacggtgacgtgccgggccgccatgtacttcgccacgtccagcttgcgcctgcttcggctcaccacgcagaacgtgtcttgcaacagggccgtgcgcttcagctccgctccggtctgctgctccacgtcgatggagaggtccagccgccccgacgcgaggtcccgctccagccgcgcccggtcgagtcggacgctggagatacggacctccggcgcgtgcgcccgtaaccgagccacgagcagcgggagaatcgacggctccagcacgtcgttcatcgccaccgtgaactggcccacgtcccggcgcgggtcgaagccgcgtccgcgatgaaccgcctgttcgaacagcgccagcgcctcccgaatctccggcgccagccgctccgcgaacgccgtgggcgccacaccgcgcccctcccggacgaacagcggctctcccaactgctcgcgcaagcgggccagcgcatggctcacggccgactgactgaggaacaggacctccgccgcgcgcgtcaggttccgctcccggagcaccacgtcgaagacccggaagaggttgaggtccagccgggcgagccgcgccgaatcctgaacagggttcatggtgacacatgaccaacattcactggatgcatcaagcccccatgcgcaggatgaaggccatggacttcgagcccagtgagcgagccaaggactacctggagcgcgtgaagcgcttcatgagcgagcacatcctgccggcggaggcccgctatcacgaagagctccgagccaccgcccagggcggcgactggaagacgtggcgcgtgccccccgtcatggaggaactgaaggccctggcgaagacccagggtctgtggaacctgttcctccccgacgagaagctcggcgccgggctcagcacgctggagtacgcccccatcgccgaggagaccggtcgcagcttcatcgcccccgaggtcttcaactgcagcgccccggacaccggcaacatggaggtgctctggaagtacggctccgaggcgcagcaggagcgctggctgaagccgctgctggccggagacatccgctcggtgttctgcatgacggagccggatgtggcctcgtcggatgccaccaacatggcggccaccgccatcgtcgacggcgacgaggtcgtcctcaatggcagcaagtggtggtccagcgggctggggcaccccaacgcgaaggtggtcatcttcatggcccgcacgcccgacaccggaggggaccgccatcaccagcactccatggtgctggtgccactggacgcgccgggcgtgagcatccgccgaatgcttcccgtgtacggcgactacgacgcgccccacggccacggtgaggtccacttcgacaacgtgcgcgtgccgcgagacaacgtcatcgccggaccggggatgggcttcgagattgcccagggccggctcggaccggggcgcatccaccactgcatgcgctgcatcggcgcggcggagcggtccctggagctgatgattgaccggggcatgaagcgcacggccttcgggaaaccgctcctcaacctgggtggaaaccgcgagaaggtggcggaggcgcgcatcgccatcgaccaggcgcggctcttgacgctctacgcggcctggaagatggaccaggtgggggcgctcggagccatgacggagatttccgccatcaaggtcgtcgcgccaagtgtcctccagaaggtggtggatgacgccatccagcttcacggcggcgcgggcgtatcccaagatacgccgctggcgggcttcttcgcccaggcgcgcagtctgcgcctcgcggatggcccggacgaagtgcacaagggtctcatcgcccgcatcgagctgtcgaagcggggcttctcccggagctgacggccatggcaactcaacgcatcttcatcaccggtggtgccagcggacttggcaaggccatcgccgtgcgcttcgctcgcgccggctggaaggtctgcatcggcgacgtcaacgacacccgcggcgaggaggccttgaaggagctctccgcgctggcgccccaggcccattacctgcgctgtgacgtgcggcgcgaggaggacctgcgcgaggccctggactggctcacggcccagtggggcggcgtggacgtggtcatcaacaacgccggtgtcgcgcaggcgggcgccatcgaggacgtgtcgattgatgactggcagtggatcatcgacatcaacctgctgggcgtcgtgcgtggatgcaaggtgttcacgcctgccttcaagaagcagggccacggccacatcgtcaacgtggcgtccatggcgggcctgctcgatgtgccgctgatgagcagctacaacgcgaccaaggccgccgtcgtgtcgctgtccgagacgctgcacaacgagctggcggagtacggcatcggcgtcagcgtcgtgtgcccgtccttcttcaagacgaacctgggtgactcgctgcgcaccacggacccgaggctgggggccaccatggcgcggctgctggagcgctccgccatcaccgcggatgacatcgccaacgacgtgttcgacgcggtggctgagcgcggcttctacgtcctgccccatgcggatggccgcaggacctgggcgctgaagcgcctgctgccgcgtgagctttattcgtggatgctgcgccggaatacgcgaggcatgcgccccggttcgcagccgaaggcgagctgagccaggagagagcccaccgatgccaccgaccgcgaccatcgaccccgctggcgccgtgcgcccgggcgaagagctggacctccccgccgtggatgcctggctcaaggcccaggtccctacgctggaaggcacgccggaagtcacgcagtacgcgggcggtgcctccaactggacgtaccggctgaagtacgccaaccgggacctcatcctgcgccgccctcccgcggggacgaaggcgaagtcggcgcacgacatggcccgtgagtacacggtgcagcaggcactgaagccggcctatcccgtcgtgcccaccatggtgggcctgtgccaggacccggccgtgctgggctccgacttctacgtcatggagcgcatcgaggggctcatcccgcgcaagcacctgccccgggggctggccctggacgcgaagcagacgcggacgctgtgcctcaacgtcatcgccaagctcgtggagctgcacgccgtggacccggtggcggtgggcctgacatcactgggcaaggggccgggctatcccacgcggcaggtggagggctggtcggcgcgctacgagaaagcacggacgtggaacgtcgccagcttccgctacgtgcgcgactggctcaaggcgaacacgcccgcggacatcgccacgtgcgtcatccacaacgactggcgcttcgacaacgtggtgctcgccccggaggagcccacgcgcatcatcggcgtgctcgactgggagatggccaccctgggtgacccactgatggacctgggcagcgcgctggcctactgggtccatgccgacgacgacttcctgatgcgctccacgcggcgccagcccacgcacctgcccggcatgctccggcgcgaagaggtcgtggcgtactacctggaccagacgaagctgaagcccgccaactggaccttctacgaagtgttcggcctcttccggctcgccgtcatcgcccagcaaatctactaccgctaccaccacaagcagacgcgcaaccccgcgttcaagaacttctgggtgctggtcaactacctgggctggcgctgccaccggctcatccgcaagggggcacgctgatgggcgtggtgtatctggtccggcacggccaggcctcgttcggcgcggcgaactacgaccaactgtcggagacgggcctcgtacaggcccgggtgctcggtgagtccctgcgcgagcggctcccccgtgtggacgccgtcgtcaccggcaccatggcgcggcaccggcagacggcggaggcgtgcctcgccgcgctcggttgcggcaccgtggccgtgcagacggcgggcttcaacgagttcgaccacgaggaaatcgtcgcccggcacacgccacgctacgcagacccggaggtgctccgagcggagttgtcacagacggagtcaccccggcgcgcctaccaggcgctcttcgccgacgccgtggcccgctgggtggccggccagcacgacgcggagtacaccgagccctggtccgccttcggcgagcggtgccgccgcgcgatggatgccctcatccaggagatgggcgcgtcgaagaacgcgctcgtcttcacctccgggggcaccatcaccgccatctgccaggagctgctccacatcctcgacgagcacgccttccgcctcaacctgacgctggcgaactgcggcctcaccaaggtcatctacagcgagcgcggccgttatctgtccacgctcaacgagcacagccacttcgaaggcgcccagcgcgcgctgctcacataccgctgagcggcgcgccgtcgtaccgcaagtcctcccacgccagcatcgcccgcttgcgtgaggcgccccagcggtactccccgaagacacccgtcttgcgcagcacgcggtgacagggaatcaagagccccacgggattctcgccgaccgccgagcccaccgcgcgcatcgccttgggcttgccaatggcgcgtgcgaggtcctcgtacgtcgtcacctcgcccgacggcacccgcagcagcgcctgccacacctgcacctggaagggcgtgccccgtaccagcaccgacaaggggctcgactccgagccaccgtgccccgcctggaagatgcgctccatccatggcgccgtgtcctcggcggacgcctcgaacgtggcgcgcggccactgcttgcgcagcgaggcgagcgcctcctcctctgactcacccgcgaggaagtgcaggctgcagatgccacgctcgcagacggcgagcagacacgcgccgaacggtgacaggtggacgccgtggcgcacggtgagcccttcgccgcccagcttgtattcccccggtgtcatcgacgtcagcgtcacgaagagctcatgcagccggccgctgcccgacaggcccacctccagcgacgtctccagcacgctgcgacgctcgtcgagcaggcgccgggccgagctcagcgtgtgcacctggatgaagcgcttggggctgatgcccgcccagcgcgagaagagccgctggaagtggaaggtgctcagccccacgtgcgcggccacgtcgtccagggacggctgctcgcgcgcatgtgcgtcgagatagaggatggcttgttcgatgcgggcgtagtcgctggatgccatgccaatgctcctgggatgcgcttcgcgaaaacgtatgtccgccaacacatggtggagcaacccggttcttgcgctgtcctcgcgcgccgggcgtgcgatgacatgaggttgtcattgtgcaacaaccggaagctccaccccgcacgtcgcctcaaacaaggagcgccatgcttccagaggaagacttcctggccgcggaggaggcgctgagacgggccatgctctcgagcgatgtcgccgcgctcgacgccctcctctccgacgacctcctctttgtcagccacaccggccgcgtcctcgacaaggaatccgacctggaatcgcatcgctcgggagccctgcgcctcacacgggtggacttcaccgacacacatttccgctacctctccgcgggcgccgtggtcgtcgtccatgccgcgctatccggtgagttccagggaacccgcttcgaagggaacttccgttacacgcgcgtgtggcaggttgtggacaacgcgccccaggtcgtcgcggcgcagtgcacggcggtgggttgacttgactccggcaagacgagcgcttatccgttggcgccaatgacgtcgctaaacgccatgtgtcgaatgtcgatgccgggtgggctctcgccctccaggttcggctgatgtccgtccgaccctggtgagccatcgagcccatccacccgcgagggttggtgggctccgtcgtttctggacgcgcgcgccccctgctctctccgcgcgccgccacctgacggcacgccgtcctctcccagccctccgcatccaggagggccgctcccgcatcgctcccggagaatctccgtgcccaccacccaccttcccgccccgcgtgtcttcgacgtctccctgcccgatttgacgctggaggcaggcgcccgcatcacgaaccacctcgtccgcggctggtggtggggtcccgcggaggacgtcgcctggctcgagtcacgcgcgcgcgtcctctccgaggacgaagcccgggcgagcgcgctgcgcgtcgtccgccgcaccgtggccgaacagcaggcgctcgcggcggaagcccgtcatcgaggcccggcccgagcccccgcgcccgtccccacggtgctgctggtccacgcgctcaccggcgacatgcgcgcgggcagcaagggcggctggtgggagccactcatcggcccgcggcgcgcgctggacccgtcccgcgtgcggctcctgtgcttcaacaacctgggctcctgctacggcaccagcggcccggccgacgagggcttcccgctgcggacggatgacgcgcgcttcggtccgccgttgccgctgcccaagggcgacctgcgccaggacgaacagcgcctgcccgccaccgtcacaccgtgggaccaggcccggagcattctgctggccatggacgcgctggggctggacgacgtggagctcgtcaccggcggctcactgggcggcatggtggtgctctgcctcacggcgttggcgccggagcgcttcgcgcgcctcttccccatcgccaccacggagtccgccaccgcgtgggtggtgggcctcaaccacgtggcgcggcaggccctgctgatggacccgggcttccccgagtccccccaccggggcctggaattggcccgccagctcgcgatgctcacctaccgcgcggagcccggcctggaagcgctccagggccgccccgccgagtggtcctcacgcgcgctgcaccccatgcacagctatctggaataccagggccagaagctggagagccgcttcgacgcgcgcgcgtacctggcgcagttgggcgccatggaccaccacgacctgtcacgcttcccgggaggcggcctggcccgcatccgcgcgagcgcgctgtgcgtgggcatcgacaccgaccagctcttcttccccagccacatggcgacgctgacgcggcggctgcgcgagcacggcctccacgccgagcacgccacgctgtccagtcaacacgggcacgacggcttcctgctggagtgggacgccatggccgtcctgctcgcgcgggcgctcgccctgcccacggccaggggcccggagcacgccttcccgcgctggccggaagtgcgccccgccctcaacccaccttgcgggacgaaggcgtgaccaccgccaccggcgcgtggtgggaccacaggggcggctcggcctcgtgggtgaaggcgcgcagccgccggtactccggataggacgcctggagcgacagcacgtctccaggccggatgacctcttccccctgcgggtggagccgctcctcgccattgcgttgcagtgacagcgccaggcagccgaaccggtcccgcacatcggagatggtgagccccggcagacccaagcgcgcctcgaacagcgagacgaccatcaggtgcttcgccaggtggaacgagtggacgatgcgcgggtccatggccgccagcgccatggccggggccgccagcgacgagctggagagcgcttccgccttgaacgtctcgcgcaccttgccgctcaagtg

SEQ ID NO: 928 - DNA, 7463 bp, Myxococcus xanthus
ttcggctcggaggtgtccgggctggcgccggaggtgatggaggggggcacggggacggccgtcaccattcccatgctggaggaccgccggagcctgaacctgtccacgtcggtgggaatcgggacctatgaggccctgcgacaggtccgtttcaccggagcgggcaggcaagcgcccccggcaagttgaggggccgtgtagagggactacactgcggcgacgcatgaccccgtcgcaggccgccgaagcgctctattccgcccacaagtcccgcgccaccgggaggctcacgctttcctcgggagggcgcgagtcccggctgtggctgcgcgaggggaacctcgtggggacgcagctgggcttcgggttccagagcccggcgcaggccctgctccagtccgggctgctggacgcggaggcgctggacacgctgtgggcgcggggtggggcaggggctccggacgaggagacgctggaggcgttcgacctggtgccggaggtggtggcggagcagcaggtgctcgcgcatgtccggcggttgagcgcgctggcggagcaggccgcgttcgagccggggacggtggaggcggaggggtttgagcccatcgcgggcgtgcgggtggtgcgcgcggcgctggaggggccgattcatggcggcgcggcggcgcgcgtgttccggtgtgaggatgtcgaggcctgtgggccgtggctcgcggatgtttcggagcgggcgttcctggagacgttggcggagttccgtgagccggagtcgctgacgcccgcgcaggaagcgctgctgctcgtgctggagcgcgagggctgggtgcaggcgctctccgtggaggactgggaggcgcgcgagcgggttcgacgggaggaggaagaggctcggcggcgagcggaggaggaggcgcggctcgaagaggagcggcggcgggcggaggaggctcggctcgaggcggagcggctcgcggaagaagctcgacgcgctgaggcggctcggctcgaagaagagcgccgtgtggcggaagaagctcgcctggctgaagaggctcggctcgccgaagaggctcgcctggctgaagaagcgcgcttggctgaagaagcgcgcttggctgaagaggctcgactggcggaagaagcgcggctcgaagaagagcgtcgcgtggccgaagaggcccggctggcggaagaggcccgtctcgcagaggtcgctcggcttgaggcggagcgccttgctgaagaggaacggcgtctcgcggaggaggcgcgtattgccgaagaggctcggcttgaggcggagcgcctagctgaagaggcgcggctcgccgaagaagctcgcctcgcggaagaggcccgtctcgccgaagaagctcgcctcgcggaagaggcccgcttggcggaagaggagcggctcgaagaggagcgccgactggcggaagaggctcggctcgccgaagaagctcgtctcgaagaagagcgtcgactggcggaagaggctcgactggcggaagaggctcgtctggcggaagaggctcgtctggcggaagaggctcgtctggcggaagaggctcgtctcgaagaagagcgtcgactggctgaagaggctcgactggcggaagaggctcgtctcgcggaagaggctcgactcgcggaagaggctcgtctcgaagaagagcgtcgcctggcggaagaggcacgtctcgctgaagaggcacgtctcgaagaagagcgccgtctggcggaagaggcacgtctcgcagaagaggctcgcgtagccgaagaggcgcgtctcgctgaagaggctcggctggcggaagaagcgcggctcgaagaagagcatcgcgtggccgaagaggctcggctcgcagaagaggcgcggcttgaagaggagcgccgcctagcggaagaggcgcgtcttgaagaagaacgccgccttgaagaagagcgtcgtctggcggaggaggttcgtctcgcggaagaggcgcggctggcagaggaagcgcgccttgaagaggagcgtcggctcgcggaagaggttcgtctcgcagaggtcgctcggcttgaggcggagcgccttgctgaagaggaacggcgtctcgcggaggaggcgcgtattgccgaagaggctcggcttgaggcggagcgcctagctgaagaggcgcggctcgccgaagaagctcgcctcgcggaagaggcccgtctcgccgaagaagctcgcctcgcggaagaggcccgcttggcggaagaggagcggctcgaagaggagcgccgactggcggaagaggctcggctcgccgaagaagctcgtctcgaagaagagcgtcgactggcggaagaggctcgactggcggaagaggctcgtctggcggaagaggctcgtctggcggaagaggctcgtctggcggaagaggctcgtctcgaagaagagcgtcgactggcggaagaggctcgtctcgcggaagaggctcgactcgcggaagaggctcgactcgcggaagaggctcgtctcgaagaagagcgtcgtctggcggaagaggcacgtctcgctgaagaggcacgtctcgaagaagagcgccgtctggcggaagaggcacgtctcgcagaagaggctcgcgtagccgaagaggcgcgtctcgctgaagaggctcggctggcggaagaagcgcggctcgaagaagagcatcgcgtggccgaagaggctcggctcgcagaagaggcgcggcttgaagaggagcaccgcctagcggaagaggcgcgtcttgaagaagaacgccgccttgaagaagagcgtcgtctggcggaggaggttcgtctcgcggaagaggcgcggctggcagaggaagcgcgccttgaagaggagcgtcggctcgcggaagaggcccggctagaggcggagcgtctggcggaggaagctcgtctggcagaagcggctctacttgaggcggcgcgcctcgccgaagaagctcgcctggctgaagaggctcggctggcggaagaagcgcggctcgaagaagagcgtcgtctggccgaagaggctcgggctgaagaagaacgccgccttgcagaagaggctcggctcgcagaagagcgtcgtctggcggaagaggagcggctcgaagaggagcgccgcctagcggaagatgcccgcgtagccgaagaagcgcggctcgaagaagagcgtcgtctcgccgaagaagcgcggctcgaagaagagcgtcgtctcgccgaagaagcgcgcctcgaagaggagcgccgcctcgcggaagaggctcggctcgcggaagaggctcgcctcgaagaagagcgccgccttgcggaagaggcgcagcgtgcggaggccgctcggctcgaggcagaacgcctggcggaagaggcggagcggcttgcggaggaggcccgcctcgcggaagaggctcgactcaaggcggaacgccttgccgaagaagcccgcctcatcgaggagcgccgtctcgcggagtccgcccgccttgcgagagaagcccgccgcgcggaggagatctgggccgcggaggaggcccgtctcgccgaggtcgcgcgcgtcgaggcggaggcccgccaggccgaagaagcccgccaggccgaagagctgcgtctggagatcgaacgccgtcgcggcaaggacgctcgcgccgccgagcaggcccgtcaggcagacgaaggccgtcccaccgaagagcccacgcagtccgactccatccccgaactcgcggccgaggacatcgaggccctcacgcttgatgtgggcgacatcctgctcaccgagcttcccgctcagccctccgaggcggattcctgggcggactccgtccagaacgccggtgcatccgacctggacctggccgctctgcccgaaagcgcggacgctctgcgtatcgcccggcagaaggctcaggccgagctcctccacgacatggaggaggccctccgccgctcgaagtccctgccgctcgagccatggctcgcggacgagccgcccctgtcgacaccgcccacgcggacgcaggaccgcgtccccatccaggacgagcagtggcacaccgaggccatctccctcagcgctgcgtccgacaccgagtcggaactcccgctgctggaagtcgaacccgagcccgaactttgggccgtcgccgagccactgccggcgccagcgacccgtcccgccgcgggcgaacctccggtcctcacgcctgtcgccgaagacgacgcggacatcctgctggaggcgacccccgacgaggaggacgacgccagttgggccacccaaccgtccgcgccgccgccgcgcccggccacacccaagaccggggacgaggacctctggcgcatcgtcgccttcgacaaggacgagggcgccgacaccctgacagcgtcgttcgaggccgcgctcctccaagtcgatacgcacctggagtcgctcgtccgctcggatgtcaatcaggcgaacgtcgatttcgacgagcctcctgtcgaggccattgtcgaggcgaccatcgaaccggtagcacccgattcatcgggggccttccccggtgacaactcatggccaactggccagactgactgggacgagccgtccggagacttggacgactgggactttgacgaggacgacttggcggcagatccctccaaccccgacgaggcagcaaagctccggcggcagcgtctcttgcgtcgcgccatggagaacatgggggtcctcggtgggcgcccgccctccgcaccgggcgccacgccctcgcccacgagcgaacccgccgccgccccggcccccgctgcctccgagcctcccaggcccgacgaggcccgcctggcccagcagctcgagcagcgcttcgcggacgtccaggccaagcgagaccacttctacgtgctcggcgtttcgcaggacgcctcgcgcgaccaggtgaagaccgccttcctcaacctggccaagatcttccatccggaccgcctgccgccgtcgctgccccacatggcgccgaagatcaccgccgtgttcgaagccatccgagaggcctacgaggtcctctacgacgacacccggcgcaagacgtaccagcagaacctccaggcccagcagaccctgcccaagccgccgtcgtccgcgccgaccgctccggtactccgcccgcagggccgcgccgacagcaatgccgacgacctctacaagatgggcgaggtcttcttccgcaagcgcgacttcaccacggcctccgaccactacgaccgcgcccacgcgctggaacccaagccgctgtatctggctgctcgggcctgggccatctacatggacccggcgcgcaaggcggacatggcgaaggccaagcagatgatggcggacgcggtgcgcgcggacccgaattgtgatcgggcgcactaccagctcggcgtcatcgcccgggtcgaaggcgacatggaccgcgcggagcgttgcttccgcgaggccgtgcgcgccaaccccaagcacctcgaggcgaaccaggagctgcggctcatcgacatgcgcaagaagaaccctccgaagaagggaggcttcttccgctgacgcggcaggcctcacaatgggtacgggtacttcagcccggcccgatttgactctccccccgcacctggctcgagccgcctgtccatcaggaggccagccaggttccccaccggccccagccattgacatgcctggaaagcgggcaggatgctcccgcgtcaggctccctgggccgtctgcagtgacgaaaggcatggaacgtggccaagcagcacctgctcctggtcgatggtgacgcgaagagcctccgggtcatggaggtcagcctgaagaaggccggcttctccgtgacgacggccattcacggcaaggatgcgctcgagaaggtccagatcagccctccggacctcgtgctcgcggacacgaagatgccggagatggacggcttcgagctgtgcaagacgctcaagtccgacgagcgcttcaagttcatcccgttcgtcttcctgacgagtcagaagtcggtcgagttcaaggtgcgcggcctggagcttggcggtgacgactacctgaccaagccgatctacatcaaagagatcgtcacccgcgtgaagatgatcctccagaaggcggagaaggagaggatcgagaagcgggagacgacgaagggcggtttcgccggcagcctcgccgacatgggcgtggtggacctggtgcagaccttcgagattggccgcaagacgggcctcatcaacatccagggcgagcgcaccggcaccgtctacttcaaggacggacgcgtcatcgacgcggagctgggacggctcaagggcgagaacgccttctaccggatgctgaacaccttcgagggccagttcgaggtgcagttcagcgcgctggaccgtccggagcgcatcgaaatctccacgcagggcctgctgatggagggcatgcgccgcctcgacgagtggggccgcatgctcgagcagttgccgccgctcgagacggtgttcgagattgactaccaccagctcgccgaccgcctgtcggagattccggacgaggtgaacggacttctgcggctcttcgacggcaagcgcgcgttgagccgcgtggtggaggactcggacttcgaggacctggccgcgctgggcatcatcagcaagctgtacttcgagggcctcatccgcgagctgggcaacgcgccgctggagccggtgcagagcagcaagcccggcatcgagcagtggctcaacacggcgccgcccgccagcgcgaccgtggagcccgcgcctcccgcgccggagagcccgccgcagccgattcccgaagccgccgttcccgaagcggcccccgagcccgtggccgccgcgccggagccttctccgcggcccatgccgcagagcgtgctcgcgcctcccgcgggcgtggaggacgagccggccgcgccgtcgcccgccgcgcccgcgcagcccgccgacgtggtcgtcttccacgcgcggcccaagcgctcggacacgcctgagtacacgcccgaagttccggtgaccgagccggtcccggaggcccccgcgcaggaggcttcggcgttcctggtcgagccgccgccggcccaccgtgccgtggagcacgcgcgtcgcagcctgctgctggactggagccgggtggacaccgagggcatcagcgcgcccacgacgtgggggccgggctctggctggtcgcacacgccgcgggcccatggcgccgcctcctccgctttcgccgcgagcgcgcccgcattcgagcccgtgccctcgccgcgtgcgcccatcttcggtggcgcggccgtggcacccaatccgttcccgcccgtgcccccgccgacgccggcgccgccgtcgtccgaggtgacgctggtgagtggcagcggctacgtgacgccgcccatcccgtcagtgcaggtcgatgcgga

SEQ ID NO: 929 - DNA, 9556 bp, Myxococcus xanthus
tcccgtgcccagcccccggacaccgtggtcctcttcgacggcgtgtgcaacctgtgcaacggcacggtcctcttcatcatcgaccgggaccccgaggcgcgcatccgcttcaccgccctgcagtcccagcgagccgccgcgctgctggcgccccatggcgtcgtgcccaaggaggaaccggacagcttcgtcctcctgcaggacggcaagctgtacgagcggtccacggccgcgctccgcgtcgcgcggatgctgaaggggccgtggcggtttctctacgctttcatcgtggtgccccggccgctgcgcgacctcgtctaccgaatcatcgcgcgcaaccgctaccgctggttcggccgggaagctcagtgccgcatccccacgcccgagctgcgagcccgcttcctcccggagaccactccgtagccaggcgtcgcccaccgaatcagcaggcgttggcgtccgtgcagcgcgccttcttcatctccgtggcgaaggggctgggcgccaggaagccggtgacacgtggctgggtgagcaccttgccctccggcgagatgaacgccacggtgggcaagccctccaccccgaagcgctccagcagcgcgtccagcgagtcctcgctgttcgtcgcgtcaatcttgatgttgaggaagcgcccctcgtcggactcggagatgacctgctgcgccgggtaggtgtcgcggtccagttccttgcaggccgcacaccagtccgcgaagaagtcgatgagcaccggccggccctccgccttcgcctgtgcgagcacctggtcgaaggcctccggggagaaggtggcctgcttcgccggcatgacgtggtgccactgccaggccggtgcgcgcgccggctcggcgagccccaggctcacccacaacgtgcccaccgggcccccgtccagcgccccgccgcgcagcaccagcgccgcgacgacgagcgccacgcccagcgccttgaacgagaactcccgcgcgccttccttgaacgagcggtgcaccgcgcccagggccacgcccaccgccaccagcagcgcggcgatgacggctcccggcacccggcccacgtggaggcccagccccttcaccacgtcccgcgcccaggggaaggcgtccttgaggtagctgaaggccagggccactagcatgatgcccagcacgctcttcacccactccatccacacgccgccgcgcggcagccggacggtgaagacgccgatgaggaagaacggcacgccgatgcccagcgcgtagacgaacagcagcgacgcgcccagcgtggtgttggccgacttcgccacgaaggccaggaggcccgtcagcaccgggccggtgcacggcgccgccaggaagccggacacgctgcccatcaggaacgcgcccgccacacccgcgccccccaccgcgttgagcttcgtctggaacgacgacggcagcgccagttcgaacgcgccgaacatggacgtggccagcagtagcagaaacaccgccaggcccgtcaccaccgccgggtgccccagcatcgacccgaacgcctggcccgtcttcgccgccagcacgcccagtgcgctgaacaccacgcccatgcccacgatgtaggaggacgtcaggagcagcgcgcggccccggccctccgtcttgcgcgcgccgaagacggacacggtgatggggatgagcggatagacacacggcgtcagcgcggtgagcaacccacccgcgaacaccaccgccgcgcccaccgcgaggctgccggcttcgaggaaccgggccgcatccagattggcgttgggacccgtgggcagcagccatggcaccacggccaccgccactccggccagcaccgccatcactccgagtttcttcgcatccatgcgcgcgtgactccgtgctcccaggccccccttgtatacgcaggccgggggccacgggctactgcgctggaggggcaagcggggaagcaggcgtcttcagtccggcggaacgtgccagccccatgacgccctccaccgcggcggcgatgtaaccaaacggattggccccatccaccgcggtgacgtgcacctcgcccatcttctgctggaaggccgcggccacctgcgggagctgctgcgccagggccatctggatgacctccgggctaacgctgttctcgatgtcgcgcagcgcgcgcgccttgcccagctccaggtcctgctgcgcccggtccttgcgcacactcagctcggcgatgactacctctgtctccacgatggaccgccgggcctgcaccacctggagctccgcgtggagccgttcggcctcctgctggtgcgcggccatctgcacctcgtgccacacggtggcctgttcgtgctcgcggcgcaggcgctccagctccagctgcgccttggcgccggcctcctcctgctcgcggcgcagcttcgccagctccacctcctgctcgtgccgctggcgtgacagctccagcgcctgttcacgctgctgccgcgccagctccatctgcgccttggcgttctccgcctcctgcgcgcgctggagccgcaccagctcgattttcgcctgcgcggcctcggactcctgcgccagcttcagcttctccagctccagtttcgcgcgaccggcctccgtgtcctgctcgcgcttgagcttctccagggccacgcgctggcgcgcgacctccgcgtcctgttcgcgctggagcttctccatctccacctgagcgcggctgacggccagcgcccgctcggagacgattttcgcgtcggccaggcgggactccgcggccagcgcatccaacttcgcctgttcgtcggccacctgcttcttctggcggacctcctgctcagcggccatcttcgccagcgccacctcgcgctccacggtggcctgctcctgcttcagcgtgcgctcctgggcgagcttcgcctcggccacgcgcgcctccaccgccagcgcctccagccgggcctgctcctccgctgtctgcttcttctggcgcacctcctcctcggccgccagccgctggaggctcagctgacgctcggcttccgtctcctcgcggtggacgaagcgctccttggccagctccgcctcacgcgcctgccgctcctgttcatggcggaagcgcgcctgcatgttggcgaagacggtggaggacaggacgcgcacgtcctggatttcaatcgtgtccaggatgacgccccagcccgcgtccgtctggtcctccaggcggcctcggccggagagcacgggcgcgatttcgcgcaccagctccgcggcgatgccctccttgcgcttggagaggcactcctccacggacatgttcgccaccagccgccgcgcggcgccgacgaacatctcccgcagcagctcggccagcttctcctgcgcgcgctccgggaaggagaagttgagcatgcggaaggccaccagcgggtctgaaatccggtacaccgccagccccgtcacctgcacgcccaccttctcgtgcgtcacctggtccgcggtgaactgaagtcgctggatgctggtggggacaatggccaccgagtcccccggcagcttgaaacaactggcgccctggccgctgacctcccgcacccggccgcgccgcatgtggaccaggaactcactgggccgcgcggtgacgagcccccagcgcttcatcttctccgggtcctccgcgggcttgccggcacgccacccgtccacatagcgcggctgttccagcttgcctccgcccccgccgtccatccggaccaggtgcgtcctcccgccgccctcccccgtctcctgcgcctccttcgtgcgggccgtctgcttcgcgctcatgtgcgtgcctccctgtggtggcccccacccgtgcaggcggccggccagcgaggggcctgccgggaaatcaagcggttggccggagggtgtgcgccattctggggcgcctcgtcccaggacggcgcgcccggactgatccacgatggcgcggcgttcacttaagacgtcctattgggagcacgcacccacacccgcggcgcgcctgatgttcgcttgacccgaaggcgcccctttttatatttgaccagtccggtccacattcaggtgtgacggtgtaggttcccctgcggcaaaggcgctccgaggcgccggtcgacgtcccctccaggaaggtgttggaagcaatggtgaagctgccgatctacatggacaaccacgccaccaccccgctggacccgcgggtgctggaggcgatgctgccctacctgcgagaggacttcggtaacgcggccagccgcaatcacgtgttcggctggaaggccgaggcggcggtgaacaaggcccggcagcaggtggccgagctcatcggcgcggccgagcaggagatcgtcttcacctcgggcgccaccgagtccgacaacctggccatcaagggcgtcatcgagttctacaagtccaagggtgaccacatcatcaccctcaagacggagcacaaggccatcctggacacctgcaagcgcctggagcgcgtgcggcaggagcggttggacgagctgaagctgctgcggctggcgcagttggcgggccaggacgtcaccgaggacaaccagtcggagctgctgtcgaagtacgacgtggactccgacgagacgtaccgtaagtgggccgagctgcccaccggcggcgcgcgcgtcacctacctggacgtggagcccgacggccgggtgagcctggagaagctggccgcggcgatgacgccgaagacggtgctggtctccatcatgttcgccaacaacgagattggtgtggtgcagcccatcgcggagattggcgcgctgtgccgctccaagggcgtgctcttccactgcgacgcggtgcagggcatcggcaaggtgcccttcgacgtggaggccatgaaggtggacctggcctccatcacctcgcacaagatgtacggccccaagggcattggcgcgctgtacgtgcgccgccggccgcgcgtgcgcatcgcgcccagcatcgacggcggcggtcatgagcgcggcatgcgctccggcacgctgaacgtggcggccatcgtcggctttggcgtggctgccgagctggctcgcaaggagctgcccgaggagtcggcgcgcctccttcgcttgcgtgaaaagctgcgcaagggcctcacggacgcgctggacatgaccgtcatcaacggctcgctggagcaccggctgcccggcaacctcaacatctccttcgcccacgcggagggagagtccctgatgatgggcatcaaggacgtggcggtgtcctccggctcggcgtgtacgtccgcctccctggagccctcctacgtgctgcgcgcgctgggcgtggacgaggagctggcgcacagctccatccgcttcggcctgggccgcttcaccacggaagaggaagtcgactacgtggtgaacctcgtagtggacaaggtccgcaagctgcgcgacatgagcccgctctacgagatggccaaggaaggcatcgacctcaagagcatcgagtggacggcgcactagcgccttctcaggtagacaggggggcgcgagccccctcgcccggagggtgttgcccgccggaacctttggtgagaagcatccgttgaaggagcaggcatggcttacagcgacaaggtcatcgagcactacgagaacccccggaacgtcgggacgctcgacaaggaagacccgaacgtgggcaccggcctggtgggcgcgcccgcctgcggcgacgtgatgcgcctgcagctcaagatttccgaggacgggctcatcgaggacgcccgcttcaagacgttcggctgcgggtcggccattgcctcgtcgtcgctcgtcaccgaatgggtgaagggcaagacggtggaccaggcgatgaccatctccaacaaggacgtggcccgcgagctgtcgctgccgccggtgaagattcactgctccgtgctggccgaggacgccatcaaggcggccatcgaggacttcaagaagaagcgcgccgcgcgtcaggccaaggcgtcctgacgttcgggaaagggagaggcgaaccatgagcgaacaggcgacccaggagacgacgcagcgccaggcgcctgccaccgcgcccgtggccaagccccccaagggcatcaccattgccgacagcgcggtggcccggctgaaggagctgctggagcagcggcagacgcccgaggcgggcttgcggctggccgtgaagggcggcgggtgctcgggcctccagtactccatggagtggtcggagaagtcccgcgagcgcgacaagattttcgagaaggacggcgtgcgcgtcttcgtggacccaaagagctacctgtacctcatcggtaccgagctggtgttcgagcagacgctcatggcctccggcttcaagctggacaaccccaacatcaaggcggcctgcggctgcggagagagcttctccgtctgacgcggcagcacgcgctccgcccccttctgggcggagccgccgccacgcgggcccggccagccgccgggcccttttcgtttgtcccctccccgcattggagagccccctttgaggacccacttcgacgtcttcggcctgaagcgcgcctatgacgtggacgtgccggcgctggagaagcagtaccgcgagctgtcgttgcagctccacccggaccgcgtggcacaggccagcgcgcgcgagcgcctgcaggccctggagggcaccaccgccctcaacgaggccttcaagacgttgaaggacccggtgcgccgcgccttctacctgctcaagctgcacggcatcgacctggaccgcgaggacgcgggcgcgcagaaggacatgccccttgccttcctggaggaggtcatggacctgcgcgagtcgctggacaccgccatggcgaagaaggacctgggccgcgcccgggccatggcggacgacgtggaggcccggaagaaggcggccctcaccgaggcggcggagtcgcttcgcaccctggaggcaggcgagccgggggacggcgggcaggaacaagtgagaaaggcatcgcacgcgctggggcgggtgcgctacttcacgcgcttcctcgagcaggtggacgcgttcgaggaggagattcaggcgtgagcaagaacggctaccttcagattcacgacccgctgaagcccaaggggcaggcggtgggcatcgacctgggcacgacgaactcgctggtggcggcggtggtgaaggaccagcccgtctgcgtcccagtggacgaaggcgacgcgctgttcctcccctccgtggtgcactacgcgaaggacggcggtgtggtggtgggcgcccgggctcggaagctggcgtccgagcacgccaccgacaccatcgcctccgtgaagcgcttcatggggcgcagcccagacgacgcggagacgcgcaagctggggcactacaagttcgcgcccggcgccaaggtggtgcgcttcgacgtggcgggcggcacgccggtcacgcccatcgaagtctccggtgaggtgctgcgcgccctcaagcgccgcgcggaagcgcacttctccaccaaggtggagcaggccgtcatcaccgtgcccgcctacttcgacgacgcccagcggcaggccaccaaggacgcgggccggctggccgggctggaggtgctgcggctgctcaacgagcccaccgccgccgcgctggcctacggtctggacaagggcagccagggcaccttcgtcgtctacgatttgggcggcggcaccttcgacatctccatcctcaagctggtggacggtgtgttcgaggtgaagtccaccggcggcgactccgcgctgggtggcgatgacttcgaccgggcgattgcccagcgcgtgctggagacgctgggcgcgtccgaggcgccggctcccgccctggtagcggaggtgctggcggcctcgcgcaaggccaaggaagcgctcaccgacgcggcttcggtggagttctccgcgggcgggcagacgcactcagtgaagcgcgaggacttcgacgcctgggttcagcccttcgtgcagaagacgggcacggtgtgccggcgggcgatgaaggacgcgggcgtgacggccggggagctggacggcgtcatcctggtcggcggcgccacgcgcgtgccggcggtgcgccgctacgtggcggagctgttcggccgtgagccgctgggcgacatcgacccggaccaggtggtggcgctgggcgccgcggtgctggccaacctgctcaccacggcggaccggcaggacgacgtgctgctgctggacgtgattcccctctccctgggtttggagacgatgggcggcatcgtggagaagctgattcagcgcaactccaccatccccaccaccgcgggccaggtgttcaccaccttcaaggatgggcagacgggcctggacgtccacgtgctccagggcgagcgcgagctggtggaggacaaccgcagcctggcgcgcttcaccctgtccggcattccgcccatggccgctggcatggcccgggtggaggtccgcttccaggtggacgccgacggcatcctctccgtcagcgcgcaggagcagagcaccggcgtcagccagtcgattaccgtgaagcccagccacggcctcacggacgaggagattgagcagatgctgctcgactccatcgactacgccgaggacgacatccaggcccggcaggtccgcgagcagcgggtggacgccgagcgcgtcctggccgaggcggaccggcagttgggcgagcacggctcgctgctccaggagggggagcgcgccaccattgattccgccatcgcccgcgtgcgcgagctgatgaagggcgaggaccacctgaagctgaaggaggccgtgcacgcgctggacgaggcgtcccgccccttcatcgaacgggtgatgaatcaggccatcacccaggtggtggctggccactccgtggaggactactgacatgcccaaggtgactttcaagagccccctggccgaggtcagcgccgacgtgcccaccggcaccaccctgctggacgccgccgaggcctgcggcgcccaggtggggcatagctgtggcggggtctgcggctgctccacctgccacatctgggtccgcaagggcctcgactcgctgagcgagcagacggacgcggaggcggaccgcttggacatgggcttcgacgtccgcccctattcccggttgagctgccagacggagctgggcgccgaggacatcctggtcgaaatcaccgaggagtccctcaccgccttcatggacgagaaccccgtcctgcgccgttcgctcgaggccgaaggaaaatggccgctgaagaagtgaggctgttacgtagtgcttgacggggccgggcagtagctctatacgtccggcccatcgcagcgccgcaccgcgatgccccacctgcccaggtggtggaattggtagacacactagattcagggtctagcgcctgcaagggcatggaggttcgagtcctctcctgggcacaaagttgagaaggggccccg

SEQ ID NO: 930 - DNA, 9333 bp, Myxococcus xanthus
cccacccggccttcgaccccgccgagcgcctgggcccacgcatcaacaaggaccggccccgcctcttcttcaccaaccacgcgcccaagtggcccctgggcgccggttacacgcaactggtgagctgggacacggaagagaaccggctgaaccactggaagctgatggacgcggccacgggtgagccggtggtggcgtcgtcgctgcaccagatcgccgccacgcgggattacgtggtgctgctggactccaacttcccgatcaacttctggcagatcgccgcgcaggcggcggtgcccttcctgccgcgggtgcagcgcgcggtggagtggctgacagcgtcccccgcggccccacaggcggtgttctgggtggtgcggcgagcggacctccagacgtcacccgggacgctggacccggagaatccgccgttcgtgtccgcgcaccgcttccaggccggaggcggcgggctgcacttcgccgccatctacgagaaccccgacgacgtcatcaccctggtcgcggcgcactctcccaccgaagacctgtctcatacactgcagccgggcgagctgctcatcaatggcaaccgcgtgcaggactggcaggcgggaatgcccacggccgttcccgtcacgcgcagctccatgggggtgcaccgcatcgacatgaagcggctgcgcatccagtccaatctgtattcgcatgacgacttcacctggggcctgacggtcttctccaacgccggcctggtgaatggcgagttggaggcccacttccggctgctgggccacgtgatgaacgccaagttgccgacgaaggagctggcgctctacctcaactcggacggcttcacggcggacatggtccccgaggcgctctaccagctctacaagcccgtcgtcggggacaagtccgcgctgcccatccgcgatggccgcgcggcgagcttctgcaagttcttcgtcgactccggccgcttcgagggctacgtgctgcccaccggttggttcggcttcgcgccgcagttcgtccccagcgcccggttcccccaggtgccgcactggaagggctacgtggtggcgctcgtcgtgtcggacccgacgccggacctgcctgagaactccacgggcgacgaggtctggatcttcgactccgaggacctggccaagggccccatctgccggctgggcagccgcaacttcgacgtgggcatgacgctgcacaccaccttcctgccaccgggcctggctgacctcctggaaggccagcccccgggcaacgtggccccgtactgcgtggacgtgcggcaggacctcgacatggacgccatcgaacggacgtacctggagtggccccagacgatgctcccacgggtgccccgcgtgctgttcgccccgtggcgcctgggcgtgaagtgggcgttgaacttcccgaagctgcgtcaggtgctccaggaggacgtgtatccgcacttcccgcgcaagtgactgcgttcgccgcagcgcctcaacacaacgacgatgttgatgattctccctggcacgtagacgaatcggcgctgggtcttttcagcgagatgctggatgagctccggctctcggtggacggcctcgcgcgcctgcgccttcgtggagtgtagcttaaggcgcaggttccctcggaccttgccgttgacctgcatggccatttctacgagctcgtcctacggtaacgcggggtcgtattcaagccactgctggagggaaatggactcgcttgcgccccagcggtgccagagttcctccgagaggtgaggcgcgaatggggagagaatccgcgcaaagaccctggccgcctcgagcggcacgcgcgggagctcggccagcgcgttggcgagaatcatcatcgcgctcacggccgtgttgaagcgcagcgcttcgatgtcctcccccaccttcttcaccgtcttgtgcagcagccgccgcgcgtcctcggtcagctccgccggtgcaccacccgcgtcctccgtcacgaacgcgagcatgttccacacgcggtcaaggaaacgccgcacgccgatgacgccgttggtctgccacggcttcaccgcctccagcggccccatgaacatctcgtacatgcgcagggcgtccgcaccgaactgccggacaatgtcgtccgggttcaccacgttgccacgcgacttggacatcttctcgttgttctcaccgaggatcattccctggtggacgagcttcttgaacggctcggcgtgcgtgacgaggccgcaatcgaacagcaccttgtgccagaaccgggcgtagagcaggtgcagcaccgcgtgctccgaaccgccgacatacaggtccaccggcatccaggcgtcgtacgcctgctgcgagaagatggcctgggtgttcttcgggtcaatgaagcgcaggtagtaccagcacgagcccgcccattgaggcatggtgttggtctctcgcgcgtaccactttccgtcgcgctggaagaatcgccaatccaaggcgcgggccagcgggcccgccgggtcctcgctgggcttgaagtcctcgagctcggggagccgcaccggcagctcgtcctcggacacgggcagaggctggtcgtagcgaatggtgtggggatgaatacgcgggtccgatgagccctccgcgagctcgaccgggaaatagatggggatcggctccccccaatagcgctggcgcgagaacacccaatcccgcaagcggtactggacgcgccgtgcgcccaatccctcgcgctcgaggtgggcgagcatggccgccttggcctcgggcgtccgcagcccatcgaggaagcgcgagcgcaccgcgacgccgtcccccacgaatgcctccgtccacgtgccagtctcgttcagggcgccgtcgaccgaaaccacctcgacgacgggcaagccgaaggcacgcgcgaactcgaaatcacgcgcgtcatggccgggcacgctcatgatggcgcccgtcccataagagccgagcacgaagtccgcgacccagatggggaggcgcgctcccgtgagcgggtgcagcgcataggagccggtgaacacgccggtcttggctttcgtgagcgcggtgcggtccaactcgcttcggcttgcggtcgcttctcggtaggccagaacctcggcgcgccgctccgccgtggcgaaccgctccagcagcgggtgctcgggtgcgacgaccatgtacgtcgcgccgaagagcgtgtccggacgggtggtgaagatgcggaggcggtccgcgctgccctcgatggcgaaatcgacctcagcgccctcactgcgcccaatccagtggagctgcttctcccgcgtctcgggccaatccagccccgaaaggtcctcggcgagccgatcggcgtacgccgtgatgcgaagcgtccactgccgcagcggcagccgcacgaccgggtgactgccccgctcgcttttcccgtcaatgacctcctcgttggcgagcaccgtgccgagcgccgcgcaccagttcaccgggagctcggcctgataggccagcccgcgatcgaagagcttgaggaagagccactgggtccaacgcacgtactccgggtcggtcgtggagagctcgcgagaccagtcgtacgagaacccaagagacttgagctgccgcttgaacgtcgcgacgttcttcgcggtggtatccgccgggtgggttcccgtttcgagcgcgtgctgctccgcgggcaggccgaacgcgtcccatcccatgggatgaaggacatcatatccccgcatccgcaagtaccgcgagacgatgtccgtggccgtgtagccctccgggtgcccgacgtgcagcccggctcccgaggggtaagggaacatgtcgaggatgtacgccttcggtttgccggggtgtctgcgcgcctcgaagatgcgctgctcttcccaacgggcctgccagaggggttcgatgttcgccgggtcgtacttcggccgttctgtggacatggcgccagttaccacaacgggcatgcccagtcagcaggcggcagagcggctcttcgggtggtctgctccgcgatgatgatcgttctcaagcccgccatccatgcggcctcaaaagccaaagccagacaaatgctggctcacgtgaacagcgctacgtcggcggaatgactgtgtccacgatcttggcagagcacagcacggcagggagccccgctccagggtgcgttcctgctccaaccatgtagaggcagtcaacgtcctcgctccgggcctgtgcccgaaggaacgtggtctgccaaagcgtcggcgcgaagctgaatgcggcccctttaaaggatcgcagttcgtcacggaaatactccggcgtcgccatccgagacgtcatcaactccgaacccagccctggcaagacggtccgcgacagtcgcgcctccaactctcgtcggaaagcctcggcccgctgcttccattccgcccctgtccccaggtgcggaaccggagccaatacatagaaagcatcatgccctgacggagccagcgccgcgtctgtcgccgtgggcctgtggagatagagcaaggggtccgctgacggctgtccagggccttccagtcctgagaacatcccccggaagtccttgccgaacagcagcgtgtggtgcgcgacctccgggtactgacgccgcgtcccgaagtaccagaggaacgcgctcatcgagtaccgagcccggttgatgcgctcgtccgtccagtgcttccgaacatgccccggaaccaggtaccggtacgtccacgccgcgtccgcgttcgacaccaccacgtccgccgccagccccgtaccgtccccgagcctcacgcccgtcgccttccgcccctccaacgcaatctcagtcacctcgctgccgtaacggacctcgccgcccagggactccagcagttccaccagaccccgaaccagcgccccggtgccgcccaccgggaagaacgccccccagcgccgctccacgaattgaatcgacgtgtacaccgcgctcgcggtcgggaagggactgccgacgatgagcagcggatggaagctcaacgcctgctgcaaccgctcgtcccggatgtgcttcgacaccaggccgaacatggaccggaacgcctcgtcccgcaccaacgcgggggtgaagggcgccagactcagcacgtccggcaccggcgtgctcatcaggggcccaatgcccgcctcgtacatccgctccacgcgggcgcacagcgccaggaatcccgcctcatcccggggagacagtcgccgcacggactggcgcatcgcctcgcggtccgtgtggtagtcgaacgtggagccatccgggaaccgcatccggtacagcggcgccacgggccgtagctccacgtggtccgccatgcgttgtccccctagcgcccacagctcctccagcaggtgcggacacgtaatcaccgtggggcccgcgtcgaacgtgaagccgtcctgctggaaggcgttcgcccgcccgcccgggctgtccatccgctcgagcaccgtgacgcgccacccacgcgccgccagccggatggccgcggccaatccgccgaaaccactgccaatcacgattgcgcgtcgttcaccgcttcgtgcggccaggccagccttcccagagggtctcagcacggtgactcgatccatcgcacacccgcgaggcccactccactccgtccgcggacaggcatccggcctcacatcgcccgcgctctgttgcgagcccccagtgccagggctaccctccccgcctcaacggggagtgcgctccttcgtgcacgggtggaagcaatgatggatgtgcccggctaccgcatcggcagagaggtcaccaccgcaggagccttccagctcttgcgcgccacacgcgaggaggacggcgcctcggtcatcctcaaggtccccgacgcggcgcggctcccctccgccaccacgcggcttcgccatgagtgggagctgacgaacgccctgagtctcgacggcgtcctgcggcccctggcgtgggccgaagcgcgggacggcgcgcccgtgctcatcctggaaggcttcggtgatgcgacgctggcccaacgcctgtcacaagggcgcgtggagccgcgcgccgcatgccgtatcgcgctgtcgttggcgcgcgccctgggtgccatccacgagcagggcatcctccaccgggacttgaaccccagcagcatcctcgtgggaacggatggcgagtccgtgaagctcactggattcacccttgccacgcgcaggccccgcgccgaggtcgctccgctcgcccccgagcggttggagggcacgctcgaatacctctcgcccgaaggcacgggacgcacccaccgcagcgtggactcgcgcggcgacttctattccatgggcgtggtgctctacgagctgctcaccggacgccgccccttcgcggacacggatgcgctgggcctcatccacgcccacgtcgccctcaccccggctccgcccgtcaccgtcgagcccgggctcccccagcccctctccgacatcgccctcaagctcctcgccaagtcccccgaggaccgctaccagagcgcctatgggctcgtggcggacctccagcgatgcctgagtgccctggaggccccggggcccgtcgccccgttcgccctgggcgccaaggacgtccccgagcgcttcgccgtccccgagaaactgtacggccgcgaaccccagcaggcggccctgcgcgaggccttcgagcgcgcagcctccagtcgctccggcttcgtcctcgtctccggggccgcgggcatgggcaagtccgccctcaccgggacactcaagcgccccgtcacggagcggcagggccactttgcgcgcggcaagtacgaccagctcctccgcgatacgccctacagcggcatcttcgaggccttccgtgaggtggcgcgcggactgctcggcgaacaggagcaggacctggagagctggcgacaccgcctcctcgaagccgtgggcggaatgggccgactggtggtggacgcggtgcctcgcatggcactggtgctcggcgaccagccccccgtgcccgagctggggcccgcggagtcggagctgcgcttccaactggtcctgcgcaagctggtggccgcgctcgccacgcgggagcatcccctggtgctcgtcctggacgacctccactgggcggacagcaccagcctccagttgttgcggctgctcctgacggatcgggacatcgaacacctgctcgtggtcgcgggttgccgctccgaagagctgagccccgaccatcccgtggagtcccttgcccgcgcgctacacgaccacggcacgccggtccaccgcatcgacctggcgccgctgtcgcccaaggacgtgacgaggctggtcgcggacgtgttccctcccgccgagggacaacccgacgcgcaactcgacgacctggtgctgtcgctgacggaaggcaacccgttccacgcggtgcaactgctgcgcaccttctacgagcgcgggctggtgcgcttcgacgcggaaggcggtggcttccggtgggatgccagcgcgctgcgtggacaggacttcagtgacggcgtggtggccctgctcacctcccgcatccgagagctgagctctgccgcgcaggcactgctgcccatcgccgcggcactgggccatctgttcgacctgcacagtctggccatcgtcctggagcgtacggatgaggaggccgagaaggggctcgtcgaagtgctccaggcgggcctggtggcgcccattgacgacgccgacctcgacagcgggggcacgtatcagttcacccatgaccgcgtgcagcaggccgcactggagctgattccggcggacgtgcatccggagatccatgcccgcatcggccggctgctcctgcggcacacgcccccggagcggctcgacgaagaactcccggagctcgtcagccacttccacctggcgttgcccgtgctccacgacgagcaggagcgccaccgcgtggcggagctggacctgcgcgccggccgcagcgccaaatcccgaggcgcctggtccgcggccctgcgcctgttgaacacgggcctctccctgctcggcgacgatggctggcggaaggaccggcggctcaccttcgaccttcacgtcgacgcggccgaagcggcgtacctcgacgcggacttcgacctgatggagcggttggcagcggcggcgctggcccatgcggtggacagcgcggaggaagtccgcgtgcaggaggtccggctccaatgcctcgcacaccggggcgagcactcacgcggcgtggacctgggcctggaggtgttgcgcaagctgggccagcccctgcccgcgaatccaaagcaaccccatgtgctggccgcggtggcgaagacgaagctgcgcctgggcctgcgcaagcccgaggacctggctgccctccccgagtgcaccgacccgctcctgctcgccacactgcggctgctggtgaagctgtcctccctggccttcatggcccgcccgctgctctttccgctggtggtgctccgcgtgctccagctcaccatccgccacggcgccacgggcgtggccgcgttcggctacgtgggctacgggctgatgctgagcgtgcacctgggcaaccccgaggaaggtttccgctatggccggctggcgctgaagacgctggaccgcttccaggcggagagcctgcgggccatggtgaccttcgtcttcaacctcttcatccggcactggaaggagccgctgtccgcctgcgtcggcgacttcctcgccgccgcgcagaagggccaggagacgggcgacatcgaatacttcggttatgcgtccagcgcgggctgtgccactgccctcatcgcccgggacggcctggccgacggtggcccgcgcatggaccggtaccgggacatcctggccacccaccgccacaagaacgtgctcttcaccgagtacatgcggcacacgctcgactccctcacgggtgccttcaccggcaacgtggaggcccgcgaggaggagctggtcacgccgtaccggcagctcgactacggcaacggcattgccacctgcgacgtgctacgcaccctgcgccgctggctgtggggcgatgcgcgcggagcgctggagagcgccgcggcggtggacgcccaggtggagctcatcgccgggcagatctacctgccctggtacaagttcttccaaggcctggcgctcatggcggtccacccgacgttggggccgctggaccggattcgctcgtcacgggccctggagagca

SEQ ID NO: 931 - DNA, 9185 bp, Myxococcus xanthus
tgtgctctaaagcatggtggagagcgtgctggccatgtccgcctcggcgcacctggccgacggcttggggggcttcacctacgccgacctggatacaccgctgttcatcgcgagccaccccttccaaggcggcgcccgatacgcgggcgcacggctggagttgccaacggatgcacccgggcacggcgtcacgctggcctgagccgcgctccgccgcacgggctgcggtcctgcgaacccggcccgctgactccacccgccgggccgtcgttgccatgaatggtggcgatgtgaatctggttccagcccgtatgcgaatgtgacgcgttggccgcgggcacatcgtggaaaccaacgaaggcggcggtggccatccaaccagccagcacccaacgcggaaagcgctggcggggggcgagcgactgttcatccatggggcgtctcctgaggggtgcgctgcgggtgtcccgaatgggacgcggcgaggcattgcagcggctgtgccgcgtgcctccgccccggagcgccacgccaccgcgtggccggaaccggtcacctgacgcatggaatgaccatgaagtggtcacccgcgagcggactgtgaggcttagcgggccgctcctcgtggggcattcgcgctagggtaggcgcatgaccctggccgtctgcgtgcggtgtggcaactcgaaggtgggcgcgttcaccccctgcacgggttgcggactggcccccgccgcccacggcaccgaacgggaactccaggcacgcagcctgctgctcacggagcgctacctgcctgggggtgagttggaggagataggccggaagattcgcaagggcgagcccgtaacctacgacgcagggctgctcgcgcagattaccgaggacctccggacacagaagctgcccatcgtctcgaagtcatcccctgggtgctccgtcgccttgtgggccgtggtgggcgtgctcctcgtgctcgccgtgggcttcctgctcatgtcgcggctgcgaggcccctgagcgcactgggacagcgtcggccgcaggggccggttagtgaagcagttccgtgctggccgcatccacctcaccgctccggttgttcctcgtctcggaggacccgctcgcccggggggcgctcgcccgggcgctgggggaccagacaggcgtgcacttcgaggtggcggccgggacgcaggtggacctggagtcccaacccggcgagccacccgacgcggtgctgtgggacacgggcctgcgcccgtccaacatggagggtcccgacctgggcgcgccggtgctcgcgctggtggtggatgaagccgcgggcgaggcagccctgggcgcgggggcgcggggcctgctgttccgggacgcggagccctccgccctggtcgccgcgctgctctccgtggcacggggactgaccgtgttcgaccccgcgctcgcggagctgcgcgccacgccgcgtgcctcgctaccggcccaggccaccgcgccgggacgcgctcacgccgcgggagcgcgaggtgctcgggttgctcgcggaggggctgtccaacaaggccatcgcggaccggctggacatcagcgagcacaccgccaagttccatgtaaatgccgtgctcgccaagctgggcgtccagcggcgcacggagaccgtggtccgcgcggcgaagctgggcctggtcaccctgtaggcatcgggccgccacgcgacggtgctacgtcgcgtttcccctgggtgataggctccggcgcgcatggccaaccaggactgggtgacgcgcctgctcaccgggcgcgcgacggcggacaagcagctcaatgtccacctctccgagcgcgacggcggcagcctccacgacaagatgcggcaggcgtattggtggatcaccaacaacgccgtcatctgtccctactacgacctggagttcggctcgtccgcgtccctcaagacgcctgcgggtgacgagctccacctccccgaggacaccagctacagctcgttcgtcctcatccccctgctcaccctcttcacctgccggcgcgcgctgctggtgggcggaccgggacgcgggaagacgacgtccgccatcctcatggccctgctgtccggcatgggccgcgacgaggtccaccgcggcatccagcgcgggcacccgcagctctccatcgcggacctgctgggcgcgccgctgccctccgacatgctcaaggcggaggacctgtccgcggtgaaggtgagctggcgcaagtggattggccagcgcgtcaaaatcatcgacgagtacaaccgcatccccaccaagacgcagtccgcgctcctgtccctcatggcggagggctacgcggagatgatggaccagtacgtctacgcgggccgctcgtcctggttcctcaccgccaacgacgaccagggcggcggcaccttccaggtcatcgaggcgctgaaggaccgcatcgacgtggtggtgcgcgcggtgcccttcaactcgggcttcatggaccagctcctccagcgcctggaggccgacaagtcccccgaggagctgctgcccaaggaaatcgtcttcacgcctggcgagttggagcgcgcctacgccgccatcctggaagtggaggtgcccaaggacgtgttggagcgcatcgccttcttcctggggcaactggacttctgccgcatggcctcgccgcgcttcgagttcaagcacaaggacacgctcaagctggccgggcagacggtggccgcggtgtgcaacgagcagtgcccgctggacaagaaggtccacctctgcacgcagacggagaacggcgtcagcgtgcgcgcgtaccagaccatcctccacttcgcgaaggccatggccttcttccgcggccacagcgccgtggagctggaggacttccggcagattgccccctgggtgctgcacgagaagctggtgcccaacccgcgcagcgccttcttcgaggtgaagggccaccgcatgctcctccaggaccgcgtggcctggctgcggaacatgttcgacatggccatgggccactacgacacgcacgcgcccatccggcgcaaggtgacgacgctgcgccatgagctggacaagggcctgtccggcgtggacctgcgcaccaccgagaagcgcatgaatcaggtgacggtgctcatgaaggagctgctcacacggcacgagctgtccggccccgtctacgaggacgtcatccacctcaagtccctgtacagccgctaccggaactacgcgacgtggctgaaggagaacccgggcggtcgcccatgagcaccttcaccgacgagctggaagccaatgcccgcgcccggttcgtgcgctgggactccgccctgtggcgcgagctcaccggcggcgcagcgcagcggctgggacaagccctgttcgaggcggggacaccagcggcgcagggcgaggagctcttgcgcgcctacctccagttgggcgcggaggccattggcctgggctacctgtaccccacgagcgcgggccggcagaacttcttcaccctcgcctggtcggacctgattccccgcctgctggccgccgtgccctcggcggagcgctcgcaggtgttcgcccagttgtggaacctgggggagaacctggagtccgcgccgccctgggtgcagcgcatcttctggcgcgtgggccgggagctgacgtcgctccaggacatcgaggcgcggctgcgtgagacctcctccgtggccctggagccgcccgacgcgccgctggccgcgcgggcccaggcgcactgggtggacctgtcgaaggaggacagccgcttcctccccggcccgattcacttcctgtcccccaccgtggtgtgcgtgcatgaccggcaccggcaggccgtggcgggccgcgacgcggccacgcagggcatctggctggcggagacgcccgtccgcctgggcgccatgggctgccgcgaggtgccggagcagacccacgtggagagtccccacctggacgaggcactgcgggaggacccgcgcgcggacgcgtggttcgccaccctgtccaatgactggcgggtggtggccacgctgcacacctcccagcacgtgctggtgttcgtcccggaatgagtccgtctcagaagcacatcacccctgaggacgtggccacgggctggcgcgacgcgctggccctgtgggacgtgcgcgtgcagctcagcccacccgagccgcacgtggacttccaccccgacgccagccacgcccaggagccgctcgcatacatcgacctggtgaagcgccaggtcttcgtcaacttcaagctcctggaggccatggaggccacgggcagcctcacggcggtgctggcgcatgaaatcggccaccacgcgcgcttcccgcacacgctgggctgggacgcggagctgcgcgtgcaggagcagcggctggttcccggcctgaagcaatccctcaccaacctcttctatgacttgcaggtgaacgaggtggtgggccgcacgtacgcggaggcgctgtgcgcggtgtaccggggcttccagcgcgtgcagggcggcgagatgtcgccgctgttcttcttctacctggccatctacgaggagctgtggggcctgccccctgggaatctggttcccgccgcgcagctcgagccgatggagcagcgctaccccggtgttcgcgccgaggcgcgcatgttcgcgcagaccttctacgcgctgcccagcggcaagctccagttcctctacttctgcgccaccttcatccgctacatcgagaagcccgcggacctggagttcagcctgccgctgggcggggacgtctccgtgccggacgtggacgacctggatgccgccatccacggcagcagtcgctgggacgacgcgctggacgaagcggaggagcggggctggctggcccccttgagcacccgctcgaaggagaaggacgagctggactccatccaccgcgtcaccgaacacctgcccggcaagcagggcggaaggctgcgacaggccctggtggcgaagcactatcggcggctggtggaccagcacatcctgaagctccccacgacgccgtcccagccggagccctacctgcgcaccacgccccaggcgtgggagtacggcgatgacccgtccagcatcgactggacgttgacggtgctgtcccagggccacctggccgcggtgtcaccactgcgccgcgagctggaggcggacctgccgcccccgtccgagctgggcgcgccgtccgtggaaatctacctggacaccagcggctccatgcccaatccggagctgagcctcaacgcaatgacgctcgcggcccaggtgctgtccgcctccgcgctgcggaagaaggccacggtgcgcggcatcgtgtactcgcacggcaacccgcaggtgtcgccgtggatgtacgacgaggagaaggcgcgcgacttcctgctgagctacatcggcggaggcacgcagttccccttcgacgtgatggacgcgctgtcacgcgagcggcccgatgcgctgcgcatcatcatctccgacagcgacttcctcgcgaacgtcaccgcggagaggcccctggcgccggtgctggagtccatccggcgctcgcgcctcgtggtggccatcctcgctcttcccgacgaactccgcgcccggcaggcgctggcgccgctgctgcgcgagcgccgtttccggctggtggtggtgcgctggccctccgacttcgcgaaggcggccgccgacctcgcccaggcattgctggagaattgagccccatggctttcgacatccgcgagattcagacgcagctcgaggcagcccccatcgtgtcgccgtattcgcatgacctggctctcgccatcatctgcgacaccttccggctcgcgaaggtccgccccccgtcccgcgcggactggggcgccctggaggaccaggcccgctccccgctgtggcgggagcaggtggtgatgctcgcgcacgtgctggtgtcctcggcgctgcggcaggagacggtgcaggcgctgaacaagaacgacgacgcgacgacgctcctgcagcgcttcttccaggacgtggccccgctgacggcggagatgattcgctccaacaccttccgccgcgaggagttcattcgcaagtgggtgcgcgtcgtgggcggcgagtgcaagggcgagtccccgaagggctccgtcgcgcgaatcgaacaactggactaccgcaaggcggaagcggagatgcggcgcgcggaggaggcccggaagaaggaggcggacaaacgccagcaggccctccgcgaggcggagcagcgcgccacggaggcgcgtgggtggcgggagtgacggaagtcctgcccgcggacctgcgcgtcgcgcctcgcgcgaacatccgacgggacacctgctcgcagctgcccccacatcccctgggccgagtccatcgcccagggactggcccgcttcgcgtccctggctgacgaggacgcggcccgcgcggacctggacgcccggttgtccttcctgcgcggtgcgctgcgggactgcgccgtaccacgcccggaggctccacgcggcgggcatccacccgggtgacctccagacgctggacgacctgagccacctgcccttcctggaccgcggggccctggccgcgaactgggacgcggtgcccacgctgccggcggacgccgatgattgcgtggtggtgaagagctccgggtccaccggagcgccggtgaacgtggtgagggaccggcgcgactgcctgcacatgtgggccgtgctgcggttcctcgtggcgcgcgcgggagcggtgctgccctcgcatccccgggtggtgctactggacgcgctgccgggcgggctggagtactcggtgcgcctgcccatcctccacgacggcgcgctgcaccgaatctccgtccttcgcgaggacgcgctccaacgcctgcgccgcgtgcggcctgccgtgctcttctccgacccggaaggactgcggtggctggcggcccagcgcgacgtgccctcgcccgagctggtgctcacctccgcgcaacacctgcccgccggcctgcgcgcagagctggcgaacgcggtgcccgcgcctgtcctcaactactacgcgacgacggagacgggaccgctggcctgggagtgcctgcggcccgaggctcctggccggttccacgtcctggctccggatgtctggttggagcccgaacaggacgaggtggtggtgacgcggctgcgtcccagcgtgctaccgctgctgcgctacctcccgggcgacgcgggcagcgtgcggcgtgacgcctgcgcttgtgggtttcatggatggacgctggagcacttcggcgggcgcggagccagccacttcgccacgccttcgggccgggaggtggatgcctgggcgctggcctgggtgttcaagcaccatgcgctgcgtggcttccgactgacacaagtggacgtctcgcacttccaactggagctggcgggagcgagccatgcggacgtggcgccactgcgcgagcggctcaccggcgccttgcggaacctgggttggacgcaggcgcgcctggacgtgtgtcacgtggaggtatcggcgctggccgtgggcaccaagccacagccgttccgccggctgcgctgagcagccttgcatgacagcgcggcgagcaagatgtcatgcagtgggttccggtgcttacctgagaagtgcgcggctcctccccagcggtatgcatgcagccggccgggagcccgcccctgaccatgcacgctcgtccggaacgacatcacccactctgggcttcacgcgccggacgttatggcgtcgcgctcctcgccttcgtcgcggcgtggctcatccaggcgggcacgatgtcgttcatcccagccaccccgttcctgttcttcttcggcgcggtgatggtgtccggctggtggggtggctggggccccgccctggcgacgacgctcctgtcggtggtggtggtggacttctacttcctggagccactgctcaacctgatgccgggcacgggaggggctgtctcgctggcggtcttcgtcgtgctcgcgctgctgatgacgaagctgaacgtcatgctgcgcaaggccaacgcggagcgggcgcgactgctggagcgggagcgggcagcccgaagcgaggcggaggccgggcaggcacggctccacgcgctcttccgggacgcgcccgccgccatcatcctcatgcatggcccccggcacatctattccttctccaacacgatgaacaacacactgatggggacggacacgctggtgggccaggaggcgagcaaggccctgccgtgggcggagtcgcgaggcttcatcaccctgctggacgaggtctaccgcaccggcgtccctttcacgggcaatgcggtgccgttccctcgcaagcccccccatgacgagatacaggagacgtatctcaacatcgtgtatcagcccacgcggaacgagcagggtgaggtcgacggcatcgccggcttcggtttcgacgtgacggacctggtccgggcccgacagcgcgccgaggccctgacgcacgagctccagctcgccgaggcacgtgactggctcctcgcggagtcgggcgcggtgctggcgtcatcgctcgacgacgagacgacgctgcggaacatggcgaagctggtggtgcccacgttcgcggactggtgcctcgtcgacgtggcggagccggatgggacgttccggcgactggaggcggcacacttccggctcgaggacgacgcgctggccgaggacatcctccgcttcggaatgcagcccagcggcaatccggggcatccccccacgggcgccctgctgaaggcggagacggttcacgtcgagcggttgacccgggaacggattcacgagctcgcacacgacgcggaacacgcccgggtgctggaagcgatagggcccgtctccttcatcgccgtgcccttgattgcacgcggacaggtgttgggggtgctcagcttcatccacgcccactccggccggcattactcgacgtcagacctggcgttcgccaaggaactggcacaccgggccgcgctctccctggagaatgcccggctctatgcggaggctcgggaggccatccgcctgcgcgatgagttcatgtccatt

SEQ ID NO: 932 - DNA, 7005 bp, Myxococcus xanthus
gtgctctaaagagagcgccagggccagcaccacggtgagaccaggccgggcgaaggaggaccgcaggatgcggttcatccaggagtcgggggcctcagtgcgcatggccgtcactccctccgccgctcaacttctccgcctccgccttgagcaggaacgcgccttccaccaccacctgctcgccaggcttcagtccggtgaggacctccacgtcgccgcccagggtgcggccccggcccacctcgcgtcgctcgaagacgccgcgcgtgtcagtgggcaggaaggccacccagccaccttccagccgctggagcgccgccgcgggcacggcggtgatgggcgctcccgggtcccccaacgggatgtaggccgacgcggacatgccgggccgaagttggccgtcggcgttgtccagctccagcctcacggggatggtgcgtgaagtcgcgtccacgcgctgccccacgtggcccaccttcgccatgaactcctggcccggaaaggccgcgaaggtgatgcgggcctgcgtgccacgctggatgcgcacggcgtcacgctcgaaggcgtgcaccaccagccacagcgaggacacgtcaccaatgcagaacagcggcaggttggggtccgccatctgccccatcctcgcggtgcgttcgacgacggtgccggacaggggggcgcgcaggacgaagcccggggggacgttgccaccgcgcagctcttcttcgctcacgcccagggccaccagctccgcgcgcgcggcggcgaccgaggcctcggcggcggcggcctctgcttcggcggcttgcacgtccttgctcgcgatgatgcgctcgtcagcgagcgtgcgcttgcgctcggcggcctgacgcgcggcctgggcctgggcctgggccgcttgcagcgccgcgcgcgccttgcccagctcggggctgcgcaggtccgcgagcttttcgccctgcttcaccgcctgaccggtggtgacgaagacggcgctcacgcgggcggcgatgggggaggccacctccgcgtaggcgtcctcgctgaaggtgagctctcctaggacggtgacattctcaccgcccggtcgcacgcccacgggcgcggtggtgatgcgcaagtctctcaacatctccgacgcgatgcggacgtggggctcgccatggtcgtcgtggtgggcacctgcctgggcggggggctcgtcatgtccgtgcgcttgcgcgtcgtgcggcgtctcgcgcttgcaggcggtgagcaggaggagggcggccactgcggcgtggaggggcttcatggaagggctccggtctccacggccagttggacgcgggagagggctgcctgaaggaggctgtcgaggtaggcggcacgcgcttccagcgtgtcgcggcgaacgaggaggaactcggcgaggcccatctctccggcttcgtaggagcggcgagcgagactttcgttgtcactgagcagcggcagggcgtcggcttccagcagcgtcacggcttccagccgcttgcggtgctgcacgcgcgcggcctccacctggacgtccacttccaaccgggccgccgccagcagggattggagccggcgcacgcgggcctcgcccgtcacccgggcgttgtctccccggtcgaagagcggcagcggcacgctcagggcgccgaggtaggcgatttcatcaatctctcgctggtacagaaaccccgcggtgatgtctggccagacgctcgcccggcccatgcggcggtcggcatccgcctgggcgagctccgcttccaacgcggcgatatcgggccgcgccgccacggtgtctgtcttcgcctccgtgacaggctggagcgcgagcactcgcagctcaccgcggatggccaacggatgtgtgagcggaaggcccaacatcgcgcgcaactggtggagttggacggcctcgtccccctccgcggtggccacctccgcgcgcatgcgggccagggacacgcgcgccacgttgacgtccaccacgggcacatcaccggcctcgaagcgccgctgggcggagttcgcggtctcccgggcggcggcctcggcttctcgcgcgaggctcagccgctcccgcgcatgcagcgcctggaggaagcgcgcggcgacgtcacccagcacccggcgctcggcgtcgcgctggtgggccgtcgccatctccagaccggcgcgcgcggattcccggcgggcgccgcgctttccacccagctcgaaggactggctgatgcccacgctcaagtccaacccacgcacggcggggtttcccggcgagccaggggcactgcgcgggcccgcctggagctcgaaggtggggttgtcgttcagcagcgacctggcggccgccacggggccctgggcctcggcggcgcggcccgcggcatccagcagcgcgggtgcacgctggcgggccaggaccagggtttcttcaagggacagcgcggcatcggcggagcccggctgggccgcggcgacacgcggaaataggagtgtggcggcgagcccgaaggctgccaccgtgagtggatggggcacggcgatgacctcgcgaaaaggaggcgtgcgtcaggtggagcgtgccccgcgatgacacacgggcacacccgtcctggcggacacgagcgaacgagacggcggacgcgacctacgcgaggggggctatcgggacgtggaggatgtcgcgcccgtcggccgacaacggttcggccttctcgtaggcgacgcgcaagggccgcgacacgagtagcacgaaggaaagcggcggggcatgcgcggccacggtgcgcacgtgggcacagcaggtgcagtcgatgcagtccggggcgcactgcccctggtcatcatcgtccgggcagctctgcgtgcagacctcgcccaccgcgccagtgagggtgggcatcaagccccccaggcccggggcgaacaggaacaggcagacgatgagccagattcggagcacgctggcgaccttctaccacgtttccaaacgcgatgcgtgcgaggggctcacgctcagcgagcctcctcgcacgcaggggaagacgactgtcaggagatgcccttgcgcagccggttccaatcgaagttgggcgccgggtcgttcttgcggcccttgggaaccgccacgtcggcgtggcccacgatgttcttcatcggaatgttgtgctgctgcttcaggtaaccggtgagctgggtgagtgacttgtactgcgcctcggtgaagggcgtcttgccgctgccgtcgttcacgatttcgatgccgatggagcggttgttgatgtccgagggcacgccgtgcagctcgcccttgcccgcgtgccaggcgcgcttgtcgtcaccgaccagctgatagatcttcccgtcgcggtccaccatgtagtgcgcggacaccttgctctgcggattgcgcatccacgacaggtcgcccgcgccgttgttggtcgcggtgtggtgcatgacgatggtgtcgatcttcgtcccgccgcgcgagttctggttcggcgagggcgcgttgatgaccgcgggcttggtgaacttgccgcccggggtggtgggcgtggtggggccgctggtgcccagcgccttcttcagcgccgcctgcgtgaggtcaccgtagaaaccggtggtgggcagcttgttgtccgcctggaacttcttcaccgccgtttccgtctgcggaccgaaggtgccggggcccgtggtcacctgggccttcgtcatgtagcccaccttcacgagcgcatcctgcagttgcttcaccttgggcccggagtcgcccttgcgcaggcccgcgggcggcgcggagaccgtggaggccgcggcggcggcggtgcgaggggcctgcgcctgagtggcgcggaacacggaggagagcgagggcaggcgaaggctcatgaggagggcttccagggggtagaggctgcgtgagtctgcccggattatcggcgcccagcccccgggagttgcgtaactcccggggcgaacttgagtgtctagattcagccggattgcattttttcaggctgtctgagtttcggcgggcaggggtggctctcctgtgccttcctctggctgttcctggggaaggtggcgccgcttccagagggcgaagatggccggatacacggtcagctcgagtaaaaacgacgtcacgagtccgcccaccagcggcgcggcgatgcgcttcatcacgtccgcgcccgtgccggtgctccacagcacggggagcaggccgatcatgtccgtcatcaccgtcatcagcttgggacggatacgacgcgccgcgccatcaacgatggtctccgtcaggtcagccatggagcgcagccgtccctcctggtccgccttcttatgggccagggtgaggtagagcagcatcaccacgcctgtctccgcgtcgagtccggccagcgcgatgagccccacccacacggcgatgctcatgttgtagtcgagcaggtacagcagccacaccgcgccaatcaggctgaagggcaccgccagcaggacgatgcccatctccaccacggacttcgtgctgaagtacagcagcaggcacaccagcagcagggtgacgggaatcaccaccttgagcttctccgtggcgcgctcgaagtacttgaactggccgctccactccacgcgcacgccggtgggcgtcttcacctcgcgcgccaccgccgccttcgcgtccttcacgtagtccgcgatgggccgcgcggtgtccacgaagacgtaggtgacgagcttgccgccctcgctgcgaatcatcggcgggccctgcacgaagcgcacgtccgccacctgggccagcggcacctgcgcgccggccggagtggggaccagcacctccttcaacagttcggggctgtcgcggtactcacgcgcgtagcgcacgttgatggggtagcgctcgcggccctccaccgtctgggagacgttctctccgccgatggcgcccatcaccacctcgttgatgtccttcacgcccaggcccaggcgcgcggcctcttcccgcttcacctcgatgtccacatagaagccgccggtggagcggtccgcgaacgcgctgcgcgtgccgggcacctgggccacggccttttcaatggccaccgctgcctgctccagcgtgtccaggttgtcgccaaacacctggatgcccagcggacttcggatgccggtggccagcatctccgtgcgcgtctggatgggcatccagaagatgttgggcatgcccgggtactggagcgtctcgtccatctccgtcagcagggcttcccaggtgaggcccttgcgccactcggacttcggcttgagcaccaccgtcgtctcgaacatggacaggggcgccgggtccgtggccgtctccgcgcggcccgccttgccgaagacgctgaccacctctggaatgcgcttcagctccgcgtccatggactggaggatgcgcgtggcctcggtgatggacatgcccggcggcgaggtgggcatgtagaggatggcgccttcgttgagcggcggcatgaactcatggcccagccgcatgaaggctggcaccgtcatcgccatggccaccacggacagcgccaccaccaccttggcgtgccgcaccacgaagcgcaccaccggcatgtagagggccaccagccagcggttgagggggttctcgtcctcccggcggatgcgtccgcggatgaagagcaccgccagcgcgggcgtgagtgtcaccgccagcaccgcggcgaagcccatggagtacgtcttcgtgtaagccagcggcttgaagagccggccttcggtggcctccagcgtgaagacggggaggaaggcgacggtgagcaccagcagcgtgccgaagatggagggccccacctcctgcatcgcggagatgatgacctcgcgccgctcgcccgggcggccttccgcctcccacgcctccagcttcttgtggatgttctccacgatgatgatggaggcatccaccattgcgccaatggcgacgatgatgccgcccaggctcatgatgttggcggtgagcccctggtagtacatggggatgaaggcgagcagcaccgccaggggcagcgtgaagatggtgaccagcgcgctgcgcgcgtgcatcaggaagaggaagatgatgaggctgaccaccagcatctcctccaccagcgcccggctgagcgtgctgatggactcctcgatgagccccgagcggtcatacgtgacgaccagctccacgccctccggcaggcccgcgcgcacctcctccaggcgctccttcaccgcctcgatgacggtgagcgcgttctccccgtagcgcatgacgacgatgccgccggccacctcgcccttgccgtccagctccgcgacaccccggcggatgtccggccccaggctcaccgtggccacgttgcgcaccagcacgggcgtgccgtccgcgctcaccttcagcgggatgttctcgatgtcctgcgtggagcggatgtagccacgccctcggatgatgtgctcgtggcccgcgatttccatcacccggccgcccacgtcctcgttggactcgcggaccgcgcgtgtcacctcgcccagcgtcacgccgtaggcgcgcagttggttggggtccacctgcacctggtactgcttgacgatgccgcccacgctggcgacttccgccacgccgggcacgctggacagcgcgtagcgcacgttccagtcctggaggctgcgcaggtccgccagggagtgcttgccgctctcgtccacgagcgcgtactggaacacccagcccacgccggtggcgtccggacccagcatgggcgtcacacccgcgggcaggcgtccgcgcgccgtctccatgtattcgagcacgcggctgcgcgcccagtacatgtccgtgccgtcctcgaagatgacgtagatgaaggacatgccgaacatggactggccacggacggccttcaccttcggcgccgacagcagggaggaggagatggg

SEQ ID NO: 933 - DNA, 7170 bp, Myxococcus xanthus
ctcttcgaacatgcttttggcgaagttctccatgaagaaggtgggcccgaggatggtgtagggcaggccgctgccggcgcacgtgcatctcgatgcggtgtttgctgtcgaagtgggggatgcccgtcaggcggtccgctccggccaccgacgagtagacgtagtgctgtacgcgcgcgagccgggccgcgtccgccaggttcttcccgtggcggacctccgcctgcacgccgcccgggccaaagggcgtggcggtggcgaacatggtgtccatgtcctgggccgcgtgggcgatggagtccaggtcgtcgtagtccccgacgaccagctcggcgccgagcgactcgagctcgcgggccgtgggggagtccgggtggtggatgaaggcggtgacgcggtggccgcgctgcaagagcttccgtgtgacggcacccccctgctggccagtagcgccggtaacgagcacggagcgtgagaaacccatgggcatgtgtgcacctcgtgacgtcagatgtccggaagttggggatgacggacgccgctggcgagcacaccgtgggcgcatcgagcctcacggccaggggttgccgggccagcaggcgacctggggtgcctgcttccctggcgcgctaccacgtcgttccgaagacgcttgggggcactcggtgcctgcttgggtgcggcgccttctcttgggaaatgccatggtcccgcccacgatgagcaagcgtgacaagcttcaggactccgagctggtggttgccgcccgggcactcgacgcggagttggcgcgcttcgaatcccaggccgagcagctcgagaaggcgccacttcaatccgagaagcacctggagcgcgcgtcggcgatgctgcaggggctggcggacctggacgagcagctccgggggcgggtgacggcgctggtgggggccatctcgaaggtgagagatcggcagcaggcgcaggccgaggccatccacctgcgtgcgcaggagctccagcggcgcaccgaggtcttcaaggacctgctcgtgcgttatggcgccctgggacagaacgcgggcgagctgaacgtgcagatgcagcagttcgcgcagcagcggcaggcggcgaagacaccggaggagaacgccgcgctggcggggaccttccaggcgctccaggagcggatgtccctggtcgcggacgaggcccattcgctggcgcaggccgcggaggaacaggcgttcctcgacgtggcccgggaggcggactccctgcgtcagcaactgttgtcggcgcggaacaagatgtcgctgttgcacaacagcttcggcggcggggcggctagctgaggtacgtgggggcgaagtcgtccgggctttcgatggggcgccgtcccgagaagccgtcgagcagagcgtgccagtgggagacggcggggtctccgaagcgccagcacaggtagacctgctcaccgccccggtgggctcggaagtcaacgaggccgtcggcgcccttgatttcgaggcccatctcttggagctggaggagctcgccgcggatgcgctcgaggagggtgtcgcgctcgtcgcgcagggaggccaggctcgggtcgttgggcttgggcgcggcgcccagttcatccgcgagctgctgggcacgctccacccacgggcggacccgctcgaaggtgcgcgtcagcagcggcaccagccgattggcttcttccacgctgaagtagcgcattccctcgagcatgcatcggtatggcccatcgccgctactgtcctggcgcgggggggacgtctgcctgtcgcccattcagcgctgggctgtgtcacggggggaatgggatataagcggctatcagtcacttcaagtcagcctttgctgcttgaatccgcctcacatggaggactcattgtctgtgagacttgcggcggcgttcgtgctgtgctcgctcggatgttcgagtgcttcgctccaaacggaggcgtccgacgactacgggttcgagcctggggggcggcacgtatgggtacgtggcccttggacggacatcgaaccgtccagtgacgtggacgcggttatcgaccagctatgccctgcggtgatgcgacttcctcgcgcaagggaacgagattatggccaggaatactgtggccttatctactccttgggcgacggagtcttctatgccagcaagggctcgcccttgggggaaacgcagttggtgggagcctccaggcgaaagtcgtgtttttcgcctcgtcgtgtagtcgatgggcgtggacgaactgttcccttggcggatttccatagccatccctggtcaccttcgcccatgtcccccaaggaccgacagggtggcaatcagcgatggttcatcaggatccagttcgatacgtcatgtcacctccaaaagctgataccccatattggcgagacgcgaccaggtgaggtctatgagcgtgtggacagacgatggaaactcgtggggatcatcaagcccgagaacaaggcagttggccgcatcaccgcgattgagaacgtgcgagactaagatgcgcaagggtttgctcgttccgctctgcttggcgttgcttccaggctgcgcgttgtttcggcccgcgcctcggcccgcgaaggcgcctcccgacgaagcggctcgctaccgatttcccgttgtgcttcccaccgatgggcagcacgtcctgccaggcgcgattgccgctgccatcgcattcgcaatggaggactttcttccgttgggggcgaagccgcgtcgaggcgctactcccacggaggtttgtgcctcccagcgccagtcctacgacgtgacggctgttcctggggcgaatgccgtggtcttcgtcagcttcttggcccggccggacgcatgccgcgacatggaagggccacctctctcggacgttcccatcgtgtacgccgtggatacggctacgtgggtcattctctccgtgcagaagtagcgcggcccgcgccagccgcctcctcgctatcggccgcgcagcagggatgcgtgattgtcgcccagccagcgctgggctgtgtcacgcagcgggaacagggcttcgcgctcgcgaaaggccgacgtgtgctcgggtgcgcagcggccctcgttgcccgttccgtcgtcgaggtccgcgtgcagcatcgcgtggaagacgaggtagtccaccacgaaggcgggcacatgcggccggtccagcgccgggtggattcgaatctcgcgtagccgcgcgtcatagccgcccacgtggatgctgcgacgcttcgtgcccgccggcttgcgcgcccagcccacgtccacctgcacccggccgtcgaaccagctcgcgttgagccgcgtgaagatggcctgcaggtcgaagcagcggccccgcgtgcgcagcggctttcccggccgacgctccctgcggactcgctcgttgtgcgcgtgcgcgtaggactccagcacctcgcccgcctgcgcatccgcccggcccgcataggccgccatggcctgcaccactgcgtccggtgctcccaggaagaggtgatggatgcgcagccgcagcccctcctcaccccggcggaagctcaccagagtggcccggttgtccgtgagccgtaggtgaaccggcaagccaagaatcgaagacaaccgccgtgccaggtccgccgccagcggcagggcttcctcgcgcgcggggagtcggctttccggcacgctgctcgcgcgctgctccgtcgccagtggcaacgcttcatcacgctcatgcacgggacgccggtcctccgcgctggtgcccgcgcgctgctccgttgccagaggcaacacttcctcacccgagggatgtcggcgctgcacgccagtgcttacaggccgctccgccgccagtggccgcgcttcctcacgcgccggaagcctgcgctgcacgctggtgctcgcgcgcggctccgcctccacgtccgcgcactcagtcgccgccgtgtcgaacaagcccagctgtgaggtcgggtgcgaggacatccaccttcaaaggtaagcctcctggcgcaaggattccaggaggatggttgctccccgggcggagaggcggcagtcgctgttcggaaatgtcgggggttttgcttcgtcgccgccttgctcaggacgtgcggcagagccggtccacccggttcagcatcgtgggcgtacgagacgccccatgcatccgccggatgtgctccgccgcagtggccgcgtccatacccgccgctccgacgaacaacggccgcaggctcttcccccgcagcacgggcaccgagggccccgtggtgacgtaggcggtcttcgccacgccaatgacgggcacctcccggttgagcgcttcgtacaggtgcgcccccagcccgggccggtcctcgccgagccacgcgtagccatccacgatgatggcctccaagggcacttccacccgcgccagcacccggagcaggtgcggcagctcgcggcggtagaactgcccgggctcgtacggcgcggcgggaggcccatgctccaccaggtgcgagacctcgtgcccatccgtccagttccggaacagcacgcacccggccacggtgagttcggggcggtagtccacgtccacgcaggcgagcatcgtgccgtcctcctgtctcagggcgcctggaagttctcgaaggtgacctgcgcggcgcgaagttgcttcaccatctccagggacggtgtttccgtggtgcggtagcgcgggggccacagctccggcaccggcgtgagacaacggcccgcgatgcgctgcacctcccgccacggcacggtgaagaactcatcaccttccgccgcgggacgcacggcgaccatgtccgcctccggcagcagggcgtccacgtcgtgcgaccagacacaccaggagatggggaactcgtcccgcttgcgcgccgtcgcgctgtagctggcgacgaacaggtccacctcctgttccgcatggagcgcgtcgagctcctccttctgggcgctgtactccgccagcgccaggcggacgtgggccagccgcacccggttcgccagcacgtcctgaccgggatgcacgtagggcaccacgcgtcccgcgtcgtccactgtgtacagggcgggcgtcaggcatcgggacgcggccgcgtactcccgctctgcgctctcggtcagccgtgccaccagctccggacgcgcgtcgccaccgatgagcagggtggagcgctccgggaggatggcgatgggtcggccctccacgcgactggcgaaggacgcgaggaaccccgggcgcagcagccgggacgtctcgtaggtatcgcgcgtctccaccgtccacagcgggccgtgctcctcgtcgtagagctccacgccttcgtccgggagccgggccaggttcgcgtgggccgccgtgaaggcttcgtcctcggtgacgccccaggtctccaggtgccggcgctggacgaacatggcggactccggcaggtccatcaccagcagctcgcgcaggaagggcagtgtccgccgtcccaccatctcccggtccgcctccgccggcttctgcagcgacatgccgaaggtggacgcgcgcagcacgggcaggagcaactcgcgggcctgctcccagtgaagcgaatccggcgactcctgccacagcgcgcgcaggtagcgctggatgagctggacgcgttgctcgggcggcagctcgcgcgtgtccgcgaagaggttgtccaggaagaaggtgccgtcacttccggcacgggtgatgtccaggccgtagtcctgcgtgcgccgctccaccttctctaccgccgggtcggcgcgcagcagcgcctccacctgccgcatcagcgcttcgcgcggctccaccgcccaggccttggaggggccgggaggaacctcgccggccgctggtgtcttcctcccgaaaagcctgccccagaaccccattctcgctcccacgtgtgtgtccgcggcgaggttatgtccggtggcccgtgggctccaccggaacacgcaggtcccgtcacaaagccaggaatgccagtaatgcgcccaagtcctcgtcagacagggactccaggctgtagagcggcatgttgcccccgacaccgaagaactggccgtgcctcaccttctcgatgacgaccagtgacttgggcacgccggggaacagcgtgtcgtagtcgttcgtcacctccggcagaatcgacgccagctcggtcagccggcccgcgccggtgtggggctcgccgtggcagctctggcatgcctccacgtagacctgctgtccgcgcgtcacgtcaccgcgcgtgacttcgacgatgtccttcaccaccgtgaagggacgggccggagcggacgggctcgggctgatgctcaccaggtattcgtacagcgcccggctctgcggcgagtccttcggcagcggcgtcacaccccgcatgaagttgacgtagcagaagttcaccgcgtccagcaggcgggtctcgaagccgccccaccagctctcccggaacgccgagtcatacagcgtgtagccggagtccatccgccccgcgggcgcggtgggcgtcgtcgcgtggcatgtcgcgcacgagaagctgttgaagccgctctccgacagccgcgagtcgttgaacagcacctcgccgtactccgccgccggcacgcggccatcgccgctgtcgtcgcagccggtcagcgccagggccagcgccaccacaccccatgccgcgcgcttcatggctgcccccgcaggatgctcaccgagtccgggaagatgcccacctccaccgtgcccaccaccgtgccttccgtcaggtccaccgcgtgcaacgtgcccggccccacgtggtcgccttcgcagacgaccaggccgatgcgctcgtcgggcgtcagcgtgacttgatgcacgttgagacagccggcgtccgccagttgcacctcgcgcagcacggtgcccgtctccgggtcgatgacggccagcgcgtccaccaactggtagggcatgtacagcgtgcgcccgtccgcggtgaacgcgccgaacatcggcggacccgcgcagcgggacggggcgctcatgcatcatggtgcgcgtctggggattgagcacgtgcacctgccggatggccatggagctgacccagacctggcccgtggcgggggat

SEQ ID NO: 934 - DNA, 7950 bp, Myxococcus xanthus
ccgagttgggcgtggagcaacacttctggcgcgtcgccatcaagccgggaaagccgctggtggtgggccgtcgtggcgccacgctgttctttggacttccgggtaaccccacctcctccctggtgacgttcgagctcttcgtgcgcccagccctccgcaagctgctggggcatgcgcaggtggggcctgggcgcgtagccggacgcctggaaggcaagctttccaagccctccggcctggcgcatttcgtccgcgtcacggctgcttggagagaaggcaacctgtgggcccgtccgctggcgacacaaacgtctggtgccctgcgttctgcggcggcggccacccacctgctgcatttccctcgggaagccagcagtttgacggagggggacgcggtagaactgcttccgctctcatgggtggcctgaggaacgaaggacgccgtggagcatcctcttgggggctcgtgctcgaaagcacgagccgccttgacttgagaacctgaggactccaaacaggggcccgcatctggagaggactcaacatgtcggacacacgctcacctcaggtccttccgacccgtaagcacacgcaacacctggaacggttctcggaggcggacatcccgaccgagcgcggctcgctgcggaccatcgtgttccgggacaagcgcaacgggcgggagcatgtcgcgctcgtggtgggacaggtttcaggacacgagggtgtgccggtgcgcatccactccgagtgcctcacgagcgaggtcttcggcagcctgaagtgcgactgccgcgagcaactggaccgctcgctcgacttcatcacccaggcgggacagggcgtcgtgctttacctgcggcaggaggggcgcggcatcggcctggggaacaagatcaaggcctacgccctgcagtccaagggcctggacacctacgaagccaaccggcagctgggtttcgcggacgacctgcgcacctacgacatcgcggcggagatgctgcggagcctggatgtgcgctcggtggacctgatgaccaacaacccgctgaagatcgcgggcatggtcgaagaaggcattcccgtccggcgtcgaatcccttcccggaccgagcacaatccgcataacgtcgactacctgaggacgaagcgcgagcgtacggggcacctgattgagctcttcgccgaggacgacgacacggaagccaagacaggctgagaagcccctcacgaggcgacggaacaccgtcgcgcgcaaccaggtccgcgtgcccttcgaggtgcgcttctggggtgtgcgcggctccattccttcaccgggcgcgcacacgaagcgctacggcggaaacacgccctgcgtggaggtccgctgcggggacgagctgctcatcttcgacctgggcaccggcgcgcgcgcgctggggcatgcgctggtggcgaagaagaagccggtgaagggctccatcttcatctcgcactaccactacgaccatctgcagggcctgcccttcttcgggcccatgtacctgcccacgagcgacctgactgtctacggcccggcgcggcacgggcagtcggtgaagcagctcctcagcgggcagatggtgccgccgtacttcccggtgacggcggacggcgtgttccgggcgcagctcacgtacacggacctggccgccacgcagacgctgaagctgggcccggcgacggttcacaccattgagctgaaccacccgggcggcaacatgggctaccgcgtcgagtgccagggccgctcggtggtgtacgccaccgacctggagcatggcagcgacatggacgcggccttctacgcgttcgcccaggacgcggacgtcctcatctacgacgccatgtacaccgaggacgagtaccacggccgcaccgggccggctcgcaccggctggggccactccacctggcaggccgccgtacacgcggcggacgaggctggggtgaagaagctggtgctcttccaccacgacccgtcacgagatgacgcgggaatggaccggctgctgcgtcaggtgcgcaagcaccgccccgacgccatcgccgctcgcgagtccctggtcatcaagctgtagcgcgcttcaccgtctcccgcaggccctggaagggcagccgctccagggccgtggggacgtccacccactcgaaggcgtcgtgctccgcgcccaggcgcacgtccgcgtccggcggcacgtggacggcgaagccgttctcctccacgagttgcggtggcagcgcctctcccagggcgaaggcgtggcggtagtccaggtccaccagcggcacgcggaggcctgtctcctcctccagttcccgcgccgcggcctgcgctggcgactcacccgcttcgagcctcccggtgaggacctgccagaaaccgccccgctccgggcgacggcgcacgagcagcacccgtgcttcgggaccacggcccttcaccaccgcgatgctcaccgtccgcatcggcggcggcgcatccacgcgctcgctgtcgaacacggtgcagaagctgttggcgatggcctcttccacctccgccatggggagcgcgcggcccaactcccgctgcatggacgtgacacctgcttctcggatgccacacgggacgatgagctggaagtggtccaggttcgtgttcacgttgagcgcgaagccgtgcgtggtgagccaacgcgacaggtgcacgccaatggcggcgatcttccgcgcgtccggagcaccttccgcgccaatccagacgccgggccacttggggatggggcccgcggtgatgccccactgggccagcacctgcatgacggagcgctccacgtcgcgcacgtaacggcgcacgtcgcgtcggtcctccggcagcaggaagatggggtagcccaccagttggccggggccatggtaggtgacgtcgccgccacggttggtctcgaagacctccgcgccctccttcgccaactgcgcgtcgctggcgacgatgttctcacgcttcgcggcacggcccagggtgaggatgggcgggtgctccaagaggagcagcacatcgccggagagcccctggcggcgcgactcgctgaagaggtgcatcagcgcgagcccgtcctcgtactccactcggcccaggcggtagacggtgatggtgttcatgacgttcgcttctttcgagccttccgcgtgggcgagggcttcacggtgggcgccaggctccacgttcccgtgggtacccggttgaggagggcatgcagctcatggccggcgcgcggcgagcggctggcctcctgggccagcgccatgagcacttcttcggagacggagaccgcgggctctcgcgaggccaggcgctggcgggcaatctccacgaattcagacggtgtgggcacctggagcgacaggagcacctgcacgtgctccagaatgtccgtgggcacggttccgcgcacggcctgagtcagcgcggcggtggtggacacggaaacactgtatgcgtctccgcgcaggctcaggccccgagcctccgtgcgcatgcccctcgcgctcagcaggacgacggggcggctgtcccgggccaggaaggcctgcagggccgcgtgtgacgtcgcgtccaggcggtccacatcctccaccagcagcgtgcgcgaggaagccgtcaggtccaggtccgcgacgggggtgatgacgcccacggcctctcgctggagctgctggaaccagacgctcttgccactgccttcgggcccgatgaccaagagggtccgcgcgtgggcctcgagcgactgcgtcagcagcgcctgcgtcacgccctgccccacgagccccaaggcaggtgtcacgggccgttccggccgcgacaccgtgggcggaggcaccaaagtgacgtcgcccagcagcgattgcgactcgaacaggcagttcttgcagatgaacgcgcccgcaggccccgcgaccaggccccccgtgtccgtacgcggacggcaacagaaggagcaccatgcgtcgagcgcggcatccgcacgcgtagggccgcgctcgacgagccgagcctctctgcgacgccgaggctgggcatccgtgaggatgtcctctcctgcgggtgcttcctctgcctcacccgccattcgagatgacgcaagctgcgtcgtgggctcctcgacgcccagaagttcctgctcgcccacgccatcacccggtatggacgcaacgccgccccgcacgtccacagtcgcatccggtggcgacgaggaatcttccgcccctgcgaccacccccgcgatgcgcgcaatctgcgcttcgagccgctgcagatcttccgcgacctccgtctcgatgacccaggcctgggcggcgtcgcgcggcgcgtcgtcaccggcgtgcagggccgcctcgcgcagcgcatcctcgatgagccgctgccggtggacgacgtccggcaacacctccgactccagggaatgcaccaccccggacgcaggcaatgcctcttcgtcgtcagcgtctgccccagaccgcgtgagcgaaggctccggcatccactccagccggttcaccgcatccgcgatgtccgcgcggctgccgtccaaccgctgcgcatggcgaagcaactgcaacgcgcgggacggattacctgcctgtcggcacagctccgccgctttctgcaggcactccaccgcacgggccacgtctccctgtgtctcggcggactgcgcggcgcggatcagctcgcgagggttctcggccatacggggagagcctaaccggctcggggcacccgcgcgcggccctcgaacgcgggccccagcatcaggcgcttcccggcccggctccagggccaccacgcccctcacgtcaggggcgtggacctgccacggcgctcacctcacgccatggccaggaacagcaggtccggcttctccaggtacttgatgatttcgtacgtgaaatccgccgccaccgagccgtcgatgacgcggtggtcgcacgacagcgacaggttcatcatgtcgcgcacgacgacctggtcccccaccaccgccgggcgcttcttcaggcggtgcacgcccaggatgcccacttcagggtggttgatgatgggcgtggcgaacaggccgccgctctgccccagcgagctgatggtgaaggtgccgcccgtcagctcctccatcttcagcttgcggtcacgcgcggcggcgcccaggcgggccgtctcacgcgccagctcggccagcgtcagccggtccgcgctcttcaccaccgccacggtgaggccgtccggcgtcgccgccgccatgccgatgttgaactcgccgcggaccaccagctcctgcgacgcctcgtcgaagttcgcgttcaggtgcgggaacttcttcagcgccgccaccgtcgccttgatgatgaacggcaggtagttgagcttgatgttctcaccggccgccgccaactgcgcgttcagccgcgcgcgcagggccaccagctccgtggcgtccacttcctcgacaaaggcgaagtgcggcgccgtgaacttcgaccgcaccatcttctccgcgatcttcttgcgcaggccccgaagcggaacgcgctcgtccgccgcgcccgagctgacggcaggagccgcgggacgcgccttctgctcggccggagccgcgacgacgttcttctcgccaccctccagcgccgccaccacatccgccttcgtcacgcggccctgtggccccgtgccggcaatcgacgccaggtccagcccgtgctcgcgcgccatccgccgcgtcaccggcgtggccagcaccttggacgccgaggcaggcgcaccaccgacatggccacccgccacgggcgccgccgctggcgcgctggcctcggaatgaccaccggcctgcgccggcgcagcgccctccacctccagggtgacgaggagctggtgcaccttcgccatgtcgccttcattgccatgcgtcttcacgacacggcccgccttgggagcgggaacggtgacggtggccttgtccgtcatcacctcggcgagcacctggtcttccttgacggaatcccctgccttcacgtgccacttcaccagctcaccctccatcacgccttcaccaaggtcggggagcttgaattcgaagatcgccatggggtcgtctttccgggaagcaggggtgttgggtcaagccatgaatcggagcgtcaaagctcagccgagccgctcgagccgctcgcgctccatcaggcccttcatgaagaactcagcggcccggtagctggaccgcaccagcggaccggaggccacgtagaggaagccgtaggactcggccagcgtcttgtacgcctcgaactgcgcgggcgtcacgaagcgctccacgcgcaggtggtactgcgacggctgcaggtactggcccagcgtcagcacgtccacgcccacgtcgcgcaggtccttgaacgtctgctccagctccgcgtccgtctcccccaggcccaccatgacggacgtcttggtgtacaggccctcggggcggttcttgaggtactccagcacgcgcagggactggtggtacttcgcgcgccggtcacggaccgtcggcgtgaggcgctccaccgtctccacgttgtgcgccaccacgtggggcttggcctccgccacggtggtcaggtccttctccacgcccttgaagtccgggatgagcacttcgacgatggtgcgcgggctctcccggcgcagctcgcggatggcggaagcgaagtggctggcgccgccgtccggccggtcatcccggttcacggacgtgacgacgatgtactccaggtccatctccttcaccgcctgggccagatggatgggctccatcggatccagcggaggaggcgcgccgaccttcacgtggcagaagcggcacgcgcgcgtgcacacctcgcccatcagcatcaccgtggcggtgccaccgccccagcactcggcgatgttcgggcagcgggcctcttcgcacaccgtggccagcttggtgcgcttcacgatggctttgacccgctcgtaaccttctccgtgcgggagccgcaccttcagccactccggcttgcgggtggtctcagtcacctggggcagagggaaccggtcgggagtcgccatggatcgcgggccttctatgggttggacggaggacgttcaagcggaagccactgacgcgaggcgtcagcatccaccagtcgtccgccagttgtcgcctctctactaatgcccccggttcctggggacaggcccggagcatctgcgagggcggctaggcaggggaccgtcacctcgcgcggccgcgggggccggaaatacgaggggccgtccacggcacaccgggacggcccctgggactgcgagcgaggcgccgccgcctagaagtggcgcgggtggcccagcgtggcctcggcaccctcgtgcacgatttccgagagcgtcgggtgcgcgtggatggtgttggccagctcctcggtggtgatctccagcttcagcgcgacacacgcctcggccagcagctccgtcgcgtgcggcccgatgaggtgcacgccgaggacctcgtcgtacttccggtccgacacgatcttgatcatgccggtggcctcgttggagatggaggccttcgtcacggcgcccatcggagcgatgccccccttcacatcgtagccgcgctccttggccttcttctccgtcaggcccaccgaggcgacctcggggtagcagtacgtggcagacggcgtcaggtcgtagttgatgggctgcgggttcttcccggcgatgtgctccaccgccaccacgcactccgcgctggccatgtgcgcgagcatcggcgtggggatgatgtcgcccacggcgtagacgttcggctcggaggtgcgcagcatcgagtcgaccttgatgtagccgcgctcggcatggatgtgtcgctttagaacaca

SEQ ID NO: 935 - DNA, 10096 bp, Myxococcus xanthus
  unsure (1)..(10096): unsure at all n locations
gcttcgaggaccttcgacggcctgggcaaagcaccgcacggtggagaacggcctgacggtggatgcctccggagccgtggaactctccacggggacgatccccttcacgggcgccgcggcgctggcgcgcgtgctggcgaccagcgacgacgtgggggactgcgtgccgctccagctcttccgcttcgccatgggacgtgacgaatcccccgtcgacgagcacatgctggccgacatgcggtccatgttccgggccaacccggagtggcgcatgggtgaggcgctcgttggcctcgtgcgctccccgtatttcgtccaccggcgtacctcttcccccgagtagcccccatgctccgcgaactttcccgacgctccctgctccaggcgctggccggctcgacggcggcgctccccttggccaacctgctcggcaccaccgacgcctacgcccagggcaccgcgccgccgctgcgcttcgtggccctgttcacctcgcacggctgcctcccggagctctggaatccccagggctcggagacgaacttcacgctcgacttccccgactccatgctcgcgccgctccagccgcaccgggacaggctcctggtgctggacggcctggattatcaggtcctctacgagcagggcctgacgggccatgaaggcggcccggtgacgttcctcaccggaagcaaggtcaacaccggcagcggggaccacctgccggagagcgcctcgctggaccaggtgctgggcaaccacatcggtggtggcacgcgcttccgctccctgcagctcaacgcctgggagcagttcggcggccagcacgtctacaacagcatcagcttcactgcgaacggctcgcgcgtccccttcgagcgcgacccggccaacgtgtaccagcgcctcttcggtgacgcgccctcgccgaccgccgacccggcgcaggtggcgagcaaccgggcgcgccgcaagagcctgctggacttcctgatgaaggacgccacgcgcctgcgcaaccgcctggcgggcgccgagcgccagaagctggagacgcacctggaggcgctgcgcgacatcgagcggcgtctgggggcgctggccgtggatccgacgccgctccccaagcagcagtccggcgaggccgcttgcggtggtggcgccgcgccgccgtcctacggtttgggcggcctgggcaacctcaacaacatgccgacgctgacgcggctgcacatggacctcatcgcgcgcgcctttgcgtgtgacctgacgcgcgtcgtcaccatgacgattccggggccgtccatgccctggctgggcatccacgaggacacgcacaacgacatcgcccacctgctcgacgtgcaggaggagccccgccggaccaccatccgcgggaagatggtgcaggttcagcgctggtacgccgagcagttggcctacctgatgacgcagctggcctccatcccggagggcagcggcaccgcgctggacaacacgctcatctactggggcaacgagctgggcgacgcgtccggccacatgaacgtgcgcgtccccaccgtgctcgcgggcggggcggggggacgcttccgcatgggccgcttcctgcgcgtgcgccccgcgggctccaacccgctgggcggctgggcgggccccggcacgcggctgagtggcgccgtggcgcacaacaagctgctggtctccattgcccgggccttcggcgtgaatgtgaatacgttcggccaccccgactacacgggggagctgccgggcctcacctgagcggcgctcgggcttgaagtccgggccccggtgggtgctacgcgcctccgccggggccttcgtgtttcttcagggcgccgcggtgtccgcgctgcgccacttgcgcagcagctcgctggcgctgccgccgcgttccaactgcgcgtgggtcaccgcgttggacgcgtccaggtggatgacgaaggccagcgtcggctcgccgcgcaggtggtagcgcaggtcggcgatgcgcaccttctggcctccttcggccagcggctccatgtggacgagtgggaagcgggcccaggcgagcgcctcgcgcaccgtcggcacggcctgtacgtgctccggcagcgtgcttccggtggcttccgcgcgccgggcctccgagggcggacccgccagggggacctctcccgcggcgaacacgtcaccgggcagcgtggccacgtaacgccacgtgctcacggagaagggcaggggaaagacgcgcaccgcctgcgcggcggggtaggccgcctccacccgctgcgtcagcaccgcccaggtggccacgcggaagcccacgtacgccacggagcaggccgcgctccacagcagcgtccgccgccagtccgcgcgccggcgccaggccaggatggctccggcgagcagcggcagcgtcacccaggggtccaccaccatcgtccagtccaggctcaggcggctgtcggagaagggcagcagcacccgcgtcccccagcccgtccacaagtcgggcaggaggtgcgcgaagacgacggaggccaggctggtgaggaacacgggcgccagccgcgcgccgcgaaacagggcgcgggcggccagcgtggcggtgagcgccaccagcggcgcggcgacgagcgcgtgggacagcccccggtgggcctggagcgccaccgtcaccgcgtcgccgcgtgccagcagggtgtccaggtccggcagctccgcggcgagcaccgacgccaccagcaccgcgcggtccgtgggtgaggcgcgctccggggcgccggggcgcacgtcgggcttgcgcatggcgccaatggcgagcccgagcagtccgtgggtgaggttgtccatggcgtggcttcgtctatcgccccacgggccgcgtggccagcggcaggggaggcgccattcgcccggcgcctgaaacggcgaagcgggacgccgggaatccccgacgtcccgctccaggtgtggcgtcaccgggccaggcccggcgtcagaggctgactacccgcccagcgcgccgttgatgagcggggccacaatctgcatgcccgggtcctcggcgttgtagccgttggcgggctcgtagatgcggacgcgctggttgccgttgatccaccgcgacaggaacgtgtccatgcccacgaactcgctgtagcacttgtacgtctggctccacgggaactcgaggtactcgtaccagtagcgcttcttctccatctgctggcaggcgtgcgcgccgatgaaggtgatgatggtgctgcagtggctggagttgatggcgcgctcgtgcgggatgaaatagctgaagttgttgcacttgttcagctcggtgaccagcgcgtcctggtcctgcttccagtagcccagcacggactccttgtcgttgggcgagtggaagcggtcatacgagaagcgcgagtagttgtagtcgcgcgagtagcccgtgtaggccagctggtcgttggggaactcctgcgccaccatgcggttgatggtgccgaagtcgctctggctgaacgtgcccggcagcagggagaagacggagttcaggtcccacgactggcgaatcttgtcgtgcagcgcgcgcgagcggaagttcgcattgggcgccaggaagatggggccggagtcgttgagcaggtagccacgcgccgggttgatggccttgcgcaggaagtagtagccggccgccgtcgccgtgccacccgcgctgtagcccgtcatcagcatcttctggacgttggggaactgcgtcttcgcgtagttcgccaccgccagcgtgttggtgtagccgctgtggtgccacgtcagcggcgggttctgccccgtcgaatcgacgtaggtggccacgttgttgcccacgtgcacgtcaccggtgcagtacggcacgtagacgatgttccaacccttcgtcaccaggtccgtcttgctgcgccccggcaggcccgggtctgcaccgttgacgagcggcgacacatacttggccgtgaactgggtgatgtagtcgtcggcgatgccgttcggattggcggcgcccagcaggcccgcgcggccgctacacgtgtcgtaatcccagcacgcgccgccaccttcgaacaggaacatcaggttgggcgaacccgtgcgatgcacccagaacttgaactgggagccattgccacacttggttcccggcagctccaccttctgccagttgtagttgttaccaccgtccaccagcacgtcgacgatggaggacatcaccacctccgcgcgtgcggctgcgggcacgagcgcggcggccgtgagtccagccaggaccaggttcttcattcggggacctccgggtttagttgggaaatccgtgtatacaatggcgttgcatccgcgtcaggaggattgtggttgtttcacgtttccgacgagagggacgcgggtgctgcattgcgccaaggatgcgacgcattgcggcatctgatgtggtgcgttgcgctatctcgcggtgggaggttgccgcgcccactccgtgcgcggtattcggagctgcatggccgtgaatgcatggaggaagggcctgcccggccttgtcgtggcgacgggtctcgtggtggcggcgctggtgtacgcgcttcgccaggacccggagccggtgacgccggggtcgcccgccgtcatcgagcaggccgccacgcccctggcgccggcttccgtggcgcgcacgccgccgcctcctccgcaggccacgccgccgccgttggacctgacgcggccgcccgaggaagtgccggacgaaaacgcgccgaaggtgcacccggtggacctgcaggtgattcgcgcgaagctgcccgacaacctctactggcggatgggcgcgcccacgcaggacccggcggagctggagcgccgcgaagcggagtcccgccgctggaatgagctctacggcaaggtgctgtccgccgatgccacggtggagcagattcgcgagtactacggccaccgccgtcaggtgtccgaggacttcatcaccttctccaccgaggtgttgtcccggttcggtgacgtgctgccggagcgggaccgcgggctctacgagctgagcatcaacatgcaccgcacgcggctggcggagctgccggcgcaggagcaggacgcgctggaccggcgggaagcccaggagcgccgccgcgaggcctggcgccagggcctccagtcgccctgagcgcgctcccgggcgggcgaggagactgtccacctccggacagtgccttcgcgggcgcgcccggcacgccacggggtgggaaagggcgtttccccgagcggcgagaatgtcggctgccttgcagatttccggcgcgtgacggtgcggtgggcgcggcggaaatgttaagcggcaggtacatcgccttggcccgttctcacaccgaccgcgtggactcactctcgaccggacaggaccctgatggcgccagccacggcgggtcggacaccagcgggctggataccgccctgctggaccagatgccggaagcggtcgtggtctgctcgctggacgcagtctgtgtccatgtgaatccctccctggagcggcacctgggccggccgcgccaggagctgctcggccggaggctctgggagctgcacccggagtggacggaacgttcctttcaggagcgcttccgccaggtggtccggacgggcgaatccgccgagttcgaacgccacgccgagccccaggaccgctggttcgtgaaacggctgtttcgcgtccatgagcgggtcgtcctgttctcgcgggacatcagcgcggagaagaagcaggaggcgacgcttcgggccctctacgacgagatgcgccgggcgcagcggcacgcggccttcctggcgcaggccagcgaggtgctggcgtcgtccctggagcacgacctcatcctgcagcgcatggcccacctcgccgttcccatcctgggagacgcgtgctcggtggacctccccatgccggatgggcaggtgcgccgcgccgccgccgccttctccagacaggagatggtggcgcccgcgcaggacttccagacgcgctatcccattcgcctggagnacgcggcgggtatcggcaaggtgctgcgtactggcgtcaccgagttcaccccggactttcccgccatgctcgccgccgcccaggggggcagctcggcgtaccggcgggacgtggaggcgctgggcatcagcgcgtacatcatcgtcccgctcatcagccggggccgggtgctgggggcgctcacgctgctcaattcggagtcccggcgcagatacacggaggcggacgtgcggctggcggaagacctggcccggcgcgccgccacctcgctggacaacggtcggctctacacggaggcgcaggaggccgtgcgcgcccgggactcgttcctgtccgtggcatctcacgagctcaacacgccgctgacctcgctcatgctcaacatccaggcgttgcggcgcgacatggagccgcgcgccagcaatggccccgcgtcaccggaggcgctctccacgaaggtggtggcggtgcagcggcaggtctcccgcctgtcgagcctggtgcgcgagctgctggacgtgtcccgcatcaccgcggggcggctgcggctggagcgcgaggacctggacctggccgcgctcacccgcgaggtggtgccccgcttcaccgaggacctggcacgcgcgggctgcgcgctgcacttggaggcggggggcgccgccaccggccattgggaccggctgcggctggagcaggtgctgcagaacctgctctccaacgccatcaagtacggccggggccgccccattgaagtgcgggtgggggcggatgcgtcgcgcgcctgtctgtcggtgaaggaccagggcgtgggcattccgccggaggggcgcgcgcgtctcttccagcgcttcgagcggctggccagcgagcggcactacggcggactggggctgggcctgtggatcgtgaagcagattgtggacgccatggagggtcgcatcctcgtggagagcgtgcccggccagggctccaccttcatcgtggagctgccgcgccaccctgcgtgaccaggtgcgagcggacgccggaggacaccacccagagctgatgggaggtgcgcgtcaccgccacgtgcaggcggcggcgtgactcgtcgtccaccgggtaggcccgcgccgtcgcgtccgggaggatgacgtagtcgaactccaggcccttcacgctgcccacgtcggtgacgtccacgccgggctcgaaggtgaactcgccgtcgctcaccagccgcgcccagcgctggtcggcgacgacgcggtagatggcctgcgcggactctgggctgctggcgatgacgcccacggaggcgtggggctcgcgggcgacgaggtcccggagcgcctcgccgatgaagagctgggcctgggcctcgtcggggaagtggtggaagcccaccggagcgcccgcgcggccggtggcggcggcctccggggcctgcgcgcccagcacctgccgcgccagctccaccacgggccgggggcaccggtaggagacctgaagccggcaggtggcggcgtcacggatgttgagctcgttgaggacggcgggccagcccgcgaagcccgcgtccgtctgctgcatctcgtcgcccgccagcgtgcagctcttgcccttgcccagcagttggcggacggcgaagagctcgaagagggagaagtcctcggcctcgtcgagcaccacgtgcgccagccgctccaggcccagcgaggtgtgctgggccttgaggaacatcaggacgggcaggtcgtccaggtccacggtgccggccatggcgtccggcgtgtcgtcctcgatggagcgcccatccacggtgatgagccgctccgcgtcggtgatgtccttgagcaccttggacagcggcgtggcgagctggaggcgcgtgtgctccagcgtctcgtcgatggcggtgcgaggaatctcgcccttggcggcggtgaccacgctctccaagaagcgccggtccatgtatgcgtccgccatccgcgtgcgcaaccgctccagcgtggtgcccgcgtctgtctttggcacgcccacccgggcggccaacgcgcgccgcagggtggggtggcgcttgaggcgggacaccagcggcggcgtgtcattccacagcttgatgccgggcacgttgaaggcggagcgcgcggtggcgagcagccaggcatcccgcgtctgcacggccacgttgcccaggcccagcggcgccagcagccggcgggacagccgcgccagcccttcttccgggacgatgagcttcatgcgggcctgggggaacgtcctcgggtcgtcgaaggccagcttcgccagccggtgcagcgccacggtcgtcttcccactgcccgcgctgcccagcaccagcagcggccggtccgggccggtgctgagggcctcgtactgctcggcgtccagcatggcggtgacgccaaaggcatcctcgatgcgccgcgcgcccttgccggtgcccaggaactccggccgcgccgccgtccccgcgccgcccgactggagcgtggcgaagtcgcggctcacgctgcgccatgtaccgtccgccaggcgctccagcaccagcgcgccggagatgatgcgcgtcaacacgccgcgctcgatgatgaccagccggcgcgtctccacgctgccctcggcgagccgctcaccgaagtactcctcgtagtcgtcgccttcctcgtagcaatagaagacacgggccacgggggcgaagcgccagtcgatgacgcgcacaccggcgcccacgtccgcgaacgtggtgcggcccagcaggtagtcgcgcgggccgccttcgccattgaggcgcaggtgcgcgaagtagggggcctgtgggtcgggaagcttcactccctcctgacgttccaggagggagcgcatctggttcatctgcgcgaagatgtgcggcaggtcggccacggccgcggtggaggcgtcgtcccgcagcacctgcaactgggcgacaagtccctgggcgtcctgtccgcgtgcggacttgcgccgcgcggcttccagcgtggactgaacacgggccagcaaggcctcttcctcggcgatgatggcgcgggcatggtccggcagcgacgcctcgacgtggctcatgcgcggcaaggtgaacctcggcgccgtatgcgtcaacctgttgtttttcctgaaggaaatgctgtctttttggtactctgtaccaggaagggatggacatgcgcggtgtgacccagcggctgctgctgatggggctggtggtcctggcatgtacggcctccgcgtcccgcaaggtcttgtacgagaaggaatcgccctacaccctcatctcggtgacggaggacgaagaggggcgccggtacctgggcttcgatgcctcgggggcgctgcagagcgtggtccggccgggcaagccgctggacctggtgctgccctacacgcaggtctccatggtggggctggcctatgtgcccgcgcccaagcgcatcctcatcgtggggctggggggcggggccatgcccatgttcctgcgcaaggtagtgccgcgggcgcacatcgacgtggtggacatcgatccggatgtggtgacggtggcaaggcgctacttcggcttccgggaggatacgcacctgcgcgcgcacgtcggagacggccggcgcttcatcgaagccgagcggcccgcgtatgacctcatcttcctggatgcctatggcccggacagcatccccgagcacctggccacgcaggagttcctggcggtggtgcgcgcgaagctgagcccccagggcgcggtggtgggcaacgtgtgggcctttccgcccaaccgtcactacgacgccatggtgcacacgtggcaggtggccttcacgcagctgtatgagttcatcgtgccgcagagctcgaatcgcatcctggtgggcgtggggtacgaggagaaggtggccgccaagacgctggaggcgcgcgcggagaagctggagcgcacccggggcgtgccattcgacttgagcgggctggtggaccggg

SEQ ID NO: 936 - DNA, 9880 bp, Myxococcus xanthus
  unsure (1)..(9880): unsure at all n locations
cgggcacactggaggggcacgtggagccggcgcacttcgaggcagcgtggcagcacgtcctcgatcagcacccagcgctgcgcacctcgttcacctgggaggagttggaggagcccctccaggtcgtccaccgcgccgtctccgtgcagctcacccggcgggattggggccacctcgcaccgaaggcacagcgtcgtgagctgacggccctcctcgatgcggatcgccagcgcgggttcgcgctcgatcaggcgccgctcatgcggctgctcctcatacgcaccggccctcggacccacacgttcgtctggagctgtcatcacctgctgctggatggctggtcactcgggctgctcctcgaggagtgcctcgacgcgtaccacgcgctcgtccggggcgagcgcccttcgcgcggcgtcacgcgcccctatcgcgactacattgcctggctccaacagcaatcatccgggcaggcggagcacttctggcgcgagcggctggcaggcttctcctcacccacgcccctgccggtggcgcgggccacgaaggccgaaggctcctggcatgggcgctcctcactcattctttccgaagagacctcggagcagctccgcgccctcgcccggacgcacgcgctgacgccgaacaccttcttccaaggcatctgggcgctgctgctcagccgctatagcggccagtccgacgtcgtttttggcaccacggtgtccggacggcccgccgacctgcctggcgcgcaatccatggtggggatgttcatcaacacccagcccgtgcggacgcgggtcgatccagacggcctcgtcctgccatacctccaacaactccagcgcgagcaggccgaggcgcgccagtacgagtacagctcgctcgtgcagattcacggctggagcgaggtgccgcgcggccagaacctcttcgagacgctgctcgtcttcgagagcttccccttctcccacgccgagacctcgccgggcggtggcgcgaccgtcacggacgtcgagacctacgacttcaccagctacatccttcacatcgacgttgtccccggtcctgccttcaccctcctggcgagctacgatcgccggcagctcgacgacgcgacgctcgcgcggctgctgacgcactacgcgcggctgctcgaggagctggcccatcaccccgagcggcgcctggacgaactctcgatgctgccggacgccgagcgccggcaggtcctgctcgattggaaccagcagcgggcggactacccgttcaacagctccatcccccagctcatccaggagcaggccgcacggaccccggacgcaatcgccgtgacccaccgcgacgcccagctcacctaccgcgagctcaacgcccggtccaaccagctggcgcatccgctcatcgcggaaggcgtggggtcagacatcgtcgtcgcgctgctcggcgatcgaggggtggacttcctcgcctccatcgtcgggattctcaaggcgggaggcgcctacctcccgttggatccggaccaccctgccgagcggttggcgcagatcctcgggcagagccagacccccatggtggtggtgtcccgagaacgccgcgcgctgctcgacgcggcgctggcgctcctgcccgccggtgcccggccacgcgcgttggagatcccggagttgctggagcgccaggccccagcggacgatccgccttgccgcagccacgggcggaacctggcgtatgtcatctacacgtccggctccacgggcgcccccaagggcgccatgctggagcacgctgggaagatcaaccacatccgcggcatgattgatttcctgcggctggggccagcggacgtgatggctcaaacggcctcacagtgctttgacatctcggtctggcagttcctcgccccgttgatgctgggagcacgagtccagatcctcgacaccgaactgacgcgggatcccgccagcttcctggcggagttggaccggacaggcatcaccgtcctcgaggtggttcccgcgttgctgacggcgatgcttgagcagctcgagcggatggaccccgcgcggttgccgatgcagtcgctccactgcctcattcccaccggcgaggtgctcccgcccgcgctttgcagacggtgggtgaaactgtacccgcgcgtgccgctgctcaatgcctacggcccgacggagacctcggacgacacgaacctctacacggtgtcccagccaccaccggacgacgagaagcgcgtgccggtcggctacgcgctgccgaacctgacgatgtacatcctggatccgcggctgcgtcccgtgcctgttgggctcgctggggagctgtacattggcggcatcggggtgggccgcggctacctgaacaaccccgcgcgcacggccgcatcgttcctaccggatccgttctccgccctcagcggagcgcgcttctacaagacgggcgacatctgccgctatcgccccgacggaagcatcgagttcctcgaccgggcggacttccaggtgaagatccgtggcttccgggtggagccaggtgaggtggagtcggtgctcgcccggcacccaacggtcaggcaagccgtggtggtggctcgcgagttgccaacccgcggcaaacaactggtcgcctatgtggtaccgtacgaggggacctggcccggtgctgccgggggcggcccccgcgacggccacgagggcatcacagtcctccgtgagttcctccagggacatctgccgcactacatgatgccctcggtcttcgtcgtgttgcccgcgttgccgctgaacgccaacgggaaggtggaccgcaaggcgttgcccatgccggacgccgccgctgcccaggaagagcgtgcgccctcgcccccccgctccgatgtggaggagcggctcgtggcgctctggcaagaggtgctgtcgcgccagtccattggcgtcgaggatgacttcttcgagctcggcggtcactcgctgctcgctgtccgcgcgcactcccggctgcgggaactcttcggcatcgacctgccgctgcggaccctgttcgagctgaccaccgtggcccggctggccgagaagatcgaggccctccgctgggcgacctcgggccctcccaaggacgagccggaggacgtcgagcgcgaagaggtggagttgtgacagtcctcgaactggtcacagagctgcgccagcgcggcgtgaggctgtggctggagcaagagcagctccgttgcagcgcgcccaagggcgtgctcaccgaggagctgcgcgcgtccttgcgcgcccacaaatcggagctgatcgatttccttcgagaagcccacgcggccacccccacccacgccatcatcccgagcgcaccccggcccccgcggattccgctgtcgttcgcgcagcagcggctgtggttcctcgaccggatcgagccggccagccccctgtacaacatggcggtcctgttcagattgcgcggtccgcttaacgtggaggcattccggcgcgcctgctccgaggtcgtgcggcgtcacgagtcgctgcgcaccaccttccagatggccgaggaccagccattccagcacatcaccccgccagcaccccatcccgtcccgttggtgtcgctcgaggcacatccgcctgatggccgagaggcgattgcctcgaggatggctcgggaagagtcctcgcggccattcgacctgacccaggggccgctcgtgcggaccaccctgctgcggctcgctccggacgatcacgtgctgctgctcaccctccaccacattgtctcggacggttggtctgagaccgtgctcgtgcgggaggtggccgcgcattacaccgcggcccccggcaccgggcccgcgctaccggagttgcccatccagtacgcggacttcgcgctctggcaacgaagctggctccagggggaggtgctcaccgcacacgtggattggtggaaggagcagttggccggtgcgccccangtcctggacctgcccactgacaaggcacgggccaatcagcgctcgcagttcggcgagctttaccccatccacctgtcgaaggacgtgggggggccgttcctcgcgctggcgcgccaggaaggggccactccgtacatggcgctgctggccgtatggcaggtgctgctctcgcgttacagccggcaggaaagacctgctggtgggatcgcccatcgcgggccgccgccacggcgaggttgaaggcctggtcgggttcttcgtcaacacgctggtgctgcgggcccgggtgcgtccgcgtgactcgttccgagcgttcctcgcgcaggtccgagacaccacgctggccgcgtacgagcaccaggacctgcccttcgagaagctggtcgaggagctccagccgcgcagggacctgggccgcaatccgctggtgcagaccttcttctcgctactgaacacccccacgggcccgatgcaggccactggcctcacgctgcgtccggcggacgtggatatcgcgacctcgcgcttcgacctggggctcgccctcatggacgacgccgacggactgcgcggcgccatcgagtacagcaccgacctcttcgagcccgccaccgtggcccgactcgccggtcacctgcgcgtactcgtggagtccgtggccgcgactccggaccagccgctgttcacgctggagatgctcaccccgggcgagcgtcatcagctcctccgggagtggaacgacagcccggcacggtacgacggcgctggcggcaccatcgcggaggtcatcgcgcggcacgcctccctgcgccccttcgccgtcgcgctggagtgcggtgacgagacgctgaccttcgagcagttggacacgcgggccaaccagctcgcgaacctgctccgttcgcgcggggtgagcacggaagtgctcgtggctgtgagcctggaacggggcacggcgtgggtcatcgcgatgctggcggtgctcaaggccggaggcgccttcgttccgctggacgcgtcgtaccccgcgcagcggctggccatcatgctggaggacgcgccaccgcacctgctgctcgcgtcgcgggccaaccacgcgaagctgccgctccccgacggcgggcttcccaccctgctcctggaagagctggacctgtcggagtggcccaccacgtccccggtgtccgacgtgggaccgaatcacctggcctacgtgatgttcacgtccgggagcacggggcgcccgaagggcgtggccatcccgcaccgaggcgtgctccgcctctcgcacagtgagcccttcatccgcttcggcgtccgcgagacagggctcgtcatggcgcccgcctcgttcgacggctcggtgatggagctgtggcttccgctgctcaacggaagcggcgtcgtcctgtatccgccggaggcgcaagccagcgacctggacacgctgtcccgcgtggtggagcgccacggcgtcacgctcatccacttccccgcaggcctgttctcgcaggtcgtggagcaccggagcgacctgctgaagaagctgcgggccatcaacgtggtgggtgacatcctgtccgccccgcacacgcgtcgcacgctgaccaccaccggagtccccgtcaccaacggctacggcccgacggagaactccatcatctccacgagctacacggcttacgaggcctcgcaggtcggggcctccgtgcccattggccgtcctgtctcgaacacgcaggcctacgtgctggattcgcagctccaactggtacccgtgggggtgccgggagagctgtacgtgggcggtgaagggctcgggcgcggatacgtgtcgcggccggacctcacggcggagcgcttcatccccgcccccttcgccacccagcccggtgcgcgcctctaccggacgggagacttggtccggtggcgcccggacggcacgctggagttcattggccgcatcgacaatcaggtgaaggtgcgcgggttccgcatcgagctggcggacgtcgaggccgcgctgcgcacccagcccggcgtactggaagccgctgccgtggtccgcgaggacatccccggtgacaagcgactggtggcctacgccatgggacgcgatgacgcgccgctggatgtcgcggcgctccgcgcgggcatgcgtcaacggctccccgagtacatggtgccgtccgtcttcgtggtcctccccacgttgccgctgagcaccagtggcaaggtggaccggaaggcactccccgcgccggacagcgcgtccacgggccgtgatggccatttcgtggagccatcgagcccgctggcgcagcagctcgccgcgctgtgggcgaaggagctgggcacggagcgcatcggcctccatgaccacctcttcgatgacctgggcggaacgtccctgtcggtcgtgcgcatcgccaagcgcatgcgggagacgttgaaccgggaggtgccggtggtgtggctgttcgagcaccccaccgtggacgcgctggccgccgtcctggagcgcgacgcgaaggtggacgaggtccccgccgcccccgcgcggcccgagcctgcctccgagccgagcgccgaggcgaaacacgccacgggctccggcctggtcgccatcgtgggtatgtcgggtcgcttcccgggtgcccgctccgtccaggacttctggcggaacctgcgcgacggtgtggagtccatctcccgcttcacgcccgagcagttggagcggctgcccggactgcccgagggactggagctgtcacagcacccggccttcgtcccggccggcggcgttctggacggcatcgacgggttcgaccccggcttcttcgacctgtcgctgcgcgaagcgcagtggatggacccgcagcagcggctctttctccagacggcatggtccgcgctggaggacgcgggcatcgacccggagcgcacgcccgaggccatctcgctctacgcgggcgccatcgactccggctacaaggacgcggtccgggccacgctgccactggatggcgcggcgctgttcgagctctacggcaccgccacccatgagagcctggccaccaaggcctcgttcaagctgggcctcaccggtgagagcgtcctcatctacacggcgtgctccacggggctcgtcgccgtccacctcgcctgccagaacctgctggccggccgctcgggtgtggcgctggcgggggccacacgcatcgccgtcccgcagcgcaccggctacgtctaccaggagggcatgattctctctccggacggccactgccggagcttcgacgcgaacgcgcagggcacggtgtccggaaacggcgtcgcgtgcgtggtcctcaagcggctggaggacgcgcaacgggatggcgactccatctacgccgtcatccgggccacggcgaccaacaacgacgggcgctacaagtccggctacaccgcccccagcgtccagggccaggcggcggtcatctcccaggcgctcgcgcgctccggcgtgcgggcccaggacatcggctacgtggagacccacggcaccgcgacgccgctgggcgaccccattgaagtggcagcgctccagcgcgcctacggcctgggcgtcgagcaccggggcaccattgcgctggcctcgctgaagagcaacatgggccacctggacacggtggcgggacttgcgggcctcatgaaggtcgcgctgtccctgcaccacggcgaggtgccgcccagcctgcacttcgagcggcccaatccgcagatcgacttcgacgccagccctttcttcgtcaacaccaccctgcggccgtggccgaggaccgagacgccgcgacgcgcggccgtcagctccttcggcattggcggcaccaacgcccacgcagtgctcgaggagtccccgatggcgcacagcggctccaccacgcgctcgcaccaggtcgtcacgctgtccgctcgctccgccgaagcgctggaagcggcggcgcggcagctcgccgggcatgccgaggcccacgccgcggacctgtccctggcggacgtggccttcacgcatgccgtgggacgcaaggccttcgagttccggcgcaccgtggtggcccgggacgccgcggacctgacggcgcggctgcgcaagccgtacacgccggtgaaggtggccgatgccgacgtgaaccgccgccgggtggccttcatcttcccgggccagggcgcgcagcaggcgggcatgggccgcgagctgtacgaagcggagccggccttccgcgcgcacgcggatgcgtgcctggcgctgctggagcccgcgctccgggagcgggtccgcgaggtgctgttcgccgggccgggaatggacgcggcggcggtggctgatacccgtgccgccctgcccgcgctgttcacggtggagtactcgctggcccggatgtggatggactggggcctgcggccctacgccgtgctggggcacagcttcggtgagtatgccgccgcgtgcctgtcgggcgtgctgtcgctggaagacgcgatgcggctcgccgtggcgcggggcgagctgatgcaccggatgcctccgggcgcgatgctcgcggtggcgatgccggagtcgcaggtgctgccgctgctgacggggcggctgtcgctggcggccatcaatgcgccggaccgctgcgtcgtcgccgggcccatcgccgaggtggatcggctccaggaggagttgcgccgcagtgaggtgggcacggtgcggatgcccgcgccgcatgcgttccattcggcggacgtggagccgctgatgccggcgttggcggaggtggtggcttcactccagcgccaggcgccgacgctccggtacgcctccagcgtcacggggcgctgggcacaggcgaacgagctggctcagccggactactgggcggcgcagatgcgtcagccggtgcgcttcacgaacgcggtgggggcgctgctcgaagagggatgcagcctgctgctggaggtgggcccgggccaggacctgaccccgttggtgcgtgcatgcctggggcgtgacaaggagcgggtcaaggcggtggccacgctgcgccgtggcgggacgactacggagcacgcgagtctgatgaccgcggtgggcgagctgtggaccctgggcgtctcggtggactggagcgtcttctacggccacgagcagcggctgcgcctgcacctaccgacgtacccgttccaggagaagcggtgctgggtggaggcaccggcgcgtccggcgcccgtggccatgccctcgctggcgaatggcgctgggcacggcagcctcgcggcgccccacgccacgtcgccgcggcaggtgcaggtccaggagacgcctgtgcctgccgccacgccagagcgtgaagatgcgccgcgaggcgacatcgaggaacgtctggcctcgctctggcgcgaacggctcggcctgccgttcgtgggccgcgacgacaacttcctggagattggcggcaactcgttgatggccgcccagctcctcaaccaggtgcgctccacgttcggcgtccagctcccgctggccgcgctgttcgaggcccccaccgtggcgggcatcgcgcagcgcatcgagtccctgctgcgtcaggccccggtcgtggagagctcgcgcgagctgcccatcgtcccgctgcctcggaacgagcccctgccgctgtccttcgtgcaggagcgcgtgtggcgcctggagcagcacctgccgggcctgtccgcgtacaacatcccgttcgtcctccggctggaaggcgccgtggacgcggtcctcctggagcgcgccgtccaggagatcatccagcgccacgagtccctgcggacgacctacgacgtggtggacgggccgcccgtgca

SEQ ID NO: 937 - DNA, 8122 bp, Myxococcus xanthus
ccgcccacctctttcggaagcggcaccaccacggtggtgaggtgatgattgaaatgcgcgatgaggaggtcgctgctcagccacccgagcggcaggcccacgagcgccacggtcaccatcgtccccacccacggcatccgccagcgcaccatgagctgggagcacacaccgaacgtcatcaggatgcctcccaccaacgtcgactggctgaacatcacgatggggtcacggaagagctcgaactgaacccatcccgcgagcaggggcccggcccacatggcggcgcacccccagatgaggtgacgcttcatctgcggcatcacactgggttttccctccttcagttgccgccgtatcgccagcacatgcaacaaccccgcgaggccgatggccccgaccccatagaggagcgttgggaccgcggcgcccaccggcgagccctcgaacacggcctggatgccccgggaaaggcccatggtcaccaaagcgctcccaaggatgtagaccagcaaatagacgatgcccacgccccacacttaccgtggatttcaggcaaacccaaccgcgcccatgcaaagcctcacatcaaggactgcaccgcggccacgacgtggggccactcccgcgagcgcgggtcgatgacctcgaagtgccccgctcccggcaaggtgacgcagcggacgtcgtctcccagctcacggccgcgcgcacagaagtcctcgctcatcgacacgggcacggtgtcgtcctccgttccgtggacgagcacctgggccaccccgagcggctggagcgacgcgggcgaggcggtgcggtagcgctccggcaccgaggacggcgtgccgcccaggaaggtctccacgatgccgtcccccagccggtgcgcgaacgcgcgcggcaggtccacgacgcccgcgagcggcaccacgccatgcaggggcaacggcgccgcactgtagagcgcatcgccgggccgcagccggtgcctggcccccagccacgccgccaggtgccctcccgccgagtggccgagcgccacgacgcgtgagaggtccagcgcatgggcctgtgcgagcgtgcgcaggaagtcagtgccgcgcgccacgtcctccagcgtgccgggccagccaccgccgtcgtgccccacgcgccggtactccagactccacgtcgcgaagccgcgccgggtcaggtccgcgcacaggtgcccggcatgctccaggtcgtacttcgcgcgccagaagccgccatggatgacgaccaccaccgggtgcggcccaggtccttcgggcattcgcaggtccccgaactggtggggttccctgccatacgccatgcgcgcatccgcggtgggagcgggcgtctccaggacccacatcgaactcatgcggacatcctactccgcggcatccgcccgcctgcctggcgccgaccggggagccctccccacggcgtgcggcccacgtcccagacgcccgcaacgggcctatccagaccggccgcccccggccgccccagtgcccccccggccatccatccgagggctcccttggtaggcgtgagtgtcatccagcgggctccgaaggtttcatcgccaagattttatgctccacatctccagatttgggcttgatttccgctcggcaaatgtaaatacctgggcccacggactcatcccgccgcaccgacggcgaagaatccggcctgggaggcacgaacaatggacgcgaaggggctacggacgttcctggagattccctacgacgagctcgaggagcgcaacctcaaggtcaaggagcagcgcctcaagcacaccgcgtcggagaagctccgtgacgagcgcatcgagtacctgacgaaggaacgcgccatcaaggcggtcaccgtgtgcttcaccgacctcgagggtcggctgcacatgctggactacgacaagaagttcctcatcaagagcgccgacaacctcaccttcgacggctcctccatccggggcttctccgcgcagcaggagagtgacctgcggctgaacatcgactggagcgccttctattggctgccctcggacatcttcggtccgggcaaggtgctggtgttcagcgaggtgcacgagcgtgacggcacgcagtaccactccgacctgcgtggcaggctgaagctgctcaccgagtcgatgtaccagaaagacggcacggtggttcacgcggcgcctgaaatcgagggcttcctcttcaagggccgcgacgccgagcaccacttccacgagaagggccacttcgacttcatctccaccggcggctactaccactcgctgcccggtgacgtgctgcgcacgttcatcgacaaggtggccgaggcccagcgcgccatgggcttccagaacgagaaggaccaccccgaagtggcgcccagccagttcgagatcaacttctcgtacagcgaagccctcatcgcggccgaccagattcagctctacaagctgctcagccgccaggtggccgcgcagttggactgcaccgccagcttcctcccgaagccggtgacgggcgtcaatggcaacggcatgcacatgaacctgtcgctgtccaagggcgggaagaacctcttccacgaccagaacggcccggacggcctcagccccatgggctgggacttcatcgaccgcctcctcaccagcgcgaatgacatctgcctcacgctcaactccagcgtgaacgcgtaccgccgcctggacccgcacttcgaggcccccaaccagatcaaggccagcgccaacaaccgcggtgccatggtgcgcatccccttcggaaacgagcgcagcgcgcgcatcgagtgccgctcggtggcgccggacgccaacccctacctggtgctctacaccctgctgcgcaccggcctggagggcccgcagccgcaggaggacgcggaggccaagcgcagccgcacccgcttcctgccggacaacatcttcgacgccatccgcatcttcaagggcagccagttcgtggcgtccatcctgggtgagggcgtgcagagcaagttcgccgagctcaagacgaccacggccgagcgcagcccgaagcagctgggcacccgtgtgaagtactcggaggtcaagttccaccacgaggtcaccaaccagttcctctggaaccagttctaggaacggacgtccgcaccgccggacttcaggagccgccgccctcccgcgacatggggaggcggcggcttcgtccgttacagcggctcgccgcgaagcgccgctgacggctcggaagcccggggccgcgacagccgcagcagcaccacgccagcgatgagggtgagtgccatggtgacgccttcacgcgggttggcgccgaaggccaccaacgtcagtcccagccccagcgtgggcaccgccagcaaggcgtgaagcggacgcagcccccgctcgcgccgccaggccagcgcggccagcgcagcggacgtgacgccgtactgcatcagcaccgcgatgctggagagggcgaacagctccgacaggtcgcccaggttgacgaacagcaggaccagcgcccaggtgacagccagcgcgcgcaccggcacgcctccggcggacatcccgtccagccccagcagcgtgtgcgcgcccgacgccagcgcggacaggtagcgcggcgtcgtcaccatcatccccaggcagatgcccagcgcggacacgctggtgcccgccttcacccacccttcgagcccgggcccgccccacacgcccgccgccgcggccagcggcgcggcctgtgaggccagctccggcagcgcggccacgcaagcccataccaggcccacgtacagcagcaccgccaccagcagcgagcccaccgtggccagcggcacggtgcgcgacgacgagcgaacctgccccgcaatcaccgggacgatttcgaagccctggtaggcgaacatcaccgtcaaccccgcacgcagccacgacacgtccacgaccgggcccgcggccaccgccgcggcgggaggtggccccgacagcgccaggaaggccaccagcaacgcggccagcggcagcagcttgaagacggtgagcgccgtccaggtccccgccgacacgcggatgccggacgccaccacgcccgccagcgccgtgacgaggacggaggcgagcaccgaccgccccagggcgccctccaggcccagggagggcgccaccgcctgggagaggcccgccaccaccgcggcggtgctcaggaacgcgctgacgtaggccacccaccccaccaggaaggacgcccgctctccaaaggccgcgcgcgcgaagaggacgggcccgccgtccgcgtcaaaacgccggcccagcacggcgaaggccagcgccaccggaatcaacgcgagcccggtgagcgcgaaggcggcaatggcgctggcacccggcgccagcgcggcgacctccgccggggcgaagaagatgccgacgccgacaatgccattgacgccgagcgagaggagctggaacggccccaccggacgcgacgcggatgcgacagcgggggcggaggaaggaaccggcacggaggtagttcactacagctgagcgccggacaccaatgcaccgggtggatacccccgatatggttgtgggcgccgagcgtttcagcccgacatccaggccgtttgcctgaggcacggccctgaggagggttcgatgcggcttcacggtgcgctgatgggactgactctgatgtgcgctggctgcgcgacgctgagccgggggttcggcgccacggccaacgaggacacgggcgagtacgaaacgccggaagaagagctggtgtacatcgtccccgccgaggacgcgatgatggtggcgcgccgcatcctggaagagcagcgctacgacgtcatggagaaggaaggcgggctggagatgttctcctcggcccatgagcccggaaagaacatgccgggcctgcgcaccatcgagcgctactacatcaagggcgagcggctggggccgcggcagaccgtcgtgcgcgtcttccggctcagctacaacgagatggagacccaactggagattccgccacaggcggcgggcaagcgggaggcggccatgttcgccgtgctggatgcccatccctttgacgccacgcgggacgccttcacctacgcgaacggtcccaatggcccccgggcggtgcccatggaggacccgttcaagaacgcgccgggcatggagcgcatgcgaatggtgcgcggcgtgcgcgacctggacatcgagcggaccttgctgcaacggctggagatggtgcccgccctggaactggtgggcagcaacgcgcccgtgcccatccgctccgtgacgccagaaggaggacagacggagcaggcgcaacaggcgccggagtgtggcaccccggtggacggcgccggcccgctgatggcgccagggcacgtgctgctgctggcggaccccctgggcacgcgggagttgcccgcggcggcgctgcggatgctctgtgaagccacggcccagggcctgccggtgacgctggcgctgtcgctgcccgcctccgagcagccgctgctggagacctacctggcgagcccgggacagttccaggacctccagacgatgatgagcgagagccccttctggcgccgcacctatcaggacggccgcagcagcagcgccatgctctggctcatcgaacaggcacgccggctgcgcgcctctggcaaggacatctccgtggtggccttcgacgccgagaaggcccagggcaacgagcgcgaggcggagatggcccggcacctgctggcccaccagcagacacgcgcccaggcctggacgctggtgctcgcgggtggcacgcacgtgcggacggcgggcgtgaactgggacagcgactatgcgccgctgggagcgcggctggcccaggtcctcccgtcagtgcgcgcgctcgacgtgggcttcacgcgaggcacgcagttctcctgccgcttcaacgtgtgggacccggtggagtgcaacgtgttcgccatcagtcccacgaaggaggtccggcagaagcccgacatcgcctccggggtgcggctcttcccgcagccgctcgcggaaggctttcacggccgcctctacgtgggggcgctgagcgcgtcacctccggcgctccatcggctggcccccaccaccgccgcccagacaccgcccgccacctcgccgtagaaacggcaagtcctgccggggttggcaagccttgccgcaccggaatggcgcgggcgcggcaacatctgcttcacctgccatggattcccaggcacggacgccgtgcaatggctggcatccgggttgctcttcccctgctcgccacgctccgccggcccgcatgacgcggtgccgcgacgagggcgtgaagccaggaagagctccatgaagaagtcgctttcgttcgtgtcgaagtccgttgccgcgctcgcgatgctcagcaccctgcccgccttcgcggggaccgcgacctactcgggcgcgctctgcacgtcggtctcgggattccacagcccgaccgtcttccgcagtggccgcctcctcaattccaacgcgaacacgctcgaggtcgtctgcccgattcagcgcaacgtcgccgtgccctccctcaatgaatcactgtccgtcagcgtcaccgcgctggacccgcacctgacggagaatgtctgctgcaccgcgacggtggccgagaaggacggcacttccctggcttcgtcctccgcgtgctccagctggggtgcggacacggccaaccacaactccttctccatcaacctcccgtcggtgttcgcgaacatcaacggctacgtgagcctgcgctgcgttctgccggggcagtacaccagcggctccagcacgtacgcgtccgtcctcgccagcttcgtcgtcacggagtagccaccatgcgacaggttcgttggggactcctgggtctggccacggccgccgttgccgccgccggtgggtggagcatgtggggggccacgcccgaagccacaccggcgcgcgcggaagccgccgaggcccggcccgggtccccagcggacctgacgtcggaggtgcgggcattgcgcgcggagttggaggcgctgcgccggggacacgggcacctgctgcaacgcgtggagtccgtggggcgccccgcgccgctgcccgggcccgaggaggcggcagcgcccgaaacccgggcggcagcgcccaccgcgcaaaccctggccacgctggaggttgctcgcgaggagcggcgacaggagttggaagccgagctgcaggccgccgcccataccgagccgcgtgacagggaatgggcgggaccgacggaggcgctcgtcacccgtgcgttcagcggtccggacttcgcgggctcacgtctgacgcgcgtggactgccgcacccggatgtgtgtgctggaggtggagcatgacgcagccgaggcacgcgcggaattgctgtcatccctgctgatggtgaacggcctgcagggacaggcggtgatgcggctcgcggacgacggaagccggctggcctcgcgcatctacctctcgcgtgcgggggagtctcttcccatgacgctgcgaccatgagccacccagacgtgtggaatccgagccggcgcatgtccgggcgggcccccggttgcccggtccagtgtgggcgtgacagcattctcaggcccgacatggcccattcacagcccagtgcccgcgacacgcgccctcttgggagcgcgccggaatcctcagactccggcgcctcgtatctcctggtgttggagggagactcgacgtctcggttcgcccttcccgccgaaggcgtggtgctggtgggccgcgacgaacaggccgacctgtgcctgcgcgacgacagcgtgtcacgccgccatgcgcgtctggtgttgacggaggaaggcgcgcgtctggtggacctgggcaggcacaacggcaccaccctcaacggccgccccgtggacaccgcacaggccctgctgtcccgtgacgtggtgtcctttggcgcggtggtcgcggtggggcgcacgcgttgacgcgccggccccgggacgccccggttcaggcggaacgggtgatg

SEQ ID NO: 938 - DNA, 10210 bp, Myxococcus xanthus
gtgctctaaagcgagcgccccgagcatgcgcggcgcgcactggagagcttgctgtccacgctgcctcgcacggcggcgccggagaagctggcggacgtgcgttcccggttgggtcgcgcgtgcgagatgctgggggaccgcgaaggcgccatcgccgcctacgcgcaggccttcccgctgcgccggctggatgatgccctggccgcgcgcctggaagcgctctacacggaggccggggagtcgcaggcgctggccgagctgtgggccaaccgcgcccaggcgctgatgggcgccgaccgcgccgaggaggccgcgccgctgttcctccagagcgctcgtacgctgctcgagcgaggcgagaacgccgcggcgctgatgcgtctgacggccgcgctggaggcgaaccccgagggcccgctggccgccgaggtgttggagtcgctggccgagttggagctggagcgaggcgagaagctggaggccgcgcgcctgtacgcgcgccgcgccgcgctgatgcccgaggcccgcgctggcgcgaagctgctgttccgcgcctcgctgctcgccgcggggaccagccgcgaggaggccttcctcgcggacgccctggagcgtgacgcgagctacgcgcccgcgcgccagcgccggggcgagctgcgtctgcccacggatgcccgcgccgctttggaggacttcgaggccgtgctggcgctgccgcccgcggacggcgatgcgcctcgcgagagtgagcgcgtagccctgacgcgcaaggccgccaccgcggcggtgcgcgcgagccgcacggatgccgcccgccgcctgctggccgagtacagcgcccgcgcgccggaagatctggacgcccgggtggagctggcgtcgctgcaccgcaaggcgggtgcgcgcgaggccctggcggacctgctggtggagctgtggccgcgcctgtccggcgagccgcgccgcgccgcccgccgcgagctggccgagctgtcgctgggcctggggcgcgccacctccgcggtggacgcgctgcgcagcctgcgcctggaggagccgcaagacacctgggcggcgcagtcgctgctggacctgctgcctccacccggcaccggcacgccggaagaggagacggagcggctggagttgctgagcacgctcgtggccgccgcctcgggcgaggcgcgcgcggagctgctggcccggcgcgccgtgcttcaccgcgccgcgggccgggtggccgccgcgcgcgatgacttctcggaggccgcgaagggttctcgtcgccccgcctcgttgctgctcgcgctgacggagctggcgcgcgagtcgggcgatgaggccgcggagctggacgtgtggcgccgcgccgtatccgccgacgccaacctcgccgcccgcgctcgcgagcggctgctggccctgtccgccacgctggtcgagaaggacgagcgcgccctcgcgcgcgaggccctgggcgcggccattggactggagctgtccgcggcggagcggtgtgacgccttcttctccctcgccgagctggcgcgccgtgatggccagccggaggacgaggccgccgcgctcgccgaggcggccctccagggacccgcgcctcgccgcgtggaggcactgctggcgcgcgccgcgctgctggaatccagcggccgcatggcggacgcggggcagagcctggaggccgcgctcgcgctggccccgaggcacgcgcaggccaccgccgcgctccagcgcgtgctgcggacccgggaggactgggccgcgctggccgagctgctctccaccgaggcaccccatgtggcgcccgccgaggcggccgcgatgtacgcagagctggccagcctctacctggaccggctgtcgcagccggtgcccgccgaggccgcgctgcggcaggcgctgcgcctgtccccgtctgacgccgccgttcgccgtcgcctcgtctcgctggtggcggagcgtggggagttgcgtgaggccgcggcgctgctggagaccgcggcggagagcgccaccgcgcacgacgcggcgctgctgctgcgtgagggcgcgggttacgcacgcggcgcgcacgacctggacaaggcgctgaagctggcgcgcaaggcccacgcgctggtccccgcgcaggggccggagctggcatcgctggcggagttgctctacctgcgcggcgcggtcatcgaggcgctgccgctgcaagacgcactcgccgccgccgcggatttccgaagcgcgccggaggccgcggagtccacgtggctgcgcctggcggagctggccgagcagaccggagagacgaagcgcgcggtggcggcgtaccggaagctgctcgtggagcggcccctgtgcgaggccgccgtcatgcgtctggccgcgctgctggagaaggatgacccgcgcggcgccttcgacgtgcgcgtcacccacgcgcacgcattggctccgtccgaggacaccgtgcagcggctcgtcgagctgtcggcgcgggcccgcgaggtgctcgcggacgcgggtgtggcggcctcgctgctggcgcgcgccgcgtcgctggcgtcggagccgctgccgctgcgtcgccggttggcggcgctgcaccgggagaccggccgcaccgtggagttgctcgcggagctgcgccaggtggccaccctcagcctcgaggcaggggacccggacgcggcgctcgaggcctatcaggaagaggcccggctcgcggtcgacctgggccgcgcggacgacgcgctgcgggcgctggcggatgcgcgcgacttgttggaggcgcgggggcagcagtccgaggccgcggcgtgcgagcgctaccgggcgaagctgctgcgcgacgtgaagctggaccccgccggcgccgaggtcgcgctggagcgcgcctttgccctggccgtggacctgggcaccgcgaagctgggcgcggcgctggccgagcgtcgcgacgacgcggaggccgaggcgcgttggctggagcgcgcgctgccgctgctggatgacgcgggcgaggccgcggccgtgttgctgcggctggcgcggctgaacctgggcgtgctgtcagacgtggcgaaggccgaggagttgctgcgctcggcgctgcgcaaggaccgggcgctgacggaggccgagggcctgctggagaagctcctggagagcgacggccggctggcggagctggcggcctggtacgaggagtgcgcggaaggcgagcccgacgcggcccgtcgcgcggagctgttcctgcgcgccgccgtgctgtaccgcgaccgggcagggcgcccggagtccgccgccgcggccttcatcgcggcgcgtggcgcgcgcccggacgacctggaactcaccgcgcaggcggcggagctgctacacgaggtgaagcgccacgcggacgccgcggagttcgacgcggtgctgctggaggcggacccgttccgcgagcccgtcttcgctcggcacctcgcctttctggatgaggccgaggaccaccaggcgctcgccgagctgatgctgcgcagggcgcagcgccaggaagccgcaggcgccgcggagagctatctgtccgccgcccgtgccttccgcgcggccggtgcccgcgagcgggcgctgctgtgcgaggaccaggccttcgagctgagccccgcgagcgcggaggccttcgagcgcgtgcgtgagcgcgcggccggtgacgtgcgccggctggcggacctgctgtcccagcgcgccgcggccctgtccacgtcggaggccctgccgctgctgcgcgagcgcgccgctcgactgctggacgcgggcgaggcgctgctggccgcggaggccttcgacgaatacctctccctggcgggggatgacgtggacgccctgtccgcgcgcgccgagctggccgcgaagggtggaggccccgtcgccgcgcgcccctacgaccgccgcttgctggacgtgggcggggacgcgctgccggtgccggtgcgcacgcggacctggctgcggttgggccatgcctcgctcggcgcgggcgcgttccacgacgcggcggatgccttcgagtccgtggtggcgctggagccggaaggcgagcgcggccgcgaggcgctgtcgctcctggccgaggtgcactcgcgcacgggcaacgcgccgggcctctaccgggcgtcgctccaactggcgcgccatgcggaggacgccgccaccgccgaggtgctctaccgccgcgcggcggacctcttcgacgacccgaaggacgccatcgacgcgctgttgccgctggcgcgcctgcgtcccgcggatgcgtccgtcatcgaccgggccgtggcggggctgcacgccctgggacgtcatggcgacctgctggacgtgtacgcctcgggcgcggaggcggcgggtggccgtcgcgccgcggagctgctgttggccgccgcgtcggtggcctccagctcgctggcggatgaagacgcggcctggacgctgacccagcgcgccgcggaggccgcgccggaggacctcaccgcgctccaggcactggtgacgggcctgcgtcagcggggcgactccacgcggctgctggaggcgctggagcagtgggtgccgcgcgtcgaggacgccgacgaggccgcggtgctgcggctggagctggccgagctcgcgcgtgacgcgggccgcgtggatgtggcgcgcgaggcactggaggaagtggccgcgcgtggcgcctcgggcgcgggttacgcggacgcgctggaagccctcgagccgctgctgaaggacgcccccgcccgccgcgccgaggtgcaggtggcgcgcgcggagttggcctccggccgcgagcggcaggtgctgctcatggcggccgcgcggggcttcgagtccgcgggacagcttccggaggccctgaaggcggcgaaggacgccgcctcggtggagccggacgtcgacgccgccctgcgagtggcccacctgtaccgcgcgtcgggcgaggcgcctcgcgcggcgcgggcgctgcttcaggccgcgcggctggcggcgccggaggagcgccccccgctgctgctggaggccgcgggcctctgggagaaggcgggagagcacggtgaggcgctggaggtgttcgagcgcatcgccaccgaggcatcggacatgctcgcgccctcggagctggccgagcgcttcggccggctgggggccttcgctcgcgcgctggaagtgggcttcgcgcccgccatggcctcgggcgacctgaccgacgcgctggccatggccgcgcaggcgggcgacacggcgcgcacgcgagaggcgctgtgggccctggccgcgctggcggacgcggaccccgcgcatgcctcggccctggcggatggcctgcgcgcggaaggcgacgcggaagggttgctggagctcgcgggcctgtccgccgcgcgtgacgccgcgttcgcggtggcgctgcgcgatgaggtgctccgctcggcggcggcctcggtgctgcctcgcctgcgcgcgctggaagagctggcgcccgagccgggcttcgcggcccgtctgacgctgttgctgcccaccctggagaagctcccggaggcgctggcggaggcggtgctgacgcaagtgcatgcgcagccgggcacggtgcgcgtggaagcgctggccatggcggcggacggctggccctcgcgacgcaagtcgctcttgcgcgagcgttacgcactggagctggagctgggccgctacgaggcctgcgtgcgcacgctgtctcaggtggccggcgaagagtcggacgcggtggcgcgcgccgtcctgcacctggagcgcggagagctgctgctcagcccgctggagcaactgcccgaggcgcgcgaggccttcgaacaggccctgaaggacgaccccgcgcagctccattccctgcggcacctgttgtcgctggtggacctgggcgaggagcccgctgtcttcgtgtcgctggtggagcggctggagcaggccgcgggcgtggagtccggcaacacctaccgcgagcggctggcggacgcctacgaggccctgggcatggtggcggacgcggccgcgcagctcgagcggctgccggagacggacgaacggctggcccgccgcgcgaggttggcggaggagcgcggcctcaccggcgaggccctgcgcctgcgcgagcggctcaccgacgaacccgcggtgctggaggccattctccgcggctacctggacgcgcagttggtgtcgcccggagcccggctcgccgcgcgcctcttcgaggccggcgagctgtcccctgaagtcacccgcatggccgccgagcacctctccacggtgcccgagggtgtgtccctggccgtccgcatctggccgcacctgctccgggagcacccgttggacgtggatgggtggacgctctacgcggaggccctgcgggcgctgggccggacggaagactcgcagcgcgcggacggcgtgggcgcggccctgtcctccagcgacgcggcggcgcctcaggcccccgtgtccacgctgccggtgccttcgggcttcgagcaccgggtacccgccggcgcggtgccggtgacggccgagcgcctgccccggctcgccgcggcgcttcgtcccgtcctggcctcgctgggcgcgggctcgctgcaactcgtggtggacccggtgggcggggtggaggcgtacctggccagcggcgacgtgctggtactgggcgcgggcgcgctgtcctgcttcggcgcctccgagctgagttacctgtgcgcgctggcgctggcgctgggtgaagacggcgtcaagctggcccggcccggtccggtgccggccatggaagcggcggcggtggcggccttccgcgccgtgccggcctcgctggcggcggggcgcgtcctggcgcggctggacgcggaggtgcgcggaggggacccggcgcaggtggatgtaggcgccgtgcttgcccgcggcgacaccttccgggcgctggccctttgcgtgctggacggcgtctagccgtgtagcgtgacgccgccatgcacgtgaagcgccttgccctcgccgccctgcccgtcacggccgtcgccgtggcgatggcctgctattccgaaccggtgtacccgggtgaccaggtgctcggttcgttccgcttcgaggcccggctggatgccgcgcgcaccacgtgcgacgcctcggtgccggacttcgcgcaactcaacgacgccggtgtgttcctcttcgagggcaccttctcgcgcgacacggacgcgggcacgggcttcttcaccgtgcagggctactcgcgtgacgcgggctatgaagggcaggtggccacgtccacgctgaaggccgtcgcgccccgtgcgtcttgtggcacgggctgtgaggactcctccatcgaggagacgctgcgggtgacgctcttcagcgacagccaggcgcgcaccctcagccgcgactgccgccagttcgacggcggcatccccgacggctcggtgccgggccccacggagaacggttacgacgtgtcgctggcgtgcggctccctcacggacatcttcttgccggggacccgcaactgcaattgccagccgaccacctgcaccacggtgtacaccgtgcagggagagcggagggattgatggtgaagcgcgcggtggtgttgatttcgggcggtctggattcgacgacgtgtctggccatggccaaggcgaaggggttcgagcccgtctgtctggcggtggcctacggacagcggcacgccgtggagctggagcaggcgaggaaggtcgccgccgccatgggcgtgacggacttccgggtggtgtccatcgacctgcggcaggtgggcggctccgcgctgacggcggacatcgaggtgcccaaggaccggccttcggatgagatgagccacggcatccccgtgacgtacgtgccggcgcgcaacgcgctgttcctctcgctggcgctggggctggcggaggtggtgggcagcacggacatctacatcggcgtcaacgcggtggactacagcggctatccggactgccgtccggagttcatccgctcctttgaatcaatggccaacctggccaccaaggcgggcgtggagggtgcgcacttcaccgtgcacgcgccgctgtccggcctgacgaaggcggacatcatccgtgaaggcgtgaagctgggcgtggactacggcttgacgcactcctgctacgacccggacgcccagggccgcgcctgcgggcgctgtgacagctgcgtgctgcgcaagaagggcttcgaggaagccggcgtgccggaccccacgcgctacacggagtccgcgtgacaccgcgcctcggctggggcgtggtggtggcgctgggcctgtcatccgggcccgcgctggccaacgacgcgggaacgccgaaggccactgcgacgccgaaggccgcggccaccctggtagacgccaccacggtggtgccggacctggtcgtggacctgcgctacgcgacggcggacaacttcttgaagcggaaggtgtacccggacacggcgcgctgcctgctgctgcccgagtcggccgagcgcctgaagaaggccgcggacgtgctgcgcgcccggggctaccggctgaaggtgtacgactgctaccggccgcgcgcggtgcagtaccagatgtgggaaatcatgccggtgcccggctatgtcgccaacccgcgcaccggctccaaccacaaccggggtggggcggtggacctcacgctgacgacgctggagggccaggcggtggagatgcccacccccttcgacaccttcacacgcgccgcgcaccatgggtacgagggcggcaccgaggcgtcgcgcaagcaccgcgaaatcctgcgcgaggccatggaaggcgtgggcttcaagcgcaaccgcatggagtggtggcactacgacctgccggacgcgaagaagcgccccgtgctggacgtgcccttctccccgccatgacatgatgaaaccatgatgaacggagggcccgcctgcggcacgctgcaggcacctccccagggtggtcacggcgtgcgtggcccgggatggcacccacgatgaagcccaccccctgcaatgtcttctgtgtcgtcctcctgctgctgtccgcgcctgcgctggcggccggaggcctctccggcaccgtcgtgcgtgccagcgacaagagccccatcccggaggtgcgcgtcaccgcgacctcacccgcgctgacagagcctcgctccacggtgacggacgcgcagggcggcttccgctttccccaactggcggatggcgtctactcactccgcttcgagaaggagtccttccaggcgctcagccggacggacatcacggtgaaggccgggcatgagccccgcgtggacgtggcgctctccgcggcgtcgcagacgcgcccctccgtgctgccccccgcgccggtggacgatgaccgggagcgggcacccgcctggacgttgcagcacctgcccgtgctcgtgccggatggggcgtggcagaccgtctatcgcgcgtcgctggggaagccgggctccggcgtcgagacgcggggctttggggtgaaccccaccatcgacacggaggagtcgcgcacctcggagttccccgtggcagtggacaccagcgcctacggggtggcgcgcgactacctgtctcgcgacgtcttccccgcggaaggcgcggtgcggacggaggccttcatcaacagcttcgactccggggacgaaggcgagccgtacggccccttcttgctctacgtcgagggtttcccttcgcccagccgcaagggctatcacgtggtgcgaatcaccgtgaaggcccgcgagccggtgcgcgaggtcggcgtccaggtggagttcaaccggaaggccgtcgcccgctaccggctgctgggctacgagtacctgtctccgaacccggagccgctcgacccaggcgacgagacggagctgtttccactggccgccggccaatccgtcaccgccatccacgaggtgaaggtgctcgggccctccatcgccttcggaatgctccgggtgcgctacgagcagggcaactcgagcaactggcgccgcgtgcagatgatgatgccctccagcacgttgcgctccgactatgcccgcgccgccccattcacgcgcctggcctacgtggcctccgcgttcgcggagaagctgcg

SEQ ID NO: 939 - DNA, 8765 bp, Myxococcus xanthus
accaccaccacgcgggatccgggcgccatgggacttcagcgtctggtcgaacgtggcgctgccgacgatttcgacggccacgtccacacccgcgccctgggtgcgcttgcggacgtccgacgcgaagtccagcccgcgcgacacgatgacctcgtccgcgcccgcctccttcagcgcctgcaccttcgcctcgctggacgtcaccgcgatgacgcgcgcgccgtccaaccgcgcgagctgcacggaggacaggcccacgccgccactggcgccggtgatgagcaccgtctcgcccgcgcgcaccttgccgcgcgtgcgcaccgtgtggacggccgtgccggtggtgcagcacaccgtggccgcctcgttccagggcagcgacgcgggcacccggcccagtccgccgacgggggccaccatgaactgggcgtagccaccgggcagctcctcgccgaagaagcggttgtccgtcttgcagaggctgttgcggccgctgcggcacagggcgcagtcgccgcacgacatgcgctggagcgtcgcggcgcggtctcccgtcttccagcctggcgtgtccgggccgacttcaatgacttcacccgcggcctcgtggccaagaatcgcgggcacgctggtgcggggcaggttgcctcggcggttgatgacgtcgtggtagcagacgccacaggcatgcacgcgcaggaggacctcgccacgcccgggacggggcatgggcatggtctccatcttcaggttgcccgcttcaccaaagctgcgcagtacgacggctttcatctgggtgcctccgtgcatctgaattcgtggaaggggaacggccctgctcaggcgccgacgagcgcgtcgcggtagccgtgcggatcgatggcgcgaatggccgccaccgtccgggcatccggaagcgaggtgacggacagcgcttcggagacctggaaggcgaagcccgtgcgctccgcgatgtgctcttccgaggcccaggggtgtcgcgcgagcagccgcgcgccggacgcgcccagttcgaacacgcccaggtcggagatgagcgtcaccggccggcgcggatctctcgtggtggcgacctgcacctccggcaccaggttgcggcgcgactggcgcggcaccaacagcaccggccggcgcacccactgccgcagcgtcgctgcgcccgccacgccggggaacttcgtccgcggcttgtccaggctgccgctggccgtcatgttggtgcggccctcggcatccacctcggccgcgccgaagaagacggtgtccacccggccgcgccgcgcgtggtcgaacaggtccggaatggtgatttccgcggaccggccatccaggtagcccaggtcctcggaggagggcagcagcgtgggaatctccggatccaacgagcccacgcaggccaggtacgtcaggtccggcgcgtgcgtcgcgcgcgccacggcgatggccaggatggccagcggtgacgccacgcccgtggccaccacgccgccgtcatcaatctgccgcgccagcagggagaccacggtctccgctggggtgatgtccagcgtcgcgctcatgccgccctccgcgtcagcaacgtttccaggaactccgcttcacggcccgtctccgccagcgacaggtagcgggccagcatttcgtcgtcgtgcgggtagagtccggcgcagccggtgggcagggcgccgccgggagccaggacgatgcggtccacctggaagccgggcagggtggcgcgaggcagcttcgccacccgctcctccaccgtggcaatcacccgcttcgccgcgcccgccaccagcaggtccgtggtcgggtcttccatgtagaggttgccgcgctcgtccgcggcgcgcgcgtggagcaacgccacgtccggatagaaggcaggctccaccgccacgcgcaggccggtgaaggggtcctccaccgtgggaggcggctccgtccgtgccagcccggacacgtccgcgtccggcgcggggatgaagggcagccccatggacgcggcgcgcagccgctggacgacgcggtagccatcatgttcgcgccaggcgagggtgccttgctccatggcccgcttgaggcagggcatgggacgcacgcggccctggaggctcagcgcgccgaaggcaatctccagcctggccagacagccgcccgccacgaggaactccgcgggcagcgggttggggagggagatgaggcccaggtcgcgcttgccctgcgcgatgagctccatcaccagcgccatgggggcgcgacccagcatgaaaccgccggtggccagcgacgcgccatccggaatggaagccaccgcctcctccagcgagcaccagcgcgccgtcttcatgcgtcctccgaatccgtgccggtggccgacacgctcggcaccatgcgcaacggggagggccctgcctgtccagcggtgtccccagcggcggcgaagggcgggaacaacatgcccaccatgccgtcggcgatctgctcatccgtgaggcgcccgtccggcttgaaccacttgtagatccacagcaccattcccaggaacgagaaggcgcccaccgtcgggtccacggggcggatgaggccctgctgcgaggcctgcgaaaaggcctcctccaggaagtccacgtacttcttcttccgggcgtcgatgaaggcgcgcgtctcgccggtgagcgtggcgtgctcgtggaggatgatgatgacctccttgctccacccccgcgtcaccagcaggatgttgtggcgcatgcacgcgcgaagccgctccaccggattcgcgatgtcctgcacccgcgagaggacctgctcctcgaacaggtccatcccgtagttcatgatggcgaagagcaactgctccttgttctggatgtggtggtagaggcccgccttcgtcatccggcacgcggcggcgatctcctgcatcgacgtgccctcgtacccccggtcacagatgagccgcgccgccgtttcaaggatggctcggtagcgctcgccctcgtccggcttccgtcctccggtgttcgtcacgtctgctcccttctggagacctaccgaccggtaggtagcagcgcccgacgcggagtgtcaatcgccaaagtcggcccccgggccggcgagcctcctgatttccctgctatttcaaggggttggggaggggctggcggttagactccgcgggccatgcggtacgcgctcgtccccatcctgttgctctgtgtcgccctcacgacggtgggggtgggggtgttcaccctgttggagcgcaaccgggaggcgcagtggcaccagttcgcggtggagcgccaggcccagttggatgaggccacacgcggggtggcggagacgctggaggacgtggcggaggacctgcgcttcgccggggagctgatgtcccagcccggcacgttggcggagcaccggcgggagatgcgggccctgttggaggcggtgggccagtacaaggtcctcatcgcctacgacgccaacggcaaggaatggctgcgcatgttggaccggcgcatgggcaagcaagtagcgcgagcgcccgtgttggcgcagatggcggaggcggcccggcgggccctgctgcggccgccgggggacgtcacgctgtcacctcccatggaggatggcggcttggactcgctgcgggtcatggccacggcgctgcccgtggatgagcaaggccggcccgagggcgcggtggcggtgctcgtcgacacgacatccttcttcacgccgctgcgcatcgtgacgtcggacccggacgcgcggctgttgctcctgggcacctatggtcatccgacctccgccagcgacgccaccctggcggactggttccggcgcctggagacggagggcgcatgggtgccgggcttcacgacgctggcggctcgcatgcgcgagggggagcgcggcgcgttgccgctgcgcgcggaggaggccgagcgattgggcctgggccgctcggaggccatcgccgtgttcacgcccatccgcgtccgaggtggcagccattgggccgcggccacgttggtgtctaccgagacgctgcgatcgcatcagcaggccctcatctggcggctcctggccgcggcgctgctcgtggcgctcttcctggtgacgttcgccgtgtacgtggtgctggcgcagcgccgcgcggccgccttgcgagagagccgtcagcacgcggaccaactggcgcacctgcacgacaagacgcagaagattctcgaccacattccttccggggtgctggcgctcaccgtggacgggcgcatcagcgcggtgaaccaggtgctccgcgagcgcatgcctccggacgccattggcgcgccgttggagacggcgttcccccaggcaccggcacccgtggtgtcccggattcgcgccctggtggaggccgccgcgagcgagtcgcgcgcccatggcatcctgggtgagacgctggtgctcttcggcgaggagggccgtttcaatctccacgcggtgccgctggaggcgcgccacccggaggtccagaccttgttggtggtggaggacctgagcaacgtgcgcgcgctggagacgcagttgctgcgcgcggagaagctggccacggtgggggtgctcgccgctggtatcgcgcatgagattggcacgccgctgggcgtggtgcgtgggcgcgcggagtacgtgctgggcaagctgggcagggaacacccgcaggggcctggcattgccgtcatcatcgagcagatcgaccgggtgagccgcacgctgcggcagctcctggacttctcgcgcctccagcccacggcggtgcggccggtgccgctcatctccctgctccaggacgtccaggagttgctgcgcatggaagtggagcggcgcggggttcgcttcgaggtgaccgttccggagacgctgcctccactggccgcggacccggaccagctccagcaggtgctggtgaatctggcgctcaacgcctgccacgcgtgtggcgagggcgggcaggtgacgctggccgcggcggtgccagaggcggagccgtgggggctggtggcgctcaccctccgcgacgacggctgcggcattccccgggagcacctcaatcaggtattcgaccccttcttcaccaccaagaagcggggacagggcacgggactgggcctgacgatggtggctcacgtcgtgcgcaaccatggtggccggctggagctggagagcgaggaggggcggggcacctgcgtcacggtgctttggcccatcgcgaagcccagcgcggaggagcggcatgtcggttgaaggacgcatcctggtcgtcgatgaccacgtggacatgggcctcatgctgcgggagcccctcacggacgcggggtatgtcgtggacctggctacgggcggcgaagcggccatccggatggcgcgcgcacaggcctacgacgcggtgctgtgtgacttgcgcatggaaggggtggacggcctggacgtgctggaggccgtgcgggcgctcgactcggacatccccgtgttgatgatgacggccttcggcggcgtggagagcgcggtggaggcgatgaagcgcggcgcgtaccactacttcaccaagcccttccgcttggatgaggtgctgctcttcctcgagcgcgccttgaaggagcgcaggctccaggtggagaaccgggccctgcggcgcgccgccgccgagcgcagcgggctgggggcgctggtgggccgaagcgcggcgatgcggaacctctacgagctcatcgaccgcgtggcctacgcccaggcggcggtgctgctgcgaggcccgagcggcacgggcaaggagttggtggcgcgcgcgctgcacttccaggggcctcgcgcctccgggcccttcgtggcggtcaactgcacggcgctgccacatgacttgctggagagtgagctgttcggtcacctcaagggggccttcaccggcgcgacccacgcccgccgcggcctcttcgtggaggcggatgggggcacgctgttcctggacgagattggcgacatgccgctggagctccaggcccgcctgctgcgcgtcctggaggacggcgaggtgcgcgcggtgggcgccgacggcagccgcaccgtggacgtgcgcatcgtcgccgccacgcaccaggacctggacgcccgcgtgcgcgagggccgcttccgcgcggacctgttctaccggctcaatgtcgtgacactgctgttgcctccgctggcggagcggcgcgaggacatccccttgttggtggagcacttcacggctcgcgcccgcgcgcgcaaccctcgctcccgcatgcagtccctgtctccggaggcggtggccgcgctcgcgaccttgccttggccgggaaacgtgcgtgagctggagaacctgatagagcggctggcggtgatggtggcgagcgaagtcgtggggctggaggagttgcgcccacacctgccacccgaggcgccggaggtgcagcccttggtgatggcgcagcacgcgctgtggcccctgcggcggctggaggcggagtacatcgcgtggatggtgacacgctgcggcgggaacaagacgcgcgccgcggaggtgctcggcatcgatgtgtccaccatccaccggcgcgaacgggagcgcgggtaggggcgcgcgagacaccgtggtaatccgccagggacgtctggcgtgatgcaacggttcatccgcacgttgcccgggctctcggggcggggacagcgggcatgggcattgcttgatgttgcaacgtgaagtcctcgtccattgcccgtgccctcctgctcggaggggatgcgtcgctcagctcgctcctgatggacgtgctggccgagctgggcatcgcgctggagtcgggcgcgccggccggtgggtgtccagacctcgtgctcgtccacgtcgagcgcggtgagagtctccagcgccggcttcagcgcgcccgggagctttcgccccaggggcccatcatcgtgctgctgcccttcgccgatgagcggctgatgggactcgccctgcggctgggcgcccgcgactgtttcgcgctgggcgggccgctcggtgagctgcgccgggtgttgctggcccacgttccaggtcatccgagttccgtattcatctctcccggcggggccgtgccgccgtcgaccgagtcgccccatgattgagcctctcgccgtgtccgcggtgcccgccactcccgcgtttccggaccgcccgctggttgcgccgcccgctccttccgaagtgccgctctttcaggacgccggcctgcgtgtgacgaccgagcggatcgtcgcccggggcaagacgctgctgctcgcggacgtccagcgggtggagacggtgcggcgcacgcctcgcatggttcctgtgttggccacgctgggcctgtgcatgagcgtggggctgccggctctgtccgcgctgtccgtctccagcagcacggcgaaggggggctatgaggcggcgctgatcgccgtcgtcatggtcatcttcggctgcatcgcgcggctcgtcctcgccgaggagtcgtaccggctggtgctgcatacccgcgctggctcctggcgcgtgcgcgcgagcaaggatccgaagtccctcatgctgctcgccgggctcatccaggacgccgtcgcggcgcgggggcagcactgagcgagctcgctgcggcggagccagaatcgttcgaaggcttcagcgcccattcacggcccgcgtgaagacgtctcgcagccagtcattcacgtcgcagtccagcacccggtggacgcggtcggtgtcgctggggttgtccacccggtggggacggttgaagtccaggtaccagcactcaccgggctggaggacgactcgctcgccgccgaggaagaaggccacgtcggggtgcgtggtgatggggacgtggagccgcacctcgccgtccgcgcaaccacgcctcggcggacaatgccgcgagctcctgctggcgcggcgcggcgtcgaagtggaagggcaggcgcaggcggtcgggcacgggcgtcgacatgcggtgctcctcgtcgcggtgaagggctccagcgtggctcatgccagccgcagtggccggtgctccgtcttggcccggatgagcgctgcctgggctcgggccagcgttccctgagggtcttcctcaccctcgacggtgacggtggcggacaccacatcgggagcgccaggggtgtcgcgcagcttctgccgcaatggttcggcccgcgctgcgtccacaccaggaagggccaggaggaacgccccgccttcccatcgcaccgtgaagcctccagggactcccagggcttcggtgatgcgggctccgtctcgcagtgtggcgtcccccgcgtcgaaacctcgggtcgtgttgatgcgccccagtcccaccaggtccgcgagcagcacgctgaagggcatgccatccctgcggcagcggccaatctcgcgcagcacttgttcctcgcccgcgcgccgcgacaccagtcccgtcagcgcgtccacccggtgctgctgctcccgctcctcacgggctggccgggtgtgtccgatgtcggtgagcgtcagcatctgcgccatgccgccagggatggcgaagggccgggccacccagcgcagccggtgcggttgggcccgctccaggaccagcgtcaggcggaggcctcgggacgattcggaggccaggtcgagctgccgcagtgtgctcgccgggtcctttagagca

SEQ ID NO: 940 - DNA, 9335 bp, Myxococcus xanthus
tgaccgccggccccggtcgcccatgacgaggaggtcctcctgggggagctcgcacatgaaggcatgctccgcgctgaggccacggaactccgagcacgcttcgttcgccacctccaggagcgacacgggtttgcgttgcagcttcagccggcccgcctccacgctggtggcgtccaccagatcattgaccagcgcggacaggcggtccacctgcgccatggccttgtccacgcgctcgggcgcgatgggctccctggccgccagcgcccgcttcagcagctccaggtggaggcgcagcggcgtcaggggcgtcttgagctcgtgggcggcgatggagaggaagtcgtcgcgcacgcgaatggcctcgtgcgcctcggccagcagccgctcctgcgtgcgctgtgcgtgcacgcgctcggtgacgtcgcggaagctccagacgcggccggtgatgagcccgcgccgccgctgaggcagggagtagcgctccaggatgcggccgttgcgcagttcgatgatgtcgaagctctcctggcttggctcctcgtacagggactggacccgcgacaagaaggcgtccggggccttcaacttctcgcgcacggccgcgagcagcgtcgcgtcgtgcgtgcaggcagccagtcccgtcagtccccagagctgctcgaattggcggttgcaggcggtgatgtgtccgtcccggtcgaccaccagcagtccgtccgccgtcgagtcgagcgtggcctccagcagggacaccgtctgctccagccgctcctgggcctgatgctgctcggtgacgtccaccatgacgccttgaagccggtgggcgcggccgtccttggacagcacggtgacgatgtcacgcagccagacgacgcggccgtccgcggccagcatccggtattcgaattcgtggggaaggcactgctccaccgcggtgtggcaataggtggaggcccaggcccggtcgtctggatgcaggtgctccaaccagaagtgaggctcggtgagccactgctccaccggatagccgagcagccgctccgcctgcttgctcacgaagatgaagcggacggaggggtctgcctcccagacgatgccgtcgacattgtcgaccagcgcgtcatgtccaccccgggcaggcgggctgacgtcccccgctgcgtcgaggcccggctccctctccgccatggcgcgctccctcccctggagcgggggctctcccgtgtctcggaccttcttcaatcaatacacccggggagccgggcgccaccggccccttacggccaggggtgcatcgtccgccgaatctccggaaccgggcaggccggggcgccctggggcagggccttgcttcctcgcggggaatgcgcaggcggagacatgcgaggatggcgcaccgagcccgccccatgccgcctcctcgcctcgcccgcgcccgtgtgccgccttcccgtgaggaccggtggttggggcgcgtcttcttcggcccccggcgcttgatgtacgtggggccgctcgctccaacggacccgcacgcccaccccacctttcaggtcctgctgtccctggacgcgccggtgcgcctgcgcgacgcccgtcagcaggaggtcgcatgtcaggcggccgtcgttcctccggacgccgagcacgccatcgttgaaggcgccctggcagcggtgctgctccacgtccccgcggaggacctggtgggccgcaggctggcgacgctgggcattggcgcggacgcggccgcgtggggcgcggcgggcgaacgtttgagggcctgtggcattggccggttgccggtgcgctgggcggaggccgaggcgcagacgcaggtcctgctgcgtgagctccaagccgacgcgggcgtcgcgaagcccacccaccccgcggtgaagaagctgctgcggctgctgccagaggcgctggaggaagacgtgcgtctggccacgctcgctccgcgcgtgggcttgtcggtgggccggctgtcgcatctgttcagcgcgcaggtgggcttccccttgcggccctacatcctctggctgcgcctgcaccgggccgccgagcatctgcaacaaggcgcgtcgctcaccgaggccgcgcacgccgcgggcttcaccgacagcgcgcacctgaaccacgccttccgccgcaccttcggcctcaagccttcggagattgccggggtggtggagtgggtgcgcccgccctcgcgatagcgcgttcttacaagccggcgggggcttcgtggcgcgaaggtggcgacatgaccgggaagaatccatgtcgatgaagccgaagctgcgcgccgctttcgaagcggagttgcgcgaggcccatgaagcggagtcgcgttcggagcatgtgcgtacctggcggcacctcgagcgggtccacgtcctcagtcaggcccacgcgggccctcacgtgcgggtgcactggcgcatgctggggttcgggtggcgccggcggaacgccgcggagtgggtggggcaggtggtgcggttgctggtcgccgcgccaggctcatggctcgggcgggcaccgctgggaaacaccggtggcgcgaacgtgggcatcctcacgcccatgcccattcccgacgacctgcgcgccctgctggacgccgaccgctgaggccctttcgctgttcacggcccgcgcggttctcttctcacattccgaggcgcgcgctggggcgaattacggtatggaacggacatcatgtcctcttccgagcaacccgcacggcaggacgcacgcgtatcgactggcgtgcctgggcttgacgccgtgctgggcggcgggctcgtgtcgtcgggtgtctacatcttcgtgggggagccgggcgcggggaagacgctcttcgccaaccagctctgctaccaccaggggcgcgccggcgcgcggtgcctgtatgtcacgctgctggcggagtcccacgctcgcatgctggccaacatgcgggacatggccttcttcgactcggcgctgctgcccgagggcgtctactacgtcagcggcttccgcacgctggaggagcacgggctgccggggttgctggagctcttgcggcgcgaggtgcgcaaccacaacgccagcatcctggtgctggatggcctggtgcaggcgcaggaggcggccggcagcagccgcgacttcaagaagttcatccacgagctccaggtcgccgccgggctgacgcgcttcacggcgctgctgctcaccagcgctaacggtcccgccgtccatccggaatacaccatggtggatggcatcctggagctgcgcgagcgcacccagggcgtgcgctcctggcgcgagctgcaagtgcgcaagttccgggggagccccacgctgcacggcgtccacgccttccgcatcaccagcgacgggttggaggtcttcccccggttggagtcgcgggtgcagcgcacgccgccgccggacccgggcgcccaccgcctccacttcggcgttccgtccctggacgcgctcttcccggaggggctggcggcggggtccacctccctgctgctcggtccacctggcgcgggcaagacgctgctgggatgcagcttgctggcagagggtctgaagcagggcgagcactgtctgtacatgggcttctacgagccgcccaaccggctgttgggcaaggttgcatccgcgggtatcgacctgggcggcgctatggcggatggacggctcaacttcatctggcagccgccttccgagtgcattctcgacgtgttggcggaccagctcctgtcggacgttcggcggcgcaacgtgaagcgggtgttcgtggacgggctcagcgccatgcaacaggcctcgcccgagcccgcgcgcatcaattcgttcttcgcggccctcacccaggagctgcgttgcacggggaccaccaccctcttcggcatggagacaccgcggctcttcggtccggtgctggacgtcccgatggaggtgggtccttccgctgtggcggagaacctctttttcctgagacatgtcgagctcgaaggccgcctgcgcaggctgctgagcatcttcaagatgcgtgacacccactatgaccccaccctgagggagttcgtcatcacaccccagggaatcgaggtgctgccccccttcagtgtcgctgtggataccctgctcacgggacttgcccggcacccgggcactggccatttctgaacgaacgtcgaggagtagtaccacccgtatggagacggtcctggtggtggatgacgagcagggcatcctggaagccctggcggacctccttcgggaggagggctatcgcgtcctgacggcctctcacggccgtgaggcgctggagcggatggcggagctccggccggacctggtcctcactgactggatgatgcccgttctggacggaccggcactcatcgagcgcatccgggccgagccggcctacaaggatgtctcactcatggggatgagcgcggtggacgtgtccgcgctgcggcatcggtatcctggcatgccgttcctccagaagcccttcgacatccacgcgctgatgcgacaggtccgcaaggccctggacggaaagcaaggctgagccccatgttctacctgctcaagctgggccccgtgccactcagtcagggcaacacgcaggtccaggtgtatctgcgtatctccgattccggagagcccgccgcgcctgtgttcgaatcggacgacggggcggggctgcgggccctgctggaaggggtggacgcggcggaggtgcgctgcgcgccggcgctggccgccgcgggcgcggagctggggctcgccgtggcggagccttcaccgcaagcgctgtcttcctgcgcggccatcgcgaccttcgtggcgtgggggcagcgaggcttgtccgggcttggctcggacaaggcgctgctcttcgtgcaggcgtcgacggagtactgggatgcgcggccctggacgcattgggatgacagccagcccttcgaggtggccgtcaccgggccgatgaaccacaccttcgaggggtgcgtcttccacatgggggacgggcgcgcgggactggcgctgtacttcaagccgggcgcgctgcagatgttgatggagatgcaggcgcgtggccagggtgacgccgccaccagcctgcccgcgattgccgtcacgctggacacgtccccttcgtatgccgtggacgcgctcaccgccgcggggcgcgccccgcgcctgccgctgcccctgaagacggggccggacggcatcagcgtgccgtctccgctggagtccctggtgctggtggcgtcgttgcgcgcggtggcccggctgtcaccggagcagcgcgaggtgctcagcagcgtcgtggccggagacgagcagatgcaggtgcgcgtccgcgcgcccgcgccccgcgtccggcactgagcctgcctgctccgtcagcgagcgcatcgactttcacaccgagtggcgccgcgtccgagccagtgttggctgccggacgaagtcctcccggaatgtcggctgatggccagccgggcgtcccagggggactggtccaagtgtgcgaaagcgcgagagaacacgctctagctgcgagattcccgcaggacggcagcccgtgcttcgccgtcccgggaccgaccaggaactcatatggccacgaagaaggtttcctcccgccgtgaagctgtcgcggctcccccttcaccgcgaatccgggaggatgattcgcagtcgctcgactcgcgccagttgctgcgggtcctcaccgccgtccgcaagggcgacttctccgtgcgcatgccggtggacaaggtgggcagcgccgggaaggtggcggacacgttgaacgaaatcatcgaactcagcgagcgcatggcccgtgagttcgagcgcatcggcaacgtggtgggcaaggaaggccgcatcacccagcgcggcaacgtggtgggcgcgctgggctcgtggggcgactgtgtcgagtcggtgaacatgctggtggccgacctggtgcaaccgacgacggagatgggccgcgtcatcggcgccgtggccaaaggtgacctgtcgcagaccatggccctggaagtggatggacgtcccctccgaggcgagttcctccgcaccgcccggttggtgaacgggatggtggagcagctcggcgcattcgcttccgaggtgacgcgcgtggcccgcgaggtgggcaccgacggaaagctgggcggtcaggccaaggtgaagggcgtggccggcacgtggaaggacctcacggacaacgtgaactccatggcctccaacctcaccgcgcaggtgcggagcatcgccgaggtgacgacggccgtcgccaagggcgacctgtcgaagaagatcaccgtcgacgtgcgcggcgaaatcctggagctgaagaacaccatcaacacgatggtggaccagctcaactcgttcgcctcggaagtgacgcgtgtggcgcgtgaagtgggcacggagggcaagctgggcggacaggccgtcgtgcgcggtgtcggtggcacgtggaaggacctcaccgacaacgtgaactccatggcgtcgaacctgacgtcccaggtgcgcaacatcgccgaggtgacgacggccgtcgccaagggtgacctgtcgaagaagattaccgtcgatgccaagggcgaggtgttggagctgaagaacaccatcaacacgatggtggaccagctcaactcgttcgcctcggaagtgacgcgcgtggcgcgcgaggtgggcaccgacggaaagctgggcggtcaggccgatgtgaagggcgtggccggcgtgtggaaggacctcacggacaacgtgaacagcatggcgtccaacctcacgtcgcaggtgcgcaacatcgccgaggtgacgacggcggtggcgaacggcgacctgtcgaagaaaatcaccgtcgacgtgcgcggcgaaatcctggagctgaagaacaccatcaacacgatggtggaccagctcaactcatttgcctcggaagtgacgcgcgtggcgcgtgaagtgggcacggagggcaagctcggaggacaggccgtcgtgcgcggtgtcggcggcacgtggaaggacctcaccgacaacgtgaactccatggcgtcgaacctgacgtctcaggtgcgcaacatcgccgaggtgacgacggccgtcgccaagggcgacctgtcgaagaagattaccgtcgatgccaagggcgaggtgctggagctgaagaacaccatcaacacgatggtggaccagttgtcatccttcgcctcggaagtgacgcgcgtcgcgaaggaagtcggtacggaaggaaagctcggtggtcaggccatcgttcgcggcgtcggtggaacgtggaaggacctcaccgacaacgtgaacagcatggcgtccaacctcacgtcccaggtgcgaaacatcgccgaggtgacgatggcggtggcgcgcggtgacctctccaagaagatcaccgtggacgtgcgcggtgaaatcctggagctgaagaacaccatcaacacgatggtggaccaactgtcgtccttcgcctcggaagtgacgcgcgtggcgcgcgaggtgggtacggaaggaaagctcggtggtcaggccgtcgtgcgcggcgtcggtggaacgtggaaggacctcaccgacaacgtgaacagcatggcgtccaacctcacgtcccaggtgcgcaacatcgcggaagtcaccacggccgtggccaatggtgacctctccaagaaaatcaccgtggacgtgcgaggcgaaatcctggagctgaagaacaccatcaacacgatggtggaccagctcaactcgttcgcgtcggaagtgacgcgtgtggcgcgcgaggtggggacggagggcaagctgggcggccaggccgtggtgaagggcgtggcaggcacgtggaaggacctcacggacaacgtgaactccatggcgtcgaacctgacgtcccaggtgcgcaacatcgccgaggtgacgacggccgtcgccaagggcgacctgtcgaagaaaatcaccgtggatgtgcagggcgaaatcctggagctgaagaacaccatcaacacgatggtggaccagctcaactcgttcgcctcggaagtgacgcgcgtggcgcgcgaggtgggcaccgagggcaagctgggcggtcaggccgaggtgaagggcgtggccggcacgtggaaggacctcacggacaacgtgaactccatggcctccaatctcaccacgcaggtgcgcggcatcgccaaggtcgtgacgtcggtggccaacggcgacctgaagcgcaagctggtggtggacgcgaagggtgaaatcgccgagctggcggacaccatcaacggcatgatcgacaccctggcggtgttcgccgaccaggtgacgacggtggcccgcgaggtgggcatcgaagggaagctgggtggtcaggcccgtgtgcccggtacggcgggcatctggcgcgacctcacggacaacgtgaaccagctcgccgccaacctcaccacgcaggtgcgcgccatcgccgaggtggccaccgccgtgacgaatggtgacctcacgcggttcatcaccgtgtccgcccagggcgaagtggccgccctgaaggacaacatcaacgagatgatccgcaacctgaaggacaccacgcggaagaacacggagcaggattggctcaagacgaacctggccaagttcacccgcgttctccaggggcagcgggatttgctcacggtgtccaaggtcatcctgtcggagctggcgccgctggtggatgcccagcacggcgtcttctacatctccgagcgcgcggacggcggcgaccagatgctcaagctgctggcgtcctacgcgtaccgccagcgcaagggactggcgaacaccttcaagtacggcgagggcctggtgggccagtgcgccctggagaaggagcccatcctcctgtcggacgtgccggacagctacatccgcatcgcgtccggcctgggcgaggaggtgccacgcaacatcgtggtgctgccggtgctcttcgaaggggaagtcaaagccgtcatcgagctggcctccttccacaccttcagtgaggtccatatgggcttcctggagcagctcacggagtccatcggcatcgtgctcaacacgattgccgccaacatgcgcaccgaggcgctgctgaagcagtcgcaggcgctgacggacgagctccgcaagcagcaggaggagctgacggagacgaacaagcgcctggagcagcaggccacttcgcttcagcagtcggaggagctgctcaagcgtcagcaggaggagctgccttagag

SEQ ID NO: 941 - DNA, 6385 bp, Myxococcus xanthus
tcaggcaagctcaagtcgtgcgggccacgggcaagctccgcaacttgaaaaccgggtggtggcggaccagccaccaggcaacatcggcatcgggcacacccgctgggcgacccacgggcgtccctccgacgagaacgcgcacccgcacacgtacaaggacgtggcggtggtgcacaacggcatcatcgaaaaccacctgtcgctcaaggagcagttgcgctcgcgtgggcacgtcttctcctcggagacggactcggaggtgttcgcgcacctcatctccgaagagctggagcgcgggctggagctgccggacgcggtgcgcgcggccattgcccaggtgaagggcacctacgcgctggccgtgctgacggccagcgaccccagccgcatcgtctgcaccaaggacgcctcgcccatggtgctgggcctgggccaggggcagaacttcctggccagcgacgtgccggcgctgctcgagcacacgcgcgacttcgtctacatggaagagggtgacctggccgtcatcaccgcggcggccgtggacatcttcaaccgccagggccagaaggtgaaccggcccacccgccgcatcgactggacgccgatgatggcggagaagggcggccacaagcacttcatgcacaaggaaatctgggagcagccccgcgccgtcgcggacacgctgcgcggccggatgctcctgtcggaaggcgacgtccacttcgagggctggaacctgtcggcggagaaggtccgctcgctgaccaagatcaccatcctcgcgtgcggcacgtcgtggcactccggtgtcgcgggcaagcacatgattgagtcgctggcgcgcctgccggtcgaggtggagctggcgagcgagttccgctaccgcgaccccatcgtcgacggcacgcacctggccatcgccatcagccagtcgggcgagacggcggacacgctggcggccttcaaggaggccaaggcccgcggcgccacggccatggccatctgcaacgtcattggcagcgcgatgacgcgcgaggccgacttctccgtgctcaccaacgcgggcccggagattggcgtggcgtccaccaaggcgttcaccacgcagctggtggccttgttcctgctggccgtcaagctgggccgcatgcgtggcaccctgtccgtgccggcggcgcaggagcacctgacgcagctcacgaaggtgccgaagatgattgaggacgtcctcaagtgcgagccggccgtgacgcgcgtgtcgcgtgagtacatggactcgcaggacttcctcttcctcggccgcggccccatgcacccggtggcgctggagggcgcgctcaagctgaaggaaatctcgtacatccacgcggagggctacgcgggcggtgagatgaagcacggccccatcgcgctcatcgacgagaagatgccggtggtggtcatcgcgccgaagcagccgcacgtcgcgtacgagaaaatcatcggcaacatcgaggaggtccgcgcgcgcggtggcaaggtgattgccatcatcgacgaggacgacgagcacgtggccacgctggccgaccaggtcatccggattccagcggcttgcgcgctgctggcgccggtggtggccaccatccccctgcagctgctcgcctaccacgtggcggacctgcgcgggaacgacgtggaccagccgcgcaacctggccaagagcgtgacggtggagtagccgccgcgcgtcttcggacgtgaagcgccagaagcccgggctcccgcgaagggggctcgggcttcgtcgtttgtgcgtgagggagcggcacctggtgaaggcgcgcgctcccgggcactcatgtctccctccgccaccctccgcattgcctgtgcgtccgaagccgcgtcgtccactccgacatcaaccccgttgcccggtgaatgttgcgggggcacgtcgctttgaacctccccgggagccgtggctacagtttcctccgtgcccgacgcgcctcgcatacatccgcccacgcagcggcccatggagggcgaggacgaggcgccactgggggaggtcgcgccgtgggaggcgccgcccgagcccgcgccgctggaggccactccggttcctctgctccgggggacgcccacgccgccgttggacctccccctgccggtgctggtgttgaccgagcaggcccggcgggtgccggaggcggagcgtcccctggtggcggcgcggctgaacctccagctgtcccggatggccaggacaggcggagaccggctggtggcggacaccttcctccggctgttggagagcgggcggctcaccggactggtggatgcgaagggacgcacctgccgcgcggccgccgtggaggctctgttgtccctgggcttcccctacgccctggaagtccagcccgaggacctggcgcacctgcgcgccaacaccctgcagcggaaggcgcaccgcctgaagccaggtacgtccatggcggtgttggtgggaggcatcggggtgcaattcgtccatgaagcgctggtccacaaaggggacgccagcctgctcacctcccaggtgggtctgtccctgctggcgatggccgccttgtggcttgctccgccccggacgcccgtgtaccgcgtggggttgctgatgctgtccctggtgtccctggcgggggcggtgtttgcgctcctgggcgtggcgcacacggggctgtgggtgggattggcggggctggtggccgccttcctggctgccctccgcgagggctgaccggcaggatgcagcacggatgtcagaggggtggactagggtctacccatcgcgtactaaaagcgcgttcaggtgagccggggtggctcgccaatacaaggagctacgagcaatggccgtgaatcaggagaaggaaaaggcgatcgaactggcgatgtccgcggtggagcgccagttcggcaaggggtccatcatgcggctcggcaacgacgagccaatgatgcgagacgttcaggccatcccgacgggctccatctcgctggacatcgccctgggcgtgggtggcgtgcccaagggccgcatcatcgaaatcttcgggccggagtcgtccggtaagacgacgctgtgtctccacatcgtcgccgaagcgcagaagcgcggcggcatctgcggctacgtggacgcggagcacgcgctggacgtgggctacgcgcgcaagctgggcgtgcgcaccgatgacctgctgctgagccagccggacaccggtgagcaggcgctggaaatcgcggagatgctggtgcgctcgggcgccatcgacgtgctggtggtggactcggtggccgcgctcgtgccgaaggcggagctcgagggtgagatgggcgacgcgcacatgggtgtgcaggcccgcctcatgagccaggcgctccgcaagctgacgggcaccatcgccaagagccagacgtgcgtcatcttcatcaaccagattcgcatgaagattggcgtgatgttcggcaacccggagacgacgacgggcggtaacgcgctgaagttctacgcgtcgcagcgcctggacatccgccgcatcggcgccatcaagaatggcgacaacgtggtgggcagccgcacccgcgtgaaggtggtgaagaacaaggtcgcgccgccgttcaaggaagtcgagttcgacatcatgtacggcacgggcatctcccgtgagggcgacctcatcgacctcgcctccaacgagaacatcgtggagaagagcggcagctggttctccttcaatggtgagcgcatcggccagggccgggagaacgtgaaggagtacctgcgcgagcacccggagatcgcgaaggacatcgaaggccgcgtgctggagaagtacggcatcggcaagtcgggtgcgcccgtcgccgcggcgccggacgagtccgcgccggccgaaggtggcagcgagaagcgcggccgtgtgaaggccgtgaagtagtccggtccccggggcttttccccggatggtggcaattcaccatgaaagccagagggccgtccgccgcgaggtgggcggcccttttgcttggtgtccggcgtccttcgcgtgggttcgcaccgggcgtgggtgacacgatgcgttgtcgtttcattccgtggggatgtttcctgctgagtggaagagcgctctagactcgcggccctgtctcctaacccgcgcaacccggagtcccgccttgttcgatagattcaaacgccgcagtttcctccaggccgtcgtcgccgttgccgcgaccactgcgttcggatgttccgacgacgagacgacgtcggatgctggcgagaagtacttcccgcagtccgtgtgctcgggtgacccgcgtccggacagcgtggtgttgtgggtgcgggcggtggacccggacaacgcgggggcgaacacgcaggtgcggctggaggtgtccaccagcgagtcgttcagcagcgtggtgctggaccagcagttcaccgcgcaggcgcagttcgaccatgcgttgaaggtgaaggtcaccaacctgtcggcgcgcacgacgtactactaccgcttcaccatcgacgcgaacggtcagaagtactccacggtgacgggccgcacccgcaccgcgccggccgcgggcgacgacgtgccggtgaagttcgtcttcgccagctgccaggactacatcggtcgttactacaacgcgtggcagcacctgctgcagctcaacgaggacctcgacttcgtcgtgttcctggccttctacgtctacgagacgacgggcgacgcgtcgttccagtccgtggacggacgcggcatcgtcttcagcgagcccgagaaggcgctccgccagggcacgggcctgacggcgttctacgcggccaactcgctgtccaactaccgcgacctctacaagaccctgcgcacggataaggtcatccagcaggtgcacgagcgctacccgttcgtcatcacgtgggatgaccacgagttctccgacgactgctggggcgacgtcgccacgtacacagacgagcgcaccaacgagaagcagaccgagcgccgccgcaacgcggagcaggccttcttcgagtacatccccatggaccacggcgcgagcgacgcgggcgccatcgacatcaacgccgtggtggcccagccgacgcgcatctaccgcgacttcgagttcggccggaacctgaagctgctggtgacggacacgcgcacgtaccgcccggaccacctcatccccgaggacgcgtacccgggcaaggtggcggtgccggccgagcagctggccctggtgctgtcgtcgctgccggaggccacgcaggcgcagttgcagtccgacatgttcgcctacgtggacatcgacgcggcggagctggcgccctacaagcagatcctcacgggcgtgtacgtgcagcaggccgtcgccgccgggctcacgtcgggagaggcgaccgagaaggcgggcgcctgggtctccggtgggctgtcgctgttctacgtcaaccaggtgctcaacgccgtcaaccaggcgcgtgaggcggcgggcgattcggccattccgctcatccccgcgacgggcgcgccgcgcggtctggcctatgcgcacatgggcaagacgggcctcttcggcatccagggctcgcgctacgtcgtggtgaagcccatcttcgacctgtacgcggccatcaagtacatgggcaccgcgggagcctcggagggcatcttcggcaacgagcagcaggcgtggctccaggagtccgtgcaggcggacaacgcgtggaagatcatcgtctcctcgatttcgctcacctccatggtgttcaagctgagcgagaaggcggacgtcccggaccccacgctgcgccaggacttctacttcaacgtggaccagtgggacggcttccccacgaagaagcaggagttcttgaagttcctgcgcgacagccaggtgaagaacgcgctgttcatctccggcgacatccacgcgtccttcgcgtccgtggagtccggcatccccgcgctgacgacgccggccatctcctccggctccatcaaggagctggcgggcctggccgtcatcggcgcgggcttctccaccggcagcacggtgtaccggtacatcgtgacggagctggacaagtcgctgaaggaagcgcaccccggcatggcgttcgtggacggtgatgcccacggcttcgtggtgctggaggtcggcggcacggaggcgaaagcggccttccacctcatcccgagcacggaaatcgccaaggactactcgctgcgccagccctccgagctgacgggcgaagttcacccgccgcgacttcatcatcaaggacggcaccatcacctccgcctgaggagagaatgcctcacctgttcgg

SEQ ID NO: 942 - DNA, 9993 bp, Myxococcus xanthus
gccccaccaccaccagccgccccggcacccggcgcagggcctgtagcgcggtgaacaggcccttgtagtagacgagccgccccaccatgagccacagcggcgcgcccgcggcctgtgcccgccagtgggcctccgcctcacgcgcggcggcgcagggatggaggtacggcgccaggtcgagccccagcggcagcgcccgcaccttgccgcgaaaggcgcgcagcagcggtgagcctgagacataggcctcgctggtggccagcacccgccgtgcccgcgcgtagagcagcgcctcgaagggcttgaagagcgcgcccgccaccctctgccggatgacgtcactgtggtgggtgatgaagacaggaggcagccggcgcaccacgtccagggccagcacccaggtcgggttgggcgtgtgcaggtgcacgatgtccacgccccgcgacaacgcgcgtcccagcatgcgcggcaggtccggcatcgcgtccatgcgcgcgacggaggccagccggcccaggcgcgtcacgcgcaccggtccgtcccacgtctcacacgtggggctgcggccctggaactcgtggctggtgcccgcgccgtccgcggcatggttggcgcacagcacctccacctgcgcgccgagcgccgcctgggcgcgcgccagcgtctgcacgtgggcctccatgccgcccgacgcgggaggatagaacttgcccaggtgcagcacccgcagacccgcgcccgctgatggcgcgttcacgactgcgccaccccatccttggagtcttccgcgtactgcccgtagccctggtagcccagatacgaatcaccgtagcgcggcgccgacaggtccacgtcgttgaggatggcgccgtacatgcgcgcctgcacgtccgccagcgagcgcagcgcacgccgcgccgactcgcggttcgtcttggccgccttcagcaccagcaccacgccgtcgcacttcgtggccagcaccgccgcgtccgccaccgcgttgatgggcgggctgtccaggatgacgcggtcgaagcgctcggaggcggccttcagcaggtccgtgaaggcctgggtgtgcagcagctccgccggattgggcggcagcggtccgcacggcagcacgaagaggccgggcacctcggtgctcttcaccgccgcgtccagcgtgccctcacccaccaccagcgaggagatgcccagctcgttgggcactccgaaggcgcggtgcaggcgcggccggcgcatgtccgtgtccagcagcagcacccggttgccgctctgggccatggccacgcccaggttgatgcaggtggtggacttgccttcctgcggcccgctggacgtcaccaccagcgtcttgaacggattgtccggcgacatgaacagcaggttggtgcgaatggcgcggcagcactccgccgctgtcgacttgggttcgcggtggacgtgcaggtcccgctcgcgcggcgccttgctgccgtccagccgcggcatcacgcccaggaaggccagccccagccgctcctccacgtccgcctgcgtggccacgctgttctccaggagctccagcagcagcaccacgcccaggcccgccagcagccccatcaccagccccaccgccaggttgcggcgcacgtgaggcttcaccggcaccaggatgggccgcgccgggtccagcacgcgcacgttgctggtgcgcagcatgcctgacagctcgatgtccttcaggcgcctggccaccagctcgtagaggcgctggttgttgtccgagtcgcgcttgagccggtcgaactcgatggccttcttgttcaccaggaaggcctccgacttctccgcgtccagcaggcgcaccaggttcttctcctgcgccaccgactccgccagcgacgtctccgcgctgcgcaccacgttgctcaggctcttgaggaagtcctcgcgcaccaccgacagcttgcggttgcactccaggagcttcgggtgctcggacaggtagcgctcgcccagctccgcgcacgtcatgcgcagctcggtgtagctgcgccgcaggtcctggatgggtccgtccgaggcgcccgacagcgcctccgcccacgtctcatcctccggagatgccttgcgcagccggtggatggcctccacccgcgcctgctgagcggcaatctggatgcgcacctcggtcagcttcaggttgaagctgttgatgcgctcactgacgatgctcatcctcgactcgagcgacgtggacagcatgtccgcgtccttcttgaagtcgtagacggccagctcgctcgtcttggactgcgactccagctcggccagacgaatctccaaccagtcgcgcgcgtcctccgtcgtccggagcttgagggccaggttctccgccatgtacgcggcggccacctcgttggccagcagcgcggcgcgcctggcgtcgaagtcatccaccgcgatgttcatcacccgcgagtccctcgcgggaatcacccggatgcgcgactggaccagcgccaccgcgtccgcgccctgcatcgcctgcaggcgcgtcttctcgtcggtgatgtgcgccatgcccaggaagtccgcgtccgtggacaggcccagcttgtccaccacccggcccgccaccgcgcgcgaggtgatgatttgactctgggtggcgtagtactccttgttgaaccagtagttgctgcgctcctcgcccatcacctccttcacttccccatccaggaagcgaggcgccatcacgtcgatgatgagcgaggcactggccgagtacaccttgggctggcgcagcgtgtgggcggccgtgagcgccgccaccaccaccgccacgccaaggacgacccacttgcggcgccacaccgcgcgcacatactgcatgaggcccgcgggcgtcaggccaccggcgccgccggccgggtcgaaaccggttccatccacgtcacgtctccctgccgtctccagagcgactccacggcctggcggcactccgccgacctacacccacacgcttggggaccgcgacgagcgtgccgtgtccccgcggggttgtccatccttccgcggtcgcctggatgccctccatccacgcttcatcgcggacgctggcgcgcatggccgagccgcctgtgctagtcagcccggcgtgacgccaccgctttccttcgtcctccccttcacgcccgagaccgcggctgccgcttcccgcttcgcccacgcgttgcctcctggcgcggaggtcgtcctcgctggagagggctccgtcgacgccgcctcgtcgcccaacgtgcacgtcctcacggcaccgggtggcaagggcgcggccatccgcgccgcgctggagaaggtgtcgggcgcggtgacggtgctgcaggatccggacacctcgtattcgcaggacgtctatgacgcgctggttcgccccatccaggcggacaccgcggacgctgtcttcggcctgcgcacggcgcaggggctggcgccggagctgctggcggaccgggccctgggccacgtcacccgcttcgtcaccgacgtgccgctgacggacccgctcaccggtctgcgcgccttccgcaccgaggcgctgcgctccgtcacgctcaccagcgacgacgacgcggtggacgcggagctggtggtgaagctggccgcgcagttgttccgcctcaccgaggtgacgctgcctcctggcgcagtgcctcgccggacgcccgcggcgcacctgtcccggctcaagacgctggtccgctacgcgacggtgcgcgacgacgcggacaaccagcatgagggctacaccacgctggagcgcatggacggggccgtccactacaaccagtggctgggccgccgcttccgcgagcacctgggccgccgggtgctggagattggcgccggcatcggcacgattacccgcgagctggagtcgggcctggagctgctcatcgcgctggaggtggaccgcttctacgtggaccgcctgaagaacctcttccgcggcaagccgcacatccggccgtacctgtccgacgtggccctggcggactgggaatcgctcaagacggagcggctggacaccatcgtcctctccaacgtgctggagcacatcccggatgacgcgtccgccgtccggcgcttcaagcagattctggcgcccggaggccgggtggtcatcctggtgcccgcgctccagcagctcttcggcgccatcgacgaggccgtgggccactaccgccgctacacgccctccacgctgcgtgcggtgctggaggagaacggcttccaggtggagaccctggagtggatgaacctggccggcctgccgggatggttcgtcaacagccgcctgctgcgccgccgctcggtccccaagctccagctcaagctctacgacacgctggcgcccctgattgcgcgggcggagtcgcacgtgaagctgccggtgggcatgagcctcttcgccgtggcccgcgccaccgggggcgatgcgtgaggcaccgccgccacgcgtgacaccccggctgtccattgaatcgcagccgccttcccaggcggcctcgcccgagagcagggccccgccgccatgaactccacgcccttgcccgccgacgcgcccccggagcccaccacggcccccactcccgagcgccaggccctgccgtcccgaggcgcgccgcgcgccgtatgggccgccctggcggcgctgtacgtgttgctgttcccgtaccacccaggcctgcgctcgcccaacgagctgtgccggctgtggcagacgcgcgcgctggtggagtacggcaccctgcacatcaaccaggcgctgaacgactacggcaaggtcggtgacctgtccgtgaaggacgggaagtactaccccagcaaggcgccgctgctgtcgttcgccgccgtgcccctctacgccgcgctgcgcgcggtgggcggcggccaccggcatgccgtgcccgaagtgcccctggtcttcttctcgcgcctgctgctcaccgtgctgcccacgctgggcctgctgtggctggtgcgccgctacctgcgcgcgtccctggagccgctcgtcgcggacgcgctcacagtgacgtacgggctgggctcgctggccttcagctactcgctgctcttcatgagccaccagacgacggcggtgctgctcttcgccagcttctacgcgctgtggcgctgcgcgcgtggcgaatggcgcgagcggggctacgtcctggcgggcgccttcgcgggcgccaccgtggccgccgagtacaccggcgcgctgggcgcgctcggcctggtgctgtacgcggtgctcaccatcgccttccaggacgcgcctgtgcgtgttcgctgggcgcgcctgggccgggccgcggggctggccacgctgggcgccctgcccttcctggtggcgctgatggcctaccaccaggtgacgttcggccacccgctgacgagcggctacaagtacctcaacgacgcgggctaccagccctggcacctgggcggcttcctgggcatccgcacgccggacccgcgcgccttcgccctgtccttcttctccccgctgcggggcctgttcaccctggcgcccttcctcctgctggcgctgccggggctggtgctcgtgtggcgccgccggagccagtcgccggaagcccgcgcgctggcgtggctgagcctggccctgctcctgggctacacgtacttcacctcgtcgttctcctacgactcgtggggctggacgacggggccgcgtcacctcaccggcctggtgcccttcctcctgctgcccgccggcctcttcctggagcgcctgcgcgcggccggccagggcgcgtgggccctgggcgtggccgcgctcctgtgcgcggtgtccatcgtcaccaccggcgtggccaccttcatcaactacatccccgatgacgtctccaacgcggtgggcgccctggcgctgccgctgctgcgtgcgggctacttcccgcccggcgtgctgaccttcctggggctgccggcgggactgacgggtggggtgctggcggggctgctgctgggcaccgccgcctgggtcttcgtcagcctggcgcggaagcccggccagacgtggcccgcggcgcccgcgctgggggcatccctggcggtgctgctgctgctgggtacggcgcatgtcttcaccagccggcatgacaccgcggaccgcaacgccgtgcgtttcctcaagtccgtctggttgaacgccccggaacgcgacgtgacgttctggcctcgcgggcgcggctgaaacacgacgctccgtgagactgtcacggagcatccacccgtctcgccctactgggatgagcctcacggtccgtcccactttgtcgctgactcgcaagttttgcgaggtccgcaatccgtgtcgtgtgactccgtgtcaggctttacccagggccctggccaagcggctggatgcattgacatggctgcaccgcgagagcgggcctgaggattgctgagacagacacctgcgcttccctgctgcccttcagggcaaggagtccccggtgcgctgtcatccgacccgcaagcccgcacacgcctctggcgcgcggagagggttcaccctgctgctggcgctgggcctcatcgcgctcgtcaccgcgggcgtgctcgtgtccctccgcgcggtgaccacggagagcacgctccaatcccatgagcgccgctcgcgtgaagccctcttcgccgccgaggcgggcatggccgaagggcgcgccgtcgtcctggcgatgatgaacaaccccgtcgcgggaggcgttggcagctacagccaggatgtcctgcagcgcctgcaggtcgtggccgagcagggcctgcccgacgtcgccgcgggcggcgtgccctggcgagagctcattccccagacgccgtacacgctggcgcgtggcacggccatcgacgacaccgtgccgggcgcctccgtcgaaatcaacgacgtggagggcgagcccatccgcgcctatccggaggctcgcagcgtctccttccgcgtcttcgtcgtggaggacgacgacgacgccgaccgcaacgccgacgccaacggccgcatctggctggtgtcggtgggcgaggtccaacccccgggcccgggcctcccctaccgcaccatcgtccgctcactcctggagcacagcagcaccccgggagggctcgcgtgcagctacggcacgaagatgggctgccggggcaccggcacctccagcagcggccttccgacattctgattcccaagccttcgaccgcaatccgttgcacctgaatcgggcggccctgaagcaccggccgccaggggggacatcatgcgctggactcgaacctggatggccgcggtggccgtggccgccgcgggagccgtgctcgcccaaagtcccggcggcgacacgggcagtggcggcacagatggtggcgccagcagcctcgcgctgtgcatcgacaccacggaccaggacaagcaacccgacttcagcagggacgcgggcatccccagcgccatcatcgtcacagatgacaacccgcccaagctgcggctcaacaccaacctcaacgtcctggacccggagaaaatcatcctgcccttcgagcaggagctcaccgcgctcatcgtcgatgaccgcgcgggcagcggcgcctccagcacgctgggctggttctattacgacgagctcatcgacgccgaatacatcgacgacaacggcacgcgagagaactccgatgacgaccgcctgctggacaagaacaacaacggcgtgcccgacttccacgaggacctctacaacatcaacccctcgcgctacatcggcgtggcgccccgctgtcccaaccggacgttcacccaccggcgctggggcgatgcggggacggtaacgctgcgcgagcccgacctgctgatgggcccgtgcaactccggcagcaactacaccgccaacacggggcctcgcaggtggcaggggcgcgctgactaccccacgcggccttcgacgggcggcgtggtgggccgcgcggtgcgcgacttcaccagcgccttgttcgcgtatgacccctaccacggacgagacaacctgcagcagagcgcggtcacctccggcatcatcgacacctacttcagcgaccagggcctgttcccgcacatcccgaacctgctggagccccggcatgccctcaatggcaacaggggtatcggcaacctcgtcttcctttccacggacgacgacgagacgtcgtgccacgaatcggaatcggcggagtgcttcgcgccacgtcagggctggacgctcgacggcaacggccagttcatgcgcaccggcacggcctgggacaaatccgatgtggcggacggcatccctgactacaaggccagcgcgttcgacagcgcgggtcgcctcatcaccggcaagagcacgaccgccgccatcaccaaggccgaggaccaggtcgtccccatgggacgcctcgcgggccggcgtgaaatcgtcttcttcctcgtcacctacgtggagcaggtgtacggcccggccacggattcgtgcttcatcacccgtccgacgacggatgggcgcgaggtgcaatgcgacctttggatgcacggcgacatcaacgtcttcttcaccaagacgccgctcaacatggacctgcgccagggcaacgacccgctcgtggtgagacagaagaacctccgcaccaactggggtgaatcccgtggtgtacccccggctggagaacgacccggcctatggcggcgtcgtcttcccgttcgaccagacgcaggatgtcccctccgtgaaccgccgcgcggcgcacacgattgtgggcgcgccgcgtgacaaccccctggtctggattctgggctgggaggaccagaacgcgggcggtgaccgcacgtacagcgacatcgtcatcctcatcaacaagcagaacaacggctcctaccgctccgacgtggtgtcggacatctctccggacatctccctggacttcaccatcaccgaggtgacgttcaccgtggaggaccagccctactacgcggcggatggcggcggcgtcgcgccctgctcgctctccgtcaagctgccggacggcggcacgggccagcgcaggccggacatccgctatgaggtggcactggactgcaaggtctgccaggagccctgcaacacctccaatcccacatacatcctcaacgacaatccgaactggctccgggttcccatcccggacagcgacggcggcgtgcgcaatgagacggccgtcctgcaggacttcctggagcagggccgcgtgggaacacagttgtgctggcgcgcggtgatggagagcccgggtgagtcctgccagcccaccatccacaacatcaacgtctcctacaaagcgcagcgcagcggtgaatacggccgcgcgtcgctcatccccatggccaacgccgtcatccacggcgtctatgaaacgcccgggcgcgcctgggtcgccgacggaggcgtggaccaggtctccatccgcacctacgacaaccgcccggacaccatcgaccggggccacatctacctgaagaagctctacgagcccgcaacgctggcgccctatgagcccacccaggaggtctgggactccggcaagtggatgcgcgacctgatgcgcacgctggagacccgtcccggcgagccgctcgacacgcgcaggctcgtcacgctcaatccggcgaaccagcaggccatcgacgtgaaggacctgatggcgcgcgccaacaccaccagccccgtcttcccagatacctactgcacccgccgcaacggcagcgtgtacctgtatgacctggatggccgcaacggctgcaccgcggatgaccgtgtggcgctgcgcgactggctctacggctgggaggaccgccagtcctccgtcatccgcaaccggatgcgaacctggccgctgggcggcgtcaacctgtccttagagcac

SEQ ID NO: 943 - DNA, 8658 bp, Myxococcus xanthus
ccctgggcctgtgcatcgaagggacggcagtgaccgtccggcgacgcgatgccgccgggctggtgcacgtagcccgtgcgctggggcacgtccacggacacgccgcccgcgatggccacgtcacactggaagcccatcagtgactggcaggccaggtgggtggcgaccagcgacgtggagcaacccgtctggacatccaggctggggcccttgaggtccaggtggtacgccagccgcgtggcgaggaagtccttgtcgttgccaatcatcacctggaagctgtcgctcgactcgagcagctccgggtgcgtgcgcaggttgaagagcaggtacgtgctcaggctcgtgcccgcgaagacgcccaccgagcgcgactccgtatccagtccgtggcccgcgcgctcgatggcctcccacgcgcactccaagaagatgcggtgctgcggatccatcagcgccgcctcgcgcggcgaatagccgaagaagctcgcgtcgaacgcgtccacctggtccagcacggctccggcgcgcacgaagcccggctgtcgcaggcgctcctcgggaacgccgcgtgccttcagttcgtcgtcggtgaagaagcggatgccttccacaccctcgcagaggttccgccagaaggtctccacgtcgggggagcccgggaagcggcccgccattccgacgatggcaatggccagatcgtcgccttcactcaggttgtcttcgctcatggctgtcgacgaactcacgttcaggaagcgaggtggggtagcggtccggtggcaccacgcacactccccacggagccctcatgccgcggggctcagggcggtgaccgtgacgcggggcagggctccgcgttgcgcggaggcgaggctcagctggctgcctgggcggcgggcggcgtgctcgagagagagaacgcgtcagcgagcagctcgtaggagcgcatccgggcgcgatggtcgtggacgatggtggtgacgagcagctcgtccgcctggaattcggcggccatgcgcaacagctgttccttcacctggtccggtgaaccacacacgacgcgtttgcggtcgaactcgagcgtggccaggtcctcgggcgtgtaggcgtaggcctccgcctcctcgatggacggaatgggcgcttcgggccggcccctgcgagtgttgatggtcagcaggtcgctgctccgggctattcgccgggcctcctgctcggtcggggcacagatgacgtagacgctgactgcggagttgggagccgcctgcacgtgcgagggctggaagcgctcgcgatacccccgcgtcaccggtccaccgtggatggggttgaagaagtgcgcgaagcagaaggacagacccagccgggccgcgagcgcggcgctctgctcgcccgagcccagggcccagacctgcggcatgcccggcgccatggtcttcaggctcagcttctcgaactccggcgtcgcgggcgtggtgcccgacaggaaggcgacgaggtcctccagcttcgtggggaagttctcgttgttcatcggcggcccgtaggccagtgcgcgggccaccaggtccgtgctgcccgatgtccgtccgatgcccaggtcgatgcggttggggtggagcgtctccagcagccggaagacctcggcgaccttgaaggggctgtagttcgacagcaggacgccgcccgttcccacccggatgcgagacgtcgccgccgcgacatgcgcgacgaggatttccggcgccacgcccgcgaagtgtcctgagccgtgatgctccgcgagccagaagcggtgataaccgagctgctcggcggctcgagccagctccaccgtgttttggaaggccgcacgtgtctgggagtcgctggcgacgatggagtgatcgagaacactgagcttcacggcgagcgttccttcccgggcagacggcgccctcggggccgcttcgagacgggccgagtcgtcgcgtgtccgcgtttcaagatggtgacaaagcctatattaacgcggttatctgcgacaaatgggatttggttgattatgcttgaaaattgagaataggtggcagcccggagtgcgcctgaataccaggggctctttcattccccgaggctcggtgtgacatcggctgttactcgacgacgacgagcgcgcacatcaacgcgccttgggtcgcgttgaccacgtccttgccctgaccggtggggttcagtcgcaccatggttccgccgtaacgctcaccgaagacaaaggctccccagatgaggatgtgggcgcccacggcgccgtcgtctcgcaggaagtggtaggggcggggctcgacgcgctcctggacaatccatccgccgtgctccagggcttcctggatggcggcgtcccagtcctcggcggtcatcgcgcggccaatcagcaccgacttgccgccataggcgcggcccgccttgagcaccaggccttcgcgcttcgaggcggtgagctcgtcgggcagccacacggatgcgccgtcgcgcgtcgtctgggtggcgcgcacgcggcgcgtccagggaatgtgccggcggatgagctcacgctcctcgggagtaagcgcgggtgacgcctcgttctccgacagcagcgcgatgttgagcttgtcgtcgagcagctcctgcgctggaccgttgtagagacacaaggtgcgcgcggcgagcgcggcgcggacgcgagcgtcgaagtccgggcccaccacttcgagccgatctctcgcgtcatgttcctgcacggcatgcagccgccggccgcgcatcgtgaagcagtggccctccgcgtccttcacctcgctgtaggtgccgatgagcacctcgcccttcgcgccttcagcagcgagcagttcgctcagcgtgctgttgagcagcagcgtcgccatctccctgcccgcggcttcgggcagctcattgtcagggaagagcacggccagattgcattcgccttcccacgcaacggtccgtcgcacgtcctcgacgacatgactcaggaaggcgcgcagcgtgtcctgcagctggatgcgcaggccctgctcctcggtgaagcgctggagcacgggctggtccatcaccacctgagccttgagccccgtttcccaaccgcccaggcccgccatcatgttgacctcaaggcacttgaggccgtcggccgagtcgatgaagtccccgcggctgagcgcgccgcgcgcatcctccgtgttggccaggacctccgccgccacgcgcgcccgttcctgcgagacaccgtagtagtcggcgatgcgccgagggtcgccgtccagcaacagccgaggcccgcgcttgacgagccggcagagcttgaccgagacctcctccagctcacggtcgcggcgcgagtcgatgaggagtggccaccggtgcagctcgtaatacatcagaggtgacgcttcgaacttgtggaagcggtgccgcgcgaacacctcgggcgtccgctccgcgaacttcaggaaggccaccgccgccgcggacagctcaccgtgcagcgcctggatttcatcggagaacttcagctcgcctggggattcgttgacgtgtggcattttccgggtaatagcactttgactcagagtgcgtataaagcggctgttttacgtgctcgaagcgacggcggctcacgcggaggcttcaaccttccggggcgtcggctgagctgatcccgcagcgcgagcggggtgttggtctggagccgcgtcagcagccgctgcgctccgatgcgcgcgagcccagcaccaggactccggacgaaaaccggaatgtgggtgctcatagcttatgctgcgcgttcccccccagcgaaggtctccggcttttccacagctccaccccttggaacctctcaccatgcgctcccacccggccgcgacactgctggagctcctcgaaacgcagacccagtccctgggtgaacggcggctgtacaccttcctggaggatggcggggatgacgcggtcctgagctacgccgggttggatttgcgagcccggcgcattggcgcggcactccaggccctggcgcgagcgggcgagcgggcggtgctcctctatccaccgggcctagagtacgtcgcgggtttcttcggctgtttgtatgccgggttggtcgccgtcccagcctatccgccggacccgatgcggctggagaggacgttgcctcggctgcgcgccatcattcgggatgcgcgcgcgagcgtcgtgctcaccacctccttcatccaggagatgggggaggggctcttcgaaggcgcccccgagctcgccgcgctccgctgggtggccaccgacgcgttgcccgaggggactgaggcggggtggcgccgtccggagccttcgcgggacacgttggccttccttcaatacacgtccggctccacgggggatccgaagggcgtgcagctcagccatgggaacctgctgcacaacctggggctgatctcccacgcgttccaggtccgctcggacagcgtgggcgtcatctggctgccgccgtaccatgacatgggcctgattggcggcatcctccagccgctctacgcgggcttcccggtggcgctgatgtcgccgctcgcgttccttcgccgcccacggttctggttggagtcactgtcccgcttcggtggcaccatcagcggcggcccgtgcttcgccttcgacctgtgcgtgaggaaggtgcctcccgcggagcgtgaagggttggacctgcgtcgctgggagctggccttctgtggggccgagcccatccgcccggaagtcatgacccgcttctcggaagccttcgcgcccgtgggcttccagcgcgaggcgctctatccctgctatgggctcgcggaaggcacgctgatcgcctcgggtgggcgcaagggcgaaggtgtcctcacgcggatgtgggacgcccaggcgttggagcggaacgaggcgctggcggccgaggacggccctggggcgcgcccgctggtggggtgcggccagacgctgcctgagcagacgctgctcgtcgtggacccggagacgcgtcgcgcttgcccgcccgagcgggtgggggagatctgggtctctggtcccagcgtggcccacggctactgggagcggcccgaggagagcgaggccgcgttcggggcacgattggcggattcggacagcggcccccggttcctgcggacgggagacctgggcctgctgaaggacggcgagctgttcgtcgtgggtcggcgcaaggacctcatcatcctccgcggccgcaacctgcatccgcaggacctggagctgacgctggagcgcagccattcggcgctgcggcccggttgtggcgcggcgttctccatcgacgtgggcggcgaggagcggctcgcggtgatgtacgaggtggactcgcgcaagccgtggaccgccgaggacgtggtgggcgcagtccgccggggtctggcggagacgcacgaggtccagctccacacgctcgtcctcatcgagccaggcgcgctgccgaagacgtccagcgggaagattcagcggcgtgcttgccgggctgaattgctcgcggggacggctcgggcgctgctgacctggagcgagtcggaagcagacgcgccccaggccaaggctcccgcgcctgacatcaccgcgtcccagccgctcaccgtggaggcacttgaggcgtggttgctggcgcggatcgcctcgcggcttcgcgtccgtccggaggagctggcgacggatgcgcccatcacttcctttggtctggactcactgggcgccgtggagttggcgaacgacgtcgagaccctgggcgtggtccttcgcatggaggtccttcttcaggggccgacggtgggggcgctcgcgctgaccctcttcgcggcgcgtggggcgtccactggcgccgagctgacgcggggcgaggagaggacgcccgcgccgctctcctccgcgcagcaaagactgtggctgttcgagcaattggcgcagggaagcgccgcgtatcacctgccggcggcggtacggctcaccggtgcactggatgatgtggcgctggagcatgccttcgctgcaatcgttcagcgccacgcggcactccgggcgacgttccgcgacgaagatggcacgccgtcgcaggtgacctcgtcggtgccggtgtcatcacttcgccgggtggacctccgcgacgtcccggtggatgcccgcgaggaggccgcgcttcgtctggcccacgaggaagcgcgggcgccgttcgacctcgagcgcggtccgctgctccgggccacgctgtttcaattggacgcgcacgagcacctgctggtcgtggtgatgcaccacatcgcctcggatggtgcctcgttcgccatcctggcccgtgagctgagcgcgctgtacgcgggtgatgtttcgctgccgccgttggcctttcagtacccagacttcgcgcgctggcgccgcgaggtcgaggcggacggcgccctggccacgtcgctcgactggtggaaggcgcggctggcagggggggccgcggcgctggaactgcccgcggatcggtctcgaccgcccatgccatcctatcgcggtggccgcgtggcggtgcggttcccggaggcgctgacggctcggctggaggcgttgggccggagcgaaggcgccacgttgttcatgacgttgctggcggctttcgaggtgctgctcgcgcgtcattcggggcaggcggacttctgcgtcggaacggccgtcaatgggcgtgagcgggcgggactcgaagggttgatggggtgctttctcgacctgatcgtcctgcgcgcgtccgtgtctggctcatcacgtttccgcgaactgttgggacagacgcgggaaggcgtgctggcggcctttgcccaccggggcgtttctttcgagcggctggtcgacgcggtccaacccacgagggacccctcgcgcgcacccttgttccaggtgctgttcgtgctccagccggagcccggcgcgggactggcgctgcccggcctggagtctcgccgcgtggaggtggacccgggggccacgccctacgatttgacgctgtcgctggcccgagggccggagggactgggagggtggctcgagtacgccacggacctgtttgatgcggacaccgccgcgcgactggtggcgcggctgggcgtgcttctggaatccattgtcgcggaccctgaccagcgcctcgccatgctgccgctgttgcctgaggcagagcagcggcaggtgctggtcgactggaatgacacgcgggcggagttcccggaggcgtgcatccatgcgctcgtggagttgcaggcgcagcgcactccggacgccgttgccgtggtgtgtggcgacggggtcctcacgtaccgtgagctgaaccaacgagccaacgccgtggcatggaggctgcgcgagcagggcgttggacctgagtgcatcgtgggcctcttcgccgaccgctccgcggacctggtcgtgggcctgctgggcatcttcaaggcgggcggtgcgtacctgccgctggacccgtcgtatcccgaggctcggctcgcgctgatgctggaggactctggcgcctcggtggtgctcgcgcaccggcatctggcgggcgcgcttccgttcggcgataggaccgtggttccgctggatgtggctggcgaggccgacgccgcgccaccgggagccgtggggcccgacaacctggcctatgtgctctacacgtccggctccaccggcaagcccaagggcgtggccgtcccacagcgagccgtcgtccgcctggtccggaacacccactacgtccacctggggccggacgagacgctgctccagttcgcgccgctcgccttcgatgcgtccaccttcgaggtctggggggccctgctcaacggcgcccgcctcgccatccatccccccaccacgccgtcgctcgaagagctgggaagcttcatcgcccgccaaggagtgaccaccgtgtggctcaccgcgggcctgttccatcaggtggtggaccacgcgctcgagtccctggcgtccgtgcgacagctcctcgcgggaggcgacgtgctctcccccgcgcacgtgcgacgcgtggtggagcggtacccgggctgccgggtcatcaacggctacggccccactgaaaacaccaccttcacctgctgccacaccgtgtcgccggacgagccgctcgtgaacgccgtgcccattggccgccccatctccaacacgcgcattcatgtgctcaacgcggcactggagccggttcccgtgggcgcgcctggcgagctgtgcgcgggcggtgacggtctcgcgctcggctacctcaacgaccccgcgctgacggcgcagcgtttcatcccagacccgttcagccccgtgccgggcgcacgcctgtaccgcacgggggaccggtgccacgtcctgccggatggggcgggtcgaattcctcgggcgccgtggatgaacaggtcaagctccgcggcttccggattgagccaggggaaatcgaggcggccctcgcgctccatcccaccgtgcacgaagcgcgggtcatggcccgggaggacggccccggagagaagcaactcgtcgcctacctcgtcgccaggccgtcccgggaactcccgc

SEQ ID NO: 944 - DNA, 8540 bp, Myxococcus xanthus
cgaggggcctgttttgcgttccagcaggacgcgcctgcgtcccatcagaacgcaggccgctcagaattcaccaggagtgcctcttcaaccctcctaaaacgtcctcatcgtgaaatcttgcgcgatttctggggcgtcgaggccctcttgggcgctttccgcgcggacgcacgcccaggctcggcagggtccacggacggagactcggggtccggctggaggacgaagactcggtccaaccggaggctgccgcgctccacaggtgcgttgatgtcgtagtcgaaggtgtacccggccagcacccgcatgcccgcgtcgcggaacagcttcgccgcctgggcattgctgtacgtgcggaagtaccactgggtttcgatgagccagtccttgtccggcccggtgacgcgcaggcggttgcgcatgggcgagcgccgcgcccgctgctccggaaggccctcgttcgtgttgcagacgacgcggtcctcccccacctgccccacccagcgctcgtgttcgggccgggcgcgcgcgtagtccgtgaggtggaagccgagcacgtagatgccgcccggcttcaagagccgccgcgtccccagcaggtgctggcgcgccgcggcctcactgtccaggtagcggaaggtcgacaccaggcagtgcgccaggtccacctgcccctccagcgacgggtcggagaaggactccatgcgtgacggccccagcttcacgcgccgccgctgcgccggcgtcaggcgcttgcgcgcatgggccagcatcgcctcggagatgtcatagcccaccacccgcaggccccggctcgatgcctcctccacgagccgccccgcgccgcaggcgggctcgagccacagcttgccgcccgtgccgaagcgctcgttgagcgtctgtaggaagtccacctcgcgcacggtgtccgtgccgaagatggcttcgtagtactgcgggtgttcgtaccagtcggtgcgtttttccatgaagggcgctcagtggccggggtgctcggggtgccccatcagccgcgcgagcaggaacatcagcagcaggcccgcgaagagcgccagcacgttgcggcccggctggtccttgccgtgccggtgcacatgcggcagcaggtccgacacggcgatgtagaggaacgtgcccgcggagaaagccagggccttggccgcgaggctttcgaactgcagcatcgcgtcgaagaggaagtagagcagcgcgccggccggcaccatcatcccgtacagcgtggacagcgacaggatggagaccttcgagcgcccctccgtcttgaggatggaggccagcgacagcgcggagggcaccttgtgcgcgacgatggccagcagcgccatgccccccacgccctcctccaccgccgagcccagggcaatcccgtcgaacaacgtgtgcgtggacagccccaggaaggcggtgagccccagcacgtggcccggatgcaccgagtgcccggtgcccgccatggtgtctccgtgggagatgtcctcgcccgcgtgcgcgacgaggtagcgctccagcaccagcaagaaggcgaaacccgcgggcaccagggcgaaggcccaccatccgccacccagatacgcctccggcagcatgtggaagaaggcggcgcccagcatcacgcccgcggcgaaagccaggaagcgcaccagatgggtgggtcggtcgttcaagacgacgaccacggcgccagccagcgcgccgaggacgatgatgagggaatacagggccaccgtggccaggaccggcgacatggggcgcgcaccctacatcaaaaaaccaaatcagtagcgccggagcaccaacaactccacccggcccggtttcacctccaccggatgctccgtcacctgcccccagctcgtcacacgcacggtgtgattccccgcgggcacgcggaagcgcgccacctggaactccgcaggcagggagagccaggaacgcaggtctggcgcattcatcgcgttgagaacgaggaaggtcagcacgcccagttcatcactcttcgtcagcgcgcccacgcccgccgccacgcccgccttcacggccacgcccgcgagctgcttcgccagcatgcggccaatccggtcattcaggtggaccacggccacgtccgccagggacgtcaccgtcactgcctgctgggactggccctccagggcgacactcacgggcggcgcgagcccccggttccggtaggtggggacttcaatcaggtcgccaccgccgcccgggtccctggagccgcgctgcttctcgggagacaggcccgcctccaccacgacgacgagctgcccttcgtccggcgccagcggcgcgtgcgggacgtccgggtacttcgccagcagctccgcgtacatgtcgtcgcggcccaccttcttcgccagccgcagcaggggctcggccagcgcgtcctcgcggggcgcgatttcataggccttcgcgtagtcgatgtaggccgagtcccagtcccgctggtcctcccggatgacgccgcccaggtagcgggcaatcgcgagctgctcgtagggcttcttctcctcggcgatcatcttctccaggcgctcgttgacctggcggacctccaccatggcggcttcgtcgtcgcccagctccgcgtagttgagcgcctggaggacggaaatcatcagcttctcgaagtcctccccccggtaggtgcgctgacgctcgttggtgacgagcgtcttcgcctcctcgctgacggagacactgtcgatctgctcgctgagccgctccgcctcctcgagcacggcgttgctctccgcccactgcccggcggcgtgcagcaccatgcccttgtccatcaacaccagcaggcggtcctgttcgggcccttccttcgccgcggcctccaacgaggacagcgcgcgcgaatagtccccttgctggtatgcggaccgcacgccccgggtgcgcgcgacatagtcacccgcgcagcccgacgacaggaggagcacgctcgcgagcgcgagcgcgccccacccgctcaggcggaccgggctgcgggagtggatggacatggaaggatgcgcccgttaccagctcacgccgcgcttctcgaacttcttgcggatctgcttctcgtccgtccattcgatgaggccggtccgcacgttgctgagcttcgcggtcatcttgtaatagacgagcttgtcccggccgacctcctggatgatggaggcgaggtcgcccgtcatcaggaagtccaccgacgtctgctgacccgggcccttggcggtgttcgggtcgacgtagccggactgctggtactcgtactcctccgcgatgtcctggcgcgcctgctggtccaccagggcgaagcggcccgtctgcgccagcgccgtctgaatcttgtcgcccagcgagcgcatgtcgatgtgctcggaggtgctgttcttcagcttgcccaccaggacaatgggcagcgagccgtccggccggggctgggagaagcgcggcgaggtggcgagcgactccgccatcttcttcgcgatgagctgcaggtcgttctcgttgaagcggtccgacagcatctcgatggtgttcgggtcctcgtacgtgccacgcgtgaaggcgcgcgggcccgtgcaggcggacagcgaagcggcgagacaggcggacagaatcaggcggcgggtgttcatggtgcgggtcactcctagttccattcgcattcgaagcggctgccttcgaagttccacttgtaggcgagcaccgcgtcgcggcggtacccggccgtcaggcggcagacgttctgcagcgacgcacgagggtagtcgaaggtgtagcgctgcgaccgcgacagctcctgcgcggtgagctgggacggatgcgtgagcgtggggctggcgctggcgaccaccagcacgttgtgcttgccataggtacgcagcggcacctggcccgccagttggacacggcgaacggtgcgcgcgacgaggatgtcgctgcggtccaccgtcgtctcgtggctgttgcggcggcgcagcagctccgggatgttggcggtgaagacgcgggtgatgtccccatcgtccacgaagaagtagaggaacgcctcgcgcgcgttgcggctctcaccggtgaagtccagcgtcaccagcaggttcaacccgcggttgggcgccagtccgtgccgagacaccgcggccagcacgtccttgtccacgccggccttcttgagccggatgaggccgtccgcgctggcgtcgcaggcgcagcggcgctcttcaatcatcttcacgagctgggcgggctcgaagccagcctgggacagcttcgtcagctcttcgtcggtgagagggagctggtcggagcgctcgtagatgcgcgggagctggttggggtcccactggatgatgttgtaggtctgcacgtctccggacggaaacggcaggttcacctgtgggcttccccggccggaaacagagacgggcgcctggctggaggtcaacgccagcgtggcggcaagcagctgggcaatcatgtcaaaacctccttgctagaacttgtagcccacggacatgcccagccggtgcgtgacgccgccaccgccaatggggatgtccggggtgtagttgagggccatgaggatgttctcgcggtcgcccaggaggatttcggcccccagctgcggcgagatgccgaagcgcaggccctctccctctgggatgacgatggcgccggccttcaggcccgcggtgaacaccaacggccagccccaggtccggaagcgcgggcccaccatgccgacgaagcggcccccgtcgaacacgtaggcaccactcacgtccaactggtaccagtccgcgccccacagcgacagcgtggcgcccacgaacagcggcgggccttccggcgcgccccgaggcggcttgcgggagttgatggccgcgccccagtcgagctggagcgacacgctccggcctccgggaccgctgtagccacccttgccgtactcggactcctctggaccgtccgtgcggcctcgggattgggcactggcggtcagcggcacggtggcggccaccatcgcaagggccccacacaacctgacatgacgcatcatctcgaagactcccccgggcggtaggtgcgaatttccagcgctatgacggcgcggcgcgccgactattcaaaaccccatgcccccaggcaagggctcactgcgtctggggggcagcccgccttcacacccgaggcggcgtgggcggcgcgggcggcgagtccggggaagtggacagccgcgccggatccagctcgggcggcgggaagggacgcgcctccgtgcgggtgacgggcagccacagcgggtgggcgcgaaggaaggcgaccagcttctcgcgcaccagggcccgcaggtcgaagagcttgctgaagtccgacacgctgaccagcgcgcgcaccgtgagggtgcggtccagcacgtccaggacgaccaccgtcgccacgcggccgtcccacagggccttgccctcgttctccaggatgcggcgcagctccgcgcgcagcgcgtcgatgtctgtctggaagtccacctggaggatgacgggccccagcatctccgggttccccttgctccagttctggaagggcttgtccaggaactggacaatggggatgaccagccggcgctggtcccacgtccgcagcaccacgtaggtgagcgtgattttctccaccgtgccccactcgccctcggtgatgagggtgtcgccaatgctgatgggctgggtgatggagagctggatgccggccagcagcgtaccaatggacttctgcgccgcgagaccgagcaccaggccggcaataccggcagaggccagcagtgacactccgacgttgcgcaccacctcgaactggatgagcagcagcgccgcggcgatgacgtacgtggccacctcgaagatggcgcggagcaccaccaactgcgtgctcacgctgcgcgcccgtgccgcgtccttcatctccgacgacacgcggctctgcacgaaggcgacggagacgtggaggatgcgcagcacggcccaagccagcgccacgacgctcaacgagtagccgatccggatgaacacgccctgcgccggacgaggcagccgcaagagcagcgtgcccaccaccagcagcgcggagaaggtgagcagcttcagcggccccttccccgaggagaccacattctcctcccaggtgaaccgggtccaccgcgccacacggcgggcgaaggccaggaccaggcgctccagcagcaccgccaggcccaggctgcccagcaccgtcaccagcagccccagccactgccagggctccagtcccagcaccgtgtcactgaagaagaaggccggcaggaggcccaccagccgggggccatactccgcgaagagcgggtccacctgccgcaccgtggactcgctgaagacccagaccatctccccctcagcagaggagacacgctggacgcggacggggacgttgttcccctgcaacggaatggtgcccaactggtcgtagcgcgcgtcggccgggtcgccctccggctccttgctcagcgagcccacgtccacgggcagcttgcggtccagcacgaacttgagcgcgcgggccaactggaagccccgctccgcctgctgggcgcgggggatgtagtccaggtccaggtagtgcgccgccagggcgtagtccccccggtgcgcggcggccagaaagccctgcacggtggcctgcggcgtcttccggtccaccgaggagggcggcgggttgagacccgcgttgagcgcggcggcaggaaggctccacagcagccccagtcccaggacgagtgccctcagggtccatctgtcacggtgcatcatggctgacttccatatccctatcccttttcggatgtctcactggaaagaagtcgtccccggagacccggcgggcgagcgtgcggcggtggacttccgaaatcagggaaacaccggccccgggagcgcacgggaaagcgttggtgcggcgcgtgggggtaggatagataaaggagtgaaggaaggtcgccgtgtccgagaagcgaagaatcctcctgattgatgacagcgagattacgctcgcgatggagaaggccgtgctcgaagcgcgcggctacgaggtcatcgccacctccacgctcatggagttcgagaagacgctgcagacctggcgcccggacctcatcctcaccgacatccacatgcccgaggccaagggcacggatatctgtcgcacgctgaagaacgagtacggcacgcaggacatccccatcgtcctcttctccagcctcccggacgacgagctgtccaagctggccgaacaggtgggggcagacggctccctgtccaaggtgaacggactggaagccatgggcgagaagatcgacgaactggtgcagagcatcctctggtgaatcccatgcgtgccttcctcgccgcggccctgctggccgcgtcgctcgctggctgtgcacgcaaggacccaccccccaagcccgcggaagcagacgcttcgtcttcgccggccaccgccgccgcgaagcccgccgcggcggcaagccagggctcgggcgccatcctcttcctctctgccgacacgcgtggctacctgggcccgtgcggctgtagcgagaacatgcggggcggcattgcccgcgccgccgcgcaggtgcagtcggcgcgcaagggctcgctgcccgtcctctatgtggatggcggcaacagcctcttcggcgagcagcggctcaagccgggacaggtgcctcaggaggagcgcaaggcgaaggcgctcgcggacgccatgcggcacatgggcctggcggtgcgcgccaccggtccgctggacgacacgcagggcgtggacttccgcaagggcctggggctgccggaactggcgccgggcgcggtgaagctgctgcccgcgggcgaacggaaggtgggcgtggtggcggcgaccacggccgcgcagctcgcggaggccagcgcccaggcccgcgcgcagggagcagacttcgtggtgggcctgctggacgtcacgctggacgtggcccagcaggcggtggagcagccgggtttgaaggccgacgtggtggtggccactcgcaccgccaccgagttcagtggcgaggagaaccgactggtgcggtccgcggtgccggtggtggcgctgcagagcaagggacgctcgctgctgcgcgtggacctggcctatgcaccccaggctggccccttcgcgttgcataagggtcaggatgatttggagcgtgaggccgccgccctggagcaacgcacggcgctgttggacaaggacatcaacctccccggcacggacccgaagctcaaggcgctcaagcagggcaagcgcgacgaactggtggcgcgccggcaggccctgctggacgctcctcccgtcacctcggacggcgtcaacgccttcacgctgcgcttcgtgcccctggagtccagccttccctccgacgc

SEQ ID NO: 945 - DNA, 10528 bp, Myxococcus xanthus
gctctaaaggacgccaccggacttcatgatgggaagctggagcaccggggttagccggcgcttgaggtccgcggagggaatccggcgcaccgtgtcgctcagcacggcccagcggtggcccagcggcatcgccttgtgcgaggacaggtccttcagctcgaaggtgaacgtcccggtctcagcccgcaggcccctggagagaatgccgcccgcgcgctgcgccaggatggcgaaggcggtggctggctggagcagtcccagaccgaagagcgcggtgagcaggtctccgccaaagcgctccagcgtgggctcggcccgctgaagctgctcgggcgtgagcagccgcgccgcgaccagtgacggcccgagcgcctcttcgggatgggacgagtcgacgaactccgggttgcccttgcggaagtgaatctggacgacgcggtccgccagcgtcagcgacagcagccctgtctgctccctcgctgcgatgcggccatagaggcggatgggggagagctgctcgagttggccgagggccggaatctccggtgcggcgtcatcgccctccaccgcgggcaccgccacaggggcggacgccggggccgggctcgcggggggagcgctcggcggacgcgcggctcccgccacgggcggaggtggcactgctccgggaggacgggcctgctgggcgggcgccacgggacgctgcgcggggtccacagtggcccgcgcaccgggacccgccatgggggccgcgccagggcccgccacgggccggacgccgggacccgcgatgggcgccgcgccagggcccgccacgggccggacgccgggacccgcgataggcgccgcgccagggcccgccatgggtcggacaccgggacccgcgatgggcgccgcgccagggcggacaccggggcccgcgctcggcgcgacaccggggcctgccgcgggccgaacacctggcctcgccatgacgggcgctccgggggccacgcccatgggagcgcccggtgcggcctgttccgcggcggagacgggcggggcgcccgggccccacagctcgcggggaacgacctcgcgcgcttccgggaagcgccagggaaaggcgaagttgagcccgtcctcggacatctggagccggccctggatggagccgctttcgatgagcagttcaatggtcggcagggtgaggggcccccacatggtgcccctgtcgttgcggacccagtactgccggacctcaccctccgccatgcgcggccttgctccttcgtcctgcgagaaaagcgaaccctaccgctgtcctccgtcgcatcaaagcagagcgccggagcgcgagccccttacttcgactcagggcgccgcgccatccagtgctgccagcccgagcgctgccagacacgccgcgtccgctttctgttcagcgggcgggtcgaagcagtacacctcgctgtcgaagaccttgcacagcccgttcggggtggacgcacaggccgacttcgagaaggctgtggtgcagttgtacccacacaccgggcccgcctcggtgttcttgcactgcggcgcgggcagttcgcgcttccaggcgcacagggcggcgggggaggggtcgaagcaggtgatgcggccactggccagcttgcacacgcccgcgggcgtccgggcgcagcgcactccctccgaggcgttgatgcagccatagccacacgtcagctccatggcgttgctgtggcactgggcggcgggcgtgtccttgccgtacacggcgaacaccacggcgggcgggtcgaagcactccacctcgccgccccggccccggcagacgcccgcgggggactgcgcgcacttcacccggccgggctgcgtcgcgcagttgtagccacaggccaccgccccgtcgatgctctgacactccggcttcggcagcgccgcgccataggccttctgtacgtaggccggcgggtcgaagcagaccgcctggccgtcaatcacctggcagtggccctgcggtgtctgcgcgcagcgcacccgctgtccgtccgacttgcacccgtagccgcaggacaccttgccgtcgatggctcggcacgtcggcgtggaagggtcttgcggaatcggaaccgagcccagggtgagcgccagcacggtgaggaaggaagcgagcacggggacctcggcggggggagcggagtcgtcccggcattgacgcccaaggggcgtgatgacgcaagaagcgggcggtcatgggcggcgggccgggcccgtggtacccaggcgccgcccgcgaggaggttcaccccggtggacgtggacgtcagtgcgctgcacctcatcctgctgtgcgtggccgcgctgattgccggcatggtggatgccatcgcgggaggcggcgggctcatctccctccccgcgctgctggccgcgggccttccgccccacgtggcgctgggcaccaacaagggacagtccgtcttcggctcgttcgccgcgctggtgcgcttctcccgcgcggggctggtggatgggaacctggcgcgagtgacgttccccttcggcctgggtggggccttcgggggcgcggcgctggtgctgctggtgaagccggaagtcctcaagccgctggtgctggtgctgctcatcgcggtggcggtgttcctcgccttccgcaagtcgccgcgtccgggggacatgccggagcccgggccgcccgcgcgcgccagggccattggcgcgctcatcgcgctggccatcggcacctacgacggcttcttcggaccggggacggggacgttcctcatcgtggccttctcgtccctgctgggacacggcctggcgcgcgcgtccgcggacgcgaaggtggtgaacttcgcctccaacctcgcctccgtcgcgttgttcgccttcaagggcgtggtgctctggaaggtggcgctgcccatggccggcgcccaattcgcgggcgcctacctgggcgcgcacctggccgtgaagggcggcgacaaactggtgcgcaaggtggtgctgggcgtggtgctggccctggtgctcaagctggggcacgacgtggtgacggcctgagcagccgtcaccccgccatcagccgatgtgcaccagcagcgcctcccggcgcttggccacggcggccatgaacttctggagctcctcgaagtaggagagcagctcctccagcaaatccacctcggactcgggctcgtcccatgtcccggggtagatgtcctgggcctgcatgacggacgcgtcgtagcgcgcgcgcagcgtcttctgcgtcacctgctgcagcgccgtggccagggcctgcacctgggccggcgtgaagacgcgcgcggtgccttcctcggaagggatgtcgcccacgtcctcgccgccacgcaccaggaagtccagcggcgggctgccttcccacggcgttccggtcagcaggtactggaggccatgccacgcctcgccgatgtccaactccaggaacgccgagcccttcgggtcaccgaagtcctcgtcatcgtcgacgaagtcctccaactgttcgggggcctggagcagggcaacgcgctgggcctcggtggcgctgcgcagggtgcagagcatctccatggagctattccaccatcaccagcttggcgttgttctccacggcggtgccttccttggcgaacagctcggtcaccttgcccgccttggggctcttgagctcgttctccatcttcatggcttccaccaccacgaggccctggccctccttcacctcgtcgcccaccttcaccagcaccttcaccaccttgcccggcatgggcgcggtgaccaactgcttgccctcgacggagaaggccgcgttggccgcgcgcagccggagccggcgctcatccgccacgtcgatgcggttcacctggccgcgcaggagcacgccaagctcgtcgccgttctcctcgaactcgacgttgtacgactggccgtctaccagcatggacagcgtgccgtgctccagcgccagcgcgtccacctggtacgtggtggcgcccacggtgattttgaactggtcgttccccaggggctccaggtccaccgggaccgcttccttctggccctgctgcttcgtgaagtaacgcatgggagtccttccgagctgggggttagcggcgcgcgcgcagcgccagcttccacggggagacgccgccgttgccaccgccctggccgccactggcagcaggcagggtcttcgcgcgcttctggtccttctggtacgtgtgcaccacgctggccagcagcgccatctcgctcagcttcgggtcctccgcgcccagcagcgcatcgtgctggcgggtgaggaagctggtgtcgtagtcgccctcgatgaactcggggtgcgccagaatcgccttcaggtagcggatgttggtggtgatgcccttcaccacgtactcggacagcgcgcgctgcgtgcgggcgatggcctcgcgccgcgtgggggcccacacggacagcttggaaatcatcgggtcgtagacgttgggcaccgtgtacccggggaacacgcccgaatcgtcacgcacgttcggtccacccggcacgcgcaggtacgtaatcttgcccgggctgggcatgaagttgcggctcgggtcctccgcgtacacgcggacctcaatcgaatgaccgcgcggcgtgggggcttcggtgaggccgagcttctcgccctcggcggccttgatctgcatggccaccaggtccaggcccgtcacccactccgtcaccgggtgctccacctggaggcgggtgttcatctccaggaagtagaagttgcggtgcacgtccaccaggaactccaccgtcccggcgcccacgtagttgacggccttggccgccttcaccgcgacctcgcccatcttcgcgcgcagctccggcgtgaggatggggctgggcgtctcctccaccaccttctggtgccggcgctgcgccgagcactcgcgctcgttcaggtggatggtgttgccgtactggtccgcgaagacctggatctccacgtggtgtggcttctccaggtacttctcgatgtagacggcgtcgttgccgaaggcgttgagggcctcgctcttggcggcgcgccacgaggactcgaagtcctccatgcgctccaccttgcgcatgcccttgccaccgccgccgcccgcggcccttgagcatgacggggaagccaatcttctccacgtaggcgcgcgcttcctccacggaggggatgggctcggtggtaccgggcaccacgggcacgcccgccttgatcatgttcgcgcgggcacgcgtcttctcgcccatggagtccatggcggaggcgggcggcccgatgaacgtcaggccttcggcctcacaggcgcggacgaaggcggcgttttcggagaggaagccgtagccggggtggatggcatccgcgccagcctgcttcgcggcgtcgaggatgcgctgctgcaccaggtagctctcacgcgaaggcgggggccccacgaagatggcctggtcggccgtgcgcacatgcagggcggagcggtccgcctccgagtacaccgccaccgtggcgatgccgagttccttgcacgtgcgcatcacccggatggcgatctcgccgcgattggcgacgagcactttgcggatcttgggcatggggcccgtctagcacggggcgaccctgtttgccgcctctacttccgggtgttcaggtactgctccatgtaagcgcgagcctgtgtcagcttggcctccacgaagcggtcgtcctcgtccggctccggcggagcgggcggacccgaccgtccaggttcgttgccgaagtcgaccgccgcagccaacaggttgcgtgccgcgtttccgccgccgaagaggcgggccagcatgcccgtctcgacgtccagccagcgcgccgcctgccggatgacgtccagaacctcaccttccacggccttggacgggcggcccgggccgctgatgcaggagcgcgcgtagctgtgctcgcggtccacgaagaggcccagcgcccggtcccggaaatcctgcgccagggcctgactcatggcgtcgagctgctcctccaagaagggctgctcggacttgcgcgccttgcggccaggggcgggcgggagctccagctcgacggcgtgccagcccgcatcggccagcccctctggcggaggctccacccacttcacctcgggcgtggccaggtccaccgcttcgcagacgcgcttgagcgtctggcgcagggcggtgaggtttccttcgacgtcggagagaaagaggacgaggcgacggtggggcaaaatgagattcctttcctggcccctgtaagcccgttcgtcacccccaaatttcccccttcgcgcgcgcctgcctgccctgctggcgacagagggcgggcaggcgagggctgaaagaaacctagagcgggatgttgccgtgcttgcgggggaggttctcctggcgcttgtccttcagcagctccagggagcggatgagcttcgcgcgcgtctcctccggacggatgatttcgtcgatgtagcccagctcggccgccttgaacggggtggcgaacttgtcgcggtagtccgccgtcagccgggcccgctcagcggcggcgtccggggccttggccagctcgttgcggaagatgatgttgaccgcgccctcggggcccatgacggcgatttccgcggtgggccaggcgaagttcatgtccgcgcggatgtgcttggacgccatgacgtcataggcgccgccgtaggccttgcgggtgatgacggtgtccttggggacggtggcctcggcgtaggcgtacagcagcttggcgccgtgggtgatgatgccgccccactcctggtcggtgccggggaggaagccgggcacgtccaccagcgtgacgagcgggatgttgaagcagtcgcagaagcgcacgaagcgcgcggccttgatgctggcgtcgatgtccagcacgccggcgagcaccgcgggctggttggcgacgacgcccacgctgcgcccgttcatgcgcgcgaagccgatgacgatgttcttcgcgaagtgctcctgcacctcgaagaagtgcttgtcgtcgacgatggccttgatgacttccttgatgtcgtagggcttgttggggttgctcgggacaatcgtcttgagcgactcctcggcccggaacgcgtcgtcctcgcacggctggacgggcgcctcttcctggttgttggagggcaggaaggagagcagctcgcgcgtcatcacgatggcggcctgctcgttctccgccgcgaagtgggccacgccggacttctggttgtgcgtgacggcgccgcccagcgcttccttcgacacctcctcgtgcgtcaccgtcttgatgacgtccgggccggtgatgaacatgtacgacgtgtccttcaccatcatgatgaagtcggtgatggccggcgagtacaccgcgccgcccgcgcacgggcccatgatgagcgaaatctggggcaccacgccggaggccagcgtgttgcgcacgaagatgtccgcgtagccggccaggctctccacgccttcctggatgcgcgcgccgcccgagtcattcaggccgatgacgggcgcacccacgcgggtggccaggtccatgatcttgcagatcttctgcgcgtaggcgcccgacagcgagccgccgaagacggtgaagtcctgggcgaagacgaagaccttgcggccttccacggtgccgtagccggtgacgacgccgtcgcctggaatcttcttgtcgcccatgccgaactcgctcgagcggtgggtgacgaacttgtccagctcacagaaggagccggggtcaaggagcaggtcgatgcgctcgcgggcggtgagcttgccggactcgtgctgcttggcgatgcggtcggcaccgccacccagctcggcttgcttctccatcttctcgagacgtgcgcggagggggtccttctcgggagtctggtccatggggcgcgtctagcatgattggggcggggacgcgctgcctggattcctgacttccatggccggacgcatggggtcgtcaagcactgcatccaccgccgccaggtccaggccgtagcgctggcggacctccgccaggggcgactcccacatttgacaccacggtgccccgaagagcggtcgggcccgttgtcccagcagccagccccggacgatggcgcgcatgcgctcctcgcgctgagagaacgcgtagaggagggtgttcgtcaggccgcccgcgaggatgcccagggcgaaggggctgcccacctgggccaggctgaaggcctggatgcccagctcgcccgccacgctcgtcggaaagccggtgaggacgtgccagacgtcatgggattcgagcaggtgcgctcgcacgtactcctcgtcggtccgcgcctccaggtagggcagtgcgtcagggttcacctggttcgcctccaggtggtcgacgaaggcacgtcccagggtgtgttcgggcagggcgcgcagcgcggccaggtggagcaggcccacgcgcgggcgctcgatgaaggcctgggccgcggaggcgtggctcatcagccgctccaccagccgccgcatcgccacggggggcgcgagcacgggggccagacccaggacgtcctggagtttctccgggtcgcggagggcccgtgccatccgccatgccgcccgcgcattcgcgacaggattccacatggtgcctccaaggcggggacgctggggccgccccgtccagcgtatgtgggaggcgcaagggcggggcggggggaccgcggccgtgctcgcgggcggacattccgaacgtcgacgagcgtacattccgggggcgggccgcccgccttgcccattccaggtccgtgcgcgccgggtggaggggacggaggttgaagccataggagggccgccatgcgcgccgcgcgaggatcctttcaaatcggctcgttccgcggcattcccgtccgcgtccacttctcgctgttgctggtccttccgctgcttgcgtttctattcggcggcgccttccagcgggcggcggaggtggccgaagtccccccggagcgactcagcggctcgcccgcgctgtgggggctggtggtggcgttgggcttgttcgcgtccgtgttcattcacgaactggcgcacaccgtgtacgcgctgcgccgcggcgggagggtgcgctcgattacgttgatgatggtgggcggtgtgtcggagttgacggaggcgccgccgcgtccccgggatgaagcgctgatggccgcggtggggccgctgacgagcatcctgctggcggtgctgctcggcggcgcgacgtggctgctccaggaggtgcgctcgttcaacctccagttcgcgttcttctacatggccagcctgaacctgttcctgggtgtgttcaatctgctgcccgcgttccccatggatggggggcgcatcgtccgcgcgtcgctggcgggacggctggggatggtgcgcgcaacgcaggtggcgtcctggctgggacgtgggttcgcggtgttgttcggtgtgtgggcggtgctgtcgctcaatccgttcctggtcgtcatcgcgttcttcatcttcatgggcgcgcagggggaggcgcagcaggtgcggatgaagatgacgctggagcgtgtgccggtggccgacttgatgacgccgcgccgggtgggtgtggacgcgggggcgtcgctggagcaggcgctgtgggacttgcggcgtgcgaggctgttgctgctgccggtgacggaggacgaaaggccggtggggcaggtgtcgctggagacggtgcgggccgtgccggattcggagcggatgacgcgcaccgtgcgcgaggtgatggtgcccgccgtggtggtgcggctggatgaggatgggtggacggcgctgcggcgcatggccgaggaggagaggccccaactcgtcgtggtggaggcggatggggtgctggcggggacactcgacgtgaacgatgtgcagcgcggtatggcgctgtatcaggcgcgcgaggagcgcagcggtcagcaggatcggcggtggcggcaggagcggccggcgtaacgggactcagtccgtcacgaaccacaggcccacggtgccgccaccctgctgcgagaagatggcgtcgctcgtttggagttcatgttcggcggcgtgcttgaacagcagctctccggttggaaagcggtggacaccgaagcctccgcaaccgccccgcgaggccgcgagcaaggtcccatccgggttgaatgacaggttacagggacggcagaagccctggacctcctccgcgatgcggcacgcgtcgaggtctacccgcggcacttcatgaccgtgggcctggcttgggtggagtcatgccgccacgcgaacgtcggacggtgcagcgccggtcttgtgcttcccggcgaaggcccaggggagctggcactcatcctgcgcgcgcagggggcgagcgtcatgcccacggtggcataacaaggcg

SEQ ID NO: 946 - DNA, 9937 bp, Myxococcus xanthus
tccgcctgctgggcgcactcccgaagcgactgttccagcgctcgcgcctccgatgacttgcgcgagttttcttcggccagcgcccgctcctcccagtacgcggtgtgccgggagaccttgtcgaagacggccaggacgcggcgcagggagtgcatgggcgcgcagcggctccaacgctggacttccgcgcgcacggtggctgcttcctcgaggatccgctcgatggcttcccggcccccgccctcggcggcgccgcccagggactcggcgcgcagttcgagtcccgtggttcccgcgtccaccgtgaggttcgccggccccatgcggggatgcgccgcgagccagtccgccacggggaccaccagctcgcgctccagcgcgcgcttcaaggggcgggcaccataccgcgcgtcgaagcctctcagggccagccagtcctgggcggcgggggtgacctccagcagggcatcgtggagcgagaggcctggacggcggcatacggcttcaagctcgcggaccaccaaccggcgcagcagcggggcggacagcggcgagaagacgaccacgtcgtccatgcggttgaacatctccggccggaagaagcgctgcacctcggagaggtagtgcgcgcgcagggaggccatgtccggggcaccgcccgacgcatcgaagcccacgcgggcgcgcagggtgtccgcgcccaggttgctggtgaggatgatgagggcgttgcggaagtccgtgaagcgcccggaggcatcggtgaggcggccttcgcccaagacgcccagcagcgcatcgtgaacggcggggtgggccttctccacctcgtccagcagcaccacgcagaagggctgccggcgcaccgccgaggtgaggtagcccggcgtctccccgtctcccatcaaccgcagcagggcgtccggaccggcgtactcacccatgtccaggcggaccatgcgctccttcgcaccgaagagtagctccgccagcgccttggacagctccgtcttgcccacgccggtggggcccacgaagagcagcacccccagcgggcgccgcacgtccgacatgccggccttgaggacggataccaccgaggctgcgcgctccacggcggcgtcctgccccatcactcgcgaggccaggaagtcgcgcacgtgtgcggacgccagcggctggtcgtcccggagcaggtgctcggggatgccggactccgaggcgaattggcgggtggcctccagtcgggtgacggaggtgcgcgaggcttgggcacaggacgccagcagccggcgcacgaaggccacggtgttgcccacctgggcaccgtagggcaggaagcggcggcacaggaagcgcgcctcgtcgagcgcgtcgggctggacctgcatcgcggcggccaaggcgtcgtcctccgccaccttggcgacgatgcggccgagcgcatcgggcgtgggctccgcgacgcgcaccaccgagaagagccgggcgaagctggtgttgcgctgctccacctgggcccaggtctcctccgtggcctcggccatgacggccacgtcacgcgccgcgaggagcgggagcagcagttgggccacgttctggtcactgtgggcgctcttgcccgcgtcgaggagctccacggcatggcccagggacagcagggcccgggcctcggtggcctcacggaaggcgcgcagcacctgctgctgccagtctccgaagaagccctcgcccgcgatgagccggcttccgtcgaggaagtagaacgggcgggcgcgctcggcctcggtggcggtgggggcgcgcagcgactgggcgagcgcgtggagcaccgacgtcttgcccacgcccgaaggccccaccaggaccaccggttcggcgtccttggccgcgagccgggtccggagcagggcgacgagcgcatcctgctcgtaggccgcgtcgagctgtccttcctgcgcgagccggtgccaggccacgccgacgctgtccagggtgggcgtaggcggcggcttcgcgggcggctcacccgggcctcgatgcgcggtgcggcggcgtggctcccagctgtccaggtccagcgcctccgtgtcttcgtcctcgccgtcctcgcgcgtgtcgtcatccaggtcggcgggtgcgtctggagggcgcggcggtggacgaatgttccggtgcagctcgcgaggcgtgagctccgacagggccacgggggtggcccgcacttcgatttccagcagggactcaggtccatccggacgcagggcaaggcgctccgcgtcggacattccctccaggcgatctcccagcagctccgaggcctcggcggggagtgtcttgctctggaaccagtgatggctgttgaggcgtggcgcgtggaggcccaggaaggcattgagcgtgggggccaccacggcggacaacgtcagcggcgcgaagtgattctcctcggcgccccagacgggaatcgcgggtagctccaccgtttcgagcgcccctccggtgggggcgatgaactccggcacgcgccgcgggtggacgcgggagagttggtcgtccagcgcgagcgtcagctcctcggtggcggcctccagcgagtccgcgtgcaccgcgagacggcgcagcgccagcggcgtgagcgtcacccggccgctgacgtgccgctgcaaccagcattgaaaacggaagttcatgggtgaggactcgggtgaaaacggtgccgtgcgtgacggcatgagccctcgggagctgaccggacccgctcacgacgcgggcccggcctgacagtccgccggattcgtcaggggtgaagcaccagcgcaccgtcgcggcggggtggaaaggtagaggggtgttcctggagggctcgggcggtcgcgttgacagcgccgcgggagccggggcatcgtgtggggactgatgacgcgctcgacccaccagacgtgttgctgctgtccggcatccgcggtgggcgtccgtccgccagtggcctgagtgccctggctgagctgtttccggaaagcccactgcccgcgagggagtgggcttttgactttctcgcgtggccccctgcttcaccccgaggtcccgcatggaacgtctcgcgctgttgcgcgccaggaactggatgccgttggccctgctgctgtccgtggcgggctgttcgcgctcgtccagtgatgcgtcacccgacgggacggtgacgttgctcaacgtctcctatgaccccacgcgggagctctacgaggacttcaacgcggccttcgcgaagcactgggcggccacgcgtggccagcaggtgtccatccagcagtcccacggcggctccggcaagcaggcccggtccgtcatcgaaggactgcgggcggacgtggtgacgctggcgctcgcgtacgacgtggacatgctgcacgagaaggcgcagctccttccggcggactggcaggaacggctgccccacaacagcgcgccgtatacgtccaccatcgtcttcgtggtgcgccagggcaatcccaagggcatccgtgactgggacgacctggtgcgcgaggacgtcaccgtcatcaccccgaacccgaagacgtcgggcggcgcgcggtggaactacctggccgcgtgggggcaggcgctgaggggcgagggcggtagcgaggcccgggcccaggcatacgtggagaagctgttccgcaacgtgccggtgctcgactcgggcgcgaggggcgccaccaccaccttcgccgagcggggcctgggggacgtgctcctcgcatgggagaacgaggcctccctcctcatccgcgaggtggggcaggcgcgcttcgaggtcgtcattccctcggtgagcatcctcgccgagccacccgtcgccgtggtggaccccaacgtggaccgcaagggcacccgggccgtggcggaggcgtacctggcgtacctctattcggacgagggccaggagatcgcggcgcggcaccacttccggccgcgctcggaggtcgtggccgcgaggcatgtgtccgacttccccggtttgaagcgcctcacgttggcggaagtcgcgggcgactggcggcgggcgcaggccacgcacttcgccgacggcggcctcttcgaccgcatctacgcgccccgcgcggactgaggacaccccgccatgtcccgtcctactcgccaccaggtgctcccggggttccgtctgtcgctgggcttcagttggttctacctgggcctcatcgtcctcattccgctctccagcctcttcctgcggaccttttccctgagctgggaggagttctggggcaccgtgacgacgccgcgcgcgctcgccgcgtaccggctcagcttcggggcctcgctggccgccgcgctcgccaacgtcgtcttcggcctgctggtggcttgggtgctggttcgctaccgcttccccggccgcgacgtgctggagtccctggtggacctgcccttcgcgctgcccaccgccgtggccgggctcacgctcacgacgctgttctccgcgaaggggtggtacggccagcacctcgaagcactggggctcaaggtggcctacacgtccgtgggcgtggccatcgcgctgacgttcatcgggttgcccttcgtggtgcgcaccgtgcaacccgtgctggaggacatcgacgtggacgtggaggaggccgcggccacgctgggcgcctctccgtggcagaccttccgacgcgtcctctttcccgcgctcttccccgcgctgctcagcggcttcacgctggccttcgcccgcgcgctgggggagtacggctccgtcgtcttcatctccggcaacatgccgctgcgcacggagattgtcccgctgctcattatcacccggctggagcagttcgactacgcgggggcgacggccatcgccatcgtcatgctgggggcgtcgttctcactgctgctggccgtcaacctgctccatcgctggagccagcgccggctggaagcccggccgggagcgtgagcgccatgcatccgtccacccttgtcttgcgccgaagcgcgcgcagtctgagcggcccggcgttcgtccgttgggggctcatcggcgcggcggtgctgctgttgggcgtcttcctcatcgtccctctggtggccgtcttcaccttcgccttccagaagggctgggaggcctacgtcgccgccctgacgtacccgacggcgctggcggccatgcggctgacgctgctggccgcggccatcgccgtgcccttcaacctcgtcttcggcctggccgcgtcgtggctcatcgcgcggttccaattccggggacgctcgttgttgatgacgctcatcgacctgcccttcagcgtgtcacccgtcatcgcggggctcatcttcgtgctgctcttcggccggcagggctggctggggccgtggctcctggaccacgacgtccgcgtcatcttcgccgtgcccggcatcgtcctggccacggtgttcgtcaccttccccttcgtcgcacgggaggtgctgcccgtgatggaggcccagggcagcgatgaagaagaggcggcgctgacgctgggcgcgagcggctggcgcaccttcctgaccgtcacgctgccgaaggtgaagtggggcgtgctttacggcgtcatcctctgcaacgcgcgagcaatgggtgagttcggcgccgtgtccgtggtgtccggccacgtgcgcggagtgaccacgacgctgccgctgcacgcggagattctctacaacgagtacgacctggccggcgcgttcgccgtggcgtcgctgctgacgctgctcgcgctcgtgacgttggtggtgaagaagttcgtggagtggaggagtcagccgtcatgagcatcgtcgtcgaacagctcgcccgtcggttcaatcggggtggcagtcccgccgtgtccaaggtgtccttccaggcccccgaaggtgccatcacctcgctgctggggccgtccggcgcgggcaagtccacgttgctgcggctcatcgccgggctggagattcccgacgagggccgtgtcctcatcgacggcgtggacagcacgcagatgcccgtgcagcagcgtggcgtgggggtggtcttccagagctacgcgctcttcaagcacctcacggtccggcagaacgtggcctttggcctggaggtccggcgcgttcccaaagcggagcgcgaggcccgtgtggaggagatgctccgcatggtgcaactggagcacctgggcggccgctatcccggccagctctccggcgggcagcggcagcgcgtggccttcgcacgcgccctggccatccgcccccgcgtgctgctgctggacgagcccttcggcgcgctggacacgcgggtgcgcgaggagcttcgggaatggctccatgccctgcacgagcgcacgcggttgacgacgttgctggtgacgcacgatcagcaggaggccttggagatatcccagcacgtggtggtgctgagcgagggccgcgtggcccaggcgggctctccctcggacatgtacgaccggcccgcgtgccccttcgtcgactcattcattggaggcgccagcgtgctgcgtggccacgtccaggcgggcagggcggccatgggggcgctgtccgtgacggctcccgccggcgtgcgcgagggcgagccggtgcatgcctttgtccgtccgcatgacatcaagctggcgaaggcagtcgcgggcgcggcgagcgcgtccaccgccaccggccgcgtggagcggctcaaacccgtgggaggctacgtgaaggtgttccttcgcctaccaagcggggacgaagtcacggtggaggtgccgcgctcggagttcgacgcgctgggcgtggcggagggggactccgtgcgcgccgacgtccggtccgccaccgtcttcgtgggggactactccatctaggcggtaattcttgagaatctaatattgcagccaaaactgcttgtttgatgggggagggcggctatgtcccaggggaacccctggagcaagacatgcacaaacgacacgcattgcgttcgatgttgtgggccgcgagcagtctggcgttggttggcggctgttccccggagccggaactgtccgacgcggaagcccttcccctggtgacgcaggagcaaggcgagcgggcctatgacccaggaccgggctggaacctggcgtggcaggacgacttcacgggcaacagcctcaactcggccaactggacggtgctgacgagcaacttcgaccctgtcaccaacaactgcaacttcggcacgggggagctggagttcccccgcgcgcagaacgtcaccgtcgctggcggcaagctcatcctcaccgcgcagcggacggcggacgcgccgtttgactcacgctgcgcgggttacgggccacgttcgtactactcgggccgcatccactcgaagggcaaggtggagcgccgctacggcaagctggtggcgagcatcaaggtaccgtccggctatggcatgtggcccgcgttctggacgctgggcgcgaacatctccaacgtcgggtggccccggagcggcgaaatcgacatcctcgagtggcactccaacgacgcgtcgtggatgaagtccgccgcgcactggttcgccaatggcgcgcagcagagctggggcacgggcgcgaaccgcgggtacagcatcgcggatggcttccacacgtacgaggtggagtggacggccaaccggatgatcttccgcctggacggcgagattcgcggcaacgagttcgcccacaacgaggcggccttccagcagaaccactacatcctcctgaacctcgccctgggcgggaactggtacggccacccgcacccggatgcgattggtctgccctggggccacacgaagacgatggaggtggagtgggtgcgctggtaccagccggggagcacgccgccgcccgcgtcactcaccaacgccagcttcgagaacggcatgacgggctgggccacctggagccccaacggcaccgaggccgcggacttcagcgagacgtacaacgggggccgcaccggcgcctatcacctgacgcactggacgaatggcacgcccttcgaggtctggacgtaccagccggtgccgggcctcgcatcgggcacatacaaggtccgcgcgtgggtgcgaaagagcggcgggtttgacctgtcgcgcctccaggccaagacgtgtggcgagtgcgcgcccgtgttcaccaacctggggaaccatggcgactggacgatggtggagacgccgcccatctccgtgacgggaggctacctggagctgggcttccacacccgcgccacgtcgggcaactccgccaacttcatccacatggatgacgtggagctcatccgcctctagtcacggcgtgagccagggctacagcaccattcgccagaacagtccggccagggtggtgtagcccaccgccgcgcgttccacgcgtccctccgaggagatgaagaacacggtggggaagctgttcacacgaaaggcggattgaatggcgtcatccccgaggagcaccgggtagtccaccgcgtgctcctgggcgaagcgccggacggcctcctcgtcttcgtaggccacggcgacagacacgacatgtgcggagtcccccgcgagcttgcgcagctgcgagaggttggaggactccattccgcagacgccgcaccagggggcccagaaggccagcaccaccggcttgccgcggagcgcgtccagccgcacggtgtcacctgtcagcgtctggagggtgaaggcgggcgcgggtgtccccgctccgggaaggttccgggcctgccacgcggccaccgccgagaagaggagggcgaacacggccaggtccacaccccagcgcacccatcgccgctcccgggcacgggcccaggtggacttcagcctcgccaacatccccgcgccgccctgcatgtgcatcctttcgattcgggacaggtcacggccgcccggaaaggggcggccgtgcctgcgtcacatcatgtcagcgcggcggcctcctcgggctgccaggctgcgtcacgcagccgggtgccgtcctggcgctgcgcgcggcccaccgcccgcgtgacggcgttgctggcgcgctccagcgtccggtcgatggccgccagcaggttggtgtccgaggattcgatggccagctcccgcccgtgttccaggcggagtgccacgcggcacacctggtccacgccgcccttggggccgttggcatcctccagccgcacgacgacttccttcaccctgtcggacagccggtccagggcgaagcgcacgcgacgctcggcgtaggttcgaagggtctctgtgagggggatgttccgggctcggatttcgactcgcatccaggacgctccttccggggcccaccatgggcccacgcctctatctctgtcgtcgtgacgcttttgccgcaaataggaaaagcccccgtgagcgcttcggaaaaccgaaggttcacgggggccggtggcggggccatgaggccctggaatcacgggccgctggacgtcgcggtgctgcccgcgggcttcttggcagccgccttggcgggtgggctggcggcgcccgtcgtcgcgggggcctgcgccttgctggccgcctccggggccgcggcgtccgtgggggccttcttcgcgggcatggcccagatgggggcctccggcaccgcgcgggcaccaatgcgcacctgctgctccaccatgcgcgaccacagtgacgccttgttgcctaccaacgcgtttttcgccagctccaggttccgcgtgtcctgcgcgcgacggtagaggcggggggccacgtccggctgggccggggcggagtcgctcacctgcacctgctcctgaacgctgatgccctcctccccgaaggtgagggtggacgtcagctcgaacttgcggcgcagcccgt

SEQ ID NO: 947 - DNA, 9097 bp, Myxococcus xanthus
gtgctctacagcgccatctatatgcaggaaggttcgtccggaaaggcgcacgacaacttccggcgagccctcaggtgaacccggacaatctggagtcgcgctacaacctggcactcaccctgatgaagatggggaagatggacgagtccaagaaggagctgcgcacgatcctggccgtcaatcctggcatctccgacgtgcaccacctcctgggtatcatctcctactcgaagggtgactacgacgaggccggcgagcacctcgcccgggccacgcaactggtccaggattcccccctgctgtggcacgacctgggcaccgcgctgatggagctgggccgctaccaggaagcgcgtgagtccttcgccaactgcgcccagttggaccccagcaacagcagctgcatcaacaacctgtccctggcccagcgcaagacggccctcaccgacgcggccttcaaggagatcaaggacacgcagcaggcggagaactccgcgcccgcgctcttcatgctcgcgcgtcagtaccgcgagaagggcctgctggcggaggaagaggccacctaccgcaagtgcgtcaagctggatgcgaagtacgccgcctgccacttcggcctctacgaactcttcttcgaagcccacaagcgcgagcacgcgcagatcgcctgcaagaacttcctgaagtacgggacgtctgaggaattccccacggagtaccagacgtgtgagagattcctgagcgacgcgacgttctgatgtcctgccttcccgactcccctccttctcgatgagcgttcgtctcaccgtcacacagcgcagcgaggccggcgctgcccagagcaccgagttcgtcctcgacgacgcggtcatcaccctgggccgcgacaaggcctgccaggtcgtgctcgcccagcaggcggtgtcgcgcaaccatgcgcgcatctgccaggacgggccgctcttcttcgtggaggacctgggcagctcctacggcacgcagatcaacggcaagcccgtgcccaagggcgagaagcggctgctgcgcaacggcgacgtcatcgccatcgccacgttcgacgtccgcttcgagcgggtgatggacctgaaccccgaatctggcggggagaagacgtccttcatcgcccggggcatggtgaaggacgccatgcgcggcctggccggcggcggcgaggagcgctacctgcgcttcatgaacggcccccgcgaaggcgagcgcatcgagctgggggacgcgaaggaagtcatcctgggccgcgacgagaaggacgcggacatcatcctcaaggatgacctggtctcccggaagcacgcgaaggtgcgccgcgactggtccggcacgcacgtggaggacctgggcagccgcaacggcatcaaggtgaacaagaagcgggtcaaccgccggcagctcaaggacggggacgagctggaggtgggcgccacccgcttcctgtacgtggaccccaccgagccggccgaagagcccgttcagctcgccgccgaggtcaaggctccgcctccgccctcgccccgtcgtccgcgcccggagcccaagcccgtggagcccccgccggaggaggagcccgcgcctccgcccgaggagcccgcgcccgcgccggaagagccccccgccgaagagcccgcgcccccgcccgaggagcaggtctccgaagagccgcccccgccggtgtcggcggagtaccccatgccggatgagcccgctcagccgagcgcgatggcggcgctcaaggacaagggcaagctcgtgcctctcgtggtgatgagcgtggtgggcctggtcttcctggtgctgatgattgccgtgctcgcgggcgcctagcatcgcgagcaggcccctgccctcatgagagggcattccttccgcccgcgcgtccctgtcacgcgcgggcggaggtccatccgcggctatcgcgtggagatgcgcgccacgggctggatgttcagctcgggcgacagctcctggtagctgagcacggagaacgacgggttgaactcgtactccagcagcttgcggacgtagcggcggatgtccatggccgtgaggatgacgggccgctgcgcgctgggcggcaggtggccacactccgaacgcacggcctggacgatttcctgcgccagctccggctccagcgccaggtgcgcgcccgcggaggtccgcttcaccgagccgcggatggcgtcctcgatgttcgggtccaacaggtacaccaccagggtgccggtgccacgcgcgtacttgtgggagatgtagcggcgctgggccgcgcggacatgctcggtgagcatgacgttgtccgcctccacctgcccgtactcggccagggcctggaggatgccgcgcaagtcacggatggagatctcctcctccaccagacgctggaggatgtccgtcagcttcagcacgttgacgaccttggggacgacctccttcacgatggcggggaaggccttctccaactgctccagcatcgtctgcgtctcctgcacgccaacgaactcacgggcgttgcgccgcagcacggcggcggtgtgcaggatgatgtagccgggcacgtcccacgtcgtgaggccggcggcctccagcgtgtcgcggtactgctcggggacccaggcggcgggctgccgggtggcggggttcacggcctcgaagccctggatgttcatcagccgcagccggtccaccgtgtcgttcaccaggacgtggcccagcgtggcctggccggtgacgacgggcacctcgttgatttgaatctggtacgcgcccggcggcagcgagccgttgccacgcgcacgcacgcctgggaagcgcacgcccagttccacgaagaggccatcacgcatgaacgggatgagttcgaagaggaacttcccgttgtcctggcgcgagtccacgaaggggaccagcgcgtcggagacttccaggacgatgggcgtgacgacggggatgaatagctcggagtccggattgagggcttccttgggcgcgggctccgatgccatgggcgtgcccaggtccgtctccatggccgggccggcatcctccgcctccacggcctgctgctgcttcttcagcatcgtccaggcgcccaggcccgcgccgatgcccagcaggaagaagggaatcttgggcagaccgggcaccaggcccaggacgatgagcatgccggcggcaatggcgatggccttcgggtaggccgtcagctgggagcccatgtccatgcccaggtgattgccctcttcctcacccgccacgcgcgtcacgatgataccggcgcaggtggagacgaggatggcgggaatcatgccgaccagaccgtcaccgatggtgagcagcgtgtacttctgcgccgcgtcgccagcggacatgcccttctgcgtcacgccgatgatgaggccaccgacgatgttgacgacggtgatgatgatgctcgcgatggcgtcgcccttcacgaacttcatggcgccgtccatggcgccgaagagctggctctcacgctccaggtcgcggcgcttcttcttgccctggtcctggtcgatggagccggcccgcaggtcggcgtcgatggacatctgctttccgggcatcgcgtccagggtgaagcgggcggccacttcggcgacgcgctccgagcccttggaaatcacgatgaagttcacgatgaccaggatgatgaagaggatggcgccgacgacgaagttgccctgcaccacgaagtttccgaacgccaccaccacctctcccgggtcaccggtgaggaggatgagacgcgtggtggagatggtgagggccaaccggaacatcgtggtgatgagcagcagcgtcgggaacaccgacaggtgcagcgccgctggcacgtagagggatacgaggagcagcaccaccgagatgctgatgttcagcgtcagcagcacgtccagcagcagcgtgggcagcgggacgatcatcatcccgacgatggccacgaccaccacggcgaggacgatgtcggagtacttggagaggaagctgttcgaattggtggcagccatcagcggtcaggcatcctaggccaacccgggtgccttctgtcagggggggcgtcgcgaagggcccctccccacggcgaaacccgccgttctccctcgggcggaagcagccgggcagtcaaccaaagtggacattcgttcttgcaccgcgccccgtcacgcgggttcatccccctgtcgtgccctgccgtcctggagggccggggcaggccacacgaaacctgggagaacacgatgcgactgaagaatgccttgagcaggggtcttccgctgatgttgctgggggcatccctggcctgttcggcctgctcggacggcggcaccagcggccctggcccctctggcgagagggagaagaacgtcgtcaagggcaaggccacggacaccgcgggcaagcccctggcgggggtggaggtggtggccgacaatcaggtcctctacgactccaatgtggtgggcgtgacgggcacggacggcacctaccggctggagctgggccaggcggccaccacctggaacgccagcgcgcggctcaagcgcgacttcaacggccgcagctacaccttcgaactgcaccccagcaacgccacccccttcgcgggcaacgagggcgccgtccgggacttcagctggaagctgaccggcgcgaagcccgagggcggcgcctacggcagcggcgtctacttcaacctgacggactacgtggatccggccgacccggatcaagccttgcagcgcgagcacgtggagttgacgctcaccccggtgggctcgctggtggacggcagcgccgggacgccggtgacggcccggggcaccaacacgccggacggcttcggcttcccggacctcccgctggggcgctacacggtgacgggccgctacgcgccgccgggacaggccgtccggccgctgctggtgcgcgtgcaggaccagggcacctacgccgaatccgtgacggctgacttccagcccgtcatggaggggttgtaccgcctggacgtggagctgaagttcccctgagcccaagggccagggaaggcgggccggggccttcgagtggccccgcccgcgcctacgccgcgccgtcggattcggaagacggcgccccctcggcgctctccagcgccgcggcggccagcatccgggcccgggcgctgagcggatcctgtccttcgggatccagccccaccgcatgattgaagtcccgggcggcctcgtggaccttgccgagccgcaggtgtacttccccgcggttgacgaagggcgtgaggtcggaggggtccagctcgatggcgcggttgaagtaggactcggccaggtccaggtcttccagcgccaggtggcaggcgcccagcgccgtctggaagtaggcctcggtggggtccatggccgccagggactggaacaaggtcagcgactcacggaagcggccgtcctggaagaggttgaagccttccgtggcccgttcgagcatctccgggccggacaggggcttcacgtcgtcgttggtcaccgttgccttggattcagtcgtcatctgcacacatccctcacgagggcgggaggacggccccggagccggtagggcaagcggttccgggcgccgggagcttagactgttatcggcttttccaccaaaacggtgcgccgcttcggaagcgatattcgcgccgccggcgcgaaaaaatggatcagaaaatggggaggaaacttctgccccccattcccccataatccttttgtaagcagcgccgccgcaaaccacccgcttcccaaactttctggagaacgcaaatgaccaccgccaccaccgccgccgccgccgccacgaaggccctcggagccagccagggtctctccgccctcgagcagaagtccctctccggcctgacgggtccggaccgtgagcgcgccgaggcgcagctcatgctccagaagcagcaggaggccaccgccttcgtggccaacctgatgaagaagctcaacgagatcgcgatgtccgtcatcggcaagatctaatcctgccgctgtaacgcgactctcggagccggcttccctctcgggatgccggctccttgcttttgcgggctcgagcgcctcacccgaaacgacaaagcccggactgcgcgacgactcgcgcggcccgggcctggtgcgtgttgcgatgaaaaggggcatgcccccctggggctaccgggacttcttcacctggtcggcctgctgcttgagggtgcgcagcgtcgcgtgggcgcgctgcgtggcacggcgcttgaggcccgggtccagctggatggccttgctgaggtccgcgagcgcctcggggacattgccccggcgcagctggatttccccccggccgaccagcgcgtccacgtggccgtcgttgaactggagcgccagccggaaggcgtcgaacgcctcgtcgaagcgctccagcgtcataagggtcgccccgagctgcgcgtggaagacggcgtcggtgggcgaggcggccacgaggccctggaagatctgcagggcctgctgcgagctgcccgcctggaggagctggtaggccttgtccgcccaggcgtaaagctgcgtgttggagaggttgaggaactgccccagggtgatttcgccgcggatcaccgcctcggcgagtgcttccgggacgacgaccttctctttttcacccctgggggcggagtcactcacgacagcctcgagaagggccaggcagtcccccacctggcccgatgaagtacgtccagcggctagaacgactggggaccgcggaagcggaccatatcattcagcttggacagcttctccagcgtcccgaacatgtcacccagcgccttgaaggactgggtcagcccggacttgtgctggttcttgtcgtaggcgccgaagaggtcgtccgccttgcggaacgggttgaagccgttcgcgttggtgttcttgagctggtcgaacaccttgctgatggagtcgaacgtctcgttcagcttgttcagctcgggcttggcactgctcatgtcccagggcagcggcttcacctggggcaggttggtgttcatgtcccaattctgggccacctcacccgccgcgggggagtccgccgccgccgagtagttgaaggccatggtgcgccgctcggtgatgacggcctcgcccaccttgtgcacgtcgccgccgttctcgtggccgacaatctccttgccatggaacgtccagtcggccgcgttctgccccatgtggaagacgtccgcggactggttcgagtggaagcggacgacctcgtccatgcccttgttggtgacctggccgaccttgcccttgcccttgtcgatgtccgtcacgcgcacgtggctgtcgccgtagacgacgtccagctggcccgtcaccgtcatgccgttgccccagggcttgcaggagcagttgatgcgggtgccgtcgcccaggacgaaggaggtgtcgcgcttgaagtcgaacttgccgccgtcgctctcgtcaacgtgcggatcaccccagacgcgggtgtttttgccgtccggccccgtcacgcgccactcgaactggcccagctgctcgatggtgtagccgcccggggtggtgatcttcccggtgccctcttccaccttcagggagttggcctcgcgcaccgcgtccagggggttgggacgctcggcggggaaggcggcgttggtgcccgtcgcacccgcctgcttcgtgggggccgcggcctgggacatctgatccacggccttgccggcgacgttcaccgccttgcccgcaaggtcaacggccttctcaaccagattcagcgtcgactcgatgagctgcgcgttgcgcgcgatcgtcgaggtgttgacgttacccacgccctgcgtcgtggtgagctgccggttaccgccaactccgccgatgccgttcgacatattcggtgctccctaaggagggggaaatgttcgatgctgcttcaccgtgattttcggtgttcagcgctgggagtttcgcctcggtgcgtcgcttttctcaaaagaaggtacgagccgatcacgcggggcgggggcacctcttgccagggcgggaaaaagaatcagaaaatcccgaggaaacttccgaccccctttctcccataatccttttgtaagcagcgccgccgcaaaccacccgcttcccaaactttctggagaacgccatgaccaccgccaccaccgccgccgccgccgccacgaaggccctcggagccagccagggtctctccgccctcgagcagaagtccctctccggcctgacgggtccggaccgtgagcgcgccgaggcgcagctcatgctccagaagcagcaggaggccaccgccttcgtggccaacctgatgaagaagctcaacgagatcgcgatgtccgtcatcggcaagatctaatcctgccgctgtagcgcgactctcggagccggcttccctctcgggatgccggctccttgcttttgcgggctcgagcgcctcggcgcgccgcccactccccttccctagcaccccgcaaagcaaaaccgccgctccggtcagagacccgggcggcggcttcaaggacaggcgtgcggcggggccgctcgcggtcgggctactcgccccacatgtccttgaggagctccttgcgacggctcatcagcttcccgaagaagttgtcgtcccgcatcttctggaacatcgcgttcgtctcgtgcttcttcgtcgtcgactcggcgtgcgacttgacgtcgtcggcggaggcgttcgggttgctcttgaggaaggtctccatctcgccctggaccttctccttcaccgtgttgatccggccttcgcccaggtactggaggctgcccttgatctccggctcgttcatccggtccacggcggagttcagcacgccttcccacgcctgcttctgggcctcgggggtcgtcgtcgtcgacttgcgcgtcgtcgcggacgcgttgttcgcaatcttggtggtcacggggaaatctcctcggaaaaaaagaacgtctcgagggctttagag

SEQ ID NO: 948 - DNA, 9729 bp, Myxococcus xanthus
cggtggagcaggggcgtgcaagagactgtggcgtgattgggggcgggagacgagtttccagatggaaggcgtggcaccgcgccaggaggagggctcagcgcacaccccttgcctgcgtcgggtgcgaggttggctccggcgcacagccgccggtcccaactgctccgacgcgggaaggcgctgcgaagcggcggtggcacccgcgtaggcggcgcgccaggacgccgctgtcaggaacggaccggcccgggctcgcgtcctcagaggaagcgggcctctgcaccggttttgcactgacatccaggctcaccagtggaggaggttcccatgcgatggatgcgcacgttgacgttgggtgtgttggcgatgtcgggcggttgtaccgagagcaaggtggcggaggaccaggacatcgtcctgagtggacgactcgttgacgaggcgggcgcgccgctctcggacgcgctgctgaagctctaccggagtgagaactccgcgtgcgcgttcgctgccttctcgtcgagctggaggtcggtgaagacccgcgtcgatggcaccttcgaggtcgacctgctgggggcggacacccgcaacgggagcatcgcgcgttgcttcgtggcccgctcgcccgagcagtcccagggaaggcgcgtttcggccttcttcctcatccagcagtcggaggtcgcgctgcccgtcatccaggagtggaccggcacgatgacggccaccgcgcaggcgcagggcgtgagcgtgggcttccggccgctgtccgccacccacggtgccgggaacaatgagcacgtgctgtccctccacccgtcgagcgccagggaggcctggcaggtgctcaaggccacctcgccggtcctcctgagcgactacgtcctcgaggacgcggaggggctcaaggcttccatcatcacgacgcgcgatgtgaatgcggggggcgtgacggtcggtctcacctataccagcgatgacgttgtcctgcctcgccgcgccctcgtcccggcaagccgtggcgcggcgtgcacctacctgaacgccgagacgccctgccgcgtcaccaacggcgacctcggcgggattgtgctcttccaggagggcgtccgtgaagtcgccgtgcagctctcgcggcccgtggtgcctcgcaaggccgtgctgcgcaacttcggggtgacgggcaccatgagcgagctggtgctggagggaagcgccgacggcgcccagtggatgcccctggccaacttgctcgatggcgccagtgtgcagtccttcatggaagtggacctcacgggcacgacaccggtgtcgcaggtccgtgttcgggccactccgcaagagtcggtgggcgcgttgcgctcgctggggcagctctcgctcttcgaggagtgacaggaccgcggccagggttcttcgtttctcggtgagggaaatcggggctcggctccgttcaggggagtgacggcgaatgagcgccgtccttcctcacggagttcccgctatgacgttgccccgttcattccgagcgctggcctgcactggtgccctctccctcctgggggcattccccgtatgggcggcgcccaccgagtcgtccggaccgcgcgagattgcccgcatcgggacttctgacagccatgtgctctggctcgagggagaggggggcgcggtcaacgtggccgtcatcgcccagtatccgcggcgtccgctcgtggcccctcggttcttccagacacactcggcggcggaggtgttcctggccgtggcacccgaggggcacgcgctgcccccggccctggcggaccacgcgctcgtcgcgatggatgagggcgaaagagcgcagctccggcggcagaacgaggcagagctttccgccttaccgaccaccttccccgaggagcctcgctcgctcaccgggagctgctcggcctcgaaccgcgcctgggctgcctccgtctatggggaccccacctgcggggacccaagccaggaggtcatccacacggccttcacgagcgactactactgcaattccccggactgtgacttcccactcggaagtgaggacggctatcagtgctcccctcaattgctcgcctgcgacaaggttcggggcaccgcgacgcgagtccgtctgcgcgccaccaattggaacggggccctgtcattcaatcatccagggcactccatgcacttcgccgtgctgaactgcgcgggcaatgggccggtgaccttcaacttcagccgaggcacgggggccgacagtgtgcagctcaaccctggacagatggggaacgtcaagctcggggcgcacatcgctccggccctcgccgccacgcgcgtcaccatgggccggtggaccgaaggcctgcccgcgagcggctcctcgtacgtctccaacgccatgtcggtggccgacaattctggcacggcggacgccgtgcttgcctgcggagacatcatcacccgctacaccatgtcggacctgaccgtccccgcctgccacaactacgctgacctcgcgctctgcaacggcacgaactgcagcaacgcttgctattacacttggtaacgggagggctgctccgcccccgcttccggacggacttgctccgggcgagggcaagctgctagggcacgcgcccgtcaatgaccaagacctccttcgggcgagcactcctcccgctgttgctgtgctgtttgttcaccaccgcttgttcttctgaggggcccgtgggcccccaggggccggcgggaccgcaagggccgcagggcccctcgggcggacctccggggccgcagggcctcgcgggtccgcgtggagagcagggcctgacgggcccacgaggcccgatgggcgtggaaggcccgcgcggcgtcatgggcccccagggctcgcaggggcccaagggcgacacgggcgagcagggcctgcctggcgcgacgggggcgcagggcccccaggggccccggggcgacaccgggccggcgggccccatgggccctgtgggggagtcgccggagatctgcacgccgggagagttcttctgcgagggaacgaggctgtgggcctgcacgcgctcgggtacggacgccgtgctgaacacgaagtgtgcgggtggcacgacgacgaatcccacggggtgcttcacgactgcctgcgcccccggcgacgccgcgtgctgccgcaccgagaggcccacgtgtcagtggagcatgagccgccccatcagcagcacgggcgcgggctacgagaacacaaatggcggcttcgtttcgcctgaccgttcctactgttacgcgccctcaagctgcctctcgacggataccttcaccgtgcagatgggaatcacgggcaatgagagcgtcacctgtggcgcggtcttctcgacgctgattatccggttgccccggcccatgacggcgccggggcaggtcttcaccttgccgacctccagggtgtcgctctccctgttcgcggatgaaaacgcccgagcctgctcgaactggacgggcaccgtgacctggcattccgaggtcccgtcttggagcgtcagcgtcaacgcgacctgctcggagacgggcaagagccacatccagcttgtgggcagcttcagcggcgacacctgagcctcccacggcccgcccacgccctgtcctcacccggctgggcgtggctgttggacgctggagccgcgtggtccagacgtcatgcaagggcaggaccgcacggggcgatttccccgggattccgagctcgcgggcggacctttcctccacgccgcaaccatctctcgcctcgatgagggaatcagggcgtcaggccgcttgagtcatggcccccacgttcatgggcggcctttgctcgcgaggtccacgatgccttccgtgttgcgtccgtcctgggtgctgctttcctcctgcgtcctgttgctgtccacgctctccgcctgcgacgaatccgaccccgctcctgatgcaggcacctggcttcccgaggactcggggtcgccggactccggcgctcccgatgcgagcgcggaggcgccgtgggatggcggctacaccgtgctggaggaacacggtgactggattgaccggggccgttactcgccatgcgacttcaatcagcagggagaccccaccaccatccggtgtgatgacctgtcgcgctatgacgtttcgcaatgctcgccggaggcgctctcccaggtggcgcagcacggcatctacctggccgacatgcgaggtgagcgcctgctgtctgacggagggagccagattacccccgacttcaccacctaccagctcttctccgacggagggacggacacgctcaacggccagccgttgctgacgcggaacacggacggcgggagcttcttcgtcgttggcagccgcaccaatcccttcaatggggccgtcactgtcaccgcgctcgccggctgccaggtgccctcacccggcatcatcacgggctgctacgcccgctgcaccaacggaaggttcagccgggcgggcaccttcgaagcgtggcgcatgccctcacagcgaggggagggcgagtcctcgggcgggctgcgcctcatctccgagtcccccgtcgcactgggggatgccgtggacgtctatgtcacgaagaaccacgcctacgtcgtctccatcgacgacctcggcggcatcggcaacggcgggctcaccgtcttcgacgtgagtgacagggcgcaccccatcttcaaggcctccatcagtctgccgggggactcgagctggaatggcgtgtgggccaaggaggatgccctctacatcgccggaaaccgcgcgggcgtcgtcgtctatgacatctccaaccccgcgcagccagagtacgtgcgccacctgcccgcggggcagggggcgcacaccgtgctggtggatggaaaccggctctatgcgatgtcgcccggcgaggtgacctatgttcacgacgtcacctcgccgctggcgcccgtcctgctccagctcatcaccgtgccgtccgagttctcctcggggggcgcgcacgacgccttcgcgtacgagggccggctctacgtcagcaatggcttcggtggttactccatcatggatgtcaccgacctcgacaacgtgcggcacctgggccagtacgtgcacggcttcaacgcctacgcgcaccacagcgccgtggggaccttcgccgggcgcaccatcgccttcgagggcacggaattcaatggcagccacctgcgcgtgctggacgtcaccgacccggcgaacatcgtcaagatgggtgagttccgtctcagccccgtcacgtccatccacaacctgattctgaagggccacctgctctacatcgcctggtatcacgagggcgtgcgcgtgttggatgtgtccaaccccacgaagccgcgccaggtggcgcactacaacaccttccgtgagagcgaccccggccgcacggacaaccttttcgagggcaccttcggcatccgagtacccggcgacgggtacgtgtacgccgccgactccgtgcgcggtctgctcatcctcaacgaactctgagcgtcccacggcgtcgctggagcagtggggctgtgaggtcgcgcctcagcgggccgcggccttggcgcgctcgacctggcgcgcccgggcacagccttcgttgacgcccaggtcacacgccttcttcaggtcggacagcgcggacttgaggtcccgcaggtggtagtgcgtcccgctgcgctccatgtaggccagcccgtggtcgggattgcgttcgatgaaggcatcccagagcggaaggatttccttgaagcgccgctcgcgcgccagggcgtagtcccgttgctgcacggtgcggaagtcctccgccccctcgccttgcttctcctcggcccgcgcctccgcctgctgtggagatttgacgacccatgcgcgccgccgtgccacctcggggttgcctggagcgagctccccagccagttccagcaggcccaacgcttcctcgcggcgtccggccttgtgcgcctcccaggcgtcgtagatgacccccttcaccacgtggtcccgcagggcccgtccgtccgagtccgtcgcgtccaaccgcaaggcgtgcaggaggtccttgcccgcgggttcccacttccggctgttggagaaaatccgagcccgttcgaaatagacggacgcacgagcgggccgcagggccacggcccggttcgcctcctccagcgcggcgtccagggccttggtgcggcgcagttgcttcgcccgagccagcctgaactcccagtagtcgccggctgacagtgcctgggcgagcaggaccagtccctggtcgttcttgccctggaccactaggtcgtgtgcgcggtcaaaatcggcaaagccgcgcaggaagcccaccttggggtgagcaaggctctgcgcctcggcgaaggcgtccatcttctcgtaggtgccgccccagcggggggcgagtccgtggagatagacggcccggacgtccgcacacgtggggcactgctccatggcgcgagtgtaggcgcgctcgcgagcctcatcgtcgcccagcgcgttcgccacgtagatgagcggccgcgccgccgcgaccgccttcggctggagcgaccacgctcggacgagatcgggcaccgcgcgttcgaaggcctcatgcatcccggcgaattcctccttcgccgttgcccccacggtcttccccccgcggcgcaggtatcccaccgacacccagtgggtccccctggcgaggtagggcgcgaaggagcgcggtgacgcttccacccaggcgtcgaggagctccgtcgattcggaggagccgttgccgagcgccaggatgccgtcggtcatccagtgctcgtcctgggggttcgactccatgccccactggagctgctcgaccgccagcgtcagctcctcgaactggcgtcggagcaggagcgagcgcagtgccaccccgtccacatgcccttgggggactttaccctcctcgcgcccggcaggcgtcacgacgggaagcccttgcggcgcggggccgggggcaggtgtcaggacgggctcctggcgtgccgcgatgcgcgcttcgacttcggcgctccgcgttgcccgtgaagcaatcacggcaagcccggcgcccaggcccatgacgaggactcccgcgccgagcgcggtacgaagagatggcattgagcctggcatcctactcaagacaggccgctgcgtgacttcccggccgtcttctggacagggaccgtggaccggggcagatgtgtgcataccgatggcctcccgtccgccctccgtccgtgcctcctccccccggacgcagaagacgaagcagctccctgccggcgcccggcgcgccgtgaggaaggattccagtccgggctggggccgctggatgtttggcgggtggctgctgttcgtcgtctggctcagcgtggagtacgtgcggctgcccgacgtccgcgcgcttcagacgcagaacccgcgcaccaccgcgctcatcacgcagcgggccgaggaggcgctggcggaggggaagaagccccgtgtacggcaggcctgggtgcctctggaggcggtggcgccgcatgcgttggatgccgtgctgagctccgaggacgcgcgcttctacaagcacgagggcgtggattggatcgaggtggagaacgccctcgaacagtccgtgcggaaggcgcgcctgggccgcggcgcgtccacgctcacccagcagttggccaagaacctctacctctccacggaccgcagcctcctgcgcaagggcaaggagttgctgctcgcccgccaactggagacccatctgtccaagcagcacatcctcacgttgtatgtgaatgtggtggagtggggagagggcgtgtacggcatcgaggctgcggcgcgtgagcacttcggtacctcggcgcgggcgctctccgtggcacagggggcgatgctcgcgggaatgctgcccgccccacgccgctggctgcccgcccagaagcccgagacgctgcgtatccgggctggcgccatcatcgggaggttgcagcgcgagggccgcatcaccgcgacgcaagcccgcgaggctcaggccgaactctcgcgcttcttcggcgaaacctccgtgcccggctccgtggtggaggccatctcccggctgtcctcggagagctgagtcgcggacccggtcaggtgagcctcgaacgatggggaccgtgctgcgggggcctcccgctacctcggcgtgttgatgagcgtcagccggtgtggctccggcgtcgcccagttctgggggctgtttccagacagcgaaaccccgtcgaggagcacgttgctgtcgaagaagtagagtgccccgccctctggtgccctgttgttacggaactcgccgccgcggaacgtccattgattgctggccgggaggtgcgcggtgttgaccgcgccgcccacgcctccgaactgggttcgcggaccggtgcattcgttgtcgtggaagatgttcccggtggcgacacccgaactggtcggcgcaatcagcatcagcgcgccgccgaacgcgggcgccttgttgaagcggaactcgttgtggttcaggttcacgttcgcgcgtgagccaatccaaagcgcaccaccggcgttctcggaataggagccctccgctcccgcgccgttctcgccgtcgatcttgttgccgtactccaagatgcagtgttccaggaagtccgacccggcgtccgacgtcgccgccaggcgcagtccagcccagcctcgggtgggattgttggcggtgaagacaatggggctggccgcggtgccctgcgcggtgattcgcccatgcacggcgagcttgtggtgtcccatgaaaatgaggtggacgccgggctcgatggtgagccggctccccgcgggcaccgtcaagtcatcggtcacgcgatacggcgagcccgcgcgcgtcagtgtgcgcgtcgtgagacttccggagagattcgtcccatcggacgtgctcaccgcgaccgtggtgctcgcggtggtgctgccgctctcgttggtcgccgagagtgtgtacgtcgtcgtcgctgtcgggcggacctgcaccgaccttccggtcacctcacccacgccgtaatcgatggagatgtcctgcgcgccggtgacttcccaggacagctcggcggacacgcccggagcgatggtcgccgggtttgcttcgaagcgcaggatgttggggcggtccgggactggatccggcgaactgcaggcggtggcgaccgcgaccacggacgagagggccaggacgaaacgacgcgagtggagcatgcgcccgttctatctcaacggaggcccgataaccgggatgggaaatgggcccccacgcgccgtcccaaggccgtgaggcctgcgacgaacggtcagagtgagtgactcagtattcacgtgtagacgtcatggcccgcggagccgctgtaggtcctggaccaggcgtcatgtctgtgaatcaacatccaagagccagcgggttctcctggcaggcctacatccacgtcgcgtcacaccggggacacatcgtggcgcgctcatactcctctcgcgggccctcgaagccgcaggcgtagcaggttcgcagtgtcttcaagacatgcgctgccatggcaggcgtgggctccgtgctccaactgggcgcggcactggcggcgggga

SEQ ID NO: 949 - DNA, 9091 bp, Myxococcus xanthus
gaacagcgagggctccgtgtccgcgaccgggccccccacctgctgaggccacttcgggggcgggcacccagcgttcgaacacccatccgttgggctcggcactccttggattcggctcagcggctttcgctctccggatgcccggggagctggtggagcaggggcgcttccaggctcctcgcccgtgcagcctcgcgcgcgaggaaggcctgcctcgcgcgcaggatgtcctggcctcgccgtgcttcgaggacctcgagataggggccgacactcttcctgacgcggcagatttccgcgaagtgtcgaacctcatccgaggtggtgagccctgagaggagggcgtcgtggagtgcacgcacggcgatggggaatcccagcttgtttcgatacttgaataggtccgcgaccgtcttcgcgacgccgtagacggtgatgggcaacccccagagcaggcggtgctcgatgccctccgtctgtgctcgccccgagaagcgaaccacctggagcggtggctggtcccagcgcggtttacgcgcatgcgctccaatggccatccagacctcggtgggggattcaggcagcaagccgtggaaccacagcgcggacttcaagcagagcacgccccgggggacgcgcttcacggcaatggccgcggctgtcaccatcgcgctcgagcgagcccagacgccgggcgcgacttctcgcagggctccgacattgcacagcaggttgagctggctgcgtgcagcgccatgtgcctccaggtctcgagatcgcagcaaccccaatgactccgccagcgcggccacggaaggccggctcttgtagccaggcctccggcgcattctgcttcccattccccatccctccccagcgctcggcgttcccggagcgcattccgagagcagcgtaccggggaggcccgacagactttctgcgcctcagcgcgtggcctgctcctacgaggagaaggtgaactccgcgcggcggttcctacggagcgcatcttccgtgtgcgcgtccgacagcgggcgctcctcgccgaaggagacgatggagagctgcgaggactccacgcccaggttgcgcaggtagtcgcgcaccacggccgcgcggcggtggcccagcgcgatgttgtactccgtggtgcccagttcgcaggtgtggcccgacaccgtcacccgcgtcagggggcgctcccgcaggcccgtggcgagctgcgcgagcatgtcgcgcgactcgggccgcagcgtggccgagtcgagctcgaagtacaccgggtccgccgacaacgagcccattgcccggcgggctgcttcttcatcctcatcggcgttgcgggttgacgtcgccgccgtggcggtggggctccggtgctggtccggaagattgtccgtcagggaggacggcttctgcttggaggcgcaaccaaccagactgaccgcggcaatgagagacaagagggttcggttcatgcctcctgtcattttcaagccccgtgccgcgcccccatccctctgagacaccccaactgtggcccgctcaccgttgcagcgtgcccaggtcagcgttgcggattgccttccgcgcgctcgcgccggtggatggtggagacgtcgatgccgagcagctcggccgccttcgtcttgtttcccccgcagcgggccacggcccaggcgatgtactccgtctccaactgccgcaggggaacgatggtgcgctgtgcagcggccagcgggtgattctcctggctggtgtccgaaggcaaatgggggcgcagttgcggcagatccaccacctccgtcgagccgagcacgaccagccgctgcaccaggttctccagctcgcgcacgttgcccgcccagggcagggcccccagcgctgccagcgtctccggggagaaccgctgcacgacggagcgcggattgcgcgccttggcttgctggaggaagtgctcgatgagcgcggggatgtcctcgcggcgctcgcgcaggggcggcagccgcagcgtgacgacgttgagccggtagaagacgtccgcgcggaagcggccttccttgacgcgcgtctccaggtcctggtgcgtcgcggccaccacccgcacatccaccgtgcgcgagccgtccgcgcccacggcccgcacctcgccgtcctccagcacgcggagcagccgggcctggagttcgggggccatgtcgccaatctcgtccaggaacagcgtgccgccgtccgcctccacgaagaggccacgccgggccgtggtggcgccggtgaaggcgcctttgacgtggccgaacagctcactctccagaagcgcgtgtggcagcgcggtgcagttgacggccacgaagggccccgcgcgccgggtgccctcgaagtgcaaagccctggcgaccagctccttgccactgccgctctcgccgcgcaccagcaccggggcgccggaccaggccacccgctcaatcaacgcgtagaggtcgcgcatcgcggtgctgctgcccaccagggcgcccaggcccccacggtccgcggcctgctgcttgagcgtgcggtgctcggtgcgcaggcggcgctgctccagcgcgcgctcaagtgacaggcgcacctcgtccagccggaagggcttggtgaagtagtggaacgcgccgcgcttcatcgcctccacggcgctctccacgccgccgaaggccgtcatcatcaccacgggcaggtccgggtccagcttgcgcgcggcgtcgagcacgtcgaagccgtccacgtcctgcatgcgcaggtcgcacagcaccgcgtcgtagacgcgcgcgcgcagttgggcgatggcatccgcgccgccggtggcgatgtcgaccttgtagccgtcgtccgtcagcggttccttcaacatctgccccatctcgacgtggtcgtcgacgacgaggaccctggctctagacgacatgtcgctcctctccggcgggtgccgcggcgggccagcgcacggtgacgcgggtgcctcgctctggcgcgctgtccagttcgatacggcctccgtggttgcgcacgatgtgcgccaccatcgtcaggcccagtccggtgccctggccgcgcttcttggtggtgaagaaagggtcgaagacctggtggacgtggcggggggcgataccgcagccgttgtcctcgacgtccacgcgcaccatgccccaggcgcccggtgtgtctccggtgtccatgctcgcgctcagccggacgcgtccgccggccccgcacgcgtcacacgcgttgagcaccaggttgatgagcacctgctggaactggtcggggtcggccgccaccgcgggcacgggcgaggcgaccgtcacctccagcttcaggcgccgccgctcggcctccatccacagcaactcccgcacgctgtgcaccaggggctccagtgggactgtctgcgcgtccgctggccggagccgggagaagtcgagcaactggcgcagcgtccggctcaccctgtctatctgcccgacgatggtgcccaggccggccgcctgcgggtgctcgcgtcccagcttctcctgcacgtactcggcccggccgcggacgatgcccagcggcgtgccaatctcatgggcgatgcccgccgccagcacgcccaccgtggccagcttctccgcgcgcagcagttgtccttccagcgcgcgcaggctgctcaggtcctcgatgacgaccagcgtgtggacctccggcgtgttcggctccagcggcaccgcgtggacgttgtactggccgggctcttcgaagaggcagagcggttcaccgtggaggctgcgcacccggccgtcgctcgtggccgcgtggaccaggtcctccagtcgctggatgacgggggcctgggcctggggaaaggccgccgtcaggggctggcccacgacgtccgccggcatgcgggcgctcagcgcgcggttggcggcggagatgtgccgggtggaggagagcgccaggaccccggtggggatgttgtcgagaatcttctgcgtcttgtcgtgcaggtgcgccagccgctgcgcatggagctggctgtcccgcagggcttccgcccggctgcgcgcgagcaccacgtacactccgaaggcgatgaggaacccggagacgagcaccgccgccagcgacaggcgcagcaccaggccgcgctcatggatccggagcacgcgcgtcgacgcgagcgtcgccaccggccatgccgcgccattcttgaaccgcaccgggctgaaggtggccaccacctccgagtcgcccaggccgagccgggcggcctccttgcgctcgatgatgcgcgtgcccgactcacccgcgcgaagcgcccgcgccagcgccgcgaggccgggcgtctggtggccgtcggtgtccaaccgccggtacctgtccgccaggttcgggtgggtcaacgccgtcggcgttccatggactcccagcaccagaagttgcgtctccgagtccgacgcgagcagcttcagcggggcgaagcgcggctcggcgtccaccagcaccacgacgacgccgccgctgtcctgcgcgtcctccggcaacgcggtggcgaaggcgcgcagccagcccgattgggcccggggaaggggcggggatgagatgacgtggcccggcggatgactgcgggcctgcgccacggtgagggccaggtcctccgcggtgaactggtgcgtcatcgccgccgcgctgcgccggtccaccagtcggagccgttcctgtccatccgtgccgaagacgaggatggccttgtactgacccaccgcctccagcagggcgcgcatctcgcgccggtgctcctcggcggtgcccggctgggccagcagctcgcccgcgaagcgcaggtcctcctccgcgctctccagggcggcggagacgccgcgcacggcctccaggagctgcgcctgtcgctcgcgggccatctggtccaccagcgcttgccggtcgcgctgcatgaagtgcaggacgcccgcgatgacgccagagagcatcagacacagcagcagcacggggaggacaggcaggcgcatgaacacgggacgcaggggcgacaccggcgcgggggctccggtgcttgccgggcctccacgccgcctggcagcgcttcgtcccggaggaaagctcctccggtagcaacgcccgtgccccccggcttggtgcctctgagcggaggcacaagccccatggcgaagcgccgcaatctgcatggcccccgttgcatcctgccagggccagcgcgggtgacgcgcgatggcgaaggcaggtggatggggccagtggctgcttcagcggcgggacgcctgctgggtgagctgctgggacgcctcgcgcaccgtgccctggatgcggcggaggttctgcggccccatccgcagcaggtgcttctgcgcggccgtcagcccttcgagcttcgggtcggcgtagacgaacatcgcgcccttggggaccacctcgatgtcaccgtcgatgacagggacggcgagcacctgctcgaaggcgaggtggagcgtggcgtccaaggtgcttccggggcgagccgtctccatgtggaggcgctcggccaggtgacgcacctcgcggtaggtggacaccagcacacccatgtcgagcgagcccaccaccttgccgatgacgtcgtagcgcgcgtagctctgcttttcgatgacgagcttgccggccttgcggcgtgcctcgaaggtgccggccggagcgaggaagctcaccgcctcgcgggggctgtcaccctgggccacgttgcccacgacggtgacgaagcggcgcagcaggtcctgctccttcagccacgtggcgaactccggcatgagcgacgcccgggcgagccgtgtgcgcagcagcgcgtccatctccgcggaggagggcagcggcggctccgcgcgcggcgccaatccggggtgggacggcttggggatgaccgccatggagggatgcggcagctccgtcgccgactggcgcagcaccagccacgtgcccacgcccgcgaacagcatcaccagcgccgccacgcccacgccccagtgcatccggcgctgggtcttcgtcaccacttcagggttgctcatgcgtccatcctccgagggatgccgcatgggattgcagccgcgatgccagcagaaccgcgccgccgtgaagccgcgcgtttccctctgagacgcgggccgccgtgtggccccggggccacgctcggccgccttgcgagcgtggcgtgctgcgcggcatcccgtggcgaagcgccacggggcgcgcaggggattgctacgcgcgaggccgggacgcgcccgagtcgtcatccgtggcggtgagggcggcctcggctggggcctcggaccagcggatgtggaaggtggctgcggtgccgtcgaactcctcggggatgctgaccacccgccccccaccgcacagctccaccgcgcgcgccagcaggcccgcggagaaggtgggcaggtccgccagcacgtcattcatccgcagctccaccgaagtggggctccgctcgacgatttcgaccacactgaagttgttgccggcgcgaaaacccatgcccgcgcgaagcagcatccgccggggcccggccagccggacgacgcccagcagggcccggccgaagaaggtgccgaagtacgcgtccatgaaccgctcgcccagcgagtagtaggccgcctcggcggggacgccgccgtagacgtggccggcggcgattcggaggaactccttccactgctccagggtgtaggcccgctccaacttctggtcgagctccaaccccgcccggcgcaggtgctcacggcacgccggagtgaggcggttctcgagggcgcgcacgaagagcgcctcgacggtctggttgaaaacaagcttctcggaaggagtcatagaggcgccccgtatacaccgggcgggccgtgggatgcttgcctaccggtgaagttttgttcagtgaaactgtcagcgagtgtcagaacgacctgcgtcacgtactggctgtcagagcgacatgtgggtgacacgcgcagggcgcacctcctggttccttgacggggagtgcagttattccagttctatcccatccatgcgaggacctgggaggggggcgttcacgggcaggcacgagaaggccattgcgccctggggagctcggccgcaatgacggaggccatggacacgcgcgcccctggtacctcgaagacggacccgtcctacaacgtgctccaccagcagcggacgcggctgccgctggacgtcctcttcgcgccgcgcagcgtggccgtcgtcggggccaccgagcggccgggcagcgtggggcgcaccgtgttgtggaacctcatcagcaacccctttggcggcaccgtctaccccatcaacccgaagcggcccaacgtgctgggcatcaaggcatggccgtccctgggggccttgccggagcgggtggacctggccatcgtcgtcacgcccgcgcgagcggtgcccggcgtcatccaggagtgcgcggagctgggcatccgcggcgccatcatcctctccgcgggcttcaaggagattggggcggagggggagcgcctggagcaggagatcctccgcctcgcgcaggcggcccaggtgcgcatcatcggtcccaactgcctgggggtgatgcgcccgcccagcggcttcaacgcgacgttcgccggcgccatggcccggccgggcaacgtggccttcatcagtcagagcggcgcgctgctgacctccatcctggactggagcctgcgcgaggcggtgggcttcagcgccttcgtgtcggtgggctcgatgctggacgtgggctggggcgacctcatcgacttcctggccgacgacccgatgacgcgctccatcctgctgtacatggagtccattggcgacgcgcgggccttcctctccgcggcgcgcgaggtggcgctcaccaagcccatcatcgtcatcaaggctggccgcacggcgcaggccgcgcaggcggcggcgtctcacacgggctcgctgacgggcagtgacgaggtgctcagcgccgccttccgccgcaccggcgtgctgcgcgtggattccatcgccgacctcttctacatggcggagacgctggcccggcagccgcgccccgcgggccggcgcctcacggtgctcaccaacgcgggcggccctggggtgctggccacggacgcgctggtgtcggggggcggcgagctggccacgctcagcgcgtccacgttccaggccctggacgccttcctgccgacgcagtggagccacagcaacccggtggacatcctgggcgacgcggacccggagcgcttcgcgaaggcgctggaagtcaccggccaggacgaaggcagtgacgggctgctcgtcatcctcacgccgcaggacatgacggagcccacgcagacggcggaccgtctcaagccctacgcgaagctgcatggcaagccggtgctggccagttggatgggcggctcggaggtcgcggccggggagcgcatcctcaacgatgcgggcatccccaccttcggctatccggacacggcggcgcgcatcttcaattacatgtggcgctacacgtacaacctggcgggcctgtatgagacgcccgcgttggcgcaggcggtgagcagcgcccgggacgaggtgcgccagtgggtggagtcagcgcgcgcggaagggcggacgctgctgacggagtacgagtccaagaagctgctcgccgcgtatggcatccccaccgtggagacgcggctggcggtgacggaggacgccgcggtggcggaggccgcggccctgggcttcccggtggtggtgaagctccactcgctcacggtgacgcacaagaccgacgtgggcggcgtgcggctgaaccttccggatgcggagtccgtgcgcgccgccttccgggacatccggacgcggctggaggcgctggggcaggggcgcgcgttcgacggtgtcaccgtgcagcccatggtgcggctggatggctatgaactcatcctgggcagcagcgtggacgcgcagttcggtccggtgctgtcttcggcgcggggggctttag

SEQ ID NO: 950 - DNA, 7477 bp, Myxococcus xanthus
  unsure (1)..(7477): unsure at all n locations
cgaggagagcgcgttcctgctcacgctcggatggaagagcccatgagagaggggtagaaagtcgatgcgcggggcaaagagctggcaaggcctccaactctataccgttggccactcgacgcgaacgctcgacgagctcatcgcgctccttcgaccgttcggcgtctccacggtggttgatatcaggacgatcccgcgctcgcgccacaatccgcaattcgaaagcgaggcgcttcgctccgcgcttcgccggcatcacctccgttacgtccatctccccgcgctcggagggctgcggcacgcgcggggtgactcaccgaacacggggtggcgcaatgcgagcttccgcgggtacgcggactacatgctgacggacgcgttcgagtctgggctggccgagctgcgtgagctggtcgcggaaggcacggtagcgttgatgtgcgccgaagccgtgccctggcgttgccatcgctccctggtcgcagacgccctgacagttcgcggcgcgcaggtcgagcacatcaccagccgaacccggtcgacgccgcaccggatgaccgacttcgctcatgtcgatggcacgcggctcacgtatccggcgggcctcggctcatccctcgatacgcgcgcgccgtttcacctcgaggcgaccgtgcgcgtactgcagcggcggccgacgaacctcgtcgacgtctgggagggcggacggtacctgcgagcgctcacggtctccgatggcttcgtgctggtcgaggtctcgaatcaggggacggtggacgagccgcaggtccggttccgcgtgctcgatggggatgactcgcgcggcgcgcatgccgagatctctcgggtgttgcggcgggggctcggactcgatgtggacccggagccgctcgatcggctgctccaatccgagcgcaagctcggccccattgtgcgggcgctgcgcggtatgcggccgccacggttccccagcctcttcgagacgttcgcgaacgtcatcccgttccagcaggtcagcctggacgccggggtcgcagtcgttcgccgtttggtagcgcgcttcggccggttcttgccgcacgaggggcaagtacggtacgcctttcctactgctgctgcgctcgccgaggcgcggctcgacgcgattcgctcctgtggcttgagcgcgaggaaggccgaggcgctccgcgcggccgccgccgccatccaagcgggcgatgtgacagaggccatgctctcgcaaatgagcagcgccgaggcgatgcggatgctcactgggcttcacggtattggcccctggagcgcggccttggttctcctgcgcggcttgggccggctggacgtgttcccggagggcgatgtcggggtcattcgcgggctctcgggattgatgcatgtcgagccgggacctgctctcgagcgcctgatccgccgcttcggcgagcagcgtgggtatttgtatttctgctcgctcggtagcgcgctcttggcccgaggcctcattcatgccgccgacgctgggccacggcgaagccttctaatcgcgccggagtcgcaccattgaggtcaacgcagcgatgcctgccgatgtgcaactcatgcagaggaggcggttcgctctcgctctaggggagccgcgcgaagccgagtcgccgctcaggagcccgtgaaatggcagacccaccgaaaccgaccgccacgccaccgccgccctctggagccgaccgcgtctcaccggagctggtgaaggagctgcgagagcgcctcaccaagggcgaggacgtcgtcgatccgaagacctgggccggctccattccggccgccttcggtatcgcccctcgcctgcgaatcggcgcgaaccgttggttcaacctggtctggctgctcccgatcggttgggggcttctcctgttcggggtcgccgtagcgcagtatctgcgcgggctccccgcggtcgaagggttcatccaccggcatcccgggaccgggttcgcaaccgcgtttgccacgccgatgccggtctggttgcgcgcccagcattttctgaacttgttcttcctcatcttcatcattcgcgcgggcctccagatcctcgccgaccatccccggctgtactggacccggcactcgacgccgggaaaagagtggctccggatgcagaagcaggtgccggacctgccgctctggaccgccaagcaggactccctcacgctgcccaaacatcttgggcttccgggcatccgccactcaatcgggctggcccgctggtggcacctcgggatcgatatgttgtggctggcgaacggactcgtcttctacgtgctgctcttcgcgaccggagagtggcgccgcatcgtcccgacgaactggcaggtgttccccgacgccgcgtctgctctgctccagtacctctccctgcgctggcctcagaacgatggctgggtcgcgtacaacggcctccagatcatcgcctacttcatcacggtcttcatcgcggcgccgctcgcgctcatgaccgggctcggcatgtcgccagcgctttcgacccggttccacggcatcagcaagcggctcagcatccagaccgcgcgctccctgcactttctcgtcctgtgctggttcatcctcttcaccttcatccatgtcaccatggtcttcgcgaccggcctgctgcgaaacttgaaccacgtgtacgcggggaccgacgccaacgattgggtcgggtttggcatcttcgctgtctccatggcggtcgtcgtgatcgcgtgggtggcggccacgccgttcacgctgcgacatccgcgggtcgtgcaacgcgtcgggtattcgctgatcggcccggcccagcggctcttcgagcacctcgacgccaagccagggacctacacggacaaggacatctcgccgtacttctggcacaacggcaagtaccccgagacgccggagtaccgcgcgctcttcgacaaccacttcgccgattaccggctacgaattcacgggctcgtcgagaatccggtcgagctgagcctcgacgagctgcgcgccatgccgcgccacgagcagatcacgcagcacttctgcatccagggctggtccggtgtcgccaagtggggcggcgtctcgatgcagaccctcctcgagctggtcaggccgaagcccgacgcgaaatgggtcgtgttctactcgctcggcgacggttccgacggcggccgctactacgacgcgcatcccatcgcgcagatgcactatcagctcacgatgctcgcctatgacatgaacggcgagccgctttcttacggccacggggcgccgcttcgcctgcgcaacgaggtccagctcggcttcaagcaagtgaagtggattgccggcatcgagttcgtcgctgacttcttcgaagtgggaggcggctacggcggctacgatgaagatcacgagttcttcgggtatcgtcagtcgatctgagtcgggtgcgaaggaatgggcgcgctcctcgatggtttgctccccccattttcggacccgttgaagcgtgagagcgtcctcgcggcgaggaggccggtcggtcgtgaggaagagcaggtttaccgaggagcagatggtccgcattctgcgagaggcggagaacctacagttgtagtttgagtctggtgccgcgtccccggtcgtggcattgcctggcgacggcttgggagtgacgtcgccagtgactccagtggaggagggaggcgactgatgggagcgtgcgtcgccagagtgccagcaacaggcgtcgaatctcctggacggagaagcggacgagggttgtcagtgagcaggctccttgaatgagacacgcaaggacgaggccgatgcatcggctgtgcatgggcactccccatgaatgtggactcctgaagcgccacacacgggacctgtcagtattaaaaagagtcatgtctccggatgattcagtgagtcaagtcaggagttcgactggcgatgtgcgctgcatgaactgacttgtgccttctcgacacaccgggatgcctttagtacgcgtgtccgggtgcgttcttcgaatctctccacgccccgtctccacctgtcctggtggcccctggtgctcatcgcttcaggtgcatggctgctgcgcatcgcgggcttcttccaccggggaggcgctttcgggcatgccgtggactacgacgagggcgtctatttcagtgccgccgcacttctttcccatggtgtattgccctaccgtgactacttcttcgtccaccctcctgggattgccatgttgctggcgccggtggccgcgctcgcacgtggcttcgacgcagcgctggcattcgcagtggtccgttggctcgtccccgggatcggggcactgagcacgctcctgtgcggacgcattgctcaggagcaatggggagtcagggcaggcgtcgtggccgcgctcgcctatgccgtcttcccagaagcggccgccaccgagcgtgggcccttcctggagccactgctcaacctcgcctgtcttggcatggcatgggtttggctgcggcatggggctgatgtctcacggtggaagggggatctgctggccggagcccttcttgccaccgcgtgcgccatcaaactgacagccggcgcttgggtcatcgccgcggtgtgggctcgcggcatggagggccagggacggcgtgccctacgggtcgtgcttgtcgcggcagccgtggggctggtctggctgggccccttcttcgcgctcgcccccgccgcgatgctcgatggccttcttcggttccagttgctccgccctcccgatggcgagtcagatgtctggcgccggcttctcatggttctgggagacgggcgcatgggcttctccgtcctctgtgtatggggcttggtcgtggccctggcccgaactcgtcgaagggaggccgtcgccgagcgactcttcgcggccgcctgggttctgacgctcgtgaccttcttgtcgtcgaagagctattgggcccagtacaacgccaacctggcgcctaccatggcggtcctcgcggggttgggggcctccgtcgtgttgagctgggcggacacgcgctcgcgcacgcaagccgcgctcgtcaccgccacggtgatgctcatcgcactctcaccgctgccggcggctatccgctctgcgaatcagcgagaccgtttcctgctcacgctcgggagctcactccgggcctccgtccccccggattcagccctttgcaccttcgaaccggcgtgggcaatcgccgccgggcggcttcccggaatcccagaggggactcccatcctcgtcgacccctatggcctcatgctgaatgatgcactgggcacccccgggcgcttcgctcacgcaggagccgctttcgaggatgagcgctcgcagcggacgatgctccccatgcttgcgcgctgtgacatcctggtccttgagggacgtggcgaatggcagctgtcctccgccagcgagcgctgggtccatgagcacttcgtgcgagaagggctcttctggcggcgtgcttctgagtgaagtctcggaagctggagggggcgagcgactctggagcaccgggactgtccactgcgcgtgcaaggctggccacggcgcgagggactccaggctgcgtggtctgggtccccgtgccgttgtagttgtcgaaccggccagagacgttggagcggaagatgcgattcttcacgcgcaggccgctcgggaacttcagctctcgaaatatcgtgccgaatgggatggaagtaaaaagaagaaaagancggagtggttcggcccccgccccctggaacgagtggtgaccccggctcagtgaaggaggcttcccgccgggggctccgtggccaccatgctcaccggctcccagggggcgaatgcattccgtgtctggcggagcgcgggggcgagtcccgggtagtggcgcagcagcacgctggccatggtgttctcgttgagccacgccatcccgggctgagtgtagaggttgacgttctggtcgttggtgaagaagcggtcgctcgccagccggcgcgaggccatgaggatgaagacgcggaaggccgtgtcgctgaagccaaaacccctgggcgggtcttcggcgagcatgcccaccatcaggtccacgcggtccacgtggccatagacctcacgcagctcccgggcccactgctcgttacgggtgatgtccttgaaggagcgggccggctggaggtgcatcagcttgcggaaggcgttgtagcgaggcacgccgcgctcccggtcgcgcatcacgtcgatggatgccaggtccacgcgggactcggcgccgtccggatcctgccggtggaggtcgcgcaggaaggcggggtagttgtgcagcacgagcgcgccggggtggctgataccgaaggagtagcagaggtccaccatggtgagcccgtcttcgagggctttcagcgtgttggggccggcgaggtccaccatcgccacctcgcgcacctggacgccatcccgcatccggtgcagtcgcatcgtgtcgggtatcagcgagtgcatgcggtagacggccacgaactcctcggtcagcgcgaaggggacgccgtggtggttcacctcgctcccggggatgccgctgatgagctcgctgcggctcatcctcccgaacagccgggtcacccgttggccgaccaggccccaccagttggtgttgagggcggtctcagtcgtgggatgcgcgaggatcgccggcgtccactcaatggtgtggattttcgccatcaacgccgtgttgatgaggcgggccgtgtggaagagccggtcgccattccagtcgggaaactccagccgcagccggtccacgatggcgttgtgctccttggcgaacgtcgtatgcagcaggctcaggccaatccaccagttgtgcgtcaccccggacttctgcaggtgggtattggggtctaccgggagctgcgcctccagcccttcgccggtgaggatgagcttgcctcgacgctggccgccgtcctcatcgtccgtgcagcgcagggcgcgcgtctcctcctcgttgcttccataaatctgtgaggcatcccaccattgtgagtgctggttgatgtacgtgggcgggccgtccttggcaccggggatgcgggtggggtcctcgggcgtgcggcggattcgcatggggtcctcggaccaggagtcgccgcgctccttgtccagggggaccttgaactcgccgccacgcttgggcgagccatggtcgaaccagtcgtgggtcatgaattgaatccacgctgcggccagcagattgagcgaggtggccggaacgaacgactggcgcgcgagcagccggttgctgatgacgcgggggctcggctccagcagcgccggctcgggctcgggccaggcgttctcaagcgggacgttacggccgaacctcgttcccgcggcgcccatccggggaattcg

SEQ ID NO: 951 - DNA, 9367 bp, Myxococcus xanthus
gggggcccccggaacggccaccccgaaaataaaggactcggggaaaaccaaggccttgttgatgccgaccagcaccggttcgccaacggcggaacgcttgccttccgacatgaccttctcgttctcctcctcgaacacccacttctcgacctgctcgtcgaccaggaagttggtgtcgcccacatcggtgacgcgcacgcggcggagcatctgccgcacgatggtctcgatgtgcttgtcgttgatcttcacgccctgcagtcggtagacctcctgcacttcgtccaccaggtagcgcgcgagctccttctcgccgagcaccttgaggatgtcgtgcgggttggccgagccgtccatcatcgcctcgccggacttcacgcggtcgccggagtggacgctgatgttcttgcccttggagatcaggtactccttggccaggtccgtgcgctgctcgccgttcacctcgggggtgatgatgagcttgcgcttgcccttggtgtccttgccgaacgacaccacgccgtcgatctccgcgatcgccgccgcgtccttcggcttgcgcgcctcgaagagctcggccacgcgaggcagaccgcccgtgatgtccttggtcttcgtcgtctcgcgcggcaccttggcgatgacctcgcccgggtggatctcatcgccgtcgttgacggtgatgatggagccctgcggcaggaagtagctcgccgggttgcgggagctgggcaggtccatcatgttgccgttggcatcgcggatggtgacgcgcggacgcgcctccgggtccttggactcgatgaccgtcttacgcgacagaccggtcacctcgtccagcgcctcggacatcgtcacgccttcgatgatgtcctcgtagcgcacgacaccgccgacctcggtcagcagcggaatcgcgaacgggtcccactccgccatgaggacgcccggctcgatgcgctggccttccttcacgaggatgcgggcaccgtagatgacctggtaacgctcgcgctcgcggcccgagtcgtccacgacgacgatttcgccgttgcggttcatggccaccagcgtgccgtccgtcttctgcacggtgacgaggcccgcgaacttcacgctacccgcgtagcggttctccaggctggactgctccgcgcgccgcgtcgccgcaccaccgatgtggaaggtgcgcatcgtgagctgggtacccggctcaccgatggactgcgccgcgatgacgccgaccgcctcacccacggacaccttgcggccgcgggccaggtcacggccgtagcactccacgcagatgccgcgcttggcctggcaggtgagcaccgagcggatcttcaccttgtccatgccgctgttctcgatgcggcggacgcggtcctcgtcgatctcctcgttcgcgcgcaccagcacctcgcccgtcacggggtcgaggatgtcatccagggccacgcggcccaggatgcgctcgccgagcggctcgatgatctcgccgccctccaccagggcgccgatgaacaggccgtccatggtgccgcagtcgtactcgttgatgatggcgtcctgcgccacgtccacgagacggcgggtgaggtaaccggagttggccgtcttgagcgccgtgtccgccagacccttacgggcaccgtgcgtggagatgaagtactgcagcacggagaggccttcacggaagttggccgtgatgggcgtctcgatgatttcgccggagggcttcgccatcaggccacgcatacccgccagctgacggatctgctgggcgctaccacgcgcgcccgagtcggccatgatgtagatggggttgaaggacggctgcttgcgcgtctcacgcttgccgtcgcggtccccggtggtctcctcctgggagatctgctgcatcatctcctgggcgaccttctcggtgatctccgcccagatatcgatgaccttgttgtagcgctcgccgtcggtgatgaggccctcaaggtactggttctcgatctccgacacttccttgcgcgcgaagtccaggaactcctgcttcttcgcagggatgatcatgtccttgagcgcgatggagataccggcgcgggtggcgttgtagtagccgaggctgcgcacgcggtccgcgagcagcaccgtctccttctcacccgtgaggcggtagcagaggtcgatgaggccgccgagcgacttcttgtcgagcaccttgttgatggcgtcgaagcccaccgcgcgcgggacgacctcccacaggaggacgcggccgacggtggtctccttgcgcttgccgtcgatgcggcagacgaccttcgcctggaggtgcacctcgccgtggtcgtacgcggcacgcacctcgtcgggcgaggcgaacacgcggccctcgccgccggcgaactcgcgggcgcgggtcatgtagtagatgccgagcaccatgtcctgcgtcgggacgatgatgggcttgccgttcgcggggctgaggatgttgttcgtcgacatcatcagcacgcgggcctccatctgagcctcgatggagagcggcacgtgcacggccatctggtcgccgtcgaagtcggcgttgaaggcggcgcacaccagcgggtgaagctggatggccttgccttcaatcagcacgggctcgaaggcctgcatgcccagacggtgcagcgtgggagcgcggttgaggagcaccgggtgctcgcggatgacgtcctcgaggatgtcccagacctcgggacgctccttctccaccatcttcttcgcggacttgatggtggtgacgtaacccttctcttcgagcttgttgtagatgaacggcttgaagagctcgagcgccatgatcttcggcaggccgcactggtgcagacgcagctcggggcccaccacgatgacggagcggcccgagtagtccacgcgcttgccgagcaggttctggcggaaccggccctgcttgcccttgagcatgtcggacagcgacttcagcgggcgcttgttggggcccgtgatggtcttcccgcggcggccgttgtcgaacagcgcgtccacggcctcctgcagcatccgcttctcgttgcggatgatgatgtccggagcgttcagctcctggaggcgcttcagacggttgttgcggttgatgacgcggcggtacaggtcgttcaggtcggaggtcgcgaagcggccaccatccaggggaacgagcgggcgcaggtccggcggaatcaccggaatcacgtccagcatcatccactccggcttgttgccggagacgcggaacgcctcggccaccttcaggcgcttggcgtacttcttccgcttcgcctcgctggtggtctcgcgcatgtccttgcgcagctcttcggacagcttctccacgtccagcgacttgagcatctcgcggacggcctcgccgcccatgcccgtggtgaaggagtcctcaccgtgctcctggtagagccggtgcatcttgtcctcgctgatgagctcgcccttctgcagcggcgtcgccttcggatcgaggacgatgtagctctcgcagtagaggaccttctccagctccttcagcgtgatgtcgagcaggttgccgatgcggctcggcagcgacttgaggaaccagatgtgggccaccggcgtggccagggtgatgtggcccaggcgctcacggcgcaccttggactggatgacctccacgccgcacttctcgcacaccacgccgcggtgcttcatgcgcttgtacttgccgcagttgcactcgtagtccttcaccggcccgaagatgcgggcgcagaagagcccgtcccgctccggcttgaacgtgcggtagttgatcgtctccggcttcttcacctcgccatgggaccactggcgaatcttgtcgggcgacgccagggcgatgcggatggcgttgaacgacagcgggtccttcggcttctcgaagaagttgaaaatgtccttcacgttgcctccgaaatctcgttgggcgcccccacatccaaggggggccgccagctgattcgggcccccgccccgttccggccgcgcccgcccctatcgggacggcgggcggccggtcaggcgggcgctccgtgcaatcaggcctcagttcccgtcttgcgctcctcgccgtcaccaccgccgaggaagtcgcctccgaagctgcgctgccgctccggcggggcgctctccagcagctccacgtcgagcgcgagcgactggagttccttgaggagcacgttgaacgactcgggcaggccgctctccaggacgttgtcgcccttgacgatggcctcgtacatgcgcgtgcggcccaccacgtcgtccgacttgacggtgaggaactcctgcagcgtgtacgccgcgccgtaggcctccatcgcccagacttccatctcgcccagtcgctgaccgccgaactgcgccttgccgcccagcggctgctgcgtgacgagcgagtagggcccgatggagcgggcgtggatcttctcgtccaccaggtggtgcagcttcagcatgtacatgacgcccacggtgacgttctggtcgaacggctcaccggtgcgcccgtcgaagagcaccatctggcccgagcggggcagctgcccctcgtccagcagggcgtggatctccgtctcctgtgcgccgtcgaagacgggcgtggcgacgtggatgccccgcttggagcggaggcacagctgcttgatctcctcgtcgtcgagcttgtcgaggaactcgccgaacgccgggtcgctgtagatgaccttgaggcgctccttgatggcgtccgagctccagttggcctcgacgtagcgctgcagcgcttcgccagtgcccttggcggcccagcccaggtgcgtctcgaggatctgcccgatgttcatgcgcgagggcacgcccagcgggttgaggacgatgtccaccggacgcccgtcctccaggtacggcatgtcctcctcggggaggatgcgggacacgacgcccttgtttccgtggcggccggccatcttgtcgcccacggccagcttgcgcttgatggcgacgtacaccttcaccatcttgatgacgcccggcggcagctcgtcgcccttcttgatgcgggcgatcttctcgccgaaggccagcttcacggcctccttcgtctcctccaggttgcggaggatgtcgcgcaggcgcgagtccagcgggtcgccgacggagatctcaccccagtacttgtagggcaccgtggacagcagctcgtcgtcgaggatgtcccccttcttcaggaggatcttccccttgtcatccacgagcttgccctggacctccttggtgcgcaccaggccgcggatgcggccgaacgcgctgtcctggaggaccttgatctcgtcgttctggtccttgaggagcttcgcctcctccatggactcgatctgcttggcgcgctcgtccttctccacgcccttgcggctgaacaccttggcgttgatgacggtgcccaccacgcccggagggacgcgcagcgagctgtcacgcacgtcgccggccttctcgccgaagatggcgcgcagcagcttctcttcgggagacagctgcgtctcgcccttcggggtgatcttgcccaccagcacgtcgccgggcttcacctcggcgccgatgcggatgatgccgctctcgtcgaggtccttgagggcctcctcacccacgttcgggatgtcgcgggtgatctcctccttgcccagcttggtgtcgcgcgcgatgcactcgaactcctcgatgtggatcgacgtgaagacgtcgtccttgaggatgcgctcgctgatgaggatggagtcctcgaagttgtagccctgccacggcatgaacgcgacgaccacgttctggcccagcgccagctcgcccgtctcggtggccggaccgtcggcgatgacgtcacccttcatcacccggtcgcccttgctgatgatgggcttctggttgaggcaggtgttctggttggagcgctggtacttgagcaggttgtagatgtcgacctcgctcgtgacatcgctcagcgaggccggcacgtccgccttcaccacgatgcggccggcgtccacgctctccacgatgccgtcgcgccgggccacgcaggtgacgccggagtcgcgggcgacgatggactcgatgcccgtgcccaccagcggcgccgcggtgcgcagcagcggaacggcctggcgctgcatgttggagcccatgagcgcgcggttggcgtcgtcgttctccaggaacgggatgagcgacgcggccaccgacacgagctgcttcggggacacgtccatcaggtccacgtcctcggcgcgagcctggacgaactcaccaccccggcggctggacaccagcgcgttggcgaacttgcccttcttgtccgtctccgcgttcgcctgggcgatcgtgtgcttctcctcctcgagagcggagtagaaagccacgtcgttcgtcaccacgcccgcctcgaccttgcggtacggcgtctcgacgaagccgaactcattgacgcgcgcgtaggtggacagcgacgcgatgaggccgatgttcggaccttccggcgtctcgatggggcagatgcggccgtagtgcgtcgggtgcacgtcgcgcacctcgaagcccgcgcgctcgcgggtgaggccaccgggcccgagcgccgacaggcgccgcttgtgggtgacttcggacagggggttcgtctggtccatgaactgcgacagctggctggacccgaagaactccttgatgaccgccgtgacgggcttggcgttgatgagatcgtgcggcatgagcgtctcgatctcctggaggctcatgcgctccttgatcgcccgctccatgcgcaccaggccgatgcggtactggttctccagcagctcgcccaccgcgcggacgcggcggttgcccaggtggtcgatgtcgtcgatggtccccttgccgttcttcagatcgatcaggtagcggatcacctcgaggatgtcccgcttggtgaggatctgcccgtcgagcggctcctcgaggccgaacttgaagttcagcttgaggcggccgaccttggagaggtcgtagcgctccgggttgaagaacaggttggtgaacaggttgatggccgtctccggcgtcggcggatcgccagggcgcaggcggcggtagatctccatgatggactgctcgggggtctcgagcttgtccagcatcaacgtctcacgcaggtacgggcccacgttgaggttgtcgatgaagaggaccttgaactccttgatgccgtgcttgaggagctcgtcgaccttctcctgggtgacttcctcgttgcactcgaggagcaccacgccgttggtctcttcgaccacgtcgtaggcggacaccttggtgaagagctcgtccgcatcgatcgggagcgtcttcatcttcgccgcttcgagcttcttgatggcggcgcgggtgaacttgcggttcttcttgacgatcagctcgcccgtcttggccttgatgtcgcgggtcgcgcgctgaccgggcagcagctcgagctcgacgctcttctcgaactcctccgcgctgtggaggtagatcgtctccgtcgcgtagtagtagttgaggatctcctcggtggagcccttgaactccagcgggttcttcttcgcggtgtccgggacggcgccgagcgcgcggatgagcaccgtggccggcagcttgcggcggcggtcgatgcgcacgtacagcaggtccttgtggtcgaactcgaagtcgatccacgaaccgcggtagggaatgatgcgggcgttgtagagcagcttgccagacgagtggctcttgcccttgtcatggtcgaagaaggcgcccgggcttcggtgcagctggctgacgacgacgcgctcggtaccgttgatgatgaaggtgccgttctgggtcatcagcgggatttcgccgaagtagacctcctgctccttcacgtcgcggatggactgggcgccggtctcctcgtccttgtcccacacgaccaggcgcaccaccaccttgatgggcgccgaatacgtcatgccacgctggtggcactcatctacgtcgtacttcgggcgctccaggtggtagctcacgaactccagcgaggaggtctcgttgaagtcgcggatagggaacaccgacttgaagacgccctgaagaccgaggtcctcgcgcttgtcggcggcaatgtccgcctggaggaacttctcgtaggactgcttctggatgttgataagattgggaatgtcgatgatcttcgcgatcttcgcgaaggtcttccgcacgcggaaattgttctggatctgcgtcggcattctggctccggggacgactgctcgggcgggcaaacttcagtaacgcgcggcggcgccgggaaatttgcaacggtcaaatgggcaaagccggcgcccccactcagggagcgccggcctgcacatccggtcaggaggctgcccgaaatttcccggaaaaccggacaacccctgtagaaactacttgatgtcgacggtcgcaccagccgcggtgagctggtccttgatcttcttggcgtcgtccttgttgacgccttccttgacgttcttcggagcgccctcgaccaggtccttggcctccttcaggcccaggccggtgatcgcgcgaatctccttgatgacgttgatcttgttggcgccggcgttggccagcaccaccgtgaactccgtcttctcctcgacaggagcggcggcggcggccgggcccgcggcaacggccacggcggcggcggagacgccccacttgctctcgagctgcttcacgagctcggccgcctcaaggacggtcagggaggagagctggtcaacaatcgcgttcaggtcagccattgaaatgtgtccttctggtttcgactaacggccaactccccctttggagagttccggccggagaggttgcggtagaaaaacttctcgaacagatgagggcttctcagccctgcgccttgtccgcgttggcctggacgactcgggcgagctgcgaacccggagccgcgatggtccgaaccagcttgctcgcgggctcgctgatgacgcccagcaactgcgcgcgaagctcgggcagacccggcagcttcgccagggccttcacgccggcgacgtcgaccttgcggccttcgacgacggcggtgcggatcttgatcttgtcctcgatgtccttcgcgaactcgaccaggatcttcgcgggagccaccacgtcgccgtagctgatgcacagggccacggggcccgtgaagtcatcagcgatgaaaaacacggacgtgccctgcgcggcacggcgcgccagcgtgttcttgatgaccttgtactcgacgttgccctctgagagc

SEQ ID NO: 952 - DNA, 9992 bp, Myxococcus xanthus
gtgctctcaagactgtgacactactgcgttgaccgccgaattccatattttcgcactgactcgctcgaagtaccttccgcaccagtgtgcgggcttctttgcgaggggcgcggcttctatcaccgccgcgtttcctgtcaaccactggagcgcctcactcctgcccactcccctaccacccacccgttggcctactgcacctttcggtcgaccgcacatcgagcttttcaaacgctccggacctggcgagcatccccattcacgagaaactcggaccaggtccgcggtcttatctgaacgccattcagagaaccaaaacacccacgcgcctgattccgctcccgatggagacgggacatgtgagtaaccgccacccgacggacgcctgtgtgacgcccgcgcaacgcggcgaggtgtggccgcttatccaccaagagatcggactgcgcaagaagtttgattctgagcacttgcgccgcggtggtcagccgccgattcccaggcccagcttcgacacgtccacacgttcgcgccggcaacgttcggccaccaccaccgagcgcaggtcactgaaagcacgctcgaagtcgtcattcacgaccacgtagtcgtaggaagcgataccccgctcgatctcagagcgagccgccagcatccggcgccggatggtctcgtcggagtccgtctgacgatccctcaggcggcgctccaactcttccatggacggtggcagcacgaagatggtcactgcatccgggtgcttgcgcttgatggcctgcccgccctgcacgtcgatgtcgaagatggcagcgctcttgcgggcgcgcgcctcatccaccaccgactgggggcttccatagaagtggccatagacctctgcccactccacgaactcgccgcgctcgatcttcgactggaaggtcgcgacgtcgacgaagttgtaatccaccccctcgcgctccttcccccgaggccttcgggtggtgacgctgatggagaacaccgcatccggcgtctccttgaggagccggtgcgcgagggtggtcttccccgccccggaaggagcggagagcacgagcaacaagccaggcgggagcacggtattcgcgttcattcgacgttctgcacctgttcgcggatgcgctcgacctcggccttcatcgccaccacgcgcacggaaatctcggcgtgctggctcttggagccggtcgtgttcacctcgcggtgcatctcctgcacgaggaaatccattcggcggccagcgggctcgttgctggccatgagggcccggaactgctcaaggtggctcgccaggcgggtgacctcctcggcgatatccgtgcgctcggcgaagagcgccacttcctgggccagccgctgcgggtccaccgcgacgccgctcgcgagctcggcaatccggtcggtgagccgctgctggtactcctgcacggccttcggagcgagctgagccacctccttgctccacccttccagcagcttcacccgggcatccaggtcggcgtagatggcttcgccttcgacctggcgcatcttctccagcgccgtgagcgcctggtccagcgccgcctggagcgcctgggaggcggagtccagctccacgcccttctcttccagacgcaccacgccgggctggttcgccacctgcgaccaggcgacatctcccggcaggcccagctcgctggccagctctcggaacgcgcgcacgtactcccgcgccaatccgaggtccacggtggggaccgtccccgacgcggtgggggcctgccgcttcaccagcagttccaccgagccacgggcgagccggtccttcacctgcttggacaccagcggttcctgggacgacagctcccggggaagacgaaccttcacttcacagaacttgtggttgagcgagcgcagctccacggagacttcttcgtcccccacgcgcgcgcggcccgcgccaaaccccgtcatgctcttcaacattgggcggttgctaggggctttcgaggccgaggtcaagccgcgcgcttgcgccgcccccagttctgtgtagggtcccgccgcgagatgtcctggcacaagcggctcgaattatgggcgaagctgacactggcgctcgtggcgtccgccctgctgtggcgcccgggccgccggcggcgtcctggcaccccacttcctggtcctcgcaaggtgctgctcgtgcggcccgacaaccgcgtgggcgaggcgctcctcaccacgccgttgatgcgcaccctcaaggcgcacctccagtccgcgcccgaggtccacgtcctggtgcacgcgaaggtcgctcgagtcctgaacggccacccggacgcggacgtcatcattcccttcgaccggcgcagaatctggatgggcccccttgcccccggcatcgccgcgctgcgacgtgcccggtatgacgtcgtggtcgactgcgccaactgggagtcgccctccgtcacgagcgcgctcgtgtcccggctcgcgggtcccgaggccgtcgtcatcggtccagacctctggccggtgtcccgtctgcactccctgcccgtccccgctcgcacggacacgcggaacgaagccgttcaacgcacgcacctgctgaccccgctcacgaacggcgcagtggcgcgtgttttgtccttccgcgagccctccgtgggcccggccatccgcgcctatctggacgccctggccgggaagcccttcgcggtcatcaaccccggtggtcggttgggacctcggcggattccacccgcggccttcgccgccgcggctcgggcactggtggcgctggggcgtacccccatcgtcacctggggccccggcgaagaagcgttggcacgaggggtggtggaggcagcccctggctccgagctcgcgcctgctagcaacctggacgaactggctgccctgatgcgcgcagccggcttcaccctctgcaacaacacggggcccatgcacctgtccgtcgcggtgggtgctcccacgctggccttcttcctgcggatggacatggagcgctggggccatgcgtacgccccccaccgcatggtggacctcacccctctggttgatggtgcgggcggtcagggcttggaggagcgggccgccgaagaggtccggacgttcgcagcgagcctcccctcctgaggcttcatgtcccggacacgggaggctccgccaccgcgtgttcgggggccagcctggggattccctcttccacgggccaactcagacggcacggcgcgcaggtgacccgggtttgagcctcctgcgcctgaaggggggccttgcagtgagggcagcccaggacggcccacacctcctctgcaatgaaggccaccggctaccccgacccctcgcggcccaggcgccgggccaggtccgtggtgctgtggtccttcgggtctcctgagacggctgtccgcccaccataggcgcgaacttcgtcggcctcggggatgctgtccggggtgtagtctgtgcccttcacgtgcacgtccggcttcaacgcccggatgatgacgcgaacgttggactcgtcgaagacgatgacccggtccgtgcaggccagcgccgcgacgagctccgcccgctcgccctcggggatgtagggccggccggggcccttgtaggcccgggtggaagcgtccgagttcaccgccaccacgaggacatccgccagggcccgcgccccttccaggtaccggacgtgcccgacgtgcagcaggtcgaagacgccattggccagcgccaccgtgcgcccttcggcccgccagcgctcacgctcctccgccaccttcgcgagcgattggattttctcgagggtgctcatctcgcgctccgaagctcttcgagcagttcatcgcgggacaccgtcgcggtgcccggcttctgcaccaccaacgagcccgccacgttcgccagccgcgccgcatcgccgagcgaggccttcgcggccagcgccagggcaaacgtcgcaatcaccgtgtctcccgcgcccgtcacatccaccgccgccttcgcgccatggacggggatgaggtccacgcccccgtccgcatcgaagagcgccatgccatggcggcctcgcgtcaccaggagcgcgcggcactccagtcgcttcaacgcggcgtgccccgcctccagcatgtcctcctgggtccgcacgggccgccccgcgagcgcctccagctccggctcgttgggcttgcagaccgtgagtcccgagaaggatgacagggcatagcggctgtccacacacacgggcatgccgtccgcggccaggcgacgcagcacatcgcgcacctcgtcccccagcacacccgcgccgtagtcggacaccaccaccgcgtccgcgtcctgggcagaggcttcgacctgccgcgccagcgccttgcgcatcttcggggggagcgcgcctcgctggcctcggtccagccgcaacatctgctgccgcgtggtgctcaccccaccggccaggatgcgcgtcttcgtctccgtctcgatgtcgcgaccgctcaccgcgtccagttggatgccggattcggcacagaggcggcgcaactccttgcccatctcgtcctggcccagcgcgccgacggcggagacctgaccggacagggctcgcacgttggccgccacgttggcgccacctccgagcttcacctccgcggactcgtagcggacgatgagcacgggcgcctcccggctcacccggtccgtctgtccatagatgtagtggtcggcaacgaggtcgcccaccagcaacaccttgcggcgggcaaacgcgtgcggcaagcgggcgagcgacggcatcgaacgaacgggcgagactgcggccatggcggcggtttgtcccacagccgcccccacctcacaagccgcgcggagcatcctccagtccgagcgcccgccgcagatgggactcgccttccagaacctcgacccccaggcggaccacccaggcctcgaagccctggggtagacgcaccgcgtccttttccgtcgtcaccacccgggcccccagccgcaccgctcgcgcctggacgtcgcgcagttcgtccgcggtgaagcgatggtggtccggaaacaacgcggcatcgcgcacgtccgtcccgagcgactgcagggtcttcaggaagccccccggccgggcaaggcccgccagagcgaacacgggctgtcccgtgagcgccgtcacgggatgaaggttgccctccgggtccacccaggccgtgggccgatagcgagtcctcaccctgggaatccccgggctcgagggcaaccacccgccgagcgtgtcagagaaacgctccgaccgcgcctctgtcggcaccaggaggtgcgtggtggattggggcgtgcgcgtgtcctcgggcctcatgacggggagcacagcagcatccgaagccgtggcgggtgccctgagccagaaaagcgtcgcgcggcggagtgacgccgggggctcacgcagcggccccctgggaagcatgtggccgttgcccagccccaccgactcatccacgaccacgaagtcctcgtctcgcgcgaggcggcgatgctggaacccatcgtccagcagcaccgtgtccaggctgaaatcgtcccgcgcacggtaggcactcgcgactcggtccgagccgacgaagagccggacctggggacagcgacgcgccagcaggagcggctcatcacccgcgaggtccgaggaaggaagcggctccgtcccgatgaaggtcagcggctcacgcgaggcgcggccataaccgcgcgtcaggatgcccaccttccggcccgcttggaccaactgctccgccagatggagcaccgcgggcgtcttgcccgtaccccccacgttgacgttgcccacggagatgaccttgagcccctccacccgctccgcgcgcagcagtcccgcgtcgaagagcgctccccgtacatgcaccgcggccgcgtacgtccacgacagcaacgtgagcggcgacagcagggcgcggcggccccagggctccggcgacggcgggtagaacacccgctcgatggcggtgggggcatccggggacgtcacggggtgcgcctcgctcgcgcgtagagcgcgaggacctccgcggcaatctgctcgttcgtcgggtgccgcacgggcgcccgctggtcggacagcgccgcggcgaccacggcgtccggcgtcggtctctccacccgcacatccgtcaggtccggcaaggcgccttcatccaccgccaccacgcggacgccgcacgcacgggcctgggccgccgcgcgggcgctccagtcattgcccaggccgagcagccagacctcatccagcgctcgcagccaccgcgcgaaggcgtccccctgttggtagcccgcgaacgtcacggcatccgccagtcccaggtcctggacctgtttgcgcgtctgctccagcaggccgccgtcccccacgagcaccaagcgcgcctcgggccgctgcttccgatacagggcaaaggcatccacccccaccgcgtgccggcgtgaaggctggaacgtggagaccattccgatgacgggtgtgccttcgagcccgagctctgcgcgcagcgaccgcgcgtccggcgcaggctggaaccgggcgtccaccagggctggcagtacctgggccgtcgcgcccttctccaacaggcggggaagcagtgcgctcgcggggaccgtgtaggcgtccgcggccgggagcgaggagcgcaatgagcgcggagcgtgcagcgagcgaaccaggacggcgcctgaaggccgtccccacctcgccagcaggtggtcatgactgaagtgcgagtggaccacgtccaccgtccgcgccttcaagcggcgcaggtcgcgccacatccgccacggtggggacttcacggacagctccaagcccccttcgtccagaagaccgagctcctcgaagcgcggagccgcgggctcctcggccagcacctccttgcgccggcggtccaccgccaccgtgacgtcgtgtcccgcggcgcgctgcgcctgggccaggagcgccacgttctcggccgggccgctgtagaagggactcgcgagcaggtggaggattcgcatccggtcagcgctccacggtggcccggtacacgtcggccagggctcgcgcctcgtgctccacgccacaccgacgccgggcctcctcagccgcgttctggccaatctgcctggcgcgctcgggctctcgcatcagcatgtccagcagctcgcgcaggccctggacatctccgggttcgaagaagaagcccgtgcggccgtgctcgatgagcgtgtccaggtacggcagcttcgaggccaccacgcagcagcccgaggccatggcctccacgtgcaccagcgaatagccctccgcatacgagggatgcaccaggatgctcagcccctgataccagggctcgatgacggactgctcgccgggcaacgcgatgcggtcctcgatgcccgccatctgctgattcagccaatccaggtccggccccttcgcgagcccgaccagcacgggttgccagtcggggtgcgcgggcaggagcgggcggatggcctgcacgaagtccccctgccccttctccttccggatgcgtccgatgacgccgatgccgtaacgcccacccaggccgagcttgcgccacgccgcgtcccggtcctcgggcgggtggaagcgcgtcaggtcgatgccatgcgagacgaccgtggacggcagcgcgatgacgtccgcgacctgcttcgtcaacgagacgagcgcatccgcgcccctcgcgatgaagcgggtgaagccgctgggcgccatcgaggtgtgccgggtgaagacgaggcggacctctcggcccagcagcttcagcagcatgcccaccaggagctcgttgttccggtgcgcatgccacaccacgggctcgcggcgcagccgacggagcaactccggccaggtgattctgggcagcccctcactcaagcccgagccgatgacgcgcgtctccgagcctgaatcccggacgagcgcgggtaccaccgtctccacgtggcgcgtcacgcccgtgtagcggtggtggaaatgcggatggacgatgagtgtcatcgcgggtccggcctcccgtgcggaaacaacgtcgtcatcgcctccgcgttcctttcactggcgcccgaaatacggcccaccgtctccagcgcctgggcacccaggctcgcgagccgctccggtgattcgagcagcgacacgagcgcctgctccaaggccgcggcgtcctgaacctggagcccaccctgccctgtcagcaacgcgacactgtcccggaagttgtccatgtgcggcccgtagagcaccggcttcccctgccccgcgggctccaggatgttctgcccgccgcgcgtcgtgaacgagccgccgacgaacaccaccgtcgccagccggtaggccctcgacagctcgccgatggtgtccagcaccacgacctggccccgctccggattgccctgcgagcgcagccccacgctcagtcccgcctcgcgcgcaagcgtcacgattcgcgccgcccggtccacgtacctgggggcaatcaccaaccgcagctccggccaccgctcgcgcagccgcgcgtacacccccaggagctgggcttcctcgccctcatgggtgcttccggcaatccatacccgctcgcccggcgtcaggcccagcgccgtgcgaaggttctcgtcctcgggcaccgggcccgcggcgagcgcgtcgaacttcgtgttccccgtcaccttcacccagtccggcctggcaccgagctgccgcgcacggacggcttcgtcctcctcgcgcatgaggaggaggtccaaatcccgcagcgggttgccgatgaggcggaacagcgtctggtacttcccgacgttcgcgggcgaaaagcgcccgttcgtcatcaccactcgcgccccaccccgcttcgccgcgcggatgaggttgggccagatttcggtgtactccagcaccagtacgtccggacggatggcccggaccgctcgccgcgtcgcgccccagaggtcatagggcacgtagacgaccccgtcgatgtcgttggccagccggcccttcgccatcgcgtagccgctgtccgtcatggtcgacagcaacaggcggcagcccgggaaacgagcccgcagcgggccgaacatcggcgagagggccagcaggtccccggcgctcgcgccatgcagccagaggacgggcccgtccccgggaggcaggtggctgtgcgggccatagaagcccaagcgctccatcagcccatggcgcgtcttccggtgcagtgcgagcaccgggacacaggactgccaagagcaggtaggtgacgaggacgtagaggacgcgcatgggcggctggtcgcgccgtctatccagatgcccggccccgggggcagcacgcgcacggggctgggcaccagccagggccgccattccgtcccgaagaagcgcccgggtgcccgcacccacacttccacctgcgccacccccggctcggtcagctcgacggaccggccgtccgcccccaggcgggcgcttccccacacccgcacctgcaccgactccgcgtcgggaagccccgggagccggacggtcagcgtgtcgcccacatgcgcttcacgccgcacaccgtccaggccctccaatgcgaagcccccaggctcccccagggcgcggaaggcgcacagggactgaccaccgcccagggcccggctgacctgctccgccgcttccttcgcgtccgggggcaacgggaagggcacctgttccggtggcaggtacatggccagggattcgaatacggcccggtacggcggcaggccgtgtgcgtcatgtgcgcagaacgccacgcgcggccgctcactcgacagctccaggaagcgggccgtgggctccgactccggcgcgacgagcaacatcacgccatgcaccgggt

SEQ ID NO: 953 - DNA, 9521 bp, Myxococcus xanthus
tctcaaggttcccggtagacgttcctcttcgagcccctggtggtgacggacgcgtccggcgcggcgacggtgcctgtgcgcgtgccggaccgcctcacgcagtggcgggtgctggcgctggcgcactcgcgttcgggcgcgcagtccggcgcggtgacgtccttcacgggcacgctgcccacgtacgtggacccggtgctgccggccttcctgcgcgcgggcgacgccgtgcggatgccggtgcaggtgatgaacaccacggacgcggcggtggaggcgcccttgaaggtggaggtgccgggcgcgctggtggagggcggcagccgcaccgtgcgcgttccggcgcgcggcagtgtggtcgagtacgtgacggtgcgggtggccacgccgggacaggtggcggtgcgcgcgacgctgggtgccaccgacgcggtggtgcgggacttccccgtgtggtccacggggcggccggtggtggagacgcgcggtggcacgctggcggcgccgagctcgttgtcgctcaccggggcggtggacgcgcacccgggaagtgagcgcgtccgggtgcgggtgttccccggcgggctgggcgtgttgcgctccgtattgttgaactcgagcgcgcgcgaggacgcggccggcgtgggctattcgctgctgctgacggcccgcgcgccggagctcctgaccgctctgggcgagactcggtccgcggaggcgctgaaggcgctgagcacgcccgggcagcggctgaaggcgcccgtgcccccggagcccggtgaagtggacgtggagtcggtacgagcggggctgatgcgggcgacccagcgcgcgctgcggtggagccgggcgccggacgtggccacggcggcgctgctggcggagggcgcgctggcacatccggacaaccccgtgctggcccgcctgggcgagcggctggccgcgcaggtggcggcggcgcagctcccggacggcacctgccagggcggcaatggctggacgctccagcggttgttggtggccaccgcggactgcacgcgcgcggtgaacgcggcggcggtgacgccggagggcaagcgccgcgcggccttcttcaccgcgcgggcctcgggtgcgctggagcgcaaccgggcgcacgtcaaggatggctacaccgcggcggcgctgctggcgagcggcgcggtgacgggctcgttgcgggactcactgcgcgagcaggtgcgggacgccgtgcagcggcgcgacgagggtgccgcgttcctgcccgtggaggcgggcgtggtggacgccgcgggcggcacgccgacggaggccgaggccaccgcgctggccgtgctggccctggagggcgacgcgaaggcacccgtggcggacctgggcgccgcgttgctcgccagctatgagccggtgaacggctggggcaacgggcgcgccaaccgcctggccttgcaggccgtggtgtccctcttccgcgagccgctgcccgcccaggtgcgggtggtgctggagcgggacggccaggtcatcacggagggcaccttcgacgccaaggccctgcgtgaggtgctgtccctggaggcggcggcgccgggctccggcggagcgcacacctggacggtgcgcgcggagcccgcggtgcccgggttgggcttcgcgctggcgttgagcgccgcggtgccgtggacgcagcaggcacaggccgggttggagttgtccgtgcaggtgccctcggacgcgaaggtagggcagccgtcggaggtgatgctccaggcctccacgccgtcgggcctgccgctggtgattcgccatgggctgcccgcgggcgtgcaggtggacaccgccagcctggaggcgctcgtgcgcgaagggaaggtggcgtcctggcagagtgaggatggcgcggtgacgctgcggcttcctccccgagggccgggcgagcccttccaggcgcgcttccgcgtcatcccgacgctggcgggcacgctccagggaggcgcgtcgtcgctgatggccctgtcgcgccctgacctggtgtcctacgtaccccccgctacgtgggccgtacgctgaggagaagtcgctggcacttcctgccccccgggccactgccccggcgctgcggggcgcgttatgtgtcgactcgtggtgacttcacgggcctccaagaaatgtagtccgcgctcccaactgggcactcacgcaggggatgcacagatttcccagcagcaacacggagtcgcaaccgctcccagggttgtttcgtcgtgggtggcaagcatggagctcgacggcgcggagagggacgagctacagcgggcgctgacgagcgcgtttgcctcggtggagcaccttcgccgggtcgtggccgccacctgccgcagggatttggaagcgctgggcgtctccggtgggctgcgtgagcgcgtcttcgcgctcatccacatggcggaggcggagggctggctgcgcgagctgattcgcggcgtctaccaggccctgccccgacaccctcgcctccaacgcttcgtgcaggtgtacctcgcgtccatccagcgcagcatcccccgtgtcggactggagcgcatcttcggcagcggccgggcggacgccgagcgtgagcactggcgcaagcgcctgacttccatcgagcggcaggtgtgccgcgtggagccggaggtgggcgcggcgctgggcaccggcttcctggtgtctcccagcgtcgtgctcaccaatttccacgtcatcgagaacaggctgctggagtctctacgggtgcgcttcggccgcaaggtcctccaggacgggacactgctacatccggggacggtgtatcgcgtgacgcgctgtctggcgcgcagtccttacagccccgcggacctgatgcacccgcgtccgcgtgatgccacgtcgggcgagctggactacgccttcctcgaggtggcgggtgtccccggcgaggacctggtcgacggggagccccgaggctggctggagccgcccgattcgcgggagtccttcacgcccggcagcctggtgctcatcgtccagcacccggcgggccagccgatgagcgtcgcgctcgatgagttcctgggcgtcaatccgggccgcacacgcgtggcgtaccgcgcgtgcacggggccgggctcctcgggggcaccctgcttcacccaggacctgcggctggccgcgctgcatcacagcggtgggcctcgcgtcccgtccgcgtcggtgggacacaacgagggcatccccatcgacaccatccgcggcagcctgtccgggagcatgttgagccagttggggtgggggtaggggcgcgaagtggaggcatgggggccgcctgatacagtcagtgaatgcgttccgctggcacccgtcccgccgtcacccactccgcgtgggggctcgtgcgtcttccggccctgctcctgttgctcatccttccctggggggccggcgctgagccctcgctgcgcgtggcgggtgcctccgccagcaacgaggtgaagctgcggacagcgtcggaggacttccggcacgtgctgcgcgtggatttgctgagcgcgccggaggtggtcggcgacgtggccgtggccggcggcgtggcgagaggcgtggacggcgagctgcccggcggcgtgacggtgctggtggatccgctccagtcccgggacggcgtgcaggtgccgttgcaggccgtggtgaaggaagcggaggccgggggcgccacggtgcccatctccacgcggcgccccatccacgtcgagctgtccgggcgcctgcccgtcacgggggactacacgggccatgtggtgctggtgcacgcgcaagggcgggagaccaccgcgctcatcgtcacgcgcgtgcaggcggtgcccgcggtgcagttcatcgccacgtcgccagcggtgacgtccgcgggctggggctggggctccatcgacgccaccgtgcggctgccgttcaaggagacggcgggcgtgggcggtgtcgtgtcggtgccccagttgctgcaattgcagcgcaaggcaccggacatggactcggccctcatccagccgcgcttccagagcgtgcgcttcgcgctggagggcgggaagccggatggcggcaacctggatgtcacgtcggtggacggcggcattcccgtgagcgcgcatgggagcggcgcgctgctcttgaacctgcggggcctggaaggtccgggcgagtacaccggcaccgtgcgcctgtccgtgcgctcgggcacgccggtggagcagcccttcaccttgtgggtgagctcgccctggttgtggggcgcgctgctcatcgcggcgggggccgtgtcgtcgttcggcgtgcgcctgtactcgcagcgcatccggccccggacgctgcgcttgcagcgggtcatggagctgcaccgccggctccaggccgtggtgagcgggcagggggctcgggcgcgggaggtagggcaggtgatgctgggccaggtggacgggctcgcgttggagattcgccggccggtgcgaggcatccgcgtgcgcgacggggacctgaccgcgctggagcctcgtctaaggctgtacggcgcgtggtgtgacacgtcacgcaagctggatgcgctcccggccgagctgcgtccggagcaggcgagccagttgctggcggaagtggaaggcgcgctgcgcacggaggacaccgccaccgagcaactggaccgcctcgccgccaaggtgcgggagctggacgtggacggactggcgcgcgccgggctggaggcgcggttgcaggacatcgaccgtcaggcgcggacgctggtggagcagcacggtgaggactcgctgggcttccggctcaagtacgaactgctgtccctgctgtcgaccgtgcgggaggaactggcgcggggcgcgctggacgccgcccggcgccagttggagttcgctcgccgctcgtacttcgacatcctctgcgaggagctgtccgcggccctggcgtcccgcacgccgccgcgaggcttcacggaggaggagtgggaggccctcacccggcaggtgaacacactgctggagagagcccgcgagcgcgcgaacaccagcgtggatgatgccgtccgcatgtaccagggcgcgcatgccgcctatgtgcgccagctcatcgtggagctgcgcggcgcggtggacgaggcgcggcacgtcagtgagtccgaggcgcagacgcaggcgctcgatgaggtggaggcgctcctgcgcgaagccatgggtcttctggtggcggagtcgtcgcacgaggccgcggggaagtacggcgaggcgcgcgtccggtttgtctccgccagccagtcccagcggatggcgaagagcttccacctggagtcgctcgcgtcggacgacggggtcgacggggcgccctccgtgcctcctcccaccgcgcccagcggtggaagcatgcctcgcgctgccggaggcgcccgccggaggggcacccgcgctgggcgacttcgagggcatgccgctgccgtcgccgcgtcacatgtggctggtggagctgggcgtgctggcgctgctcaccacggtggcggtggcgttggggcttcagttgctcaatgtcttctcgcccacgtggggcggtttcggcgcgtgcatgacaggccttcctctggggcttcggcctgcaccaggtgggcaacgcctccttcgagggaatcaccgggttgctgacgcgcgtggagcggccggccacgcctccgccggccacctgagccgcgcgaatcagcgccgccggtcctggatggtcttcgcggtgatgcggtccaccacgcccggggccaccagcttgaggaactgggcgacgcgggccttggtggtcatcaccacctcgcgctcgcggcgctccatggcgcgcaggatgatggccacgcaggtgtccacgtccatgttgcccgcgctctcgtcgtgcttgctctgccgcacgggctggccgtccgcgcccagcgcgctgtcgcggatgttggtggcgacgaagccggggcacaccaccgtcacgtccacaccggtgccgcgcagctcgatgcgcagcgagtcgaagaagccgtgcatggcgtgcttgctggccgcgtagccgctgcggttgggcacgcccgtcttgcccgtgagggacgacacggccaccaccagtccgcgccgcgccttgaggtggggcagggcgtggtgggtgcagtacaccgcgcccaggtagttgatgcgcatcagccggtcgaagagggacaggtccttcacctcgtccacgcgcgcgtccatcgtcacgcccgcgttgttgaccagcacgtcgacgccgccaaaggcctccaccgcccgctccaccaggtggcggcaggcctccgcgtcacctacatcggtgggcactaccaccgcgcgcccgccggccgactcgcaccgggccttcacccgctggagcgcttcctcatttcgcgccgccagcaccaggttggcgccgcgtccggccagcaccaccgccagcgcctcgccaatgcccgccgaggcgcccgtgacgaccaccgtttttcctcgcatggcgcgcattctggcccctcgccgtcagaggggcccggaaaaaatccgaccaccaggtgacacttcaattcgggcccggtgttctggtcgcgccaacgtgcttcgcgaggggaaagacaccatgccgtccatcgccgttttcgcccaggcccacccggagcaactggggtggctcagcagcaagctgctgggggtgacgctcacttccgcggagtgggtgctgtgggtgctggtgtgcctgtcggtgctctccatcgccatcatgctggagcgcacggtgtacttcgcccgtcaccggctgccggactcggaggcgctggcggtgcggctgtcgcgcggtgagctggacgcggtgaaggccgccatccaggggcgtcagggcatggaggccgccatcctgcgtgaagggctggcgtgcgccgaccagggcgcggacacggtggagcaggtgattgcctccaccctgtcgcgtgagcgcccacgctacgagcgcttcctgtcctacctgggcacgctgggcaacaacgcgccgttcatcggtctgttcggcacggtgctgggcatcatcaaggccttcaatgacctggggaagatgaacgcccagggcggcggcggggccatgcagcagaccgtcatggccggcatctccgaagcgctcgtcgccacggccgtgggtctggcggtggcgattccggcggtggtggccttcaacgtcttcagccgtcagctcaagacgctcaccagccgcgccaatgccctgggccacgcgctggtgggcagtcttcgctcggaggcccgttaggccatggcgggcagcgcgcaggacaacgacgacgaaatcaccggcatcaacgtcaccccgctggtggacgtggtgctggtgctgctcatcatcttcatggtgacggccaacttcatcgtccgtgagacggtggaggtggacctgccccgagccgccaacggcggtgagacggtgcagggcctggtcaacgtggtgctggacaaggagggcaagttcttcttcgacggcaccgagatgaccgagaaggagttggaggcgaaggtcgccgaggcggtggccaaggacaaggacacgcgcgccatcatcagcgccgaccagtcgctgccctacggccgcgtcatgcggctcatcgatgtggtgaagggtcagggcatcgcgaagttcgcgctcaacatcgagaaggacgtggcccccgcggctgcgcccgcagcgccctgaagcgaggcatcagcgcatgagtcaggcggtcctcgaaaatagtcccacgacgcccacgcacgaccgctcgctcgccgtggtgggcgcattcctgctcgtgtcgctggggattcacgtcggcggcttctgggcgctgggggagggcgactcgcgctcgcgccccgtgcccaagcgccccgtggagatggtgatggtggaggtggcgaagccgcccccgccgccccccgagccgccgaagccggaggagccgcccaagccgccgcctcccaagcccaaggtggtgaagccgccgccggtgaaggtggccgaggcgcccaagccgctgcctccgccgcccgtggacgcgccgccgccgcccaacgataccccgcccccctccgcgaagcccgcgcccctggtggtgggcctgtcgatgtcctccaccaccagcgccggaggtttcgcggcggccgtgggcaacacgctctacggaaggacgggccccacggcgaaggcgccccaggaggtgaaggcgtacagcgcgccgaagtacgcgcccatctaccaggtggactccgagcccacggtggcctccgaggtgaagattccctacccggaggaagcgcgccgcgcgggcgtggagggcaccgtcacgctctccatcaccatcgaccacgagggcaaggtggtggcggtgaagattctcaaggggcccggctacggcctcaacgaggcggcgagggatgccatccgccgcttccgcttcaagcccgccatcaagggcggcgagcctgtctccacggagatgaaatactcgtacaccttcctgctcgattgatgtcgccactcccgctgggagagcggcggagcccgggcgtgcccggcatgtcaggggtacccatccccacgggcattgccgggattccacctcgccatcgctccgtctctctttcagcgggagcggcaaccccctcacccgtatgcttggacacgccatgtcctccaccctgaaagcccgaggcgcgctcgtcgcggcctcgctcctgctggcggcgcccgtgctcgcgcaggcaccccaggccggcgcgcctcccacggacgcggccacgccacctgcggcgcaggcccagcccaccatcaccaagcctcccgaactggtgcagcaggtggaggcgcagtacccgcccgaggcgctcgcgcaggggctcaccgcgtccgtgcggctcatcatcaccatcgcggatgacggctccgtcgccgaggtgctgcccaccgagccggtgggcaacggcttcgacgaggcggccatcgcggcggtgcgccagttccgcttctcgcccgccgaggtcgacggcgtgcccgcgccggtgcaggtggagtatgtctaccacttcaccctcaccgcgccggagccggaggcgggcgccgaggccgtggaggccgagcagcccaaggccacgctcaccggtcagctcatctcccgcggcagccgttcgcgcgtgcccaacgccaccgtgcgctgcggcgacgacgcggacgcgcccgaggtgatgtccgacgaggacggccgcttcacgctcgaggtgcccgcgggcacctgcgaggtgcgcgtggtggccacgggcttccagctctaccagacgaaggaggagctgaaggcgaacgagacgacggaggtgaacttctacctcgcgccctcgggcggcggcctggagacggtggtgcgctccgaccggccg

SEQ ID NO: 954 - DNA, 8967 bp, Myxococcus xanthus
gggatgtgcgcttcgaatgcgcgctctgcttgcaggacgaggatggcctcctcgcagccgaggagtccacggtcctggcgcgggccgcggaggcgcgtcgggcgttggcgtcgcggggctccgtgcgactgctggagcggatggcgtcgcggggagatgcggacttcgcgctcgacgtgttgcggcggttgcccgcgcaggcgcctccgggggcgctgagtgcgttgctcgccgtgtcggaccgggtggcgggtggactggcggaggcgctgcatggctgggcccgtggccggcctttcgcggagttgccgccggaggaacgagcgttgtgggcggactgggcgctcgcgcggctggcgcggctctccgcggaggatgctcttcgtttcctcgagtgggccgccgccgcgcgggacgcggaccgggtggaggagacgcgcgccttcgtctcagcggtgtccgagtccctggcgcgagagccgccatcgcttcgcgccagccgcttccaggacgcggccttctcccggttcctctcgctcgctgacgaggaggatgcaccccggttgcacacgtggagtcgagaggcgccgtgcacggagccgttgctggaggcggtgctgtcactgtcctcacggctgcggtggggcgatgcgctcgctcccggccagggcgcgcgtttgttgatggcgctctggacgggggagggccgcgaacgcctgctggcgccgctggcgaaggtggtgcgcgcgtggagtggcggcagtcagcatgccgggttcatcgacgccgtgtggcggcgtttccagcagcacccggacgagcgcacagacttgttggccaccttcacgccgtggagggcggaaatctgggaacggcagcaggcggcggagcctgacgcggtggtgtgcttccagacgtggtggccggtggaggacccggagcagctaccggcgcgtgtggatgcgctggtccgtcagtcgccctcggaggacctgtcgcgccgcctcgaaccggtgtggaaggcggcggaggtccgggtggatgcgtggccgcgtgccacctcgctcgcggtgtcatacgcggcggcggtgttgtcggcgaccgtgaggcgggacgtcgacgcgctcgacccggacgcggagcgcttcctggcctggttccccagcttccgggagcgtgtcgtcgccgcgtcacctacgtcgagcgagcggagctactcccgcgacttcctgaaggacatcgaggtcgatgtccggttgattcgggagcacctcgagcgaaagcggcagcgggaggaccaggcgcacgaggcggagcttcggcgcatggtcgaggcgtcccgccagcgggacctggagcgccagcgggagttgatggcgcgtcaggtggaggcgtcaccgcccgcgcatgacgtggaggtcgcgccgctgcacacgccgctggtgctgctgaatccgcgcgggccggtgcagccgctcgacctggaggtgtgcttcccggaggcccggctgcgcacgctgctggactacacgcggctgttgaaggtcatgagcgtgaacaacgacgtgatggcggtgttcgaggcgcacggcctgtcggtggccacctggacgtcggaggccaccgcgtgggggacgctgctggtgcggcgtccggagctggccctgcgcttcggggtgttgttccaggggccatggggctgacggagcggcggcgctcagcgcctcagagtgggccgttgggcgtgaggagcaccttgccggcgcgcccaccttccatggcgcgcgtcagggcctcctggatggactccaaggggaaggttccctctaccgggacgtgcagtgcgccttccgccacctgcttcgcgagccgggcgaacagggcgccctgctcctcgcgcggtgtcttcttcgtccacgtcaccagccagaagccgcgcagggtgatgtccttgaagatggtggcggcggctgacaaccgagggccctttccgctcatcgcgccatagttcaccaccacgccgccgcgcgcgagcgcgtcacccaggcgttgggtggattcaccgccgacggcgtcgatggccagccggaccttggcgccgcccgtcacttcgcgcacgcgctccggcagttcatccgagtccagcagcacggcgtccgcgcccagcgcggtgagctccggcgccagctcttcacgccgcaccacgttcagcgtcttgaagccagcctgcttcgccagggtgatgatggagcggcccaccgccgagttggcggcgttctgtatcacccactcgccgggctgcagcgcgatgaagtcccgcagcaggaggtccgcggtcggaggattgatgaacagcatggcggcctgccgcaggtcggttcccggcggcacccgcaggagcgagtccgcgggagcgaccaagtgggtgcaccaggtgcccgcgcccagcgggaggaatacgatgtcacccaccttcacggcgctggagtcctggacctcgacgacgcggccgacgccttcgttgccgggcacagcggggagcttcgggagctgcccgtactggccgctgagcgtgaggatgtcggagggattgatgggcgtggccagcacttcaacccgggcctcgcccggcttcagcgccacgtccggctgctccacgacttccaccaccttcagtggctgtccgaaggctgagaaccgcactgctttcatgggacgctccatgcttcgtgtgggagtgtggggcgcaccctagcggccttcgaggggcgcgccgagcatccaagcagtcgccgtgccccaccgctttgccttccggggggcgctgcgcaggttcctccagccccgccggccgcccgctaccagatggcgcgggagctggcggcggacctccgccgctggcttggagagggcgatgcctacggccaggaagaagcggcggcggagctgcacgacatggcgaagcgggcccacgaagtgatgcttgagctgtgcatgcggcgcccccgtggtctccaggcgtctgaggaggcggtcagcacgaacgagccatgcgggtgacatcaggaccccaacacctctgcatccaggtgcttcagacagcaggggtgtggggcggtcgcacgagctacaccggcgtgaacttcacaccggtggccttcacacgctccagtgcctgtttgatgtcctcggagacgatgagggccagaggccagccctccgtgcggaataccttggtgtcacctgtcctcttggcgtcgatgcgcaggttgtcgacggcgtaataccggcccaccttctcgggcagcccatcctccggcatccagaactgcacttcggacgctttctcatcgatacaacgcacgagctgcgtgaccacgaagagcaggtactggtccgggtagccctggatatcgacgggaatgagctgcacgtcgtcaggggcaagctccgtgaagacctccgcgaccctgacgtggatgatgggaacgctcagggccgtcagcgtgaaatccagcggcttgcccacatgctggatagggatcttgagatgcccctccacagggaccggacgaccctcattgaagcttctcggatcgtccacctcgcatccatgttggtccagagggtcatccagatgccaacggcctggaacctggacatcctccttcaacctgaagaagcgctgggtcatggcgggcatctagggctgtgcgctcttggtgacaagctggttcaaccgcgttcccgcggtgcgagtttccgcagccagccgtctgagtgctctcgtcagtgcttctctacactcagaaacgttacggcaacggcgggttgcgtcgtacagccgctcgtggatcaggtcgtgatactcctgcggatgaggccctttgtggcccggaatgggcacgatgttctcagggtccttcaactccattcctgctttcctgaaaatcttctcgaacttcggcgtccagggcccgccgcgtgcggtggagacgctgttcttgttcgtcgccaggtggtggtcctcggtgtggccgccgctcataccccgggccgccatggcgaccgcgttgggcgccagtgcgacggtgaatccctcggccgtcatcgccaccgactgcacgcctccaatggccacatactggtagcccgcttgcgtctccaccgcgagcgcagcctgcgctgagcccggcagcctcgaagccttcgccgccagtcccgccgtatggccgatggccgccgtggccagcatgacgaagacgcgcgccgcgttctccccgagcacttcgccgtacgcctcgcccgcttcgctgagctgtacaaaggtggtggctcggtccaccgtgcgcaccagcgccatccatccgtccagaatgcgccacacggtgtccacgcccagataggcaatggccgtagccgtcagcagggctgccaggcccttgctcaccggctcgggcagcgaccagaggagcaggtacatgctgaccgaggcactcaccgtcgccagcagcgcctgcgggtcggccatgtcctccagcgcctcggccgtctcttcccacaccgagtccatggcgatggccatggccagcgagtacttgccgtcgctggccagcagcgggccttcggccagcaggcgcaggcagtcgccgggctgcgacttgcgttcgcaccagcggccataggcgcgcgtcagctcatcatccgcgtaggactcgaggaggcgtgggccgtccgggtccttctcttcctggagaatgagccgggggccgcgaggctggtagaggtacacgccgcttcgctcggggactccgaagcgctggcgggcctcgcgcaggggattggagaagggccgcacgtcccgggcgagttccaccatggcctcctcgaattcatcgtcgtccagctccacgggcccggtgtcatcgtccgtgaacggcgtgtggaccctggaaggcccatcccctgtgtccagacgtacgagccgggttgtcgagcagcccgtgacggcaagcgccagcgacagccagatgaccgcatgcgctctcatcctcgtcctccggttccgggcgtactcctacgaggccaagtccagaactaccagaagagcctgacgagacgagctgaccgcttcgaggagcgcgccgagcgcccaatctgccgatgtgatccaccgcagtgtccgcctggggcgcacgcctgtccatcgctggacgcggcccgtgcgtggctggggacaggcggacagacggggctcgccagtcgcgtccacgctgctcactttccgttgcgggcaacgggacggcgaggaggtcgatggtgagcaacgcgcacggggagttgtccctggccccgccagcaggcgctgtgggagcagcggcgccgcagcgggtcctgaagcgatggatggtggtagggcttcggcccgtcttcgcgctggcgggtgttggcacactggcgttgctggtccacaaggccgggcctcgcgagctgggcgccgtgttgtccggcgcggcgccctggctgccgtgggtggtgctgctggagctggggcggcagtgcatggacgggctggccacgcgacgtgcctatggaccgggagcggggcgagtgccctggcgcgtcctggcccgcgcgcagcttatcggtaccgcggtgtccagcatggccccggcgggccgcgccgcggcggaggccaccaaggcggccctgctgagtccctacatgggcgggggaaccgccaccgcggcggcggcgacctcgcaggcggcgtccctggcggcgggaggcttcatctcgttcccctgcgccctcgcgtcctacatgctgacgggcatgtccctcttcacgatgctcatgctggcgcatggcgggttgctggtgctggtgtcggtgggcgtgcgcgcgtgcatgcgcgcgaagcggcccggtgcgtggctggtgtgtcgcttcagccgctgggcgctccatgcggagcagttcaaggcctcggcgcggtgtggctcgttgctgccgtggtcgcccatgctggcattcttgtgcagtcggctgttccaggtggcgcagtacggcgtgctgacctacgcggtgggcatcgacacctcactggtgcaggcgttcttcgcccagggcctctacctgtgcgcgctggcggtgggctcgctggtgccagggcaggtgggggtgagtgacggcgccttcgcgctggctgcgggcgtgctggacaccacggccgcgcgcgccatgtcggtggcgctgctggggcacctggtgcagttgctgttcgtgctggtgggggcgctcatcccgctggtgtggcggattcgggcgccgctgcccgtagcacccgcaccggcgtgccgctgaaggcggcgttgccgcagagcgcgtccacggcctgcgcgtccgtgaggtcgttgtggctggcgcccgcgtgggcggtggccacggcgagccgggtgccctggcggccatgtccgtaaccgtggggcaggctcaccacaccgggcatcacctcgtccgtcacgtggatgggcaccgtcactgtgcccacgcgcgaggtgacggtggcctccatgccgtcggcgagcgcccgccgggccgcgtcctccgggtgcatcatcaacgtgcagcgcggcttgcccttcagcaggcccggtacgttgtgcatccaggagttgttgtcgcgcaggtgccgccggccgatgagcagcagctcgccactgtgctgctcggggacggtgtcctgggggaaggctgcttgcaggcgtcgcacgtccgccaccagcagctccggcgccaggtggatgcggcggtccttcgtctggaggcgctggggcaggcaggactggagcggccccaggtcgatgccgtggggcgactggcgcagcttctccagggtgaggccctgcttcgccgggtggaagcgcgcgccgtagggccccagccgcaggcccaggtccagcactcgctccggacccagacgggacagggcctggtacttgagcgtggcgcgcacggaggggcggcccttgcgcagcgtcagcagccggtgctggagggcgagcagaatctgccagtcctggcggctgcccggcccgggctcgaagagggcgggcgagtacttcgcggtgttgcgcaccgccagcgcgtggaaggcgatgtcgtagtggctgcgctccagcggtgacaccggcgggaggatgaggtgcgcgtggcgcgtcgtctcgttgaggtacgggtcgatgctcaccatgaagtccaggcccgcgagcgcctgttccatccgagcgccatcaggcgtggacagcgcggggttgcccgcgacggtgagcagcgcgcggatgcggcctgggcccggcgtgagcatctcctccgccatcgccgccgtgggcaactcccccgcgaactcgggaagccctcgcacgcggctcttccagcggccgaagccgccgcggcccacggccagggcccgtggacctccgacgacgtcgaacgcgggcagggtgaacatggcgccgccgcgccggtccaggttgccgctcaccacgttgagcacggtgatgagccattggcagagcgcgccgaaggattgggtggacacgcccatgcggccgtaacacacggcggctcgcgcggagaggaagtcccgggcgatgcggcgcagggtgtgcgcgggcacgcccgtgtgcggtgagaccttctccggaggaaagtcccgggccagcgcgcacacggtctccaggccgtcggtgaaggcatccagcggccccaggcgcggcgcgtgctccaccaccgccacgtgcagcagggcgagcagcgcgagcgcatcggtgcccggccggatgaagacgtgcgtgtcggcgatggccgccgtctccgtgcggcgcgggtccatgacgacgatgcggccgccgcgctgctggatggcacgcaggcgggcgcgcacgtcgggcgccgtcatcaagctgccattggacgccaggggattggcgcccagcacgagcatgtagccggtgtggtcgatgtcgggaatcggcaccatcagctggtggccgaacatgaggtaggcggtgagctggtgcggcagctggtccacggacgtcgcggagaagcggttgcgcgagcgcagcgtgcgcagcagctccggaccgaacagcatgttgcccaggttgtggacgttggggttgcccagatatgcgcccaccgcgtcacggccgtgctcccgttggatggcatgcaggcggcgcgcggtctcatccaatgcgtcgtcccaggagacgggctcccaaccgctggcggtgcggcgcatggggccgcgcagccggtccgggtcctggtgcaggtcctccagcgccagggccttgggacagacgtggccccggctgaaggggtcctccgcgtcgccccggatggaggtgatgcgtccggcgtccagctcgatgcgcaggccgcacatggcctcgcagaggttgcaggtgcggaagtggacctggggacccggggcggcgctcattcggggaactgtagcgcgcggcggagggccgtccgcccggcggcgcgggtcgcgcttccatccgtctgggttcagacgatgggcttcctggcggactgcacgatttcagcggcacacgtgcgaggggcccgtgaaaggatgccgtcccaggagggcagcacatgcaccgtgtgtatccgttcgtcgtctccctggggctctcgctcgcgccgctcgccgcccatgccgcggcgccggctgcgcccgtggccgaggtgaaggcgccgaccatccagttcaagcagatgaacgcccgcgtggggtaccaggaggaattggacaacgccgtggacatgcggctggcgctcgacctgcgcgcttcgaacatggacaagccgatgtcggtggcgatgtcggtgacctcgtccagccgccacacggtgacggtgctggccgcgaaagggaaggtcatc

SEQ ID NO: 955 - DNA, 11476 bp, Myxococcus xanthus
gctgcgggtccacgcatcgggcctccagcgcggagatgttgaagaaggacgggtcgaagcggtttttgccttcgatgaagctgccccgcatgcaccggtcgccctcgcccgacagcgtggaggcgtagtggctcgccaggtcccagcggcgaacgtcctccaccaggtcgcgtcccgcctccaggtgccgccacagcgcctccaccgagtcggactgggcgaagcgggcgctcattcccacgatggcgatgggctcctccgccgtcgcgaccgccaccgtcttccggagggaactcacggcgacgggcagcggcgcctccctgtcatcacgaaggacttcgcgcgggggcacaggcgcctctcgcggcttgtcgtccaacagccgcgatgcctcggcgccgtgattccgggcaatgaactgactcagcgccgcgacgctgttgtagtcgaagagcaccgtcgtcggcagcgacgtgccacaggcgtcgttgatggcgttgctcaggttcacggcgatgatcgaatccacgccgtagtccgcgaagctgtagtcgacctggatctgcgactccggaaccttgagggatttcgcgacgcacgccttgatgacgtcccggacccgctcctcgatggacgtggcatccgtgatgacggggcgaggctccggggcccgctgccgctgggcgcgcgggctgatgggctggatgacgccatcgctctccgcgatgatgacctgctggccacgctcgtgagcatcggccgccgggaagaagaccgagctgaatccttccgattcgagcactgccttccacgtctcaggagccagcgccgggcagccaggaatccgcaggtcctcgtcctcgtagctccaccatccgtcgagcaacccgaatgtgagatgcgcgaagagggtgttgtggctgatctcattgaggatgagcagcccgttctgggccagcgcggacttggcgttgcgcagggtccggcggatgtccggcgtcgcgtgcaacacgttgctggccaggacaatgtcgaagtgcgcacggggaatcccctgcgcctccagagggacatcgatgtccagcagccggcgcgtcaggaacgggttgccggggctgtacgtcttctccgcgtgctggaggaacgccggggagacgtcggtgaagcagtactcctcgacgtccagcgcgcaggtgcgcagcatggccaggacgtgcgcggtggcgccgcccgtgcccgccccgatctccaggatgcggacgcgtgcccccggggactgttcgcgcaatagttggacgtacgccaccacactccgggcgagcgcgtcgttgaagaagtcggccaccgggttgtgcttgtagaccccctcgaccaggctcatcgagccacgcgagaagagcacatccgtggccagctgcctgcccacgaggatgtcggggagcgccttgatggtggtctccgccaacgtggtcagcgcgcgcgtgttcggatcctgcgtccaccgcgagcgcgacccttcccactcctgccagacctcatcgggacgcgaaggaggcccggaccgggtgtacgtctttccatcgcgcgtggagaggacgccgtgccggaccagcgccgcgacgctctcactgaaccagcgcgcgtaccgcggtgagattccagacgaggcctgcatctcgtcgaggcgcgcgggcagccgcgtgaagcagcccatggcttcgagctgcgctccgaggaggcgcggaagcgactcaatcattgacggtttctccctcgatagcggccgcgccgatgcgcgtccgcagctgtccgatcagcgatgggcgtgtctgagcaaccggtttttcaagcgtctgttgttcccgcgggggcgcgggggaaatccagtaacgctcccgcgcgaacgggtacgcggggacgtgggtgcggctcaacggcgccgcgtagagctgtgtccagtcaacggtcccccccgttgcccacagcccgagcaacggcgaggcgtctcccgccttccacgccgtcaccgcgtctcgtacggcggcttctgcctcggcggaacccttcccggacggatgcgccctgccagcgcggccccccacgaagagcccctccctgcctcccgtgaggaacacctgcagccgggtctccagcgccgccagggagtcgaccaccatggccaaccgctcctccatggcctctcgcccgacctggagcgtgtaggccagcgagggaagctccgcgtccgaccagcgcccgctccgaaccgcatccagcaactgcgcggcctgctcccgaagccgttcggcgttcttcgcggagaggacgatggccacgggcccacggggcacatccgccttggccgcattggcccgagcgttccccaggtactcctccatgacgacgtgcgcattgacgccaccgaagccgaacgagctgacgcccgcgcgccggggcagcggctgcccgcgctcgtccatcagggccggccagtcctgcgtctgctgaacgatgaagaacgggctgtcctccagcttgatgtacgggttcaagcgctcgcagtgcagcgtcttgaccagcatccggtgcttcatctggagcagcaccttgatgacgcccgccatgccagcggccagctccaggtgcccgatgttgctcttcaccgagccgagcccacagtgcttctcgaggctcgtaccgccaccccgggcctcgatttgcgccgcgaaggcgctcttcaggccattcacctccaccgggtctccgagctccgtcccggtgccgtgcgcctccacgtagccgatggtgcgcggatcaatgtccgccttccggtaggcgtcctggaggagctgcgactgggcgttggggttcggcgccgtcagcgagttggcccggccgccatggttctccgcactgctgcggatgacgccgtagatggggtcaccatcccgctccgcgtccgccagccgcttgaggaagacgacgccgacgccttcaccccgggcgtagccgttggcagtggctgagaatgtcttgcagcggccgtcctcgctgagcatgccggccttgtcgaacgcgatgtgtcccccgggcgtgacaatcgtgttcacgccacccgcgagcgccatgtcgcagcttccgctgtcgatggcctccatcgcccggtgcagcgccaccagcgaactggagcaggcggtctccacgggctcgctcggtccatggaggttgaggaggtagctcatccggttgggaccaatcgacgggacgaccgccgtggacgaatacccctggatggcgaggttcgcccgctcgaccaggctgttgtagccggtgatgccggtgcccacgaagatgcccgtccgcgtccccgacaggctgtgtggggcgtagccggcgtcttcgatggcccgccagacatgcatcatcagcagccgctgctgcgggtccatgacctcggcctcgacgggtgagatgccgaagaagagtggatcgaactcctcgacgccttcgatgaagccgccccacttcaccttcgtcttgttcccctccttgcgtgggtctccgtagagctcgcgccaatcccagcgcgacgcagggacctcggtgatggagtcgacaccaccggccaggttggtccagaactgctccaggtcacgggccccggggaagcagccgctcatcccgaccacggccaggggcgtgggtccccggcgggccggcgtggacgtcgacggcgcgtccgtccgcgccggttcaacagaacgtccgcgcgagccacccctccgctcacgcgtcctcaacgcggatgtcactggctcggccgcgggcatccgttcggccaggctgacgacttccggcgtggcgccgcgttcctgctcaccgaagtggtgcaccattgactcgcggtgtgcacgcagcaggtagcccgccagcgtatccacgctcgggtactcgaagagcacgggcggcgtcaggtcgagctcgtaggcccggttcagcctgttcgcgaactcggtgagggtgatggagtcgaatccgtactcactcagctcactgtccgcgtccacggcggcggcatccaccttgaggaccaccgcgatctccgagcacaacatcgccgagacgcgggcacgtacttcatcccccggctccgcggtgcttgaggtcgcgctggccgacgggctcgggctcaccgacgttccttccagcagcccgctgcggcccagccacttgcggatccgctcggcctgtcccgccaggatcatgacctggctctgcgcgtgctccagggcgtgctggaaggcttgcacgccggcggtcgtctccaggaccgccatgccggtggcatgggtcatcatctgttcggtcgcggcgtcgacatgcatgccgccctcgcgccacagcggccagttgatcgacagcgtctttccgaagcgctcgccccgggccactcgcgcttcccgctggcgggcatacgcatccatgtaggcgttcgcggccgcgtagtccgactgccccgggttgccgatggcccccgcgaaggacgagaacatcacgaagaagtcgagccgttcgctacggctggcctcgtccagacaggtgagcccctggaccttgggtgccagcacccgctcccaggcctcccagtccttgttcttgagcaggctgtcctcaatcacgcccgccgcgtggaggatgccattgagtccgccgaaggtgtcccgcacccaggcgatgagcgcctgacagtcctcggcacgggtgacgtcacaggggcggtactccacgcgcacaccgggccgccgcagggactccatgaatgcccgctgcgcatcccccgccggcgaacggcccgtgagcacgatggaggcttgctccgtggcctcgacgatggtctgcgcgaaccgcttgcccaggccgcccgcgccaccggtgatgaggtaggtaccccccttccgccagagtggcgcctccggggccggcgctgtcagctcccgccaccgggtcaccaacaccttctcgtcctggaacaggaggtgcggaagctccggcgccgtgctgctggactggagccgcgcgaccactcgctcgacgtccgttggcgcgtcgacctccaccatctggagctgcaacgtcgggtgctccagtcgcgccgtcttgaagagaccgagcaagcccctcagggagtcccgctccgtgtcctgcgtggacaccacacactggagcagcgtcgcctcgcggcctgcttgcaacgccattcccttgatggcctcgaacagcttctgaaccagctcacggaagcgctccggcgcgctggcggccgacgtccccatgaccaccttctgcgccccctgaatccggttcgcggcggcctcggccacggcgctggtggcgccacagaagacgagcacccggcgccgcgccgctgtgataggcgcgctcgcgagcgccgtctcctcccagatgggcgcgaacaggaggacgtgattctcggcgccagcgcgcacaccggccgcgggcacgggccgcgtggagaatcccttcaggcggacccagaccttgccgtcgcggtcacagagggagatggaaatcttctgccggttcttacccgcggcgccgtccgtctcatcgcgcaggtgaatccagacgtccgagggagcaggcccgtcccacacctccagcgcatcgagcgcgaacggaagcgagagctgtcctccctcgtccgagtgcagaccgagggccgcctgcaacgcggcatccagcaagctcggatgcaggacgaactgcccctggctgctcaacacctgctcggggagcacggcccgcgccagcacctggccacgacccaccgagagctcttggagcgcacgaagcgtgggtccgtaggtcagcccggccgacgcgaacgtctggtagacggccgcgccgctctgtcgccggtcctgacaaccggactggaggaccgacaggtccacgcaaggtgcagtggcctcctcgtccgtcccagcgccgatgcgcgcccgcccctgacagaagagcagcggcgcctcgtcggtgcctccgtagatttcgaagacgacgctgccgtcctgctccgcctccagaccgatgtgcacctgcaccggggcgtcggtcacgatgatgggccgtgaccagacgacgttccgcagtgtcaccttgccgggaggcgtcaggccactggcgttcaccaccgcggcgcgcgccatctccaggaaggccacgccgggcagcaccttgtcctggcccacgacatggtctcggaggaagaactcctctcccgtgaggtgggcgctgtagcgctgcccccgcaggtcggacgagttctcatgcaccagcggatgcagggccgcccggctgccggcccggacgcggttctccgcgcgcgccggcttcgctacccagtacttctccttcgcgaagggataggtgggaaggctccgtcgccggagctgcgcgccgccatgcagcttcgcccagtcgacgggcatgccacgcgtccagacctctaggaccttcgacagcttgccccgggccatccacttggccaccgcctcctgcatctccgcgtcatccgcgaagacggacaggaactccttatgccgcttcacgtggccccggtacacgctgtccgccagccccctgccctcggtgaactcgaggagcttctccttcagctcctccaacgagcgcgcgagtagccccagccgttcctccatcgcatcgcggccgacttgcagggtgtacgccaccgacggcaggtccgcctgcgacacctcgccttgctccacggcatgcagcaactgccgcgcgcgctcgatgaggcgggcctcgttcttcgccgacagcacgatgaggtgcggcgcgtcttgcggaacctccgcggcgggcgcactcgatggcaggtactcctccacgaccacgtgggcattcacaccgccgatgccaaacgagctgacgccggcccggcgcggaaccacgttgccggcgccgtcctccaacgcgggccatggctgcgtctcgcgcacgatgaagaaaggtgaaccgtccagacggatgtgccggttcaactgctcgctgtgcaggctcttggccaacgtcttgtacttcatctgcagcagcaccttgatgacgccggcgacgccggccgccagctccaggtggccgatgttcgtcttcacggagcccaggccgcagaaggcgcggtccacggggcccgcgccgagcgtcgggtccagcgcggtgaaggcgctcttgagcccgtcgatttcgatggggtctcccagcgaggttcccgtgccgtgcgcctcgatgaacgtgacggttcgcgggtcgatgccagcttgcgtgtaggtcgcatgcagcagctcggcctgggacttggggctgggcgcggtgggcgagttcgtccgtccgccatgcccggcggcgcttccccggatgacgccatagatgtggtcgccatccgcctcggcgagggagaggcgcttcagcatcaacatgcccacgccttcaccgcgcacgtacccgttcgcctggtccgagaacgtcttgcagcgcccatccgggctcaacatgccggccttgtcgaagccaatgtgccccgcgggcgtcgggagcgtgttgacgccgccgacgatggccgtgtcgcactcgccccggtggatggccaacatcgccttgtgcaccgccaccagcgagctggagcaggccgtctcaatgggttcgctcgggcccttgatgttgaggaagtagctcatccggttcgggcccacggagggcaccgcggccgtcgacgcgtagctcttgatttcggcgttcgcctgctcgatgagcgagccgtacccggcctgtcccgtgccgatgaacagcgcggtccgagtacccgacagcgagctggcggagtagcccgcgtcttccatcgccagccagacgtaggtcatcaacaggcgctgctgggggtccatcagctccgcctcggaaggcgagacgccgaagaagagcgggtcgaactcgtcgatgccgtcgatgaacccgccccacttgatgagcgtcttcccgggctcctgattcgcgtcgccgtagatctcccgccagtcccagcgggacgcgggaatctcctggatgcagtcgacaccgtcccgcaggttccgccagtacgcctccaggtcctcggccatggggaagcggccactcatgccgatgacggccagtggttcgtcattgccatacgtgagcggttccgcgctccgagacggccgaggcatgcgtcgcagccgccgtgcctccgccttcggccccaccgccttcgtcggcgctggtgtgttccccgaatcggcgcctcgcttggcgacgaccatgtaccggtcgaagttctgccggtacttctcagcgaggtgctcggacaacgctgcaatggtgggcagctcgaagaacagcgtcggcgtgagcgacaggccatacccgtggttcagccggctggtgaactccgtcaggctgatggagtcgaagccatactcactgaactccgtgttgatctcgatgtcacccgcgctgaccttgacggcccgcgcgacctccgtgatgaggacgctgcgaatctggtcccgcaccgagcttgggtcccccaagggtccggcatcggccggcgaggcatccacctcttctgccggagccaggattcgaggcgcgggcgcggcgcgcagctccttcaccggccgcatcaggaagcccttgagccggatgcacacctgtccgtcgtccgcgagcaggtccaggtccagcttccgcacagcccctcccgcagtgcttcccgctgcgttccggatccagacccacagctggggcggacaaggagccagaacctccaccgcatccaccgagaacggcaacccgatgggagccggcgactcctgcgcgctcaggccgatggtcgcctgcaatgccgcatccatcagcgaggggtgcaggacgtagggcgccaccgtcgaaccgaggccctccggaaggacgagcctcgccaggacctggtcaacgccctgatagacggcgcggagcgcccggtgccccggtccataagcggcccccagtgacgcaaaggcctggtagcactgctcggcggacagctcaccgcgctggcactgcgacttcagggcggccacatccaccgccgccgcgggcttcggctcgaagaaagtcaccaggccctggctgtggcagacgtgcgtgtcgtcggagccgctgtggatgtcgaatcgcacgcgcccatcgtcctcggggaacagcgacacgcgcagctcggtcgtgggcccctccaccacctgcggctggggccacgtcacgttcgtcacgcgaacgggccggacgaccgccgcctcctccccttcggcgagctggagcgcggcacgcgccatctccaggtagacgacgccggggcaccacccgcttgcctagaatcacgtggtcagcgaggaagaactggtccgcgctgaacacggcctcgtagccctgctggcggaggtcggagacattccgccgcagcagcggatgcagggcgtccacgccgccagccctcagcgctccccacgtgggcacaccggcaggctgttccccttccgggacccagtaacgcgtccgggagaacgggtacgtgggcaggctcagccgctgcggccgctgggccccgtacagccggttccagtcgaacgacagtcccttggtccagaggtcgagcagcttgtggtacttgcccttgctcaaccacgacgcaatggcctcctggaggtcgtcgtcgcccgtgaacacggacagcgcgtccttgttccgcttcacgtgaccgcggaacaccgcgtcgcccgcgcccgcgccgtccacgaaggcacggagcttctcctggagcccggcgatggagtccaccaacaaggccaggcgctcctccatggcgtcacggcccacctgaagcgtgtacgcaagcgcgggcaggtgttcgtcccggtacccttcccgctccaccgcctcgtgcagctgccgggcctgttgccgcagctgctcctccgtccgaccggagagcacgcagatggccggcccacgcagcggcgtcggagtcgcttcgtggcttggtacgtactcctccacgacgacgtgagcgttgacgccgccaaagccaaaggagctgacgcccgcgcgccgtggcaacggacggccgctggcatccttcagcgcgagccagggacggccttcctgcaccacgtagaagggcgaccccttgagcgcgatgtagggattcagctcctcacaatggaggctcttcgcgagcaccccgtgccgcatctgcaacagcaccttgacgagccccgccacaccggcggccagctccaggtgcccgatgttgctcttcaccgagccaatgccgatgtgcgcgtcggtgccttcagccgcccccgtcttctcgtagagggagtggaaggcgctcttgagcccgttgatttcgaccgggtctcccagcgacgtccccgtgccgtgagcctcgatgtagcccgccgtgcgtgggtccacgcccgcgcgcagccaggcggcctcgatgaggtcagcctgggccttggggttgggcgccgtgagtgagttcgcccggccgccgtggttctcggcgctgcccagcaacaatccgtagatgtggtccccgtcgcgctcggccagactgaggcgcttgaggtacagcacgcccacgccctcgcctcgcacgtagccgtccgcgccgcgagcgaaggccttgcagcgcccgtcctcactcagcatcccggccttgccgaagccgatgtgcgcgtccggggtgacgatggtgttcaccccgccgaccagggccgcgtcacacagccccagctcgatggcgaggagcgcgcggtgcaccgcgaccagggagctggagcaggcggtctcgatgggctcgctggggccatggaggtccagcaggtagctcagccggttcggtcccacggaaggcacggagccggtggcggtgcttcccttgatggcgacgccagaacgctccagcagtgacgcatagccggtgttgcccgttcccacgaagatggcggtgttgctgccagccaggctctgcggagcgtgacccgcgtcctcgatggcgcgccatacgtgcgtcatcaagagccgctgctgcgggtacatgatctcggcttccgacggggagatgccgaagaacagggggtcgaactcgccaacgccttcgatgaagccgccgtgccggatgcgggtcttgttgtcctccgccgccgggtcgccgaagtagtctcgccagttccagcagtccgcggggatctcctcgatgcaatcacgccccgccgcgaggttccgtcagaaggccgccagatcgggggcgccggggaactcgccactgatgccgaccaccgcgaccggataccggtgtcccggcaccttcgcg

SEQ ID NO: 956 - DNA, 8316 bp, Myxococcus xanthus
cggccccatgcgcgggggcgctcccagccttccggccggactgcgaacgtctgcgtgctcgactttttccgtggcccgcggactgcccgcctcgcgaggccgtgctccacccctgccgcgcccgcgccacacggcacccgccgggcacgggccccacgcggaagggaggaggagcacgcctcccttccagcgggactcacactaaccgccgatggtgtagcgctgcaccgccttgccatcgaacggccggctctcgcccccgatgacctggttcaccgtggccgagcccacaccacccgccgcgcagttggcgcccgtggcgccgccctcgaagaagagctccaggtccagcgtccgccggtccgcggagaacgcgccgcggcccacctgccggaagcccgggtaggtgaacgcgacgtcgaagcactcgccgtcgccctgcacgttctcgatgctcacgacggtcgaggtgaaggacagcgcgttctgcgggagctcggggttgcaggtgccggacatgcccgcgttcggcgcgccctcgatggtgcccgggatgctgtcgacccggaagttgccgccctgcaccgtcatggtgacgctctgataacactgcgagctggcaccaaagttgatgtcttcactgaagccgttcggatggctgggaatgttggccccagtcatcgtcagcgtcttgccttccacgaacgccaggatgccctgcggcgtgctcaggttgggcgtgttgtccaccgggtcgctctcaccacagcccaccagggacagcgcagacgtcatcaccgcggacagcagcagcttcttcttcatgggttgctcctcttcatccggcgggcatcgccgggctgacgcgacagtcgacaggcagcgagccaccgttggcgtggcccgtccttcaaggtgcgttcacgctcaatgacgcgagctgtcccggtccgcggccacggccgcgtcgcgaagctcacgcttgagaatctttccggccgcggagataggcaggcgctccatcagctccacgcgcttgggcaccttgaaacgcgccacgcgtccccgcaggtgctccaacagcgcctccgccgaaaccttcccatccggcttcagcaccacgaaggcgcggccaacctcgccccacttcgcgtcgggcacacccaccacggcgcattgcgccaccgcggggtgctcatacagcgcggactccagctccagcgggtagatgttttctccgccggagatgaacatgtccttcttgcgcccggcgatggtgaagaagccgtccgcatccacgcgcgccaggtcgccggtgtgcagccacccttccgcgtcaatcgcctcgcgcgtggcggcctcgtcttcaaagtagccggagcacatggaggggcccttgaggagcagctcacccacctcgcccgtggggacttcccggccgtcgtcatccaccagcttcgcggcgatgaagtagttgggccggccaatggagcccgccttcgacaccgcgtactccggtcccatgctgaagaggcccgggccgaactccgtcataccgaagccctgcttgaagggcaccgggtgcaccgcctgccacgcctggatgagcggcaccggcagcgccgcgccgccgctggtcatgaagcgcacggaggagaagtccgtcgtcttgaagcgcggcgactccaggagctgctggtactgcgtgggcaccgcgaagaagagcgtcaccttctcccgggggatgaggtccagcagcgcctccggctcccaccggcgcatgaggacgacggtgccgcccacggtgagcagcggcagcgtgtacacgagcaacccgcccgtgtggaacatgggcgtgtgcgtcaccgtgacgtcgccgggccgcacctcgtggaccaacgtgttgagggtgttccacgccaccatgcggtagctgacgcgcgcgcccttcgagcgccccgtcgtcccgccggtgaagatgaggcagaggatgtcctcttcggacaccgcgtcctgcgtcaccggcgagcccggcacgtgggccagcgtcgccgcgtaggcgtccgcgcccggcaggccttgcgactccagggacaccagccgggggccaccgcccaggcgctcgcggacatccgccacggtgtcgcggaagtcgtcgccgaagaagagcacgccgggacggatggagcgcaccaggtccgccagctcggcggcgtgcaggcgccagttgaaggggacgaagacggcgccaatcttcgcgcaggcgaacagcgcgtccaggtactccacgccgttgtgggccacgatgcccacccggtcgcccttctgcacgccggccacgtcacgcagccagccgcccaacgcggtggcgcgcgtgttcatcgcgcggtaggtgaagcggcccgcgtcaccccgggacgggtccaccaccgcgacactgtcgggccagtagagggcgccacggcccatccagtcaccgatgaacatgtgcgcgccctccgtcatggcgtgactcaggccgtccagcggtagagggcggaggccatggcgagcccgccgccgctggcacacagggccaccaggtcgccgcgctgcaccttgccctgcaccaccgcgtcatccagcgtcatcgggatgcaggccgaaccggtgtagccccacttgtccatggtgtagtgggccttctccatcggctggcccaggatcttcatggtggcttcgatggtgcgcaggttgagctgcgtgaagacgaactgcttcacgtcgtccagcttcaggttctgccgcttgaggagctggtccagcagcatgggccagcgctcggtgttgaacgtcgccgggaacttgcggacgaactgcaccgcgggcttgccgcccgtgagctccagcgactccgcggtggccgggcggttcgtaccgccggtgtagacacccagcgcgtcgtggtactcgccgttggccagcagcttcgcgcccatgaagccgggcgtgtcacccgcgcccagcacgaccgcgcccgcgccgtccgcgaacagggtggcggtcttcttgtccttccagttgatgtagcgcgacatgccgtaggcgcccacgacgaggatgcgctggtagctgtcatccgcggcaatcgtcttcgagcccacgtccagcgccgtcacccagcccgcgcacgcgcagttgaggtcgtaggtgccggcgttcaccgcgcccagcttcgcctgcaccacggaggccgtggcggggctgagatagtccggggtatcggtggcgatgatgatgaggtccagttcctccggcttcgtgcccgcgcgctccagcgcctggcgggcggcgcccacgcagaggtcggaggtggcctggtcatccgccatcatgtggcgttcgcgaatgcccacgttctgctggagccactcatccaccttctcaccgagaatcttctcgacgtcagcgttggtgaggaccttctcggggacgtagcggccagtggagagaatctgggcgtatcgcatgagtgttcgtcagctccgggcgccgcgcgccggtcggcgggcgggacgcagggtgttcttcttcaggggcttcggtttgggcttcagcttcggcttcggcttcgaagcggcggaggacttcacggtgttgcggcccgtggacgcacgcgggtccaggccgtgggagatgagcgtcatcgcggtgtcgaggacgcgctcgagccccgggtcctcctcccagaggacccagcgcatgccgaggaaatcactgatgcccatgaggcagtaggccagcgcctccgggtccatgcgccgcacctggcccgcctccatggcgcgggtgagcccgctcacgtagccgcgagcgaagcggtcgtagtagcggcggtagcaggcctcatccacgaactccgcctggcgcaccacgcgatagagattggggtgctgccgcacgaactggaagaaggtgcgcaggccctggcgctccacgtcgacgcggtcctcgcagccggccacggactcggcgatgagccggcgcaggcgcgtgcccagttcgtccaccacttcgacgaagatggactgcttgtcggggaagtagacgtagaacgtcccgagcgccacgccacccttgcgcgtgatgtccgcgatggaggcgcgctcgtagcccttctcaccgaagaccgactccgcggccttcaacagcttcgcacgcgtcttctggcctcgcggcgtgacgggtccggagcggtcttgagaagatgaagcccgattcatgtttcacctagcggtagcacccggcagggagggtgtcaaagcacggccgatggcttcgcgcgtcaaaccgaacgttcgacgcacggcgtcagcactcgtgcggcgccgacgtgcgcaaagcctactctgaatgttcagtacacgtggtcacgcgacgggagccgttgcgcgtcgggacgtgccgcgcgggaggcggcgcgggcacgacatgccacatcatcctcggcctgagtgattgccggtggcacggagtgcgccagcacggatgcgcgtgatgcgctccaggctggcctcgagcgcatcctggacgtagacgggcagatacacggcgctcatgcgtggcgcctccgaagcgacatgcagcccaccgcaccgcgctcggagctggaaatcacaaacacattggactgtcggccatggcctcgcgagaggtcgtgcgccgcaaggcagactctcagcgcgccactggcagcccccacataggtgccgggcaggtgcagccgaggcgccccgagccgcgcaccgagctggttcgtgcacctcacggatgcgccgctcgatcgcaacaacccagcccacttgggcgtgctgcttcgaaccgatgagcgctttccggaaatcggtgggcgcgctgcgccgtgaacagtcaggcgccagccctccgttcatccggacacaatgcgcggcgtcaacgagccccgggcaggtgccaccgcacctggctcgccccaggttcccgccgccgtccggccgaggcggcatccggcggacggacacacctttccactgtcagcatcgacacagttcacggtgcgaatggacgtcgcgttcgaggttgcacccttggagcatcaaatataaattatctgccgtcccgcaaaagtgcctataaattcaaggcaaacgcccccatgttcctggacgaactagaccaccgcatcatcgacatgttgcagcgcgatggccgcgccacgcagctggagctgtcgcgtgcggtgaagctgtcccagccggcggtggcggagcggatccgcaaattggaggagcgcggcgtcatcacgggctactcggcccgcgtggacgcggcgaagctcggcaaggacatcacggccttcatcggcgtgagcatcgagcacccgaagtacttcgacgagttcttgcagaaggtgctgttgctgccggatgtcctggagtgccaccgcgtggcgggccaggactcataccttctcaaggtgaagacggcgaacacccgttcgctcgactccctcctggtgggaacgctgcgcaccatcgcgggagtcacccgcacgcagaccaccatcgtcctgacgtccatgaaggaggacacgcatgtccgcgtgcctccagacaccccaaaaggagcgtgacgtatgagcgccgacgcgatgagcgccccccttcccccgccgcccgtatggcggttggcccagcggatgtcccgcatcaagacgtccgcggtgcgcgaaatcctgaaggtcgccgagcggcccgacatcctctccttcgcgggaggcctgccagccccggagctcttcccgctggaggccatcgccgaggcgcacgccgaggccctggcgaccgagggccgcgccgcgctccagtacagcaccaccgagggcttcggcccgctgcgtgagtggatttgcggccacctccagaagcgcggccgccagtccaacgcggaccaggtgctcatcaccaacggctcgcagcagggcatcgacctggtggccaaggtgatgctggaccccggtgacctcgtcatcgtggagaaccccagctacctggcggcgctgcagacgttcggcgcctatgaggcgcgcttcgccacggtgggcagcgacgaccagggcatgcgcaccgacgacctgtagcgcctgctggccacacacaagcccaagctggtgtacgtggtcgccaacttccagaaccccaagggcaccaccctgtcgctggagcggcggcgcgaactggtccgcctggcccagcagtaccgcttcctcatcctggaggacgacccgtacggcgagctgcgcttccgcggcgagcacgtgccgtccctgtccgccttctacgacgagggcgtcgtcgtgtcgctgggcaccttctccaagacgctggccccgggcatgcgcctgggctgggtggtgggcccgcgcgacttcgtgcgcagcctggccatcgccaagcagtccaccgacctgcacacggccacgctggctcagcgcgcggtggtgaagctgctggcgcgcttcgattacgcggcccacctggagtcgctgcgccccgtctacggcgagcgcgcccaggccatgctggacgccctccaggcgcacatgcccgcgggcacccagtggacgcaccccgaaggcggcatgttcctgtgggtggagctgcccggcgggctggacgcccaggcgctgctgcccaaggcggtggagcagaaggtggccttcgtgccgggcgcgcccttctacgccaacaacccgcgcccggagttcatgcgcctcaactactccaaccgcccgccggacctgattgccgagggcatgcgccgcctgggcgccgtgattgccgccgagctgggttgagcccctgacggagcctctttgccgcgccgcgtcggaaacgacgcggcgcttttcatttcaagaagttgaagattgattcaggtttcaactcgctcgccgctggccagcgcggtcggggtttcgtaccctgcgcggcatttcgtaccaccccacctgccggagagacacatgcagctcaaggacctgaagatcatcgtcacgggcggcgcccagggcatgggcgctcacttcgcgcagcgcctgcacgaggcgggcgcccaggtggccgtgggtgacgtggccgaggagcgcctcgccgcgctgcccgccggcatccaccgccgcaagctggacgtgtcctccgaggaggacatcgtctccttcgtgaactgggcgcagggcgccatgggcggcctcaacgggctcatcaacaacgcgggcatcctccgtgacgcgctgctggtgaagaaggaccggaccaccggcgaggtgaagaagctgtccaccgcggactggaacgccgtcatcggcgtcaacctcacgggcgccacgctgatggtgcgcgaggtggtggcgaaggtcgccgagtccggccagaagggcggcgtggtcgtcaacatgtcgtccattgcccgccacggcaaccgcggtcagtccaactacgtgtccgcgaaggcggcactggcggccaacaccgtcacctggtcgcgcgagttcagccccttcggcgtgcgcgtgggcgcggtggccccgggcatgattgagacgccgatgacgcagggcatgaaccagaaggcccgcgacgcgctggtctccaacatccccgtgggccgcatcggcgtgcccgaggacatctggctcgccgtgaagttcatcctggagtgcgactacttcaacggccgcaccatcgacgtggacggcggcctcaacttctgagtcccctcctccgggcggcacggcaccgtgtcgcctggaggttccgctgggacgccgcgcttcaccgccggctggcgtcactgaggcgcaggtccctcagcagcgcgggctcgtccgcgtagagcagcttgtaggcgctgtagctgccgagcaccttcttcacgtactcgcgcgtctcctcgaagccgatgtgctccacccactcgtcgagctccgcttcgggcagcgcatgccgccagcgctccaccgcgcgcggcccggcgttgtaggccgccaccgcgtaggccacgttgcctccgaagtgtttgaccagttgtcccaggtacgccgcacccaggcggatgttcgtgtgaggctggagcaacgcggactcacccggcatcggcatgtccagtgagtccgccacctgtctcgccgtggtgggcatcaactgcgccaggcccagcgcgcccgtggccgaacgcgcgcgggcattgaagcggctctcctcgcggatgaagccctggagcaggtcggggtccacgcga

SEQ ID NO: 957 - DNA, 10311 bp, Myxococcus xanthus
  unsure (1)..(10311): unsure at all n locations
tctaaagcagcagcacgaagagcgaagcggagacctccgtcagaatcctctccttcctggaccggtacctccgacggagcccctgaagccgcgagcacggcttcgcacttgtgcaattgcatgcacagtggctgacacggccttctgttatttcatggggtttcgcattggcatgccccttgatgggtatgtgcacatgaatctcagcgcccttcgcgtccgtgctcttgctggcctcgtgtccgcgccgatgctcgcgcacgcccaggaagaaccgactgtcgcaccccattccgcgcctcccgctgtccatgggggaacccagaggttgagcagcgcggcggccctgggcgtgcactcgctctcggtggactccgtctcccccgcgtcgatggccttcatcgtggacatcgagcagcccctgtcaccgttcatctcggtgttcgcaggcgggcacgtgggcgtgaacctgaaggcgacgggcctccaggctggcggccgtgtttatctgaccgggaggcccttccagggccccttcctgtccgtccagggcgatggcaccttcttcgacgcggatgacgatgtgtcgaagctccgcgcctccgtcagcggactggtcgggtattcgcagcagttgggcaaccagtggcatatcgccttggcgggcggcgctgggttcagccacctccggcaggagaccgagctgccgcgctccgcgacctgcacgctgttctcctggtgtctgctttcgacgcccgagcgcaccgtcgagacaacgcagacgctgcatcccgtcgtgaggctcacggcggtacaccggttctagggcagaacatgcattcatggtccggtgaaatcggccttcaagggtgagcaggtgaaggccgtgctctcccggtggcacgaccatttccgcgtccgtctgtgggtacccacggagagccggacggtgcagacccgcgccatggcccccgaggagcagtccgactgactgcccgctgatgcgactccgaggtaggctgacaccatggtgcctctgaccgaccgggcttcgctacctcaggaagcgcgctccgccctggaaaaggagctggcgtccctgacgctgctccaggacgtcgtgcgatggggcttcgcgagctcgccgccgcgcgatgtcacggaggtcatcgtccaggacgagttcacccacgacgtagtgatgccgtggatggaaggcagctacctcgtctttgacacgacctgactgggcggagtcacttcggtctccgtgtgggaccaccgacccagcgcagatgagctcctcgatgcccggcttgcatccggatggacgccgacgcccacgagcaccgtcgacggcgacatcatcatgggacatgccgcgtgcagagtgccgcctcaacggccctgacagccggccgcctcggctgcccgctggtcatggtgccctatgcccccccagcaagggggaaggcgcgctcacggcgggcggcaacgtggccggcaaggctcccgcggtggcactgccgaacatgcgccggatgtggtcgccgtagagggtgatcgtcagcaagccaatcaagacgaggaatgagaacgcggccaccacggtcgccgccgtgcccaggagcgtgaccgcctcctctcgctgctggctccagatgcgacggcaatcccccgtgacaacggtcccatccggccggcggtaaagccggacacagacgcttccaccgggctggagcagtgattccacctccagcgtggtcatctcactcaggttgtggacggagagcctgcaggcaccacagtgccggacacgtgcatcccctttcatgtcctcccagcgcatctcgcagggcgtcgcgatggtgaggcgttccgtcagggcgcgtgtgtccacggcggaggacattatgggacacgcccttctacagacatcggccatccgtccgtaggatgaatgaccgatgcctcgggcgacacggaaccaagtcgccggctactggccgtcgagcctgccgtccaggttccggtcgagcgcgatgcgcgtaccagagcccggagggaccgcggtgaaggtcacctcctgccccgcggtgttcgccagcgctcggagcgccgcggtggagatgttcgcgctgccgtcatcgggcttccaggtcccgggaccccgttcgtacaggaaacccttcacccggctgcccacggccaccttcgcgaccacgtcggcctcgtaggtcgcgccaccgagcaccttcgacgtgaactgtgctcgggctcgcgcaatcagcaggtcgatgcgcgcccccacgttggcggcattcgatgccgtgagcgtcacctgctggccgacaatcggcgccaggtcggtatccgccgccagcatgaagtcctccatctggcgccgctcggtgtcgttccggaagcccacgaggggcccaccgatgctggtgttggagaacacgatggcgctgaagaagcggaacatggtgtccaccgcgccgtcatgcgtgaagccgaagccgcgaacctggtcacccaactgccccgtctccgggtgcaggaagaagctgctgtccgggaagccgaacatgccaaccttcgtgtacatgttccgcacgtggggaatcttcatgatctggctgatgccctcgaagctggaacgggtgtccgtgccgaagaagccccgcgcaccgtcaaccgtgtggcagccattgcaattgaacccgttgtcatcgccaatcgcgatgccgtccacccggcggcttccgaagtagaagtcgctcgccgctttctgcgaagccgtgagtgcgttgtccagccttcgaatggggttgggcggcagttgcacctggagctggaaggccgtgaacgtgtccatctccgcctcggtgggcatcgacgcgcggcccagcagttccgggaaggcgacgatgaagttcttgaaggacatctcctccccgccggcatcgacgccgaagaagccatttgaacggtcaccccgccagtgcatggcgccctggttcgacatgccgcgcagggtctgcgtcgtcatgggccccttcatcgggtggaactcgttctgcttccccgtcccgttgatgggtgagctcgggtggccggtgaaggaacggaagatgccaatctcgaggtcgctcgcgaggcgcatgttgatgggattggccgtcaccgtcgcatccgggttgcccaggtcccaggcgagctcgtccttgtcaccgaagatgtggcaactggcgcacgacgactcaccgttggccgatgagaagttggcgtcatagaggaacgggcggccctggacgacggaggcgggctccggattgtagagcgacaccgaggacagctgcgccttggtggccaggtcgatgacattcaccgcgttgtcgaagcgggtcatcacgtanaggcggttgcgtgcctcgtccaacaccagaccgctgggcccgccgccactcacggggatgtggttggcgctcgcggtgcgcgggtcgaacgcattgctctccagcgacgcggtgtcgtagacgccaatcttgctggagctgaacgcggccacgtacagcttcgtgccatcctgggagacgaccatctccgtcggcgtggagaggctgtggttcttcaccgaggggtcgaagccgggcttccccgccagcttcgagtagtcgatgtgcttgttgaggtgccgcgggtaggccgtgcccccggagatgacggtgatgcgcatctgcgcgaggttgccctgcaccgtgctgccgccatattcaccggcgccctcgaagcgggtcaggttgttggcctcgctgttggacgcatacaccacacccgacttcgggttggtgaccaggttgaagagggtggtccccacgcccgagaaggaagccgtctcctgaagggtgtccgcgtcgatggcgaagacgtccttgtccggcagacgcaggcgcacgccgttgttgaagttgcggcccagcgtgtcctgccactgcccggcggcgctgttccatttcacgatgagggcggtctccggcgccttcgcgccctcgaagttcgtggcgggcccaggcaagccgcctggcatgaggttgtttccgaatggcggggtgtcggggaagacgaggcacatgtcccgctccttgaacccgtcgcacacgctccccaggctgacggaggtcgtctgattgccggactgggcaatggccgcatagacagtcttcttgtccgggctggtggcgagcccgcgcggcgtgtcgccgaagagcgtcacgatgcgcaggggcgtgccgcccagcgtcgccccgagcgaagccgggttgaagacccagacgtccgcgcgccccacgccaggcgtggtcagcttcgggtcccccgagccaggaaccgctgcgatggacggatcggtgcggtgctggccccggtgcgcggtggtgatgaaggcatggccgttggtgcccgcgaagacgatgtcgcgcggctcatcgcccacgagcagcgtgcgcaccacccgcggcgtgcccaccatgctcaccacgctgacgctgtccgacaggtggttgaccacccagacttccgtgttgctgcgcgcagcgacagcgacgggctccaggcccacgggcaccgccgcgatgagcgagagccccgcgctgctgatggaaaagacctccaggcggttgtccggcgtgttgacggcgaacaaccgagtcccgtccggtgagagcgccaggggacgcacgtgcgcgctgtcgaacgtgatgaacgagggcacctgggccgccgcggtgaatgcggccaacaaggacaccacggcgcacaacgaaacggcgcgggcgcgccaacagttcctgcgcacgcccacttgctgagtacccaccatagggacctcctcacgagacgggaaagcgttgctgtccagggattagcagtggacttcgcgacaacgcccccaccgaagggaggggaaccggcccctccccacgcccaaaggcagccaccggcacggcgcgtcaggctttgctcgcgagcacaaggcgccgcaaagccgcgaaaccgcacatgtaacgcattgcggcgtccattacgtgacactcattgcggggttgccttcgcgcacctcaacccgactcgcacgttttccgtggtttagtgcctgacgcaaccggccgaagagggacgtgctcatgccgagccttcgaagcgctctggatctgctgcccacgaagctctcccctccccgggcggcatccgtgctggtgccgtgtggcgccgccttgcggagaatcgaccatggggtgagcgggaagctggtgctggtgacagccccgctcggctccggcaagacgacgctgctgacgcagtggtaccgcgaagcacgcgtgccgcacctgcttgcctggctgtcgctggacgagcaggacaacgctcccgagcggttcttcgcatacctggtcggggcgattcgccgggccgctccagacttcgacgcgtacagcacgagccagcccgagcacgcgacggccgtcatcctgcaaagcctgtggagcctgggccgcgagctcgtcgtggtgctggacgacttccatgtccttcgcgagcgcccactggtgcgggccttctcgtacctgctggaccactcaccaccgcacgtgcattgggtcgtctcgtcgcgcaacatccccgagctggacctggccaagctgaagctcaccgagcaactggtgacgctcgacggccgggacttgaacctggacggcgaggccatccgcgagctgggcctgcgcctgtgcggcgcggtgctcacgccggaggacatcgactccctccgcacgcggacagaaggctgggtcgctggcgtcaagctggcgctgctgtcggcgggtgagcacgcgagcgtgagcgatgcgctgaggaaggccattggctccaatcacgacgtggcccggtacctggcggacgcggtgctgcgcgagcaacccgaggaggtccgcgagttcctggtgctgagttccgtggtggagcaactccacggcgcgctctgcaacgcgctgcttggcatcacccgaggacacacactgctggggcagctcgagcggtcgcagttgttcatccaggcgctcgacaccgagcggcagtggtaccggtaccatccactgttcctcgatgtgctgcgcgcccagctcgcctgtgactacgcggaccgcattcctcggctgcaccgtgcggcgagcgcctggttcgcggagaaccagatgccggacgaggcgctgacgcatgcgttcgcctcggaagacagggactggtgtctcgcgctcaccgcgcgctgcatggaggcgtggatgcgcgagggcgagctcgcctccgtcctccactggaccgcgaagctgacggcgcaggaggtcatccggtcaccagccatctgcgtgggccacatcgcctgcctcatcctgtcccgtcgcttcgcgcatgcgaccgcggcgctgcgggatgcccagcaccacctcgacacggccgatgaggtatccgcccccgaacgcgagcggctgacgaagcggctcgcacatctcacgctgcttcacgccgtgttgtccgattcggcgccggacaccggcatggacctggacgcgtctccgggctccgaggagtcggacgtcttcatcgcgggcgccgtgctggcggcgaaggcctaccgggcgctccgaatgaaccgcttcgatgcgatgcgccgactcgcgctgagcgcccgggagacgttgcaggggcacaacaacccgttcctggtcggatacacggacgtccttgtcgcgctggcggaccgggcgcaggggaacatgaaggacgccgcggcgcgttgcgaggaagccttcgagcgcgcgagtcgtggacggcgcaaccccgtctgggcgaacgcggccacggcgctggccaacgctcgctatgagcagaaccggctcgacgaagccgaggcgctctgcgtcgaggtgctgccgctgctcccgcaggcctccgtgttcgagacgttcgcgctcgcctacctcatgctggcccgcatcaagacggttcgcgggaagtacgcggaggcgtaccggctcctggactacctccacggcgtgcttgagtgcggccaccagacgcgcttcctggcccatgtctgcggggagaagattcgcctctacctggtggagcaggcgcccgcacgaatgcgggtggtggcccaggagttcggcctgggcgagcgcatgcgccggggcgagtggagcgagaagcgcttctacgacgagacgtgggagcggctcggactcgcgcaggcgtgggtgctgatggcgcgcggccgtcacgacaaggcgcacgcgattctggaggtgctgcgggccagcgcgcacgaggtgggctatgtgtcacgcgagacggcgctgctggccaccatcgcggtgtgccactggcgcgcgggtgacgcgatggccgcattcgcagcattgaaccggggcttcgcactggcgcagcgcttcggcttcgggcgcagcgttttcgacgagacgccgggcctgcaggaggtcgtcatcgcggccgcccggcaacggaagctgagctacgcgtttcccgaccggtacgccacgcggtaccaggacctgctgtccgcgggaacgcgcgtgcctcgagagttcgcggctccaccctccgcgcccctggagccactcaccgagcgcgaactccagatgctcaagctgctcgcacaggggctgagcaatcaggagatcagcgagcgctccaacgtcgcgctttccacgaccaagtggcacctgcggaacgtgttcgccaagctggacgtgaccacgcgcaccgccgccatcgtcaaggcgcaggagcgcctgcagaggcacctgtgaaggctggggccgtccgtggaatgaacgctccttccacgccgcgccgcgcaactggatctcccgagcccccgctcccggacatggacagttgtcctctggcatgagagccctgggggcggttgaatcggaacatccgcgccaccgcatcgtgtggcaggcgcggcggggctccaggccccaggaggagcgtccgtgcccgcagcgaccatccccaccatcgagaccgagcgcctcgtcatgaagggtcacagcctcgaggactatgaggagtgcctcgcgctgtggagtgaccccgcggtggtccgctacatcagcggcaagccgtccacacgcgaagagatgtggtccaggctcctgcgttacgtgggccattgggacctgctgggctttggattctgggtggtgcgtgagaaggcgacgggccgcctcgtaggcgaggtgggcctgggcgacttccaccgcgacatgcagccgcccctgagcgccgggcccgaggcgggctgggtgctcgcccccggcttccacggcaagggttacgccacagaggcggtacgcgcgggcgctggcctgggcagatgcccagctcagccctgagcgcgtggtgtgcatcatcgcccccgagaatgcagcgtccatccgcgtcgccgacaagtgcggcttccggcagacgggccagggacgctacaagggagagccctcgctcatgttcgagcgactggcgccggtgaaggctgggacatgaccatggccccggtgaagcgacccacgctcaagcgcgccgtcaacccgatgcccgcgaatgtccgggcggcgttgctccaacgcgggctcatggacgcgtacaaggcgcgtccgccgtaccagcagaatgactatctcgggtggattgcccgggcaaagctggaggcgacccgacagaagcggctcgaccagatgctggacgaactggccggcggcacgaagtacatgaacatggcgtggtctggcgggcggaagtagcgcgcagcagcagggcgagagtatgcgcgaggtgcgaatggcaggtcgacttgttcgtagcgtccccgactgcacttcggatcttgctgggttccagcgggtgcttgcagagaccgtgcgctggtgtgcattcaaggtaactcagaagtcactcgaaacctgcctccgcacaccatacattctgcccaacccactcgtggtgtcgaatcgattcgacgcaatgaagcgtgttgcgtcgaatcgacagcacctgctcatgagcgtgaagggagcattggactcggatgctaagccagaccacggtatcctgcagggaggcagactgctcatcttcttcccagatggcacgttgagtgatggggcagccgaggcgtcctctcacgggtattttgatggtgagaacgggccgccctgggacacctgggtgggagtcttttccgacgagacgatgcctcgcaataccggcaatgactatctcatctcctgggttccccccatattcttcgacatggtcgaagcggggctcagggacaaccccgaatcttgcatccagtggcttgaccaaactgacctgagcatggcgcagcgcctcaaaggcctgcgctgagagcagcgccaatccggcacccattcctgcacgccgcacattcccagtagactgccgagaatgagaatcctcttcatcattctcactgcggcaatcacgctctgcctgtggccgacgacagcgcaggcatgtgtttgcgtcgcgggcggggggaaccttcacaccgacctcaaggtggcgcgtgagcgtgcgagcgccatctatcgggctcgcgtcgtcccagcccctcgtggcccctacttgggaaccgtggacgtcgaggtcctggaggtcatcaaaggcccggtcgtcaccggcgagaagttcaatcttccccagggtggcggaggcgactgccgggtccggttccggggcgaagcggagtatctcatctacgccgaacccaaagacgccaggttgatatggcactgctcccgctcccgaccgatgacctctttggatgatgcggagtgggtctggctcacgacggggaagctcccttcccttccggccgtggtccagcgcgaatccgtctcatgcgagccctgcgacatggaacgcattggaggcagtttgattacacccccagggaaggccctcatccctccgcatgaggaacgcaaggcacttgccttgatgaaagcccgtcgcccattcctcacccactccagcgctgcctcgaccgggcagcggttggtcatggtcggcaggtcatgggaaggcaagtcgttcgagctgattcaaacgcccgcccatgccgccgaagcacgctgcacacagcaggtccacctccgctggtgcaagcagctcaccgtatcgaagcctttagagcac

SEQ ID NO: 958 - DNA, 10391 bp, Myxococcus xanthus
gtcgccaacggtgtatttcttcgactccttgggcagcaacgcccagaagctgggggtcgtccgccgcatcatcgagaacacgcaactgctgagcagtcccacgctcgtggacctctccgccgccgtccagaccgacgggcatacctgtggcacctggatgctcgaggccgccaggctcatcctccaactgcgcctgtccggagtggacctggccgacatcggcaccttccacgccgaactcctggcactccaggagcagattggggacctgcacgcgcagaacgtccagttccaggaggactacgcggcggaggactccatcgacgaggactctcatgacacgacgggaaaggcctccatgggcgcgtcgaagaactcggacgtcgagttgatgagcgaggaggtcgacccgttcgccgaaggggaggtcgacccgttcgccgaaggggaggtcgacccgttcgccgaaggggagatcgacccgttcgccgaagaggtggaagggatgagtgaggacgactcctccgcctgagcaggtgggtggcacctcaggcggcgcgcgggcggcagttgacctcgatgaggaggcctccgggcgccgtgcagtacaccatcgtgccgcggttgttccggatgacctcggagacctccagcccgtcgcccttcgcgagggcgtggaactgcgtcaccaggtcttcactgtccacgtagaacccgaggtggaaccccagtttcacccttgacctcactctctgaagctcactagcacagccgcagaagagacctccgcgcgtcagaggcggacgcgtggaggtcactgcctcgtcgcggtctacgtcgccgcgtctgccttcggattcttcagcaggtggtcgccgtagtcctcacgcagcttcgtcttgaggaacttgccggtggacgtccgcggcacctgcgggacgaagacatagtcatccggcagccacatcttcgcgaactggcccgccaggtgcgcggtcagctcctccttcgtgacctgctgcccctccttcagtgccaccgcggccagcgggcgctcatcccacttcggatgtttcccggcgaagacggccgcctccagcacggccgggtgcgccatcagcgcgttctccagcgccacggaggagatccactcaccgcccgacttgatgacgtccttgctgcggtcgcagatgcgcacgtaaccgtgcgagtcgatggtcaccacgtcgcccgtcttgaaccagccgtccttcgtgtagcggtccgcgccctcatcgctgaagtaggacgacgcgacccagggcccccggacctccagttcgcccatcgtctccccatcccagggcagcagcgtgccgtcgtcgctggcgacgcgcgtctccacgaaaggcagcgcgaacccctgtgacgcccgcgccgaggacttcgcctcatgcgccgcctgccgcagcggccccttgaccttcgccatcgttccgacggggctcatctccgtcatgccccacgcgtgaaccacttccaatccatgccgctgctggaagccctcaatcagcgacggaggcgccgccgagccaccaatcagcatggaccgcatgctgctcaggtcccacttgttcggtgcctggtccagcaacgcgaggattccaatccagatggtgggcacgccgcccgccagggtgaccttctccgccgccatcaagtccagcagggagggcgggtccaggtgcggcccgggaagcaccagcttcgcgccggtgaggacggcgtcgaaggccaggccccacgcggcggcgtggaacatgggcaccaccggcatcaccgcgtccgcctcgcgcatgcccgtcacgtccgtcatgcaacacgccagggcgtgcagcacggtggagcggtggctgtagagcacgcccttcggattgcccgtggtgcccgacgtgtagcagagcatcgacgcggagttctcatcgagctggggaaagtcgaagtccggggactcggccgccagcagtgcttcgtagtcgagcgtcccctccggcgcggggcccgcgtccggcaccacgatgacgtggcggatgctgggcaccgcgtccttgaacttctcgaacagcggcagcagcgagcggtccaccaccaccacggagtcttccgcgtgccgcgcgatgtagcccaggtcattggggtgcaagcgcaggttgagcgtgtgcaccaccgcgcccatgcacggcacgccgtaatacacctccaggtgccggtagtgattccagctcagcgtggccacccggtcccccgccttcacgcccagccgcgtcagcgcgttggccagccggcacgtgcgcgcgtagaagtccgcgtacgtgtagcggtgcagcgacttgtccgggttgcggctgacgatttccgagcgcgggtagaatgtccgtgcgcgctccatcaagtggctcagcgtgagcgggaaatccatcatgcggcctggcagcatcggcacccttccttgtgacggcgtgaggaggtgccgatgctaacggagcgcggacccgtgcttcatccacgctccgcgatgctgcgttgcgtcagccgaagaagacctgggcgacttcgaagaactcctgcgggacgcgcttgagctcgcgggtggcgtccgccaggtccacgctgatgatgtcgttgcctcgcagcgcggccatcttcccgaactcgccgcgggccaccatgtcgcaggcgtggacgccgtagcgggtggcgagcacgcggtcatgcgcggtgggggcgccgccgcgttggatgtggcccagcacggacacgcgcgtctcgaagccggtgcgccgctcgatttcgtgcgccaggatggtgcccacgccaccgagccgcggcctgcctgcctcgtccagtgcgccgctggtgacgagctgctcctgctggtccgccgacagcttgatgcgcgtaccctccgccaccacgacaatggagaaggtgcgcccgcccgcgtggcggcgctggatgtgctcggccaccttcgcgaggtcggcgggaatctccggcaccaggatgacgtccgcgccgccagcgatgcccgcgtaggtggcaatccagcccacgtgacggcccatcacctcgcagacgatgacgcgcttgtgcgactccgcggtggagtgcagccggtcaatggcctcggtggcgatggcgacggccgtgtcgaagccgaaggtgaagtccgtggcgttgatgtcgttgtcgatggtcttcggcacaccgacgatgcgcagtccttcctgcgacatgcgcgtggcggccgacagcgtgccttcgccaccaatggcgatgacggcgtggatgccgttgcgttcgatggcgcgcttgacgcgctccagcccgttttcgaccttgaacgggttgacgcgcgaggtgccgaggatggttccgccccggtggaggattccggacgtggtttcacgcgtgaggcggaagtggttgtcctccaacaaccccttccaaccatctcggaggcccatcatctcgaagccgtgggcgttggcgcggcggacgacggcgcggatgacggcgttcaggccggggcagtcacccccgccggtgagcacggcgactttcatggagaaacgttctaccgcgcccgacgccagacgcgatgtccaagttcgcccgagcgctcacccggggaccttccaaccctctatccgaacaccgccggacgacgctgggcccaggggcgggcagcctccaactgggcggcgagccggaacagggtggcttcatctccaaagcgccccatgaactgaacgcccacgggcaggccgtccgggctccagtggagcggcaggctcatggcgggcagccccgtgatgttggccatcgggcagtgggaggcgaaggcgcccgcgcggagcagcggggccatgggctcgcccggtggcgaggagaacgtgcccagcggcggcgcgagctcgttgagggtgggcatcagccagacgtccacgtcatcgaagtgacggagcgcggcgcggctgtgacgctgcaattccgcgctggcgcgcaggtaggcggacaggccctggtccaggccatattggtagagggcccaggtgaatggctcgaagtgcgaagcctccggactgcgtcccaggcgctcggccatcgcgtcgatgctgaagacgacgcccgcggtccacacggtgatgaagtgctggcccaccgcgtcatcaccgggcacctccaggctgccctcgtccacgtggtggcccaggtcctccagcagccgggccgcggagtggatggcggccaggcactccgggtggatcgcggcgcccatggggtttcgtacggccacgcggatgcgcaggcggcccgggggcgtgttgacctcctgggtgtagggccgcgccttggcgggggcctggtagggcgtccccgcgtccgcgccgcaggtgacgtcgagcagcgccgcgctgtctcgcacggagcgggtgagggcgtgttcggtgacgagccagtggacggcgtccgcgatgtcgccgcccatggggttgcggccccgggtgggcttgaggccgaagaggccacatgcggcggcggggatgcggatggagccgccgctgtccgtcgcgtgggcgaagggcaccatgccgctggccaccgccgccgccgcgccgccgctggacccgcccggagagcgcgaggtgtcccaggggttgcggcagggcccgtgcagctcgccctccgtggtggggagcagccccatctccggcgtgttcgacttgcccagcaccaccaggccgctgcgccggtggcgcttcaccagctcgctgtcctggtctggaatgtagtccttcccgaagcgcgagccgtgagtgagcgggtgaccctcctgggccgtgagcaggtcctggagcaggaaggggacgccggtgaaggggcccggaggcagcgttccccgggctcgctcgcgcgcctggtcgaattgcgtctggacgaccgcgttgagcgtcgggttgaggcgctcgatgcgggcaatggccgcatccacgagctcgagcggcgtgggctcccggcgccggacgagctccgcctgtgccgtcgcgtcgagactgacaaaggggtccatgtccccgactttgtcatgattcacgcgacctggaagcgcacccggtgcatgcctatgtttcggacccatgcgcatccgcgtcttcgattccgagcgggaggccgccgccacgtgcgcccagcgaatcgcccgagcggcggcggcacacccctccctggtgctggggctccccacggggcgtacgccgctcaacgtgtaccgggagctggtggaattgttcacacgcggcggtttggattgggcccaggtccgcaccttcaacctggatgagtttctgggtgtgtcggcggacgacgcgggcagcttccgcgcctacatggagcggcacctcttccagcacgtcaacctgtcgcccgcgcacatccaattcctcgatggcgcggtggaggacgcggaggcggagtgcgcgcgctacgaggcccggctggccgaagcgggcggactggacctggtgctgttggggctcggttcgaacgggcacctggccttcaacgagccggcggacggactgcgagcgcggtgtcaccggacgcggctgagtcgtcagacgcgcgaggccaacctcatgctcttcggggatgacccgtcgcgcgtgccgatggaggcgctcacgttgggcatggccagcatcctccaggcacggcaggcgctgctgctggctttcggcgaggccaaggcggaggcggtgcgcggcatggtggagggccccgtgtccccccgctgtcccgcctccttcctccagctccacccggacgtcgaggtgtggctggacccggcggcggcccgcgcgctgtaaggcgctgcgactgcctcagctccggccattctccgcgggcgctgcgggcttcttcggctccttcgccgcggacgccggtgcctttgtgcgtgctggagccaccggcttcggcttcgccacgggcttcaccgcgggcggcgccttccgcggcggaggcgggcgcgtcagctcccacgccgcgagcaccttgggcacgtagaactccgtctcgccattgcgcggcacgcggccattcacggagcctgggcccgcgttgtatgcggccaccgcgagccgcacgtcaccgaagcgccgcaactgctgggccagatagcgcgcgctgccgtcaatcgccggctccgggtcgaacgggtccttcacacccagcatggccgcggtgccgggcatcagttgtccgggccccatggctcccgccggggagatgcggtgcacgcgcgtctccgactccacctgcaccagcgcgcgcagcagccccgggggaaggcggtgccggcgctcggccgcgtcgatgacgggctccaggggcgcgtgtccctccaccaggcacgacggccggtgcgccagatacgcgcgcagcgcgcccgccttggcctccaggaacgagaaggacagcggcgacacgaagctgttgccgaaccaggccaccgcgacgttgagcagcaccaccggcgcgagcacacacggcaaccaccacgcccacccgggcaccgtcatccccccacgccgtgccgcccgcttgcgtcccacccctccacccttaggggcgcttggggcctccgtccaacttccggcgcccagggcggacctccgggggaaggcgcagcccgtccagcaccagcgtggtgagcgcgtccggcagctccagcgggttgccgatgtcctcctcgctcagcaccgccagcagcagccgctccacggcgcccaccaccgccagtccgctcaccgccggacggatggggcgcagcagcccgctggtgtgcgccttctgcgtgatgtccaccgcgtgacgcgccacctgccgcgccagctccgccaccttcgtccgcgcccccaccgccggcccccggcactcctggaggtacagccgcaccacgcccgggtactggagcagcgcgctggcaatcaccgccgccaccgcgcggtacgcgtcgaacatggcctccacgttgcgcgcctccgccagggagtggccgcacgtctccagcccggccagcagctcgcggcgcaccggctccagcaggccgtccaccagcgccgccttgtcgtcgaagtaccggtagaacgtccccttggccaccccggccgcctgggtgatgtcgtcgatggtgacgccatccaggccccgcgccaggaacagcttcagcgcggcgtcctccagtgtctgctcgcgctctcggcggtgggcctcgcggcggcctccgggccgtgcgggcggcttgcccgtctcctgggcgccacccgcccgcgtgccatcccggctcgccattaccgtgcgctcccgtccattgcgcggtagaaaaagagtgaccaaatagtcatttatgggaagcgaagcgccggccgggcgcttcgccggaggcgaccatgatcggcatccccctgggctgggtttactccaatttcggtgaatgggtccttcacaggtccgtcctgcacggcctggggaagaaccggaagagcttctggagcttccactggcacgagcaccaccagaagtcgcggcgccacgacatggtggatgaccagtacatgcgctcgctgtggagctggtcggcgcagaccaaggagctgatggggctggcggtgctggcgctggcccacgcgccgctgttgccggtggcgcccttcttcgtcgggacggtgtgggcctgcgcggcgaactactacttcgtccaccggcgggcgcacctggacccgaagtgggcgcgtgagcacctgccgtggcactacgaccaccacatgggcaaggaccagaacgcgaactggtgcgtgacgcacccgttcttcgacctggtcatgggcacgcggcgcgagttcctcaacgtgcaacctcccgcatccaagcagcccgcgcccgtcgaacagcccgtgcccgcgcccgtggaggcccggaagcgcacggcggcggcttccgggctccggtagctacgggcggcctagaacaccaggtcgaagtagttcgcgtgcgccttcacgcccgcgcaggcgcgcagcgaggcggtccagtcctcggaaggcagcgtgccccgggcgtcgaagatgaactcgagctcgggctgccgggccaggtccatcaggtccaccgggccggtgctggtgagctggatggtgcgcgtgggcgcggtgctggtgcgcgtgtactcaccgatgacgtgggtgtcgttggagcccggctggcgcacggagacgttggcgcgctccacgccgctgaggtccgtgtcggccgtcacctcgaagacgcgcagccgaagctcggtttcgatgtccgtgtcctcgggcagcgggtcggagatgtcacccagcgggaaggtgatgctccgctccacgttgacggtgagtggcagcgccgcggggaaggccaggtcgcgctccgtcttgcagatctcctcggcctcggcctcgatgaagaagagggattcacagccggtggcgagcatcgcgatgctggagaggagcaggatgcggaaggaagtcgttcgcatggttgaaaagctcctggctcagaagaagtagaggatgaagcccagcttcacggagggcatggtggcgcgcacggagaggttcctcgcggtgacgtccgggtcatccgtggcgtcctggagcagggcgctcgcgtcgtccacgcccaggtccacgtagctgaggcccaggtgcagtgaagaagttgaagcggctggccgcgcccacctccaggcccacgctgccggtgacgtagttgtacgtcacgtcgcgaatggccgcgctggcccggctcggcgtcgcgcccagccagtccaccacgtcgttgtagtccgaaccgaagtagtgccccgcctccacgttgaaggacggcgccaggaaggtctgcatcggcaggatgctcaggccgccgcgcaagccgaagctgagcgtgttggtggtgggacccgcttgcaagcgcagccacggcagcggccgcagcaccgcggacaggcccacgccgtgcggcgcgcccgcgtccagcatgaggccaaagcggtgtggggtatccgacccatcggccagggccggtgtcgcggcccccaggcccagggcgcaggtgagcgccgcgccgtgccgtcccagcaggaatgtcctttgtcgtctcgtcgaggatgtcgccatcgtcatgtcgtgttccagcgtgttccggcccggtggccatcattcgcgcgaccgggcggaaaatgaagcggcgtcagggaaaatgacggcgggaagaggccgcttcggcgctggtatccgacattggcggcctgggccgccggtaattcagggttctgccgtccgattggcggcgagcccgatgacgttgaccatcaaatccttgatgcggcgcggcttctctccgccgttgtcgcggaggatgaggtcgatgtcgtcgtcggcccggtggtactcggggatgaggtctccgccgccgttggggttggacaggccttcgaacatgaagaggacgtcctcgcccttgcgtccgaaggacgcaccgtcctgccggtcgcggaacacgttgatgtcccggttgatgcggtcgaacgggtcatcgagcttcgcgttcgcctggtccagcacttcccggaagtagttgggctgcccgcgcgagttggtgtccaccaccgacaggcgctggtcatcccagcggcccaccatgtccacgttgatgacgccggcaatctcctccatgccgagccccggaatcgggtggtccacgaagtactgcgagcccaccaggcccttctcctcggcgcccgtccacagcaagagcacggagcggtccagctcgccgcgcttggccgcctccgccagctccggcaccgccgccatcagcaccgcgctgccggaggcgttgtcgtccgcgccgttgaggacgttgccgcgccggtccacgccatcgtggtccaggtgggccatcaccacgatgacctcgtccttgttgggccccgagcccggcagcagcgccatggtgttcaccgcctgtccggacgcggaggccagctggcgcagctcctccacgcttcgctgcgcccccgcgcgcggcggcgccaggggcaggccgcgcgcgttcatcgacttctcgtactgctggttgagcagcgcgagcgtctccttgggcatgttgtcgtcgaggtagaagccgccctcgaacagcgcgtgtccgtaggtgctcggcgtgtgggcgtgctcgcccgactcgccgcgcaccccgggccggcccgcgaacgagtacacgtcgaagcgctgctcgaaggcgttgctttagagcac

SEQ ID NO: 959 - DNA, 9125 bp, Myxococcus xanthus
atgctcaccgtcaactgcaactcgccggtgaagtcaccctccgcctgcggccggaaggccaccatggcgctgaagcccgagtcgtacggtaccacgccgcccgtgagccggccgcccggcatgaagaagacgccgccgccgttgttgctgatgtggatgttcttcacggcgcactcggcgctgcccgggttgcggaagtagaagccctgcaccgcgccccggcctggcgtcacgttgccgaagtccatcaccggctgcggcgtcaactcgtacacgcacggcgcggtggcgcgcgagcggccagtgaggatgatttcgcgctccgggttgaacaggtcatccgagcgcacgcgcagcgcggccgtccacgtgcccactgaggtgggctcgaagtagaccttcagctccagcgcgtcggtgccaggggcaatgggcagcccgggcgtcgcctccagcacgggccagacgccgccgctccacggataggcctcggtgccgcgcgtgggcacgtccacgctgaactgcggactgtcgccgcccgccgccacgccgaggaactggagggggccgttggtgcccgcgttggagatgcggatgacgcgctccaccttgccgcccaccggcacctcgccgaagtccagcgacaccggcgtcaccgccagcgtgggccggccgccgcgcgcgtccagaatcacctgcgaattgcgcgccttgtcggacgtgtagtgcaccgtgaggtcgcccacgttgggaccggagtagcgcgccgcgaactccatctgcatctcgacgacttcgcccggggcgacggaggagccctccggccgggagagcggcacgaaggcatggtcgctggtcaccagccgctcgatggtgacggggcgccaggtgatgttgcgcgcgcgtgtgtacgactgcgtgcgctcatgcacgggaatcaagtcgaaggggacgggcgccgggtcgaacacgaaggccgaggccaccgagttgcccttcagctccacggtggccggcgtgcagccctcacaggagagaatctccaggcgcgcgcccatgttccccagcgcgcggggcaggtacctggtgctcaccttgcgcgacgacagtggggggatggtgatggtgtccgcggcgaaggggtccgggtgcgtgcccgccaccgtcagcgtcagcggcaggtccacgggattcgtcaccgtgacctccagcgtgcgctcgctgtccacctcgagcgtctcgtagtccaggaagggcggctccacgccgatgggggtgggcgtgcccacgcccatcgcctgcacctgggcttccgcgccttggttggcgtccgtcttgacgtgcaccgtctccgtcgccaggccttcggtgagcgggtggaagcggacgtgcaccacgtgggactcgcccggcagcacccgttcggcgccttcgcccagctccacttcataggaggggttgttggccagacccagcgcgtccagggcggagaagggcacgtacccgacgttgcggatgcggaccttccgctcgcgccactcgcccacgggcacatcgccaaagtcgaggaggtccgtgtccaccaccgcggtggcctgcaccgcgcgggtctccttcccctcgtggcacgccgtcccgatggttacgagcaacgccagtgtgagtccacgccctgtcagccccatcctcattgcccgctccccacccttctccccacacccaccagcccgtgcccggtgagtgatccgccccttgctcctccatcaatttacgtaccagcccagggagcgagggggagtctccctgatttcaggaggttggcgtgatgtgggtgtcatcaggttggcaaagaggaagggcgatgctctggagggtgaaagactttcccgtccttctggcggtgaggaagtgtgggtgactgtcagcggatgaggcgaatgagcgcctccgcgaccattttgggctgctccatgtggacgtggtgtccgccggggaggtgcagcggtggatgggcgagggtttggagcgcctgcgtacggttgcgcatgagggcttcatcgtggcgcagcccgccggtggcgaggatgagctgcagcgggcaggtgacgccggcctggagcgccatccactgggcctcgtcataacccatgccgaagcggcggcggtggcgcgggtcgaaggtgaaggcgaagccgccctcgtagggctccgtcccgtgccgggcgaggtacagcgccgcgtcctgcgtcagcgtggggctgttctccagcagccgtgccgcggcggcttccacggtggggtagcgcttgcggttgggcgggcggcgcgcgtcatccagtgcgctgcgcagccggcccagggccccttccgcgggcccgccagcggggcccaggctttcgatgagcgtcacgctcttcacgcgccctggacgggcggcggcgtaggcctgtgagacgatgccgcccagcgagtgccccaccaggtgcaccgcgtccaggcccagcccgtccagcgtggcctctacgtcgagcgcgtagtcgctgaactggtaggtggcgccgggacccacgtgggcgctgcggcccatgccccgaaagtcgagcagcaccagccgccacgtttggggcaggtgcgggatgagggcatcgaagctgtgggaatggtccagccagccatgcaggaaaagcacagcgggcgcgtcgggcgcggggcgctgccggacattcagcgccaggccttcggcatcaacagagagggattcgagcgcgtcggacacgggagcctcctgccccgtgccttacccggttcacgcgcccgggagaaccgtcatccacgcccggacgcggcgcgcgttcagcggggtccagcgggttgtcgcggcggcccacccgtgtcgggccgagagagaatcatcgcgagctggcgcgcctgattctcggtggcgcagcggtactcctgctgcttgccgttgtccttctcgatacggagaacccagacatcgttttccttcgtaacattcgcctgctgggacatgtggcggttcctccccgccgcggggaagagcatgtttcatgccgcacaggagagcggcctcaaaggcccgaatttccggcactgcgccgctccgcctctggagcggggtgacaaaaattgtgcacagttgcgacaattttggccagaaagcctcgcatagattgcgtagtgccccagggcgggtctgcctttaccctgttacaacccgaggtgtcaggtgtcctgggcgtcaggccattcccaggcggagcggtagccgccgtgggtctgggtcccctcgacgaagcgggcatagaaggggtgcccgctgagcgtggcggagtcgcccacgacgaagaggtgacggcgtgcgcgggtgagggccacgttcatgcggcgcaggtcggtgaggaagccgagctgcccctcactgttggagcgggtgagggagacgatgatggcgtccttctcccggccctggaacgcgtcgacggtgtcgacctccacctcggggctgagcgcctcgatgcgctcgcggagctgatgggcctgggcgctgtagggcgtaatcaccgccagctcgcggggggccagtccggcggcgagcagggcgcgcacgcgggcttccaccagtccagcctcgccggggttgaagaggcttcgcgtggtgggctcgacttcttcgtcgaagcccttgcccgcggtgtccaggtagagcacggggggcgcatccacgtccgcgccaggcgtgaggacggcgtccagcgtgcggtccgcgatggaggggtgggcgcgaagctcgccgccgtacatctcccttgaggggaaatccatgatgcgcgcgttcatccggtactgctcgcgcagcatgcgtttgacgccctctccatggtccttgagcaagcgctcgaagaggctcacgcccaggccggccttcgcggcctcctgggagaggacggtgggcggtagctgctgcgggtcgccagcgaggatgacgcggggggcgcgcaggaagcccagcagcgccaggggctcggttgcctgggtggcttcatcaagcagcgccaggtcgaactgctgtccagagagcacgccggagtcgaggctggagagcgtcacgcagatgacatccgcgttggcgagcacggacttcacggccttgcgctccagggcgcgggcctcgtcgagcatgcccttggcttccgtggtggacgcgcgggcgttggcgaagcgctcgcggctgcggccttggttgcgctggcggcgcgcgtagcccagcagggagaaggcctcgtcgaagaggtcgcgggagacggcgcggtccgggtgggactccacgacgatgtccagggtgtgttcctggagccgggcggccacgcgggcggggtggcccacgcggatggcgcgcaggcccttgtccaggcacaggtccaacaggtggtccacggcggcgttgctggcggcggtgcagagcaggcgcttgccgtccgccacggcctgggcggcgacctcggccagcacggtggacttgccggtgcccggaggccccgtggaccaggaagaagtcctcgccggcgagcgcgcgggcggtggcgtcctcctgttcggggttgagggggcgggtgggctcgaactcgcggggcttgtcaaagcggggcggctcgttgcccaggacgacctcgcgcttgtgccgctcggcgcccttgtccagggccttgatgcgctggaggccggcacgcagccggtcataggtgacgtcgttggggacgacgtccaggcgcaggaggccctcgtggacgtagggcggcggggagcggtcgaaggcgagctggatccgcgtggcggtggcgcgggagatgagcgcgcgggcgggctccttcacctccgcgcggcggggcagcacggccaccaggtcgccgttgtgcaggcgggtgggcaaggggcggcggtccgcgcggcccagggtgacgaggaagcggcctcccaggccgacctcctcctcgatggactccaggtccaggacggacagcccgtgctcctcgcgctcattcagcgtgaggctctgggcgagcgcggccaggcgggctttctcggcctcgcgttcctgggcgaggagcgagccgagctggtcgaagaaggagacgtcacgggccatgggcacgtcatgccaccgggccggggccagggccagtgggacggacgtccgcgtgttctggagtgcgagagggagcccaaaggctggggtagaatgacgggatgctcgggatgcatctgcctgggggcattgtcgaaaacgtgcgcaagcgtcccggcatgtattgcggtgacgttggcgagtacgggctgcaccacctcgtctatttcctcctggacgttgcctacgaagaagctcgccgtggggagtgcagggacgtggtgttggaggtgggaggggatggttccatcgcgctcttctgcaccagtcgcaccgttaccgccgagaacttggtcagagtggcgacgggagcgggcttcttggggcgtccgccgggcgatggctggggctgggacagcatgctcgtcgtgtccctggccttgtcttcccgctaccaggtggacatctgggcggacgggcggcagtggcgggtgatgggcgagcacggccatccccagggagagggggcggcggtgacgccgatggagccaatgcctgtctccgcggagcgaggggtacgcgtccacttcgttccggacgcgaccatcttcgaggtgctcgccttcgacagggctcgcctttcccgtcgctgtaacgagctggcggcgctcgctccggggctgcgcgtcagctttgccgacctccagcggggagagcgcacgctgtggcatctgcccggtggcgtggcgcagtgggctcacgtcctcacggaggctcggccccagctccaccccgagccggtcgtcttcgacttcacgtgggatggactgcgcgtccagtgtgcattgcagtggtgcgaagacgaggacagcacgctgctgtcatttgccaacgccgtgcggaccgtgcggcatggcgcacacgtgaagggcgtcactcaagcgctccggggcgcactggcgaagctctcaggtgagacgcggggggcattcccctgggctcgggtggcgcagggcctgacagctatcgtcgccgtgagtggaccccggagacagatggcgttcgcgggccccaccaaggagttgctggccatccctggcctggaggaggccatccgcaagcagctccagcccctgttcatcgagctccttcgcgagcacccggtgacgccggcactcctggcacggcgtacgagcggctcgcggtagtcctccagaaacagtccgggccggcactcccgcgaagggaacaccggcccggcgcctgcgtcagctcaaccctggcctgctagatcttgccgccgctcacaaccagcgcgtaggtcgcgtccagcacgcgcgtcgccagattcgtgtcctcgatgatttcgtcaccaatcacctccacggtccacgtgccggcggcggggttggcgaggaacacgttctccaccgtatccaccttgttcgacacgccgcccgccgtggagacgttgctcgccgtcaggccgttgttgccccagtagacgacgccggtgggggacgtcacgcgcagcgacaggtcgttgatgcgggcgtgcgccgcgcccaccgtgccggcggggtcggtgtagaccatggtgacgttgagctccgtctccccgggagccacggtgacgttgtacgtattcgtgccgagcgggagcagggtgtccgtctcgttgatgatgctcgtcacggcggcgcggtcatacaggcgcttcacgtccgcggtaccccagccctgccgcgcgcgcgtcaggtcaccgttggagccgcccgcgagccagttgtagcgatgggccatgttgatcatcagcgccttcgccgtggccatcttcggacggctggcgaagacatccgcgccaccaccgaagcccgcccagacgccctcgtgccacatctggaacagcaggccgaagtgccccgccgtctgcggcgtggccgcgctggtgccgccgaagttggtgtaggacgtgttgctggtgttcgacgcggagcggatgaggtcgtagtagtacgacaggtccggcttgagccggccgtccgccgccggacccacgctggcgccgccattccaccggtcatccccgcggttggtgttgtcgtagtggtacatgccacccacggacacgatgttcttcgcccacgcctgtggccgcgagttctggttgccggtgttgctctgtgactgcgtgctgaggatggggtactggaacaggtagtcatccacctccgcggagatggtggtgtagctcgtcacctgcgcgctgcccacgctggacgtctggaacacggcgcggtacggcccggccgggtcgatgagctcccggttgatgtcgtagcgagacttggcgccgccgaactgggaggactcgttgtagcggtagaagatgccttgtccggaggggaccaggccgcgcgcgttcccgtccacgccccgggcgaagttgatgctgtagcaggcggtaccgtggaagctgcccgtggtggacgtgctgtggatgaggggaggtgtcgcccactcctggtgcgtggtgcgcagctccgtgtcgaagatttcgccgcggacgccctgtccgctgaagccctctaggccttcgaggtaggtcgcgccgcccacatcgcggacgttgttgttgtcgagctcacccggcccgccccagcggtcgacgtactgcacggcgttggagcgaatcagccgctccaactgggactgggtgagggtggcctccacgcgcaggccgcccgcttcgatgagctccaccgtgccgcccagcgtgcggaccagcgaggcgacctcgccctgtcgtgccgcgccgcgctcgcccaccatgatggagtagcgctgcggctccagcttcagcgagcgcccctggagggactcgcgcagcacgccttccacccggtactccggatggtacgcgcccacccagcggacatagggcagcccggcgacgcgcttgtgcgtgctgggactcatctccacgaggaaggtgtggtccgtgaggaagcgcagcaccttgccccccgcggccttgatggcgtcgcggtactccggcaggggcgtggcgtggaactgcaccaggtgcagggtgttgctggcgtccgaggtgagcacgcccgcgaccaggggctgtgcgcccttcagcgggtcgaagcgcgcgtgctccagccgcaccaggtactcggtcggctgcacgcggcccagcaacgccacgccgccctggctgtaggcgaagaagtcctggcgccggccgtccgccgtctcttcctgccaggtgtggagctggaccgacgcacgcggcacatcgagcgtcttcaacgcatggatgggctgggccgtccggtggaagatatgcccggcgctcgtggcaagggcatatgtgccgctcgccgcgcggtcgatgcccgtggcgaggcgcgccttgtcgacctcggcaccagtgaggacccgggcggggcccagcgccgcggtgctccggatgatgccggggcgcagatccggtgtgttcgcggcgagcgccgtgactggcgcggacaagccccaaccgagggccaggagggacagcggggacaacgaggacggcatacgcatggtgggtctccttgagagggacttccgtgctgcacgacgcttgaatcctcgaaaaaacgagaagtgcttgttagtctgcttaagatgagtgtgtcaatgcatgcccaagtctgggaattcattggaatgaaaggcattcgtggcgtttgggtgacactgcggatgcgatagatgtgtcgggttgactgtctttttcgcgtggcagcgttatggctggggaccgtcgctgtcaggccctctcatgcggaggcgtccggagccgcacgtcatggacctggttctctttgttggcttgcagggctcgggcaagagcagcctctaccggcagcgtttcgcggccacgcacgtacacgtcagcaaggacctgtggcctcacgccgttcgc

SEQ ID NO: 960 - DNA, 10692 bp, Myxococcus xanthus
accctctcccgcgtgaagtcgggcgcgcccaacgcagtgggggtcgacatcccccaggagctctggattgccatgggcatctccaccacgtcccttctgggcacaccgctggtgctgggcggcaagcgtgcgcgcagcccggacgagaagctggtgcagaacacctccgtccaactcgcggaggcccccgcggacatcgacgctcaccgccagggcgtgctctacgccaacgcgaacatgacggacgcgcgcatggcggacatgttccagggagacgaggtgggcaacaccgcgcacatcgacctggccaaggtgcagatgttctatttcacgctcatcgcagcggtgggctacttcatggacgtggccatgtcggtggcgcgcgggacgacccacgcgatgcccgccctgtcgcaaggcatgctcgccctgctggccatcagccatggtggatacctgctaggaaagacaggcgaccactcgaactccaagcagacctgacgccgcgcgcgaagcgttacgacgcagcgcatgaagcgttaccgcggtaacgcgaacgtcaccttcggtaacgtcctgacgcgccgagccaacctgcaacgtcttgaatctccgagcgcggcgcgttggcagacacgttgctctgtgctggggcatgcgcactgcccccgcacgcatgctgtcgttcatggccgcgctcgcggtcctgctgtcagccactccgtcgagcgcattcaagattcccatcagcgaggagtcctacctcaacgtcgccatcctcctgcagccgcagctccagattgtcgacgaaggcgcgccgtccggcggccccagctccgacatgttcctgcggcgcacgcgcctgctcgtcttcggccacatcacccagaagctgtcgttcttcgccgagacggaccagcccaacttcggcaagaacggcgactggaacgtcgccttcttcatccaggacgcgttcatctcctacgaggtggcggagaaagtctggattgacgtgggcatgctgctgccaccgctgacgcgccatgtcctccagggcgccgtcgcgttgcaggccgtggactaccactccagcctggtccgctgggcacctggcgtgggcaaggtgtggcgggacatcggcgtgcaggtccgcggcttcgccggccccttgggattccgggccgccatcttcaatggcgtcaacggcaagacgaccccggatggcaccgtgctcaacccggacgatttgcctcgcatcacggcgatggcgcgctggaacttcttcacgcgcgaggaggacctcttcttccaaggcatctacttcgcctccgagccgcgcttgtcggtgggcatcggcgccgactaccagcccaaggcggtgtccacggaatccggtctccatgattcgttgggcacggccgcggacgtgttcctcgacgtgcccctggcgaacgaccaggagttcgtcttcaacgccaccctcttccactaccgccagggcttggacaacccgcagagcggcacagggctctacgcggagacgggctggcgcttcggcaagttccagccgctcatctccggcgagtacttcaaggcgcgcgtggacggccaggacctgctcgcgctcaagcccggcttcaacatctggttccagaagcacacgctcaacctccggacagaggtcgccgtcgcgtggacgggcgacatctcccaggcacgtgccgccgtgacgggcacgagccagctccagctcttctactaaccctcctccactcccaaggaagccaacgatggcccagacgcaggaagcgctcattcccacgaaggacgccttcagccgcaaagcccacgtgaagagcctggaggactaccagcgcctctaccagcgcagcatccagcagcccgaggccttctggagtgagatggctgaacagctcacctggttccacaagccagacgccatcatggacctggacgccgaacaggtggacttctcctggttcggcggcggcaagctcaacgcggcctacaactgcatcgaccggcacgccacggagcgccccggcaaggtcgccatcatctgggcgaagaacgagccgggcgagtacgaatccatcacctaccgcgacctccagcaccacgtgggccgcgtggccaacgtgctgaaggcgcacggcgtgcgcaagggcgaccgcgtctgtatctacctgcccatggtgccggagctggcctacaccatgctcgcgtgcgcgcgcatcggcgcggtgcactccgtggtgttcgccggcttctcatcggaggccctgcgcgagcggattctcgactccggcgccaaggtgctcatcaccgccaacgaagggccgcgcggcccgaagttcgtgcccaccaaggccatcgcggacgaggccgtggagggcctgtccctggtggagtccatcctcgtggtgcgccgcacgggcaaggaagtgcccatgctcgccggccgcgactactggctggacgcggagatggcgaagcaccgcggcgtctgtcccgcggagtggatggactccgaggatccgctcttcatcctctacacctccggctccacggggaagcccaagggcgtgctgcacaccaccggcggctatctcgtctacgcggccaccacgttccgctacgtcttcgacatccagccggaggacgtctacttctgtgcggcggacctgggctgggtcaccggacacagctacatcctctacgggccgctgatgaacggcaccaccacggtgatgttcgagtccacgcccaccttcccggacgcagggcggctgtggcgcgtggtggacgacctcaaggccaccatcctctacaccgcgcccaccgcgctgcgctcgctcatcaaggagggtgacgcgtgggtgaagaagtcctcgcgccagtcgctgcgcctcctgggcagcgtgggcgagcccatcaacccggaggtgtggcgctggtaccacgacgtcgtgggcgaaggccgctgcccggtggtggacacgtggtggcagacggagacgggcggcatcctgattgccccgctgccgggggccacgcccaccaagccgggctccgccaccctgcccttcttcggcgtggagccggtgctggtggacgacgagggccgcgtcatcgaaggcaacggcgtcagcggcaacctgtgtctggcgcgctcgtggccgggacaggctcgcacgctgtatggccaccaccagcgcttcaaggagacgtactacgcgcgcttccccaacctgtacttcaccggtgacgggtgccgccgcgacgaggatgggtactactggattaccggccgcgtggacgacgtgctcaacgtctccgggcaccgcctgggcaccgccgaggtggagagcgcgctggtggcccatgaggccgtcgccgaggccgcggtggtgggcttcccgcacgacctcaagggcacgggcgtatgcgcgttcgtcacggtgaagccggactggcaggagtccgcctccgagcagatggtgggcgcgctcaaggagcaggttcggcatgtcattggccccatcgccacgccggaccgggtggtgctggtcaacggcctgccgaagacgcgctccgggaagattctgcgccgcatgctccgcaagattgcctcgggcgaggtggagaacctgggtgacgccagcaccctggcggacccgtcggtgctcgacgaactcctcgcgaaggccacacccccacaggcgaagcgctgaccggaggagaattcccatgtccacgaatccgaatgaggaagcgctggaagcactcgcggcggcgcgctggcgcgtggccggcgtgctcaccgtgacgacgctggtggcgtacctgggcttcatcctgctggtggcgttcgacaagccgctcatggggcagcagctcgtccccggcctgtccattggcatcctgctgggcgcgctggtcatcgtcgcggcctgggcgctgacgggcatctacatgctgtgggcgaacgggaagtacgaccgcgccctgcaccaactccgcggtgggaagtgaggcaggcatgaaccccgcagaaacgacgacgcagctcggccagccgaacgcgacggccatcctgttcttcctcctcttcgtcggcgtcaccctggcgattacgtactgggcggcgcgcaagacgaagacgacctcggagttcttcgccgcgggcggcggcgtgagcgcggcgcagaacggcttcgcgctcgcgggcgactacatgagcgccgccagcttcctgggcatcgcgggcctggtggccacgtccggcttcgacgggctcatctactccgttggctggctggtgggttggccggtcgtgacgttcctcatcgccgagcccctgcgcaacctgggcaagtacaccttcgcggacgtggtggcctaccggctgaagcagacgccggtgcgcctgtccgcggcggtgggcacgctcaccgtggtcagcttctacctgattgcgcagatggtgggcgccggcaacctcatccacctgctgttcggcctgtcctatgaggcggcggtcgtcatcgtgggcgcggtgatgattctctacgtcctcttcggcgggatgattgccaccacgtgggtgcagatcgtcaaggcggtgctgctgctggcgggcgccacggggctcgcgggcatggtgctgtccaagttcggcttcagcccactgcggctcttcaacgaggccgccacccaatacggcgcggaggtgctggcacccgggaagctggtgaacaacccgctggaggccatctccctgggcgtggcgctgatgttcggcaccgcgggcctgccgcacatcctgatgcgcttctacacggtgccggacgcgaaggcggcgcgcagcagcgtcttctacgccacggggctcatcggctacttctacctggtgacgttcatcctgggcttcggcgcgtccgtgctggtgggccgtcaggcgattaccggcgtggacaagggcggcaacatggcggcgcccatgctcgccgaagtcgtgggtggcacgggcttcctgggcttcatctccgccgtcgccttcgccacgattctggcggtggtggccggcctgacgctgtccggcgcggcggcgctgtcccatgacttgtggtccagcgtggtgcgcaaggggcaggcccccgaggcggagcagctcaaggtggcccggctggccagcctcttcctgggcgtcctggccatcatcctgggcgtggccttcaaggggcagaacgtggccttcatggtgggtctggccttcgccatcgcggcgagcgccaacttcccggcgctgctcctgtccatggcctggaagaagttcaccacgaatggcgcggtggccagcatgctgacgggcgccatcagctcggtgctcttcatcttcctgtcccccacggtgcaggtggacctcctgggcaacacgtccgcgctgttccccctgcgcaacccgggcgtcatcaccattcccctggccttcatcgtgggcgcggcggtgtcgctgctcttccccgagcacgagtccgccgcccgcttcgccgaagtgaagcaccggatgcacgtgggggtgccccagccggcccccgcggtggccaccgtggcatcgaagcccgcggatgagccgtcccgccccgccgccacgggcagcgaggccaaggcctgaggacggacattcccctggggcacgggtcgcctacactgggcccgtgtccaacgcctcagagcagggccccaccgagggcctccgcggtcggttgcacgaaatcatcttcgaggcggagacgcccgcgggcagggcattcgacgtcggcctcctgtgggccatcctcttcagcatcatcgcggtgatgctggagagcgtcgcctcggtgcgggcccagtacgggagcctgctgctcggcgtcgaatggttcttcacgggcctgttcaccctggagtacctgctccggctcttctccgtcagcaagccgctgcgttacgcccgcagcttcttcgggctggtggatttgctggcgatcctgcccaccttcctgagcgttctgattcccggggcacagtccctgctggcgattcgagtgctgcggctgctgcgcgtcttccgcgtgctcaagctgtcgcacctgctcggccaggcggaggtgctgctcaccgcgctgcgcgccagccgcccgaaaatcaccgtcttcctgggcaccgtgctgaccatcgtcgtcatcatgggcgcgctgatgtacgtggtggagggccaggagaacggcttcgacagcatcccgcgcgccatgtactgggccatcgtcaccgtgacgacggtcggctttggcgacatcacccccaagacggcacctgggcagttcatcgcctccattctgatggtgatgggctacggcatcatcgccgtgcccacgggcatcgtctccgtggagctggccgccgccacgcggcacgcggtggacaaccgggcgtgccccgcctgtggccagcaggggcatgacctggacgcgcatttctgcaagcactgcggtcacgggctctaggtcgcgggcgctcgcatggcccccgtaccagcggccgggcgcctcctggactggacggaggcggaaccggcgtccgactccagccaatgcccctcacagggtgaagcttatcgacggagccctggctctcgatgccctggaggcaaccatgctcttccgccagctcttcgacacgacgtcctcgacgtacacctatctgcttggggacgaggaacaaggaacggcactcctcatcgaccccgtcgcggagaagctcgaccgggacctcacgctgctgcgggagctaggcctctccctcacccatgcgctcgacacacacgtgcacgcggaccatgtcactgcgtccggcctgctccgggctcgcacgggcgccaaggtggtgagtggcatcaccggggcaccgtgcgctgacatccacgtgaaacatggcgacacgctgcgcgccgggaccttcacgctccaggtgctcgcgacgccgggccacacggatgacagcgtgagctacctgttgggagaccgtgtcttcaccggggatgccctgctcatccgtggcaatggcaggacagacttccagaatgggaacgccggcaccttgtatgactccatcacccaggtgctgttcgcgctccccgatgagacgctcgtgtacccggcccatgactacagagggctgacggtgacgaccatcggcgaggagaagcgacacaacccgcgcgtggccggccggagccgagacggcttcatccagctcatgaacaacctgggcctgccgaagcccaagctcatcgacgtggcggttcccgccaaccgcgcttgtggactgacggcaccggtccgcgcgcgaggcagcttcacacattgaggtacaggggggcggcgccggctcaaggcttgctgttcggaaatgtcgggacatttgtgggcggtctcaatcggtgaacgcacgcgccacgttcccgggccaacctgtcacaacacggcagcgagccccacccagacatcaccgcctcctgcgactccagggcaggtatgttgatgccaagcgcacaactcgatgaaacacccgccagaaagcaggcccccgacgttcactccgcaccacgctgggtaggatgcggttccatgcctcgcaccgcgcataggccgctggaagtggatgaggagaagctcgtccttcaattccccagcctggaccgtaaggccgtgggtgctttcttcacgcctgcaccgctggcggaacgcaccctcgcgctcgcgctccagcacgtgggcggaggccccctcacggtcgtggacccctcgtgcggcgcgggcgccttcctcaccgccgcttcgcggctgcggcccggcgtccggctctgtggcctcgagttggaccccgaggtcgcccgcctctgccaggcccgcgtgcccgaggccaccgtgcgcgcgggagacgcgctgcgagacggactggagcccctgctcgccaccactccgccggaccaccaggagctgtgggtgggcaacccgccctacaacggcacctcctccgtgctgaaggacccgggcacctatgcgcggctgcgcgccctgctcccactggcactgatgcctggcaccagcctgcgagacgacttcgccttcttcctcctggtggccgcgcaccggctggccacccgtcccggtgcgctcgccttcatcatccccgcgagcttcctcgacgccttcatgtacgcgccgcttcgccagtcgctgctggagacactctccctgcgcgaggtggtggacctgggccccggcgccttcgcgggcacccaggtgcggacctgcatcaccgtgtggagctccctcccgggcccccaccccgccccgcgcttcgagcggggcggcatcggacaacacttcacccccgagccccccgagtggcggctcgcccccactgcgcccgaggcctccgccctggacgcccgctggcgagagcgtggagagcccctgacgcgggtcgtccccgtaagcctccccggcgtgaagacacgctagcacgagctgctggtggacgcggaccctgagcgactcctcacccgcgtgaaggacttcgcggccacgcccgaagaagccctgcccgagttcgcgaaggcccacggcctgcccgatgagctgctgcccaagctgcgcgcattgaaggccgggccaccgctggaggtggacgccagctacgtgcggcccttctatcgctacggcggcgcgcgccaccgcggcagcgtgccgcccgaggcccgcgcctactgctacctggaccggcggctcgtcccccgcggtgaccaccggctgcgcggcccctatgacccgcacctgggcgcggtgaagctgctcttcaacgtgcgagagctgcccttgtcggccgcgctgctggaggacgaaggctgcgtgcatgaccaccgccacgcgcgcttcgccccgctctacgtgccgcagcgcctgcgcgacgagggcctgggcctcacccggtccgtgaagacacgggacgaactgggcccgctggtgcccaacctctctccccggggcctggcatgggccgaacgcctgggcggccccctgcccgccttccaggccctggtccgcttcctcaatgggccggaagtccaaggcatctgggcgcccgccttcggcgcctcccgcgtcgtgcccgtgcccctcgcggaggagtgagcgctacagggcagatggctcgggtgcccgcttgctttcccctgcggcgggcacgcgcaaccgctagtgtccaccttcgctccgtagcgcatgcctcaggaggaagacacactcatgaagattcgagccctgctcaccgccgccgcactgaccgccgccctccccgcactggctcaggagggcgcgggcacgccgccgccagcggacaagaagacgcagcccaagggccagacggccaaggcccaggtgaaggactccgagggcaaggacgtgggcgaaatcaccctcgagcagaccaagcaaggcgtcctcatcaagggcaagctgagcaacctgccgccgggccagcacgccttccacatccacgaggtgggcaagtgcgaggggcccgccttcaccacggcgggcggccacttcaaccccaccaagaaggcccacggcctgctggcgcccaagggcaagcaccaaggcgacctgcccaacctctacgtggcgcaggacggcacggtgcagttcgacatcttttcgcagaacggtctcaccctgaagtcgctgttcgacaaggacggctccgcggtggtggtgcacgccaaggaggacgactaccacaccgatccggcgggcgacgcgggcggccgcatcgcctgcggcgtggtggagaagacctagtccgccccacgcgggaagcaacccggcctctccctcgcactgggagaggccgctgtcacacgtagccgaagcgccggcgggcgaaccactccgcgcccagcagcgcgatgagcgccaccaggtagtaccagcggtcccacagcggctggtccctggcgcggcccacctccaccaccggcgggtccagcagcggcacatccggaaggccgtcctgcggcagcgtgtatgacttgccgcccgtctccttcgcaatctgcgccatcaactccggccgcacggacgcgtccgacagctcgggccccacggcgcgcacggccaccgcgtcctcgcccttgcccaggtccgtctcgcccttcttcgcggaggccagcagcttgtagggcccgggcgcggggggctcgaactccagccgcaccacgccgtccgtccccgtggtgcccgtctgcaccgccaccggcttctgcgtggcgacggagaagagctccacccgcacctgcgcgtcctgcgccggctggtagtccgccatccgcgcctgcaccacgacgcccacgggccggcccggctccacggacggcgggtccgccgtcaccttcagcgtcgtcaggtccgggtccctcaccagccaccgcagcgcattgccccagaagcggtcatacgcgcggctgggcgagccgtgcttgtgcgccgcgaaggcccagtaccaggaagcgtccgtggccatcaccagcgagcggccccggccgtagtcccacacggccaccaa

SEQ ID NO: 961 - DNA, 7305 bp, Myxococcus xanthus
ctctaaagatgatgttgatggtgtccttcagctccaggatttcgcccttggcgtcgacagtaatcttcttggacaaatcgccattggccaccgccgtggtcaccagcgcgatgtttcgcacctgcgcggtgaggttggaggccatgctgttcacgttgtccgtgaggtctttccatgtaccggcgaccccgggcaccgcggcctggccgcccagctttccgtccgtccccacttccttcgcgacgcgcgtcacctcggcggcgaaggcgcggagctggtccaccatcgtgttgatggtgctcttcagttccaggatttcgccccgggcctccacggagattttctgtgacaagtcgccgttggcgacggccgtcgtcaccttggcgatgttgcgcacctggtccgtgaggtttccggccagcacgttcacgttgtccgtgaggtccttccaggtgccggcgacgccgggcaccgcggcctgaccgcccagcttgccttcggtgccgacttccttcgcgacgcgcgtcacctcggaggcgaaggcacggagctggtccaccatggtgttgatggtgttcttcagctccagcacctcgcccttcacggagacggtgattttctgcgacaggtcgccgttggcgacggccgtggtcaccttggcgatgtttcgcacctggtccgtgaggtttccggccagcacgttcacgttgtccgtgaggtccttccacacgccggacaggtccttcacgtcggcctgaccgcccagcttgccctcggtgccgacttccttcgcgacgcgcgtcacctcggcggcgaaggcgcggagctggtccaccatcgtgttgatggtgctcttgagctccagcacctctcccttggcgtcgaccgtgattttcttggacaggtcaccattggccacggccgtggtgacctcggcgatgtttcgcacctgcgccgtgaggttgttggcgagcaggttcacgttgttggtgaggtccttccaggtgcccgccacgcccggcacttccgcctgggcgcccagcttgccttccacgcccaccgtgcgtgccacgtccgtcacctgctgcgcgaagatggacagcgtctgcgtcatcgcgttgatggtgtcggcgagcgcggcaatctcgcccttggcatccatcgtcagcttctggttcaggtcgccgttggccaccgccgtcaccacgcgcacgatgccccgcacctgcgtggtgaggttgacggccatgaagttcacgttgtccgtgaggtccttccacacgccggacacgccgcgcacttcggcctggccgcccagcttcccttcggtgccgacttccttcgcgacgcgcgtcacctccgcggcgaagctgttgagctggtccaccatcgtgttgatggtgctcttcagctccagcacctcgcccttggcgtcgacggtaatcttgcgggacaggtcacccttggcgacagccgtggtgacttcggcgatgttgcggacctggtcggtgaggttgttggcaagcaggttcacgttgttggtgaggtccttccacgtgcccgccacgcccggcaccaccgcctgggcgcccagcttgccttccacgcccaccgtgcgcgccacgtccgtcacctgctgcgcgaagatggacagcgtctgcgtcatcgcgttgatggtgtcggccagctcggccacctcgcccttggcctccatcttcaggcgctgggtgaggtcaccgttggccaccgccgtcaccaccttggcgatgccgcgcacctgggtggtgaggttcacggccatgacgttcacgttgtccgtgaggtccttccaggtgccggacacgccgcgcacctcggcctggccacccagcttgccgtgggtgccgacctcgcgcgccacgcgcgtcacttccgaggcgaagctgttgagctggtccaccatcgtgttgatggtgttcttcagctccaggatttcgccgcgcgcgtcgaccgtaatcttcttggacaggtcgccattggccaccgacgtcgtcaccagcgcgatgttgcgcacctgcgtggtgaggttggaggccatgtagttcacgttgtccgtgaggtccttccacacgccccccacgcccttcacgtcggcctggccgcccagctttccgtcggtgcccacctcgcgggccacgcgcgtcacctcggaggcgaaggcgcggagctggtccaccatcgtgttgatggtgtccttgagctccagcacctcgccgcgcacgtcgacggtgattttcttggacaggtcgcccttggcgacggccgtcgtcacctcgccgatgttgcgcacctgggccgtgaggttgttggccatcaggttcacgttgtccgtgaggtccttccacgtcccggcggcgccgggcacctgggcctgggcgcccagcttgccttccacgcccaccgtgcgcgcgacgctggtcacctgctgcgcgaagacgttgagggtgtccgtcatcgcgttgagcgtggcgcccagcgcggcaatctcaccctgcgacggcaccatcaacttctgggtgaggtcgccgttggcgacggccgtcaccaccttcacgatgccccgcacctgcgtggtgaggttggaggccatgaagttcacgttgtccgtgaggtccttccacgtgccggacacgccaggcaccgcggcctgaccgcccagcttgccttcggtgccgacttcgcgcgccacgcgcgtcacttcggaggcgaagccgttgagctggtccaccatcgtgttgatggtgctcttgagctcgaagacctcgccgcgcgcgtccacggtgattttcttggacaggtcgccgttggccaccgccgtggacacctcggcgatgttgcgcacctgggccgtgaggttgttggccatcaggttcacgttgtccgtgaggtccttccacacgccggacacgccgcgcacttcggcctgaccgcccagcttgccgtcgctgcccacctcgcgcgccacgcgcgtcacctcggcggcgaacgagttgagctggtccagcatcgcgttgacggtagtgccgatgcggaggaactcgcccttgacgggctggccatcaatctccaacgccatcttctgggtgaggtcgccctgcgccacggccaccagcacgcgcgccacctccgtggtgggctgcaccaggtcgccgatgagcgaattgatggagttgatgctgtgggcccaatcgccgcgcacgtcgcccagcgacacgcgctcgcccatgcggccctcgcggccgaccacgcgctccacgcggaccacttcctgcgtcagggtggcgttgagcgacaccacggcgttgaaggcactggcgatctcctccatcaccgggtcggcgccgccgcccgggagccgcacggagaagtctccgccgtgcaccgaacgaagcgcggcgagcaggggttgcagcggatggccgccgcgtccctggccacgcggggtggacgcgcgagcgccacggccccggccgttgcggcgggcgggcttcggtgccgccacttcaaggtccgctggcgaggtggagcggggtcgtccccggtcaccgctcaagcggttggccgcggggggctcggaaggggccacctcgcgggtaggcgcctccgggcgggaagtgccgttccccgaaggcttgcgcgcggaggcacgcttacggccgttggaaggagactggggaaccttggtgtcgtccacgcgagaaacctctgatcgggatgaacgctgctggctgcgctgagcggcgcccgggctgggacgaatctccagggagttcgcgggcttgtcgattcaatgcaggccccgcggaaccctgaacgttcaccaatgaacgcggtggttcagaggcccggaccgcccgtgaaaggcacccggcgccgcacctcctaccaacatctcagggggcaggggccgtgcacggaaatccgtcgcagccgtgcacatagaggggccgtccgaggagcctccgagcaggcgcccctggcgggcgctgcgccggctcgtaccgggcggtctggagatccaccgcgaaagcctgctcgttcccctgggcgcaggcgatcaggacgcgctcggggcgctcgagccaccacaagcccgctacttcacacggcaactccacggggagtggagtgagggttcgcgcttcgtagaagcggagcgcggcctcgtcgagcacggcggcgaaggtgccctccgctcccacggacagccgcgcttccgccccggataccggcacctgtcccagcaccgctccgtcaggcgccaccgagacgagctgcccctccgcgtcgagcgccagcactccgcccccgtggctgacgagtgatactggggagaagtcgcccatgcgcctgggctcggccccgtcgtcgcgccagagctgtccggcctgcgaccaccagaggcgattctcccggtcgaaggtgacggcgcgtacgcctgccagggggaaccgctgggagccctccggcagggtacagaccgccatggcctgggcgccgtagacggcggcgcgcgaggcatccggcgagacggcccagcccagcagggggcgttgcaggaggcgggcgagacagtggttcagcgcgccgaagtgcggatccgaggtgggcgcggagatgaggtagggcaggctggtggtggcgacgtagatgagcaacccgagcgcggcggcggtggccacggtgagcggccatgggccggctcggcgcaggcgagcctccttcgcggaagcgcgcgccgccttgcctcctgacaccggactctcgcgtccactcacggcggctcctcgcggcggtgttcccgaccttgccgggtgatggtgtcaacagcggcccggcgccacgtcccagttcgtttccccacgacagcacagaacggggccgaagggtggccgtgccatgatgttctcgaggggagacaacgcccgcatggtgggggagaaggcgctgcgaatcgtgggagtcgccctggccgcgttgctgacggccggcgccgcggagaatccacggagtgccattctgggcacggtcatcgatgcccagtcacggcagcccgtcgcggaggtcgtcgtaacggcgagcctgtccgcgcagggcggtgagcgcatcgccgtgacccagcccgacggaaggtatcggattcccgacctgcccccgggcgactacgcgctccgcttcgagcgcgagctgttcgagccctactccctccccctctccgtcagtgaagggcgcaccttacgcgtcaacgtcgagctccagccgacggagccaggagaggccgttggattgttctgcggaggcccgactgtcgacacgagcagttcgacacttcggttcatccagtggcgagaagacgtctcgcgcgttccggtcagccgcccaacgaagtgggctggcgccatgcgcacctcggacagcctcgcggagtgggtacccggcacggtggacagcgtggacggaaggtccttcagcggtgccactccctttgaaaacgaatacctgctggatgggctttcgactcgcgatccgaccacgggccgcaacctgctcccgctgagccaggaactggtcagcgacatcagcgtgctcaccggcggatacatgccggagtacggacgtaccacggggggtatcatcgacctggagccagtggtcatctccaatgagctgcatggtgaggtcttcgcgaactgggcaccgggcgcgctggaaggggcatggaggcctgcgacaggcccccgccccgccctctcctcggacggcgcgctccgccacctgggggatttcggcgggacactgggcggaccgctgctcaaggaccggctctggttcttcgcgggcatcgtccccgcgctcagccgcgtcgaacaggacgccggcttcatggaccagcgcagcctccaggcactggccaggctgacgtatgccctcaaacacagacattggacatcgctgacggttgtcaccactcccgcgttgatgcgggggatggaaggcgcgcaggctccgcgggcggtggacagcgacacggtcatgaccgtgctcgcctacaacgccatggtcctcgacggacgcgtcacgctcgatgccaaggcgagttggctgggccacgatgtcacccggctgtcgcctgttgcccctgcgagcgtcgacacggaccgattccaggcgaagacgcaggcctcctattggctgaaggccctgggacaccatgcgctggaaacaggcctggagctcgaacatgtcgtccaacgcccatcgcaggtcgccgacatcaccagcagcaacttgagcgggttcgtgcaggaccgatggaccttgaacgaccggctcacgctgaatggaggtcttcgctacgacgcgcagttcctcgatgcggacgtgcgtggaaacatgacgcatcaccagctctcaccacgagtcggactcgtcttcgaccccggcgggaacggccggatgaagctgttcgcgcacgccgcgaagtatcaggggatggttcccctggggttgctcacgccggacgcgcgcatcgcttcgcggctcggcccgacgtcgtcttccgagttcatcgcgggcgcggagcatgagctctcgctgttcgcgaaggcgggtgtgacctacacgcgccgccgcctggatgatgcgctcgcgaccattgcggacgacggtgcgggcgggtttctcatcgtcaatcccggcgcgggccctgctgccagcttgccgaaggcaacgcgcacctatgatgccgtcacggtggagcttggccgcagcttttgggacggctggcaggcccagctccgttacacatggtcttggctccatgggaactacgcaggccccttcggcactgatggcggacggccgctgtcacagtcgcgattgctcgcagcggaccggccccatgtcttcaaggcctttgcatccaaggagttcacgctcacgcggaagctcacgctcaacgcgggcctcgcctacctgggcgcggctggggcaccgcgcgaagcggccagcacgcggacgccgtgggtacacaccatcgatgcccagctgagcgcgcgctacgacactgacgaccagcacatcgtgacgctgaggatcgacgcgttcaatgtgctcaatgcacaaacaactctccgtgaggagacgttgctgcccttgcagtaccagacgccacgacagctccgcctaggggttcgctactccttctgaggcagagctcccctggccgagggtgccggctgctgttcggaaatgtctgtagagctc

SEQ ID NO: 962 - DNA, 10892 bp, Myxococcus xanthus
gcatcgccggtctggtgctgttcctcggaggggccagggcgcaggggcgcggtgtgcttggtgcgagcatcctcttgctggtccacgcgttggcgcaccgagaggacatcttcgagttgtggcccggcccggtgctggcgctggcggggctggcggtggtgacgctggggccgtggttcgtccggcgcaggggcttgtccgagagcgctgctcgcatgcgcatccaccaggccatggccatctatctgttggcagcgctcgtgtacgcgttggcgacgaatggaacgccgtcgtcgacgctcgcagcgctcaacctcctgggggagatgctgctgagcatgggcgggagctggatggtctctcccgcgttgcctgtgacactggcgctcgtcgccgcgtcggtgctcgtggcggctttccagtggaagggcacgctcgcctcgctcgtcgcgacgctgggggcctgggtggtgggcggcacgtttgtcgcctcactcatggccttcctttcgatgcgcgcgagtctggtcggcccgtggctgcgttatggcgcgctcttcatcctccatggcgcggccctgtccctggccgcctccgtgggcgtgctggccctccatgccgcccaggagtgggtgcggaggcgccggtcggacgtcgccggcggcctgtcgtggggacgcgacacagggttcgtggtgagtggactgatgctcgcggccctggcggtggggggctccgcttccgacggcgctcttccgctggagatcgcctccattggcatcctggtgttggtggcgctgcactgcgcttggagccagcacaccggcaggcacgtctacttcgtgcagacagcggtggtcggcgtctacgccctggtgcgcaatctgtatgcaccgggcctgcgcgccgagcacgacgcattcttcgcgctggccctgggcttcatcctggtgggagtgacggtgctggcccggcgggcgggcgtgcagcccgtggaggcggccacccggcgcttcgcggcactgctgcccgtgggcatggcgctggtgctgccaggcgaggcgacgcaggaggcggcactgctcgcggggggctccggactcctgtacgcgacgctgggcgcggtggagcgcagccggctgttcggtgcattcgccgcggccgcgtgcaacttcgcgctgctcatctccgcgctggcctttggcctggagggtttggaaatctacctggcgcccatgggtttgctgttgttgatgctgggccagctcttcgcggagagcctgccgcacgccgcgcgcaacacggtgcgaatcctcgggggcttgttgctatatgtgcccgcgtcggcgcgcatcgcggtccaggtgggccagtctcccgacggcacgtatgcgctcgtcttcagcggggtgtgtctgctcggcgtggtggcgggcatggtgttccagattcgcgcctacctggcgttggggaccctgttcctcacgctggacgtcgcggccacgctgctcgacgctgggctgagggaccaccgcatcggcttcctggtgatgacgctcaccgggctcacactcattggcgggcgcgtcctgacgacgttgaagcgtcaggagtgggaaatgctcgtgcggcgggtccgcgtccagcttcgcggttgggattgagcgcgcgggtggcggcccaagccccgggctccctgcggcccctgcgccgctggggggggcaccgacgttggcccctgggatgcttgcgccggctacttgaagcaaagggtggtcgtggtcaccacgtcagttcgcttgacccattcgactgtcctgcaggtctcgccgggaccgcaggcgtcatcgtcctggcagcggcggtgacactggcggtcgcccttctccgcctggcagtagagctcttcgtcacgggcgggtgggccacagacctggctgatgtagcactcctcgtcggcgttcgcgcacacgtcggtgaaggagcaggtcgcgagcgaggaattcggtagatgggacgtatcgtctccgcagccagcggagaccagaaggcagagcaggctcatcagtgacagtcgcatgggacctcgggaaagggtgaggggtttctccaagtatacgataggcgaatggtgcgggccatcaacgccccactggcgtgggcgcggaggcgtcgtgggcaggcgcgtgcaacttcgtggctgggattgaggggcgcgccgctgctgtcttttcttttctcttcactcccgagaatcgagaaggctgcctcgtgctgggccaggagtctcagccttcgtgtccagggtgggtgttgccttacggtcgacgcggtgatgccaggagaaaatgctgtccaatggcacacgcgttctggattcgaaatgcgtgcctttaaagctgaaaatggaattcatgcgttcattgttgtggcggttatccggcgtgacagtcctcacgtcggaccgccatccccaagtcgaagcggattggagcaagacaatgaaggtcagtcgagtggcccccatgtggcgaatgctgagtgcggccctggcgttcggcatgatgagcgcgtgcggttctgagttggaggacgaatccgtcgtttccgaagaggcgccggtgggcggcgagtcgtcatcggactcggcgtcggcgatggccggtgaccgttatgccaacgcagtcgtccaaagcggtgtcattgccgtcctcaatccgaacaacgccgtgggcgcaccggatgggaacgccgcgacgttcctggggctcctgggcggctcgatggtcctggacatgggcctgggcgaagagggcacagggccgctgcgcgtctactaccagggcctttcgctggcggtcatcgcccaggtggaattccttcgtggggacatgagcatcatcagcacgggacaggcgaacctgctggacctggggctcgggactcactccacgctggtgccattcagcagctccacgccgtatcgctatgtgaggctgcgcggtggggttgcctcgttgtacggcttggacgcggtggaggatacgggcggtggtgcgagcgctgtgtgtggcgatggccgtatcaacaatggggagcagtgtgacgacggcaaccgggtttcgtcggatggctgtagcagcacctgccgggtggagcccgggtacacctgcaatggcatgcagcccagtgtctgcacggacgtcaatgaatgcacgaatggcactgcgcagtgttcggtgaatgcgatttgcacgaacacgccgggaagttacacctgcacctgcagaccgggctactggggaaatggttggacgtgcagtgacatcgacgagtgctcgaacgggactgccgcgtgcaatcccagccaggtgtgtgtcaacacgccgggtggctatgagtgcgtgggtggctcctgtccggctccccgggtgcagtgtggcgcgcagtgcgtggatgtgtcgtcggacgtgaacaactgcggcgcctgcggcgttgtctgtccggcggcgaagacctgctcgtcgggcgtctgtgtcatgaggtagccgggaccgacgctgtcgctcgcggaatgacatcatgagctggcaggctcaccgccctcgcggcgcaacacggcgccgcgagggtcggggttctcctggcgctgtgatgggacgctgcgcggtggctcaggacttcttcctggcttcgtcaatcacctcttgcttggagaggggcttgagcgagccgtccggctggccctggaagaagtcgaactcgtggatggtgcccttgaccaggtactccttgtcccgcgccgagttcaccatcgcgcgttcgcgaaacgtgaacgagggcttctcggggtccactccgacttggggcatgacggcgcgctcttcgggtgtgggctgccagagcggctgtggacgtggctcggagcgcagcaccgcggtctcgtcgaagccgggcctggtgctcgttcggaggtcgcgctggatgtcgaactggtcgagcaccacaccgctcttggggtccttggccgggttggtgacgatgcggtccttgccgtagagcgggttgtcgaccaggggccccgtggccgtgccgtccacgcccaccggcgggccgctgaaggacgtatacggagtcttcgccttgatggacttttcgccatcgacgtggtcggaggcactggtggtgacgctgtcgcccgcgggctggagcttgccgtgcttgtcgatggcggacttcgacgttccgtatcccggttggatggcgtcgaacgcgaagttctcacggcgcgacagcggaacatccggcttgatacgaggcgtggccgagttgttgccgccatcacggcgatccatggcatccatgatgtcgctcatcaggtccaggctgttgttccgtgcccgcgtctcgctcgcaatttgagacgggcttggagccttggtggagtgatgggcgacctgccgcggcatgcgggtgggtgccccgtggctgccggagtgggacactcctcgcgcgccttgcttcaacaacgtcgtcgttaccctcgtgatggtacccatgatgtagcccccccctggtctgaagcatgaggtgcgttccttcatgcctttgtacgaattgtccttcatctgcgcacggagttgcgtggggggaggacgatttgggcgagggcgcagttgtgccccgttcgacgcctccgtcattcgagggtgggccttccgggacgaagtgagtcgccacgagatgcacttaatggacagctcacgtccacagtcgcgggaaagacacagcctcagcggccctcgccagggaatgacgtggtcgctccaacgtgtgcgttgccatggccagatacgcaccctagcgtcgcacctgccattggcggatgaagagcccgttgtcgccccacctactctccgaggtcagaggatgcgcagattgctgccccaggacgtctttgtttccagcaccgctcttgaacgatgcgagtctcccgcccgtgccgcactcagactcgtgggagtctttttcgtcgccctgttcctcggagtgccaggcggcgcggaggcatccgatgcctcgctcgcgccgaacttctattcgggacatggaatcacggttcatgcggtgcggcacatcacggataggctcatcgacgtggaaatctccacgccgctgatcgcgcctcacgcggtctatgacccacgccaccacgttcgggtgctcctgccgacggggtattacaacaacccgggcgtgcgttaccccgcggtctacctgttgcacgggggtggaggcgcgaactcggctcagtgggtggagttcggtgcggcgtatgcgattaccgagaacatgcccgtcatcaccatcatgccggatggcggcaaggtcggttggtacacgaactgggtcttccctcgcggggtgaatcaggcgtgggaggagttccacctcaaccagctcattccgtgggtggaccagaaccttcgcacgctggcgtacaagcggggccgtgctatcgcggggctgtccatgggcggcttcggggccatcagctatgccgcgcggcgccccgacctgtttgcctatgcggccagtttctcgggggccctggacctgggtgacgccgccatccgcgccaccgtcacggaggaggggacacggtggcttcagaatccggatggggcgtttggctctcccttctggcccttcgaccaggcctggaacatgaacaaccccattccgcgtgcggcgtctctgcggggcgttgccgtcgccttgtatgcggggtcgggcatctgggatggggatgtgctcgaacgcgtcccgggggcgtccacggaccggttccaccatgcgctgaatgccgcgggcgtgccgcaccactacgagatgtatggccgcccagcgccgggccagaagcccttcggttgtgacggcggacacaacttcagttgctggaactacgcgttcttcgacgtgctgccgcgcatgttggccgtgcttgacgggccgtaagcccaacggcacgtcaggtgatggagcccttcgtccgatgcgaagggctcccactgccacccgcgcgagcggagcgccttcttcctgcggcctcttggggcgggtgctggatgagtgggtccacgaagggagatgcttctcctcagtggctcagcaaccacgtcgcgagcggttgccacgcgagcgtcggtgcatccgccgcgtacaagaggtcgccatggccgaagtcctcggacactcgctccgggccgaagcggcggacgacgagcgccgtgacatccgtcgatgacacccgggtcgtcgaatacagcccgtagtcaccgaacgcgccagcggcgccgaggtagaacaacgggacgcggatgttcgagagctcgggccttggtgtcgccccgcaccagatttcgtcgagttccacggtctcacgcagcgactggtgcggcggcgcgctggcgaaccacgcgctcacgctgtcctcggacgactcgcgcaatgccgcaacgtcgccgttggcgtcgaggatgggcgcgctcaggtggtacagcggcgtgtatggcgcgagaaggtaggtgaggccattcatcgcgagcagtgcaccgcggttggtgtagctcgaaaacactggagactgcgcctggggggcgctccgggccagctcgcccaacgtgatgaagaagctgttgtcggagtcggtcacgccttgagcaagcgcctcacgtcccgcggcggcattggcgcacgcaagctcgcgcagttccgcgtgctcgggcgcgatgtcgtagtaggcgtcgagcacggcgaccgccgacacgtggcggccgttggcggcggcatacgcgtaggccagctcgccgccatgcgagaatccgccgagcacgattcggcccttgtcacggtcgccgctgagccgtgctgcccgtgcgaaggtgagcgcgacggtgatgtctccgagctcctgggcaacccccatctcgcccaggtcggagatgtctccgtaggcggagggcagcgtccagcgacggtcaacgccccagacgtcgatgtcccgggccgccaggtacggtgcgagccccggcgccgatgacgcgggattgccgagtgtcggcacgaagttcgtgacgaagttggcgaagtctccgtgaagcaacatgatcgcgtgggcgggcgaccgtggccgccacggtgcgcgctctcggacgacgcgatggacccgcacgatggcgtttggtgcggtgctgacacgaatgtcgaatcggtagtgatagacgtcttcggtcacgaactcacgtaacaccgcgaacggtgttggagttgacgcgagcgattccgcttcagtttcaatccgcgaaggtggggatgcgaatgcggacgtgcatgcgaacaacacgatgaacgaaagaccaagattggacattcgggacccttcaggtgcactcgagacgggatgtgacatgcccccagaatgggaaggggctggccctctcagaacgaagagctcggcgcggacatatcgtcccgttttcattgaagcttcgctttgtggaagcagagccggaagccagtcactcaaggtggtggtgcccgagcgtgaggaatccgaagcgacccaacgcctggttgagagctgcacggacgcggactgacttgaggtcagctcgacacggaaatggactgtcagatctcctggtgttgcgctctgacaggtaggcccatctcctttgtgggccacggcaattcccatcacggccgaaagtgccctgtcatgtcgttgactcagagtctggcttgaagagacacttctcgctcaccaagggaggccgaacatgaagaagcctgctcgtacgaagcgtgcaaagactctcaaggtcacggtgcgcgttctgaaggtgtccgcgctcaaggcatttgaaaccaacgtgtccagcatttcccacatttcgaagtagcggcgtcccgggcacgacatgggcgttcaatcaggtgtcgtgctcctcgaaatggcgagggggagctccatccttcagacccgcagggcgctgatggagatacggggcctcccctttgctcttctcgtctccatcctcggagacgttcgccgcggagggagcgccgcggtcgtccgtgcgctggtgaaggcgggcgtcggccctaccggcgccagggagctcggagcgcggctcgaagaggaaggggcgctggggcgaggtgcgccacgttggatggacgagcaagccctccgcaaggcattgggaatcaccggcaggctgcgactgggacctcttcgcacggccgacctttccgagaacagcggagcactcatccaactgagcgccacatgttggcgaagcgctggcagtggtgtgtgtgtcgcctgtggcctgctctgggaggttcagagcgcggacgcgcccgatgaggccgccgcggtggcgaatgcgaacccgcgccgagccgtgattgcgctgggggcagccgatctgacggccctccggaaagcgatgaagccgcattccctcgatgcgcgtacctggacagagggcgcctacgggcggccaggcgccagacgcatccggtcccggcccgcggcgggatgcccgtgctccgcgaactggggcgcggcgaaccgcatcggcaagctggagggctcgcggatggccggtgccgcgctggggcgcgtgggaatcgcgacgcgcgaagccacggtccgtggcaggcggggggctcttcccatcgtcaccctgacctggggagccgccaccctgcgtcttcggaaacgaggtcgtcccgtggtgtcaggacatttcctggcccaggtgggcgtcggagcctccctggaggagcggaggctgaccgcgcgagcagaggccatcgagcgtgcctcgtccctccttcgtgtgcccgacgtctgcgcgactccggcgcgtgcgctcgagcaacctttcctgcccatgagtgattgggacctctacacgccggagcagtacgcaagcccggggttcccctacgcgccagtcacccaagacacgccactggattgggtcagggccacggatgcggagaccggtgagcaattgctcgttcctgcggccttcacgacttccgaacggctcgtgggcccgcgcttcctgtgtgcctcatccaatggcgtcgcgacgcatacgagcgatgacgccgcgttgcggtccgcgctcctggaggtggtagagcgcgatgcactccagctcgcctggtatcgaggtcaaggggcgcggcgcctcgacatggctacgctcaacattgatgagggggtgtcacgtcatttcaagggttcgggctggactctccacttctcgtatctgcccggtcgcgccgaccttcacgtcatcgcactcatcgccgaggcgacaggagagggggcgtttcccaaaggagggacgctcctcgccgcggcggcggcgggggacccggcagtggccgtgcaccgagcgctccgtgaaatgcgaatgttgacggaggcggtggcccttcgtcgggagcttccgattgacttcgaggcgctccggcggcccccggtcctggagaactactggctcatcgactccctcctcgacatcacgttgctctacttgaaccccgcgatgcggagcgctgtcgacctgctcctggaaggccccccggtggagctccctcgtgttcgggtccccgacacggcgggggagctcgtcacgaggctccgacagcatgggctgcgcaccctggtcatcaatctcacgctggcggcggcctctccgttccggacttgccaggcgctggtccttgggacgcagcctctggcgttctgtccgagcctgctacgcctcgggagtgggctgctgccgcgccgccttcccccgcgcaatcccaagccgcccacatcgccgctcaagctcaggcgagggctgttgaatccgtacctgcttccgctggcatgagtctcaccgaaggcgcgaggcgacgtctcgaatgagcgaacgcgtcatcattctgggcgcgggcctcgcaggactggcggcagcgcatgcgcttgtcctcgcaggccaggacgtcgtcgtgctcgaggcgcgctctcgagtcggtggccgggtcctgaccctgcggcagccgttcctggacggaatgtacgccgaggcgggcgcgaagtatgtcctcggtgggcactcgacggtcctcggctttgcgaggaggctcggcctggatctcgacccgctgccagttccgcacacgtcggccttgcggcccttccatcttcggggacgtcgcatcctggcccccattggtgatgatacgagcctcccgcatgtcctgagggcggatgagcagcagctcggcctttcaggtctctatcggaggtacgtggcgcccctcgtggaggctgtcggcgaccccttccatgagtcctggcccggtccaggcgcggcccacctcgatggcctgacccttcgtgaggccctcgcggaacggggcgcttcttcagcggccatcgacgcggtgagcctggggcggtttgacctcgtgggtgatggcatcgacgcaagctcggcgcttggtgttctgcgacgggagttgttgacggtcggcagaggaggctcgagcgcctacaccttgaggggcggcagtgaccggcttcccgtcgccctggcgaaagcgctcggtggaaggattcagttcggatgggcagcgaagcgcatcgagcaggaacaggggaccgttcgcgtgtcctcccgcgagcagcacgggagagcacagaacgttcacagcggagcggctagtgagccccattccgttctcggtccgttgtggcgttgagctcgtaccggccatcgcagggggccacgtgcacggaggaccccgtagag

SEQ ID NO: 963 - DNA, 12849 bp, Myxococcus xanthus
gcctgcggtggaccacagcgcgtgggcgccactgaggacgccttcaacaaaggggcgcccctgcaccaggacggaggccagcccggttcccagccggccgagcgcctggtcgctcatcaccaggtagcccagcccgcccagcatcgacgtcagcaggatggccagcccggaccagacctcgcggcgccggggcacgggttcggcggacacgcgcgccatgacgctggccaccagggtgggcgggggaaggggatccgccagccggtacaggtcctgctccatcagccggtgctcttccaggacggcggcgcaggcggcacactcggcggcgtggtccagcgcgggcccttcaccggcttccagctccgtgaagaggacttcgaggtccgggcacaggtggggattcatcgtggagcctcctcggccgtcatcttcttgcgcagcttctcacgggcccggaagagccgggccatgatggtgccaggcgcacagcccatgatctgggcgatctccttcgtcgtgcgcttctggacgtaatagagggcgagcacctcccggtcctcgacggacagggtggccatggcctcctccagcgactgccgctcctcgcgggcgatggcgccttcctcctgcgacgcctcgccgctggggagcacctccttcatgggctccagctcctcggtgcgcaccttggtgcggcggcggagcaggtccaggcagaggttgcgggtgatggcgagcacccacaggtcgaacgggcgcgcgtcgtcgtagcggtggaggttctggtaggcgcgaagcagcgcttcctgcgccacctccgcggcctcggcctcgctctggagcagccgcagcgccaggccgtagacagggcgctgcacgctgcgaaccaaggcctcgaaagcggacgggtcaccccggcgggcggcctgcacgtccgctttccagggaagcggaggagcttcctcagccatcagcatcccgatggcatgggcaagcgtcccgggagcgtcgtcgagggcaagagcgttcacgcctgggtctacggcgcgcccgtccgcccattgcatccgggagatacatctctatttcttccgtgatttcgcgggcttggccttggctgcacgtttggcctcggtctccgcgcgcgcggccgagcgggcgtccttgcgctggcgctgccgctcacggaagcccagcggcgcggcgggctccgcggccttggcgggcgcgggggccttggcggccagggtgcgggcgcggcccgaggcgggctccaggagctccacctcgcgcggaccggtgcggcggcggcccggagcgcctgcgccccgggcatcgcggttgccggcgggcgcgcgcgtgtcgcggtctccggacgaacggcggcgggtctccgtgcccggagcgctacggctcgaggcgcgcgcgccgtccgcgtcacggcggggcgggccccggcggctggagggctcgtgcgcggcggcggcttcggcctccgccagcttcggccgctgcgaggcgcggatggtctccgcgctgtcctcggcgtaatcgaagtggaacagccgcttgatgaccagggtggcgtaggcgccaggcggcagggtgaaggcgatgttgaccttgatgtcgtcgcggttgagctcgtccgcctgcgtgcggcccacgacgagcttgtgcgggaacgacagcaggggccgctcctcgtgcttgaagtagagcctgcgctcggcgccggggacttgcaggtccgacagttggagcttctcgcggcccagcacccagcgcacggcctcctccaccttcgggtcgctgaacgtcgagttcggcgcgagcagggggaaggaggcgtcgcgcagcgtgcggagcacctccgggctggcgtcgcggtggaacagcagcgtgccggcctggtagcgcatggggaagaggtgctcgcgcggcagcatcagctggaggtagcgccgcacaccctcgttccagaggaagctctggtacgtgaagatcagcatcgcgcggtagtccgcgtcgatctgcatgaaggcgcgcaggtagtcacccggctgatcgcgcagggacttgaggacgcggtggtacttgcgcgtgccctcgtaggggacgcgggcgtcccagcggccccagttctccttccagaaggccttgatcttggcgtcctccgtccggtccagctcggacggcttggccatgtagttgtgcagcgcggcctcgaagtcgccccggatgaggtccttggcgatgaagccctggccgtgcttcagcgagccgaagcgctggctgtcgaagtagttgatgacgcccaggcggttgacctcggcggcggccacgttgaggggccccagcgactccggctggagcgcgcgcaccgtgacggagaagcggttggaggtgatgttggcggcggacagcggcttgtccgtgcggcccaggtacttcagccgcaggtcaggctcctgcatgtccacgtcggcgccgtccaccgcgatgatctgctcggtccggccctgcttgtccttgaggccgcagtagctgatggcgccgggcttgagcccgaacgcatcccgcagccgggtcacggcgtcgaacgtggacagcttttgcttgtccatcaggtagacgcggtgacgtcccgagtcgacttcgtcgaaacggtatgactccttgacggagaagtcctcgggcttttgtttgattcgcacggcgccccccttaccagcgcggcgccccggaatgaagcacctgcgccagaaaggggataacgtgacctcccatgcgagttcttcccctgttgctcctggccctgactccggggtgtgcctccacgctgtccacgcagcagacggcccgaacgctggcgccggggcaggtccaggtgacgggcggagtgggggccttcgtcccggtgggggccctggtccgggtggtggacgccggcatcgagcagggggaggcggcccgggacgcggtggtgaatgaccgcccctacacgctgagcgaggaggaccagcaggagctgctgacggcgggcgtggcgctgatggtggccccgccgggcgtcaatccggagctgatggtccgggtgggagtggtggaccggctggacgtgggcctgcgctacagcggcatctccctgcgcggggacctgaagttccaactggcccacggcggagatgaggtgggtcgctatctggagctgggccagcgctccttcgacatggccctgggggtgggggtgtccaagcacttcttcagcagtccggtcctggacgtgctggaggtggtggagatgaacgacttcagccgctacgacgtggaggtgcccctgtacctcagcgcggactggggggacgtcttcaagctctacgcggcgcccaagtacatctacagtcgcacccggctggacgcgcggctggtggactactcccagcaggggaagccggtgtcaggcttcgacgcgaggcttcccgcgacggtgggcagccacttcgtgggctccacgctgggaatcgccgtgggctaccggtacgtccacctcttcgccgaggtgacggggggctacttccggagcaggccgcagctcttcgggatggagcggaacctggggggcgttaccgtgatgccttcagtgggcctggccatccgggcgggcggttcggacaggaagccgacggccggtcgctgaggagccgtcccgccaggcggacgctgctcggaagtgcagtggtgatttccgagcgttccccggtgccgatggcctctggtagtgtccgggccggtgaggatttccgcgtgagccagtcccccgtcccgttcgctcccaaacccgggcagattcgcggcccccgactgacagggcgcttcgcggatggcacgctcggagagtttcccctggggccggcgacgtccctgggccggcatccgtccaacacgttgcggctggtggaccgggaggtttccaaggaacacgcggtcatcgagcgcgtgggcaaggacttcatcctcaaggacctgggctcgtccaacggcaccttcgtgaatggccgccgggtgaaggagctcaagctgcgcgacggggacgaaatctccctgggcgcctcgcggctcatcttccacagcggcgagccggtggcgccggccaacgcgcccaccgcgccgggcgtgacggtggtggcgcagtccatctccatgccggccttcctggcgcagatggaccaggtgccgcagaacttccggcccgccgaacaggtgtcggacgtggaggcgctgcgccgcgactacgagaagctgcgcatcgcccatgagttccaccgccaggtgagcctgcagggcagccagacggggctcttcgagcagatcctcaaagtggccttccaactgctggccgcggaccacggcgtcatcctgaaggtggccgcggacggcgagttcatcccgtcggcggtgcaccaccgctccgacaaggccgtcaacgtcatgctgtccgacaccgtgctcaagcgcgtggtggagacgggcaaggcggtgctgacggcggacgccatcatcgacgagcgcttctccgcggcggagagcatcgtcgcacagggcatccggtccgccatggcggtgccgctgaaggtgaacgggaagattcaggcggtgctcttcctggacagccggcagcagatcaacgccttctcggagaaggacctgaccatcctctccggcatcgcctcgcaggcgagcatcgcgctggagaacgcggcgctggccgagcagattcgcgccgaggccgtgacgcgcgcggagctcagccgcttcctgtccaaggccgtcgccgacgcggtgatcgccggtgagacggaagacctggcgcagagccggctggcggaggtgagctgcctcttcgcggacatccgcgggttcaccaccatctcggagaacgattctccgcaagaggtggtagacatgctcaacgcattcttcaccgccatggccggggtggtgttccgccacgaggggaacctggacaagttcattggggactgtgtcatggccgtctgggggccgccgctgtcgcacccggacgatgccgcccgcgcgcttcgggctgccttggagatgcaggacgccgtgcatgagctgaaccgccgccgcgtggccgcgggcaagcagcccatcgaggtcggcatcggggtgaacaccgggcaggccgttgtcggctacatgggcagcgccgagcgccacgagttcaccgccattggcgacacggtgaacacggcctcgcgcctgtgtggcatggcgaagagcggtgaggtcctggcctccgagtctacggtgcgcagggcgggcgccggcttcgacgtggaggggctgccggccctccaggtgaagggcaaggagaaggccgtgccgacctaccgcgtccacgggctggagtacaccaccgccgcttcctcctcacgccgcgcatgagtccgacgacgcaggcctgccccaactgcggccatctacacgacatccgcgtctacgtgagcggccagcgtgtccagtgccgctgcggcatccggttcgaggcccgccggggtgacgtggccgccgaggtggcgcgcaacacgatggtgcccacgggcagcggcatccaggagcagcgccctccggccaatgggacctccggcgtggtgacggtggttcctcacgcggagccggagccaggcatcgacatctccctttctcgcgctccggagcccgtgcgctccgcgcctcccggtggcgtgaacgggctgccaggcgtggcggcgccggggaccagcggtgtggccatgccttccagcaacggcgcttcggacgcgtcagtggaccagacgttggtgcgctcgtccgcgaagacgggctcggacaccgcgcactcggagctgaacgcgcaagagaacagcaccttcgtgggcgctggcaaggtggacctgccgggcttggagctgctggagctgctcgggcgcggcggcatgggcgaggtgtggctcgcgcggcagcagtcgctggggcgcacggtggcggtgaagctgctgccgccgcggctggcgaaggacccggagttcgtcacgcgcttcgagaaggaagccacggcgctggcggcgctcaaccacccgcacatcatccagatcatcgaccggggcgttgcgggcgagcactactacttcgtcatggagtacgtggaaggccgctcgctgcgcgaggcgatgtcggccgggctcccgccggagaagggcatcaagctcctcctggcggtggcgcgcgccatcgagtgcgcgcacgacaagggcatcatccaccgcgacctgaagccggagaacatcctgctggacgggcgggggcacgtgaaggtggcggacttcggcctcgcgggcatccgcgcgccggactcgcgcctgcagctcaccgcgacgtcggtggccatgggcacgctgaactacatggctcccgagcagcgccgcgacgcgaagaacgtggacgggcgcgcggacctcttctcgctgggcatcatcctctacgaggtgctcaccggggagcttccgctgggccgcttcaagctgccctcctcgaaggtgccggggctggacccgcgcgtggacccggtggtggaccgcctgttggagcaggacccggccgcgcgctacgagaaggccagcgagctgtgcgccgcgctggaggcgatgatttccaccagctccgcgccgggcatcccgcagagcgacctggacggccgcatggtgcccgcggccgcgcggtcggtacggccggggcggcagaccgcgctgtcgcgtcagctccgttcgggctggcggcgcgtgcgcggtggcctgtcggtggtgggcgggctggcgctgctgggcttcgcggtccggtggttcgtggggccggtgagcctccacctgggcgacgaccagcgcgtcatcatcggcacgaagggtatccaggtgaagcccggcaaccgggtgctgccgccgaacacctacggcgaggtcttctcatcgctttccttcgcggcgcccgccaaggccgggggcacttcgcgcctggagctgggcttcaacgagggcaacgaggaggtcaacgtccatagtggccaatggcggctggtggatggggagctccaggccttgcaggcgggcaaggagaccaatgggcggcggttgattccgcgcgcgtacatcgcgcagcgctacttctcgtccaacgatttcacggccgaagtgctgatggacgtggcgcggctgggaccggagtacgcgcaggaagcggatgcgcagcactacggcgagctggcgttccgcatcaaggacttgcaggtctccgcgttcgccattccggacgtgggcatgcggctgtcgtggcgctacttcatgccggacgggcgcgaggtggtggggaacagcgcgcaggacacggaggcgctcgtcgaggacgagatgccgctgccggcccacggcccctaccaggtgcggctgcagatgcgccggaacagctcgggcgtgctggtggaggcgttcctcaacaacgagcgctacgcccgcaagctgctggtgggcctggaggaccgcgtgggcaaggtggccctgggctgccgcaacctgtcctgctcgttcgatgacttgaaggtccgggggcacctgatgccccggcccgtccgccgcgtcgccgccagccccgagtagcccgcacggcaggcgaaggcttgcgcggacgccgctccatccccaccttgctctcggcatgttccgcctcgcgggcgtccgtgccgagccttcagggggacggggatggagctgtggcgcatggcactgacgccggtctacgcggcgtgcctgttgggactgttggtggtggccttcgcctacgggcgcaaggacgtgacgtcccgtccctaccgcgtgcctctgttgtggttcggacttctggcgggggtgtcgctcgtcgtgctgcggcacgtccaggggaccggagcggtgttggcctcggagacggccgtgaaggccatgggctctgtcctgctgatgctggccgcggggttggcgctgcggggcgcctgggcccggacccgggccaacgtgctgcggggttcggcgccggtgccgctggatgaagcggtggaggccctgcgtgccggtgcatccccgggctggggcgtctaccacggcgtcctggacgcggagtcgacgttgacgtcgcccggtggcgtgccgtgtgtcttcttcgacgcggaggtgcgcgaggtggcggcggacggccggcgcgggccgctgttgtcgcgtgagcgcgcgtatgcgccggtactggcgctgcgtggccagcgcctccatgcttcggtgtccttttcgcccgcgtcgctgatggctccggtggaggtgcgccggtgcaaggccctgccaggcacggtgcccgcgtcctggtatcagacggcgcacccggaggccctgtcctgggagcgcgtgggcgcggtgggcgaatcctgcctcgtggtgggtgaactccggaggggccctgtcgagggcagctacgccctggtcggtcgggagggcggccccgcgatgttggtgctgggaccccaggctccggccacctgtgggacgctggcgcgccgggcctggcggcacttcgcggcggccggggtgctgtccatggccgcggccgtcgtcctgtcaggggcgctgtgagacgcgcggcgggggccgtaccgccgcgccagaaacgtgatgcgccgccaggcctcgcggtccgggcactgacgcccgggccgctcgggactcgctcaggcggctccggtgcttcgcgcggtggagaacacgagctgttcctcgctgtccgccacccgcacggtgagggtccgctccacgccggcgaggcccagcggcgtggactgcgccaggtccgagagcagggagcccgcagcgcgcaggtggaagccggtggtccacatgccctccagctcgccgaacacggtgcgcagctcgtccggggccttgcgttcgtcgatggcgcggcgcaggcgcaccatgccgctcacgaagttcctgcaccgcatgagcgtgttggggttcttggagatgacctccgcgaagctgaagttgccgccacccgggcgccactcgctttcgatgagctgcaggtccttgccaaggtcgcgcaccgtggggtccttctggaagtaccacttggcgatctgcgcggcgcggctgggtgacaagtcattcagcatgaggctgccttgctcctgcacctcgcggaggtaggcctcccagatgggggcgtagaccgcgcgccggaactcggcggaggcgcggggaagctgctcgctccagggcagcgcgcgggccagggcgcgtgagaagcgggacagctcgagcgtctggatgcggggcaccagggcgcggaacgagtcatccgccatcttcagctcgagccgcgtttcgatggggtgcttgcccatgtcctcctgcatggtgctgatgacggtggccgcgtccttcgcgtccagcacgccccagacgacggcgtcatccaccgcctgctgcaggtccttgcgcgacagcttcttctgccgtccccacagcatcaggtgcaggccgtagccgaagtcggaggccacgggggtgggagagaagcgcgtcatgtccgccttcaggtccaccacccactggccgcgggtgcccagcagcttgtcctcgtagccccggcgtccgaggaacgccatgcgccgggcgccctggaagttctcctgcgtcacccaggactgcttgctgacgttcttcgccttgagcagctcgaacgagcccagccccagtgagaagccgatggcctgctggcgcgtgagcgtggtggcgtgcaggtagttgcgcagctcgaactcgctttgctgggcggggaggctcttcatccacttcagcagctccaccaggttgcccttgagcagggactcgtggaagcgcatcgcggtgacgtcctccacgacgacctccagcagcgtggaggtctccgacaggcgcaggtattcgtactcgaagccctcggcgacctgcgtgcggacggcgttctccagcgactctgcgacgcgggccttgaagtcggcccaggcctgcggaaggttggccgggtccgcaagctgcgggtcgatgccaaggcgctccagcaccaggcccagcaccttcttctgattgtcgtccagcttcgccttgctggccttgtccaccaggccgtccatgatttccaccgcggtggtgcccttcttgacgaggtcgcgaaggacgggccccagcagcgcttccagcaactggcccagttgggccttcaccgtcgccgggtccagcagctccacggtgatgcccaggccggcggagagcgcctgctcatgggacttcaccttgcgcacggcgacctggatgcggccggcacggggacgggagaagctgagctggtagtcgtcggtgagggacacccgggcggacaggcccgccttggcgctggtcttcaacgcgagcagctcgttgccgcgcaggaagcccaggcggttgaggttggtggggaagatgtccgcccagttgagctccagccgtgtgtggagcgccccgcggacctgccacgccaccgcgtcccccgtggtcagcttggccaggtcggtggcctgcatcagccgcagctcggacaggtcggagcgcacggcctcacgcatgttctggcccagcggatgcgcgcggtagtcgctgagcgtgacggacagctccgtctggttctcggaggcgaggaaggacaggctggcgctcacggcggccttcacgcgcgcggacacctggtagcgcatccacccgatgtcactgcccagcagcagttggggccggggccctggctcggcgctctccgggctcggctcgccgatgatgccgttttcgtccacgtcgcccagcgagttgaagttccggatggacgcttcgccggtggcttcgaaggagagggtgaagccgtgcatggcgagcttgggcggaaggattttctcttccgtgaaggtcccctgggccagcggcaccttgatgtcctggtcctgcagcttcacgtcgggcaccttgcccgccacgacgtcgggaagcttctccagcagcttgttgaccactttcatgcgcgtccccctgggctgaagcctcctgcacgtgggccggaggtctcttcgtcgtacgccgttgcccagctcggaacaaggcggataccagaaaagaccggtggtcagcggacagatgccctggagggtggggtgggagccgcccccgcgcggtgcgtcagggctcgtcgcccaatccgtactccttgagtttccgcgcgagcgtgttgcggccaatcgccagcacgcgggccgcggcggtgcggttgcccttcacggcgtccagcacgcgcaggatgtggcggcgttcgacctccgccagtggcagcaggcccgcatccaggggcgcaggcgcagtcggcgcgttgacaccctgagcggctgcgggaggcggcagggcggcccggtccacatcgggcaggggcaggtgctcttcgagaatctccccttcacagagcaccacggcgctctcgatacagttctccagctcccgcacgtttccgggccagcggtagcgcttgaggcgctccaccgcggcggcgctgaggcggggcggcgtcagccggtgcctccgggcgacggcggcgacgaagtggcgggcgagccgctcgatgtcctccgcgccgcgctcccgcagcggcggcagcaccacctcgaccaccttgatgcggtagtagaggtcctcgcggaagcggccctcggccaccatgcgggccaggtcccgatgggtggccgcgacgatgcgcacgtccaccttcacggcctgggtgcctcccacgcgctcgaactcgcgatcctggatgacccgcagcaacttgccctgcaccggcaggggcagctcgccaatctcgtcgatgaacaccgtgccgccgctggccgcctcgaacttgccgggcacgcggtggtccgcgccggtgaaggcgccgcgttcgtggccgaagagctcgttctcgatgagcgtggcgggcagcgccgcgcagtccaccttgatgaagggctggtccctgcggggaccattcacgtggacggcacgggcgaacagctccttgccgctgccactctcgccgcgcagcagcaccgtcgcatcggtgggcgcggccttgcgcaccagtcggtagatggcctggagctgcggggactcgccgatgatgcggttgaagaagtagccccaccggtacctggggttgctccttcgcgcgttggagctattgataaaggctggtactctgtagctcggtgctcacctgggaggcgatgacggtcacccgttgcgtgtcctcgttggtgaagcggtcctctccgcggcggttgagtacctgtatcacgccgtagagggagccgtccccgtcgcccagtggcaaggggagcaggctggtggtgcggtagcccgtcatccggtcgatgtccactaaaaagcgatgctcgcggcaagggtccggcacgttgatggcgtgccccgctttgcatacggagcggacgacgccctggtccagcttgacccgaatttgggactcctcatggcaggtgattgtcgtgaatcaacagctcgcgacgggtcgcgtccaacattcacagggttcaatggtttgttcgcaacgtaatgaaaatattgtccataagtgtgtgaaggtgttcgtcgaggtccacatagctactgaagagtcgtaagaatgggacaagtccctggtaagtgtacgaaggga

SEQ ID NO: 964 - DNA, 10085 bp, Myxococcus xanthus
gcccgcatggcggtggtggtcctggccgacgaggacgacaactccggcttcggtccggagagctacatccagttcctccagacgctgaagggcacgggcatgtcccaccgcagccggctctacggactggtgcccaccgacgccggctgcgcgaccgcgggcagtggctcggcccgcttcaccgccgtggcccacggcacggggggacaggtggccaacatctgcggacagaactacgacgggctgctggaccaggtcatccagggtgccggggagccgcaggcggacttcccgctcaccgcggcgcccacgggcctgggggagatggccgtgcgcgtccagggccagccggtgcccgcgacgcagtgggtctacgacgcggagcagaacgccatcgtcttccagcccggggccgtccccttggccggccagtcggtggaggtccgctaccgcagcctctgcgcggtcccgtaggcccggcagggaggtccgggtcaccccggccaagacagggaagtcgcggtgttacaggaaatgatgcaccgtggacttccgtgttcccacccggcgcggctatcgtggcggacgtcgtggaaacattcggccgctacgagctgcttcggaaactcgccatcggcggcatgggcgccgtctacctcgcccggcagaaggggccggtggggttccagaagctgctggtggtgaagcggctcctgccccacctgtccgaggacgacgagttcatcgacatgttcctggacgaggggcgcatcgccgcgcacctcaaccaccccaacatcgcgcaaatctacgacttgggagacgtggacgggcagtacttcatcgccatggagtacgtgcatggcgaggccgtggggcccctgggcgcccgggcccagcagcacggcatcaccatcccgctggggctcaagtgccgcatcatcgcggacgccgccgcgggcctggacgcggcccacaacgcgcgcagcccttcgggccggaagctggcgttgatccaccgggatgtgtccccgcagaacgtgctggtgggcttcaacggcggcgtgaagctcatcgacttcggcgtggccaaggcgtccgggaagctgtcccagacgattgtcggcaccatcaagggcaagcacgcgtacatgtccccggagcaggcccggggtgagccgctggactcgcgctcggacgtgttcggcctggggacggttttctacgagttgctgacacagcagcgcctcttcaagcgtgagacggagctggccacgctcaaggcggtggtgggaacgaagattgtccctccgtcggaggtggtgccggagattcccaaggcgctggacgccatcgtcttcaaggcgctggcgcgcaagcgggacgagcgcttctccacggccggtgagctgcagctcgcgttggaggagttcctcctcacggagaagctgcacgcgacgacggcgcacctggcggccttcatgcgggacatgtacgcggaggagctggaagaggaccgcttcgccaccgagcccaccgtcatcaacttcgacctgcgtcaggcggcgagggcccagtcccccaggcctccggcgcgcgccagcggtggctcctcccccgcgacgtcgcccgtgaacgccggtcaggcgcggcccgccgccccggcccgtccaccggccgccgcgccgggtgcgaaacccgccccagcgaagcggcctccaccgaagggccccggcggacagggcgacggcggcaagtagcccgcggcctagagattctttccgtccaccttcatcaccggcaggccgtccagttcgatgccgtccaggcagcggacgttgatggcgcgcatctccttgccgtccggcatcgtgcctttgccgaaggagcggaccccgcaggtgtcacagaacaggtggtgaatggacttcttgccgaactggtagtcggtgatgtgctcggcccccttctggaggttgaactgctccgcgggggcgaagcccaacaacatgcccgtcttgagacagatggaacagttacaggacaccagcggctggctcaggtccaggctcacgtcgtaacggaccagaccacagtggcaaccaccctcgtagcgcttggattcggacatgcgcgcatcctgccccaacgcgcacgggatgagcggcacgaaacgatgacgcctggcggcgcggctacaggctggccagcgccacgcggtacagcgcgcggtagcccatgcgcggcgcggattcgaagcgctccgcgttgaagatgtccttcagcagcgcctgcccatccggcgacgtctggaggctcagcagcgtggactccagcgagctcaccaactgcggctgcagccccatggccaccgggacaccgtcgttgggggcctcgtcggtgtacgcaatcagctcgaagcgccggccggcgcccgcgcccagcacgtcctccacgccggtggcgaacgtcagccccgtggacgccggcgggcaaaagacgctggtgacgtccgccttgccgtccagcaccgactccagcgcgccctggtacgagcccgcgaagtgctgcgcgaagaaggcccgcgtcggctccaggccctgcgtcttgaggtaggcggtgggcagcaggtagcccgccaccgaatcccggtccacccatgtggcggtggtgcccttcagccgctccaccgtcagccccgcgcccgcccggcacaccagggcggaccggtaggacgacatgccccggcgcacgccgcgcaccaccacgcgcacgcccatggcttccatgcgcgcgcagacgaagggcggggcccaggccgcgtccgcgcggccagagagcaaatccttggcgagcgtctcgtagctggacgcgacgctcacctccaccagcttgcccagcgcgcgctggaggaacgacgccaggcggtccgcgcgctctcgcgccgactcgctgcccagggaggggggcagcccgaaccggaaggaatgccggggcgtcgagggggcttgcagggtcatacgaccccctaactacccctccctgctcagtcgcgccacttcatcgtcagccaggccgaaggtggcctggagcatatccaggattcgctgctcgggatggctcggggcgccccccgcgtgggcaatcttgatggccagccggaaggccttcacccgctgggcgtgcgtcgtcaggccgtgggccagcacatggagtcgctggggcaggccctcggcggccagggccgtcacggactcgctgacgaagctctgggcgcgctcggggctgacgttctcgaagagggggtccgccgcgaagctctccaccagcgcccgggcctcggcctcctggagcttcccgtccgcggcgctcaccagcaccatgacctccgcgaacagccgctccagcggctcgcccagcgcctccctcaggctgccgccgttctcgatgacgtcgatgatttgcgccacctcgtcctcggagatgcccagcgcggcctggaacgtcttgagcaggcccagctcgtcccgcgtggcacgctggtccgccagggccaccgccgccgccagcccgaaggccagcatccggttcttatggtccggcagccggcgccgcagcgacgcgagcacgtcatccagattcttcgcctccgacaaccgcgcggcgctggtctccaccagggcgttgagctcatccgggcgggtgccctcgaactccgggcgctccagcacgcggctgaggagcgtctgcatctcccgctgcgagacgcgcccgtcggccatcgcggccagcagcatcgcctccaccagtgcgccgttgcggtcgttccgcgccttcactgcctgctctcgagccatgggctggcgctcccttgcgtgtccttcggttcggtcgtcgtggccccttcctcgctggcgtgcagcgggtcggggttgagcgtcttgtccagcaggtgactcggccgcacgttcgccatggcgttgaggacgctctggcggacgttgggaatctccttgcccagctcctccatcagccgctgcatccgcttgcgctggaggttctcctgcgtgccgcacaagtcacacgggatgatggggaaggccatcaactccgcgaacttcgcgatgtccttctccggcgcgtagcacagcgggcggatgaccacgttgcgcccatcgtcgctgcgcaagaggggcggcatcgccttgatggagccggcgaagaagaggttgagcagcagcgtgtggatgaggtcgtcgcggtggtggcccagggcaatcttggtgcaccccagctccaccgccgccgtatagaggatgccgcgccgcatgcgcgagcacaccgagcactgcgtcttccccggaggcgtcttctccaggacgatgctgtaggtgtcctccttcaacagcttgtacgggtagccctcacgctggaagtacgcctccagcttgtccgctgggaagccggggtggccctggtccaggttcaccgccagcagctcgaacttcacgggtgcgcgacgctggagctcccgcaggaggtgcagcatcgtgtaggagtccttgcctccggacacgcccaccatgatgcggtccccgtcctcaatgaggcggtggtccgcgatggctcggcccatgtggccaagcagactcttttccaggcgctggacgtcgttcatcggcgcggccatcctagcggcggcccgggaaaaaacacctcaatcccaaggcccggtccgctagcctgcctcccgcaatgccgacctacccgcaaggtgccgttgacgtagtagatgcctcaggagaagagagcgcgacccgcacgctggaagccgcgcgcgaaatcgccgtggacctggaggcggattcgatgcacgccttccgcgcccggctgtgcttcctccagctcgccaccgacgaccaggtcttcctgttggacacgctccaaccgggcgtggtgccgggcatgctcgccccgctgatggccgacccggcgcgcaccaagttcttccacgccgcccagggcgacctccagttcctcgccgaggtgggagtccgagtgcagggcctcttcgacacccaccgggcggccaccctgctggggtggcccaaggtgggcctggccgacctcgcccgggaacggctgggcgtggagctgccgaaggagcaccaacagtcggacttctccatccgccccctgcccccgggcatgcgggagtacatcgccaatgacgtgcgctacctgtgcgagctgggccgccaggtccgcgacgcctgccgcgaggccgacatcctggaggaggtcctcctggactgcgtccgcctgtgcgacgaggccgcggcgcgccccgacgtgggcgcggacttcaagcccaagctgccccgcgccgggctgaatcccacgcagatgacgctggcccacgccattgcccacgccctgcaccgcaagcggctggagtgggcggagaaggacaacgtccctatggggcggatgctctccaacatggcgttgggtgacatcgcggtgaagctgcccaccaaccccaaggagttggcgcgcatggccggcgtgcggggctccttcatccgctcgcacggggaggagctcctggccgtggtgcgcgaactgttggagaagtcgcgccggggcgaactggcgccggagcgcgaacccaagggccccaaggacaccaacaagcgcaagcgcgaggaggccctcaagaccttccgcgtggagaaggccaccgagcgcaaggtgacgcccagcgtggtgctgaccaatccgctgatggacgcgctggcctcgcagcccccgaaggacgtggaggcgctgacgcaggtgccctacttgggggagaagcgggtgcggctgtacggccccgcgctcgtggagctgctggccgcctaccccgtcctcaacgcctgaagtgaaggtggggccgcgacctgctcgcggccctggcgccagtcatggagaatgtccgcccgcgcgccccttcctgccgcggatggagatgctcccggtgcggtgccgacacttcatctatccgctgctcgtcctctgcctcggcgcctgtgcgggctcgcggccccagcccgctcccactcggtctgcccccgctcgccccgtcacgcaggccgtgacgcccgagaaggaggcccccgtcctcaccccgccgggactgcggctgtctccggccgtgcggcccgtgcggcagacggtgacgctggagctggacccgcggcggaagatgttcagcgggacgacggacatcgaaatcgagctgccccaggccacgcacgaggtgtggctgcacggggaggagctctccgtgaaggacgcggccttcatcgtggcgggcgcgcgggtcaagacgtccacgctgcccatcggcgacatgctcgtcttcctcccgcgtgaggcggtgggccccggcaccgtcatcctgcgcgtggcgtacacgggccgggcgcgtgcccgggagagctcaggcgtctaccgcgaacaggacgcggggcgctggtacacgatgacccagttccagccgctggccgctcggcgcgccttcccctgcttcgacgagcccgccttcaagattccctggcggctcaccctgcgcgtgcgcgaggaggacggcgccttcgccaattcaccggtggaggccgagacgcacggcccggatggatggaagacggtgcgcttccagacaacgcccccgctgccctcgtacctggtcgccttcgcggtgggcccctttcaagccgtggacgcgggcgtcgcgggccaacaccgcgtgccggtgcggatgctggtgccgcagggccgcgccgcggaagcggcctgggccgcgcaggccacgcccccgctgctggagcacttggagacgtggttcggcacgtcctacccctacgcgaagctggacgtgctggccctgcccggcacgcaagggggcgccatggagcaccccggcctcatcaccttcagcgccccgctcatgctgggccccgtggagggggactccctgtggcgccagcgctacttcgcgctgacgcaggcgcacgagctcgcgcatcagtggttcggcaacctcgtgacgcccgcgtggtgggacgacctctggctcaacgagtccttcgcggactggctcgcctacaaagtcgtgacgcagtggaagcccgaatggcgcggtgacgtgcgccgcgtggaagcgcgaggtgatgccctggtggaggaccggctcgtcagcgcgcgcagtgtccggcagcccatcgaagcgccgggagacgtccactccgccttcgacggcatcacctacaacaagggcgccgcggtgctggccatgttcgagtcctgggtgggccccgacgccttccagcaaggcgtgcggcactacctggacacccacgcgaggggcaccgccaccaccgcggacttcttcgaagccctcacccaagccaccggcaaggacgtggcgcccgccttctcctccttcctggaccagccaggcgcgccgcgcgtcgccatgacgctggagtgccccaaggagggaccgccccggctgaccctggagcagcggcgctatctccctctgggctcgccgggcggacgcggggaagaacaggcgtggcaggtgccggtgtgcgtgcgctacgccgccgggggcacggagggccgcgcctgcacggtgctctcggagtccacgggcacgctgtccctggatggcgcgaagtcctgcccggactgggtccaccccaacgcggaaggccgcggctactaccacgcgctgctgcgcggtgatgcgatggagcggctgacgcggcaggggggccgggggctcagcatcgccgagcgccgcgtcctgctggatgacgccgaggccctggtggccagtggcgagctggacgtggcccaggccctgacactggccacgcgcctgctgcgagcggacgacccggacctcgtcatgggcgcggcggccctggtcgccagcgtgcgggatgacttcgtcccgcgagccgcgtggccaaaccgcgcgcgcttcgtccgtggcctctttggcggtcaggctcgccagttgggcttcgttccgcgcccgggcgaaagcgacgacgtgcgcatgctgcggccccggctggtgtggatggtggcccagtcaggcgaggacgtcctcctgcgaacggaggccgggaagctcgcgctgcgctggctggacgaccggcgctccctgtccatggacgcggcgcagggcgtgctgggcgccgcttcggcctcgggggatgccgttctccaccagggcatgctcgaagccctgcgcaccaccacggagagccgtgagcgcgacgtgctcttcaccgccatgggaggctttcaggattccgcgctcgccagcgccagccgggccctgctgctggcgccggacgtggacacgcgtgaggccctgcccatcctcttccggcagttggaggagcagcccacccgcgcgggtgcgttcgacttcctgcgcgagcacttcgagacgctccgggagcggctgccgcgggacatcgcgccctggctgctgggcaccggcggattcttctgcgacgccgaacaccgcgcgcggttcgcggacttcttcgcgccctacgcgcccaccttcgaagggggtgagcgcgccctggcgcaggcgctggaacgcgtggacctgtgcatcgcccagcgcgaagccctgcgccccggcttggaacgcttcctgcgccgctactgacgtcagcgcttgcgcgcgagcatcatcccgtcacgcaccgtgagcagcacgtgctccacgcgagggtccgccgccaccttcgcgttgaagtcgacaatcgcatggtcactggggccctccggctggagcacccggcccgaccacagcacgttgtccgcgatgatgagcccgcccggccgcagcagcggcaacaccgcgtcccagtaggcggcgtagctcggcttgtccgcgtcgatgaacgccaggtcgaatggcccctggagcgttttcagggtgtccagcgccggccccatgcgcaggtcgattttccgtccatgcggactgcgcaggaagaaagcgcgcgccacgtcggtggcctcggggtcgatgtcgcaggtaatgagcgccccatcatccgggagcgcttccgccatcatcagcgctgagtacccggtgaaggtcccgatttccaacacccgccgcgcaccggtcaacgcgaccagcatgcgcaggaaggtgccttcaacggacccgacctgcatgttgggggaggacatccgcgcatacgtgacatcacggagttcatcgaacaggggcgcgggtgccgtggtgtgagcgtccgcgtacgcctcgatttcgggaggaacgagggtgaacttgggcatgtcccatcgattagcacgtaccgcgggggccccccacttcaggttgccgtcagacgcctcgtgcataactttgtcgtcgctctggatggaggaggtctcgatgctggcagccagaatcggtggtgcgcacgcggatgtgtcccggtgcatcgccgcgagcctccagtgtcaggtttcctgcgaagagggcatggcccgccgggtcgcccgaggggagccgctgtccggcgaggtggtacgcctgcttcgacagtgtgctgaactgtgcgaactgaatgcacgcgcgctccagaaggagagccggctcgcccggcgcaccgcgagcctgtgcttcgacctggccaacctggtagcccggaccgcgtggctggacgcagaggaccgcgattcgtacacgctcgcgcgggacgcgctgcaattggcccgcgcgtgcaggcccctgctgttcgcctgagtcagaagcgcaggtgcggactgagcaccagcgtggggcccgcggtagggccgctcacgccgcctgcgggacgggaatctcagacagcatctcgttgagcgcgtcgacctgttgcggctcgtggcccggctgagcctggacgatgtcgatggcgcgctggagcatgcgccgcgccgcttcgggagcgtcatgttggacgtggaggcgggccagctccacgagctgcggcaccaggtatggg

SEQ ID NO: 965 - DNA, 8773 bp, Myxococcus xanthus
accgagccgccaggccagaccggccttcatccgcatgagcacacaaccccctctgttcttcatgatgaaacgactgttcatttctattcaggtgtgtcgaaagaaatacaaaatatgggtgcttccggcttcgcctctccggtccatgcagagcggcgaccgcgcgtcgcgcactcgccatgacgcagcgattaaacttgggctaggcacagcgagcctattcctgccgcgtcaagacacgcgacgcggcgaaacagggagctggccctttccaacgttcagctcagccctggctttgttagggattcttagaactgcggcactccgcccgcggaccacacggacacgatctgcttgggaagagcccacatgctaccgaggtcgagttcgtcgtccccggcatagcccttctccaacgcggtcaagaggctcgtgaatccggcggtgagctgctgctgcgcggccgcgagcccactgccccctgtggtggggtaggtctccagcgggccgccgaacttcagcattgcctgcaccatccggaatcgcgcgaaatggctgaactgatcctccaggtcgttggcatcctcggggcggagctctgggtcgatgacgggtcccaagttgccctcgccctgcccgacgatggcctggagcacctcattcgcctgtttcagcgcggtgcggctgtcaccgccgatggtgctgctgaacctggcgtagtcgtctcccttgtattgcgggttggcgaattcgctcttctgccggtggtccgcgtcgggctggtagagttcgttccagcgctgattgatgccctgctcgatggccttgtagaactgaccgatggaatcgtagacatcttgcggcccgttcggcgcgccatcggtctttggctcgggggtctcgatggcggccaggagggacatttgctcagggttcaccggcccgagcttcacgggcttgttgaccgcgatccaggacgggaacttgtcgtaccgcggcgcccattcgcctgtgaacttcggcgagtatcccttgggggcgaacagcgcattgaagaggttgctggccagttcgaggtgtagcatctcctgtacgacgaccgagtagatgttgttgaaggcgagctgctcccggcttcgattggggttcttctttccgcgaacggtcacctgctggggcgggagctgagcgttcgtgccaggaacctgcaaggaataggcggccgtcagatagagggggatggtccacagctccaagtagacggctttctggagatgatcgaggagggctgcgtcggtccaggtcttgttttgcacagggagctctgaggttggtgggaggtgccgtggctggatgcgccggcgaggagagcaatgttcgagccagggcctgtggaagaacgactccagtcattacaactccttgcggtgatgccagtctccgggggccaggggaatcccgtgtcactgacacgtcagcgacggaggctgacgtgtccgccaactttgcgctgggcgtggtgagatgcctgcgggcggccaggccgtgctcgcccgccgcgcccactcgccttgacgcgcacaggacgcagcgaccgaatttcaggtaggcacaggttcagcgagccgccggattgccggactgccattccaagtacattcgttcgatggccgtcctggcacagtgcacgaacgcggcgacttccgggcctctccgtgccaaatcgtcctgcgtctctccaaggtaagacgcccgcgcactgcgcatgatactttgatgttcatccggcaggcgttcaatgacccactgggccgcaacgtctttgggggcgattccccccgtcgacaggctgaaccagatgcgagccagcgcaagcaccacggtcctttcgtccccacgccagtccgcaggttcgttccattggagagcggtgtcgtagaacgctctcgccagatcggtccggggtacggggtcgaagaggtcggttgctggctcgcccaacaggcagatgctgtgtctccttgccttcgccagcaagattgtcaggtcggggtccacgatggcgggctggacgtggccggcttccatttctccgcgcaaccattccccgaattgaagttcgcgtgacggcgggtagcgccaagggacgaccgcatcccggacgacaacggtcacttcgagagggcggagcgattcacgcgtcattggccatgtcgagaccgacaacagctccttgagcagcgcgtgtcgaacggcttcggtcaatggggcgctgacggttaccagcaaatcgatgtcgctgtgtggtttcagccctccatcaactgccgagccgaagaggtgtatggcctgcagcgaactggccaggtgacggccaatcactgagcaggcgcttgaaacctggtgcgtgatttcagtcggtacggatgcgttcatgtcggccaccactggcagggtccttggctctacagattcggaagatgccccatgtgctccctggttgaaagaacaggggacgaggcttcccctgtcgtcaacactcaacgcaagggcgcaggcgcgcgacgtgcgcctggtcagctcgcggcggagatggaggagacaggggcttggctgcagcctcacttcctcgctgtggcctgctctattgggtgctggcgggcgcgacatcgccggcgcgctcggcgatcggacgggcatagcggacgagtgagagcagcaccttgcccggctcctcggccatcagctcgtgcgccgactgctcgaaccagacgagtcgcttcgacggcgccttgacgcccgcgaaccattcggcggcaaccatcgccgagacgttgcggtcgtggcgtccgaggaacaggagcagcggcgtcttcagccgcttcacatgcgataggtccgccgtcagtatcgcggcaaggagcctctcgaccgagaaatcctgcgccttccagacctggcgtacctcctcgtcggtgtattcgggcgacagattcaccgctgcgccctcgaagctcgcatcgggacgccgataggcggcacccccgaagaaattgagccagcggcgctggagctggatgtccttcaacggcaccggcgtcttgccaacggcatagggcgcgattgagtcgaggtcgcggatcgcctctgcgttcttctccgcgcgcgcctgttccatcgcccaggcccagccgcgccgctcgctctcccgcgcatcgatgccctgggcggcgccgatataggcgtggagccattcggggtgcctctccgcgagggtgagcccgaggaggctcccccaactatggccgaggacgaagatcttctccttgccgaaggtctggcgcgcccatttgacgagctcctcggcatcggcgtgcacctgctcgacggtgagcgtcggggcgaccgtggccggatcgttcgcgacatacgtcttgcccgcgccgcgctggtcccattggatgacggtgaagaattcgtcccagccgtgcgcgaaataccaactcgtcggcatcgccacccagccggggccgccatggagcacgagcagcaccggattgcgtaggtcgcggctgcggatcgagacccattggtcaatgcctccgaggcggagcttctcggtgcgctccatcccctcgggcgccacgatcttgcggagctccgcgatgatcttgacagcctcggcccggtcacgagggcccggcgcctcctgcgcctgtgcctgaatgctcgccagaagcagcaccgccaacggtagccacgattctttgcgcatcactccccctcgattctgttcgtgatttccgtggatattacaagccttatcaccgaggcactgcccggccgctcatggacgctctgactccgccaccggtgagcaccaaggtaaagtgggcgaagcgtcttgcacttgcgactggcggagcccgcgggaatcgaatgaattgtcattccgactgcgacgtttggcgtgttgctgggatgcgtggtggtgagtcaccgagacatacgaatccgccccttcaacgtgacagatgcctgcccatgggacagggcgcatggtccacccagcgcaggtcaagccgttcggcccagccctttggagatcacctctcgcatgctcgttggctccactgccgcgaattcaccccgtggctcgcgcggtagaggccgattgtggtcgttgcgcaccgatgaggcggcgaccgaatgggggggccacggcttccatggccggccctacctggacgtgctgagcgcatcgcctccgcgctccaggtgctacgccaggtcaccaccgtgaaccccgtgcttgctccattccatcgtccaccgggtgatgtcaatattgtcctacgcgcccaagcgtttcagcggttgacgcggcaaggaggcccgaaaccagcctccagggcctgtgtctcatggaggtagcgatgcgacggtttggactggtgctggggctcttggggggcgtggggtgcgccaccggcatgcgaggtatcgcgacccagtacaatccggagacggggcagtacgagacgcccacgcacgaggtcgtctatcaggtgcccgccgaggacgcgatgatgacggcccggttcatcctggagaagagccgctatgacgtgatggagaaggaggggggactggagatgttctcctccttcattccggacgtcattccccccgagcgctactacatccaggggacgcggctcgggccccggcaggcactcgttcgagtctttcgcatcaggtacacgcaggaagggggaggctacactgcggaggcctccggtcggtccggcgggcatctctccgtggcggatgccttcaccaatatccctgggctggagggctaccggccggcgcacggctaccgcgacctgggtatcgagcagaagctgctggagcggctggagatggctcccgcgctggagctggtgggcggcaattcccctgttcccattcgctcggtggtgatggagaactggggcgagaagggtgggaccaccgccacctccgccgctcccgcgtgtggtgctcccttggcgggggcctcgtccctgttctctgcgggaggcgtcctgctcgtggcggaccccctgggcacgcaggaggtgccgtccgcggcgctgcggatgttgtgcgaggcctcggcccaggagctgccggtgacgctggcgctgtcgattcccgtctccgagcagtcgctcctcgatagctacctggccagcgacggcgattcagcggccgttcaggagctcctctcggggagtgctttctggcgccggacataccaagacgggcgcagcagccgcgccatgctgtggctcgtcgagcaggtccgccgcatgcgcgtctctggaaaggacgtggacgtggccgccatcgactccgacaaggcccacggcaatgcgcgcgaggcgcagatggcccagcatctgctgaacgctcagtcgaagcgcccccaggcctggacgctggtgctcacgggcagcgtccacgcgcgcaccacggaggtgagctgggatggcgacttcgagcccatgggctctcgcgtggtgcgcgcccttccctcggtgcgtgccctggatgtgggcttccagcgaggcacccagttcgtctgccgctacagcgtctgggatgaggaggtggagtgcaacgtcttcggcatcagcccgacgctcgaggcacggcagtcctccaagcaggccgttggcctgcagctcttcacctcccagcagcctcacggcttccacggccggctctacctgggcgcgctgagcgcatcgcctcccgcgctccaagcgccgcgccaggacaccaccgtcgaccccgtgtcctcctcgaagtgactcgcctggacgcacccatgaccacggcgtccatgctctccgagccgttcatgtccggaggtccgccagccaccgcagcgcccggagcccgggcatgaagcagtactcgcctccacgggtgaccacgaaccgagggaggccttgcatgcgcctggggatgggacgctttggaactgagaacacgcccgtcccatcgttcgcgccgacgagggggtccttcgcatcgcccagcccgagaaagtcaccgccgttgacccactccgattgcacgaactcgaactgccgtccgaggtgcgcgccgatgaaggcaaacatcaaccctcgctcggcgccgtcgtcctcgaggatgccctcgggcagttcgggcccataggcggttccgcgccggatcatccgatggagtctgaccacgccggcgacggacgcgtcgcggggattcgctcgccggacgtgtgacgcgggaggcgtcttgtatccggtcgggtcatctgaatagaggaaggcgttgttccgtgacgaatcggcgccaaggtcgggagcgtcgtggtgtgggcacagcgccagcggcgcgccgctccgccacctccccatcatcttcgccgccagaaactcctcgtcctcccggctgctcgcggtggccttcaggtactgcctgaacgcggccacccgctgatgaagcttgcggaaggcgacgtacgtcccattgcgccccaggacgtcaggccagggcatcggggacacgccgcccgtttcgtcggggtagccgagtacgaattcgcctgccttgagcggttcctcgtggggattgcttcctggaatgccgctgccctcgacggccggatggctgatgccgtccttgaagccgaacggctccttgccggtgctcagtgcatggcagtcctgacgccagattgcctcgatgccgccaagttcccgcaccgccttgctcgcgcgctccagcgccgtttcgagttgagcctgagtcggcgaaagcgccgtcagcacgacatggacgtcgctcgttcccagcggtggctcccagtgttcggggctgctctcgccgtcgtcccccagtgccttcgcccgggcggccatcccctggcggaactcccacgcgaagctgtccagtgagtttcgtggtacgcccagcgcctcgagcccgtgatacgtgagcgcgacgctgagccagcaatcggcggtcgggctgctcggatgggcggccgtggccacaaccgagcagagccgccccatcaactcccgccccgcgctccggtcatcgatgcggaggaggatataggtcgcgacgtacggagaagggcggggccgcagcactccgctatggatgtcgtccagttcgagcatctcagtgggccgtggcgaggttcttccagaaacgcaagaggctgtcatccgccccgaacaaggtgctgaagatggtggagtcggcgaccagcacgtcgccggccctgccgtcgcccggcggcatccacaccagcgcattgaactcggtgtttccctcgttcgtgaagggatggggcctggtcaggtcgattggctgtttcgccaggacacgaagggaatgggagtcctccgtcgtgaccgcgtagtgcggcaggtgcatgtggaagttgaagttctggaccccggagagccagccgcgcgtatccaggtcttccatcaccgtcaaagggacgcttcggttcgttccttcgacgacggcagggcgcaggccccaacgattctcgacggggattcccagccccttcatcaacgagcgcgcatagccgccgaagcgttgctgacgaggcaccagcgcgtcgccatgatgggcgtactccagggcgcgctcctccaggtccggtgagtgtccgacgtcgtggtgtgggcctatcaccaggcaggtgccttcgcgctcaaggaatgcgcggaccgcttctatctcctccggggcggccacctgtccggtgacgttgtggtccaggccgaagacgagcagcgtgtccgcgtcggcgaggaccctctcgtcgagtggcagggggaagcccgcctgatcgacccgctgaaacatggggaccctgtgcccggtgacttcctcgatgacccgttggaacttcacccatgcccagaagaagagctccagtgagcccgcgactccttgctggaacctcagcgggtcagcccactgtggggactcgtagtggggccagagggctcggcgaacctcggtcatggtcgagaaccggttgtccatttcggcagggtttcgattggcttctccggggtagctccaggacgtgtagacgctgactcgccgatgcccccgcatgtatctcctcggcgcgtggttctggttgtacgtccgccccgacgtttcgcccatgacatgcctctactgcatctgctcgagcatctcggcgagcgcggccttgatcttcagcgccttcttgatttcatcgcctgtgaagaacgggtactcgccgtactcgagaaagctgttgcactggtggtctcggatgaactggatgaacgcaggcgtgttggtcttccagtccatgggaaacccctcgaggttctcgaaggcggtgttgattccggactgtgtgaagagtacgactgcgtcctcggtgtatttgtcgaaatcggtgtcgaagatgccctgatacatgaaccgggtgtcgtcatcgaagagcacccagcggaggtagtggagcttgagcggcgcgagaaggtcggggttggccttgagtgcttcggcgaccctctggccgtagccacgcatggcatcggcgcgcccgggcttgacgttggcaacaatcgtgaagccataacaagcaggagtcttcggaaaaatcggaccgtacttcccccgctcgaggtgatcagtcgacctgggaatggccatggcctggggc

SEQ ID NO: 966 - DNA, 9198 bp, Myxococcus xanthus
ccggacggcaccgcgtgtgagccggacaatgcctgcatcaccggcgccacctgccaggcgtggctctgccgggtcgaggagcgcgcctgtgacaacggcaacgcctgcaccacgtacgtgtgccacgtgctggacgggtgccagtccgtgccggcgccgccctgtccagcgtccgggccgtgtcaggtggggacgtgcgacccgcggatgggatgcgccacggcccccgcgccggacggcaccctatgcggcgcggcccaaggcacctgcgaggacgcggacgtgtgcctggatggggcctgtgtgaagcgcgacctgccggagggcttcctgtgtgaagcggccagcccgtgccaggtgtcggggcactaccgcggcggcgtgtgtgcgcggcccgcggcgcaacccctgaaggtggattgggagcacgacgcccgggcgggagaagagcagcttcaggacctgctggtggggccggaaggggacgtgacgctgtcgggcttctacggcacgcccgtgctggacgcggcgggcaaggggcctctggtgcgggcctccaaaccggcgcgccgctgcatgctgtggaacgaccggatcctgtgcatggacatgccgatggacgggacggtgtcgctgctggagcgcgacacggggacaccgcggtggaccttcaccctggccgacgcgcggccggacttccgggacaggacgcagacgctcttcctggcgcggctggcggtgatggcgccggaccggctggcggccctcttcgaggcctaccccacggaccagcggcgcgacacggcgtgccgcatgtacttcctggtggtgctggatgccttcggccacatggtgtccgcgcgcgagttgacggacccgatgctcgccgagtgcaaccacccgcacccgtatggcctcgcctcggacgcggtgggggacctctacgttgccttcgcgcccacgctgaacacgggcgcgccgctggcgtcggggacgccctcgttgctgatggccttctcctcggacggggtgccgcgctggcggaggacggagcccctgcgcgcgggcgagctcgcggtggtgaacgggctgctgctgcccgaatggggcttccaggcgttgagcacccgggacggaacaccggtgggggagcacctcgcccagcaactgggccgcgcggtggccacccgggacgtggtggtgcccagcgcgtcgggcaccacggtgaacgcggatgtggacagcctgagtttcacgccggccgccacgcagctgaagggcttccggctcccggacctggagccggcgtggctgtactcgctgaaggaaggccagcacctgacgagcaaggagctccggctggccacctggcccaggggcgcggggcttccgcccgagacgctggtgttgacgcacgcggtggcggccgacaaccagcggttgctggtgggcgtgcgcgcgcgggatggggcggaggccttccagtgcccgctcgactacgcgccgcgcacggtgccgcagttgatggagctggggcccggtgccctctacctgatggatggggccctcagttgtggcgagtgcgatccgcccttcgccaacagccagccgcgcttcatgcgcttccccatgccggggttgctgcccgcgaacgcgccctggcccgggactttcggaggaccggggcatgggcaccatgagaacgcggctcactgagcggcgaggcccttcactgtggagaacttgtgggcgcttgagaggatgcgcccctcgcgcagccagccctggttatccacggtgagcggtgcgcccacggcggtgacgtgcgtaggggccttgcgcgtgagccacccgagccacgcgcacagcgccgcgtccaactggtcatgggtgggaagcaggcccggcgggaagcgcaggccccgcgcctccagcaccgcctgtcttcgcgtccgtcccgcgtgagacgtcttcttccccaacttctccacagacagcgcgcgccatgtcgcgccggggaaggcctcgaagaggcgggcctcctccagcgagtccgtgtccacgtccaacaggggatgcccaccccgcgcatgcagcgccgcgaacagcagcaccccgccccggacgaagccggcgaagggacgtccaggctcgggcagcacgtcgggcgtgcgtcccggcgcgcgcaggcatcgctccgcttcgcgcacggaggctcccggccgggccagcgcctgggggccatcgatgacgagcacatcctccgggttcaaaggaaatgacgcgcgcagcagctccggggtgaagccgagcgccttcgaggggacaggccaccggagctcggagaagcgcacctgcccccgggcatccacctccgccacgtccactggccggggaatgcgtgcgtacgggtccgtcaaatcccagcccaggaagcgcatggtgagctcaagccggcgtagcggtttcccacatatcgcgctgcttcatgacgcgccctgaaaggaattcagtctccaccgcgcctgctcacactcatcgtgaatgcgcaactgctatgggtcctcaccacatccggcctgtcacggtgcttgcgggagtcagaacccgacgggtggacaggccccgcgcagccgatattcttcgcccaccgtagcgttggcgttcgtggacggtattccacggtgcccacgtgcaggccgctcgggaagcaacccccttgttcccggcgctcgcgtggaaggagtgcggttgcccggacgaccttggaggtccggcgtgcggcggcttcgtggcatcgtggggggcccgctcgggccccgggtggaagtctcccggggcccgagagacctcgttcagtcgccgctagggttgttgtgtctccgccgcctgattcgcttccacgcgcgtgaaggacagcaggtaggcgggctcgtctcgcgtgctcgcctgtatcaacgcttccgtcagcgcatgcaggggccagcggtccatggacgccttgcggaagagggtcaccgcgccctccagcgcctcgattcgcgccagcgcctgttcacgcccggcctcgtcgcccatctcctgggcgccgccgcggacgagctgcaggcccaccacgcgctccaccatggtgggttgttcggccatgcgcgtgccgatgtcgcgggtgatgcggcccagccgcttccggccctcgggggacagcgagccgcgcgtgcccacgttgcgcgtgcgcagcacccatgagccccggtccgtcacgctgtgggccgccaccgccatcgccgtggcgctgacatccggcacccccgagccctccagcagcttccgggcttcctcgtacgtgcgggtgaagacgccctcgcgccacacggggagggcggccacctgctccaggcggtcaatctccgccgcgctcatctccgagcccggctccgtgtctcccaggagcagcagcaactgaatctgcatggcgcgtgggttagcggccgccagcgcctccagcttctggcggaacaccgtgcgcgcttcgtcgtgggaggactgcggcaaggcctcgccccggagcacgtccatcaccgccacgaagagggacgggtcctccagccgaggcacctgccgcagcaggaagagcgccttgtccgcgtccagtcgcgggctgcccagggccagcatcagcctcacgtcatccgacgcggcacgctcccaggcggccttcgccgcggcggcaatggccgggtcgggcggcagcggtgcggctccgggaagcagctcgctctgctgaaggtcgggctggcccaggtccacccaggcctggcggaacgcctgttgccagtccatgccgggcgtgcgccgcagctcgctcagccgcgccagcagcttggcttccggagcgcccggggcggcggcctccagccggcggagcgcgtcgctggcctcggtgtcctggccttcctccagcgcgagacaggccttcacgaggagcgccggagcatgttggggcgccagcttcagcgcggccgccagtgcctcatgcgcctgggcccgctgtcccgtcgcggcggcccgagcggcgcggtccgtctggaccagcacctccatgggggcctgggactttgctttgggcgcctcgtgcgtgtggtccgcgtgggacgcgccatgcgcgtcgtgcgtgtcccgcggggtggaaccgggcgatggaggccgtgggctccacaggaagagccctccggccaacaccgccacgccaacgcccgcgcctccccacaggagcttgccgcgtcgccgaggcgtcggggcgttatcggaggaagggaggggaggcgtcatcgggcgggcatctccgcgaggggtggggacgcgcattccagccgccccggccctcgtggagcaagccggtccacccgccaccccgggggctgtccggttcaccccacccgtgtgatgtcattgacgcggtacgcctccctcggaggcgggcgcgtcagtccttgtagacgaccttggagccgccgctggcgcgcacgtcgctctggctcgggcgggacacgagctggaggacgctgcccccggaggcctcgccgctgacgcggtcggatgcatccacctccacgcgcgagccgccgctcgcttccgcgtccagcgtcttgacgcccttcacgtccagggcacgcacgatggagcccccgctggcctcgacgtcgaagtccgttgcccgtcccgccagcgtcaccttcgagccaccactggcctcggcctccacctggcgtgcatccacgccgcggacgttgacgatggcgccgccgctggcctcgacgtcgaactcgtccgtgcgcgtggcgtccgcgtccacgtggctgccgccgctggcgtggatgccttcgacgcgcgggctggagacgtacaggcggacgctgccgcctttgaatccgctgaagagcttcttgtccacgcgggtgcgcagcgtcccgtcatgcacatccatttcgattcgggacacgagttcggccggtccctccaggcgcacggacttggggcccaccttcacctcggcccggatgccgtggctcaccgatacctcatcgaagtcgggcacctctcggacatcgcctcgctgctgttgtgcggaagcggacgcaccggcttgagaatcctgggcatgggcacaggcaccgaagaggaggaaggcggcgacgattgagacgcgggcgggggacatgggcacgctccaatggaaaaggggccacgacacgggcccggcgtgctcaaggtacgcacggtccccgcattgattgcctgccccgccgttcaggggtccgaaagcaggctcaacgggccgcggacggaggtcgtctccccgggcttgatgtccacggggacctggtgcgccttggtggtggcatccaccagcttcaggttgtgctggcccgcgggcagcttcaccttgaagagcggcgtcttgcccaggtcctggccgccgaggaacacctgggccttgggctcggtgaccagggtgaggaagccgggctcgcccgccggtacgctctccgaggcgggcggcgtggccggtgccttgcggggtgccgtggcgaccgccttgctccgctgcgtcccgttgcggacgcgcttgaaggtccggggctccttgagcggggcgtcgtcctcggtggcggagtccgagtccggggcgctctcatccggcacggggacctgatccgtcagggtggcggggtccacatccgcgatgaccagggccgaatcacccgtgtccttcggcccatcgttcaccggtggggccacgggcgtcgctgtcgccgccgccaggtccttgtccgcgttcaccggagggcgtgtcccggcggtttgctgggagggcgatggggcagcaccctggccgagcaggggtttcagccgggaggacacgacgccaccgtccagccccagcatcaccaccgcgacgcccagcgccagcacgcccaccaccgccgtgacagccatccaggcccggcttcgccgagcgggttgtggctggaactggggggcccgtgcgcgcctggggcctgttgtgtcgctcccccggccttgcaccgtggattcttcttcgtcctcctccatgggcatgtcttggacgcggacgggctgggtggtgggctcggtcgaagagccaccctgcctgcggcgaggaggaatggggcggcgcggcgagggcgtcaccggagccgtgtccccaccacgctcggggggcagcaccggcatgcgaatcatcgccgtctgcaggtcgcgctcggcggggggcggcgtgggcacggaggcgcgcaggccgtcctgcgtccgggacgcgcgggaccgtgcctcggcacgcgggggctcattcacggacggggaaggctcgggcgtgcgagatgaacgggcccgcggagcgtcatccgaggtgggagccggctcatgtgcgcgggatgaacgggtccgaggcgcgtcatcgccagcaggcgtcggctcagtcgcgcgagacgagcgtgcccgatgcgcatcatccgcggcagggagcgtatccggcgtgcgaatcggtcgggcgcgagagtccccgggtgctggcggagcgggtgactccggggaacgcaccccgcggacctgggtctgttcccgatcagcggcctgggcatcggccgccgaggcccgcgagccctggcgtgaggaggcctcacccggcgtggacgcagaggcgcccgcgtcccggccggtgcccggcaactgcgtgcggaccgtgtgctccggagagtgggccggcatccccggctgggtgcgcacgtgctgccccccggacggagggagcgtcgtcgcctcggcgggaggaggcggcggagcgtgtgcgtcagcgggagacgcgcgcgaggccagccgcttgcccggaggcgcctgaagcacggccttgcgaacggtgccggcttcaggggacgcggcgggagcgcccgtggtgggacgccggggcgcgggggacggcgcggcgttccgaggcgttcccgaagcccgaggcgccggcggcaaggtgacgccgccggtgggcagctcggacggctcgacccccatggccatcaccttggccaggttcaccacgccggtggtgtcccccgtgtcgttctgcccgctcatcaggagttgccgcgtctgctcgcgccggtcggagaagaggcgcagcatcagctcgctgctctgctcgggatgccagatgagcggccccacggcgcgctcgatggcgcgggcgaactccagcgtggaggcgtaccggtcctcgcggcgcttggacagcgcgcgcatgacgatggcgtccagctccggcggcacgtgcttgttggtgcgcgagggcggcgtcacctcgcagcgcagcaccgcgttcatcatcgcctcggcctgcttggcgtagaacagccgcatgccggtgaggcactcgtgcagcaccacgccgaggctgaacaggtcgctgcgcgcatccaccggctcgcccatgatctgctcgggcgacatgtatccgctggtgcccttcaccatgcccaccgcggtgcggctggcgcgggccaggctcttggcgatgccgaagtcgagcaggttggtgacgccctcgtacgtcaccatgatgttcttctccgctacgtcccggtggatgacgggagaggggcggcccagcggatccgtgaaggtgtgtgcgtagtgcagcgccacggcggtatcgcgcaccgccatcaggctgtagcccatggggatgggggtgttggcctgccggcacgcgcgggccacctccaccagcgtggcgcccgggacgaactccatggagaggaagagctctccgtccgcgatgtccaggtcgtacacctgggcgatgtgcgggtggttgaacgcggccgtcaccttggcctcgtccaggaacatccggacgaattcctcctcgccgcggatgtcggggaggatttgcttcagcaccaccagcttgtggaaacccgccaggccacgctgggacgcgaggaaaatctccgccatcccgcccgtcgacaggcggcagagcacctcgtacttgcccagcgagcgcgcttccggcgcgagcggcagcgtgttcccactcattgaatggcgccgaatgtacaccgcgagccggatggacgcgaaagccccgtccctcacgggttcgttaccggacctgatgacttcccgggtagggcggaattgaagccggattcaggtggggaatcgtgggcggcccggacggaggatgtcaggggcgcgggcccggctgcgtcccctgcggcaggtcgccaattcctggcgatggctttcccggtgagacgcaggccctccatgggccgtgctcccgggggctgatattttcccgcgcgagccctgctttcccaggatgggagtgggctaaacacgcgcccaaggttccatggatacttctgtttcgccccgcaccgtcaccggccgtctcgacgtccaccctcgaggcttcggcttcctcaccgttcagacgcccggctcgcccgaggtgctgtcggccttcgtccctccgcccgacctcaatccgtacttcgccggggacgtcgtcacggccacggtgacggcgggcgcggatgggcgctggtcggccagccagttgtcgttggtggagcggcctcgcacgcaggtctacggcgaggtggtgctgcgcaagggcgtgaccctgctccacgtggaccgcgaggtggccaacgcggactgggtgctcgacgccgcggggacgcaggtgcaggccggtgacgcggtggtggcgcgcatcgacgaaggcaaggtggtgctgctctaccgggtggaggaaggggaggaccgctccctggagcgcgtcatcgcccggcacgggctgcgaaaggacttctccgcggaagtcgtcgaggaagcgcggggggcgcgcgcggtgccgcatgcggtgggcgcgcggaagggacttgcgggacgtgcccacggtgacggtggatgcgccgtccacgcgggacatcgacgacgcgatttcggtgctgccggcggggccggacggggcgctgcggcttctggtgtccatcgcggacgtgggtgagtacgtgaagcagggctcggcgctggacgccgaaggcacgtgaacggggccaccaagcggtgtacctggcgggggcgcgtgctgccgatgttgccggaagc

SEQ ID NO: 967 - DNA, 11295 bp, Myxococcus xanthus
  unsure (1)..(11295): unsure at all n locations
tctccaccccggtctccggcgtgggagacagggtgggccccgacggctccaggggccctcgctccgactcagggggcggcgactgcgtctgcgtcgcgggcgctggtggaggcccgggtgcccgcgggggccccttgatgccacacgccgccagcatcagtgacacgctggcggccacgcacagccgcgcgaggaccttgcacatgactagaactgcatccccagccacgcgcggatggtctgcggcgtgtccaggtcgttgcgcagcgtcgcgtcgaactcctgcaagccgctcatcgggaacaggatgccgtacgcgatgccggcgatgaacccgtcctccgtcttgtagtccgcgcccacgttgacctccaggcccagcgccttgcgcgtggtggacggcgtggactgcgcgtacatggcctgcgagtagatgacgcggccgtagatgtcgaagccctcggtgatggtgtacttcgccgaggggcggacatagaacgcgtccgtcaccccgaccagcagctcgcgccacaggatgaggtcgatgcggtagtcgcggttgaagcggaagttgcggatggcgttgtccctgcagccgcccgtgccgcagtcgtactgcgggccctcgaagtcacccggcgccgtctggccgttggcgcccgaacccgggcggcccggctggttgccgaagccatacgccttgtcgccggaggcgaagcccagctccatgttcagcgacagcttctggtccagcagccgcaactcaccctgcgccacgccgccgaactgggccacggtgaggctctggttgagcgtggggtcgttgatggcgcccacgtccagcgcgcggttgccgatgcgccccaactgggcggcggcctcgaactccagccgccagttcttctcctcgtacttcagccacaggtccggcacgaacagcgtcgcgtcccgcgggatgaagccggtgttctggccattcgtggtggagccgtcgtactcccacttctgggtgcggtaggtgaagtgcaggccgtactggagcacgccctggttgttgtccagcttggagcggatgacctggtcggtgtcccggcgcgcgatggcaatcacccaactgtgcgcgtcatcggactgggtcaggtcgatgggctcgcccacggtgccacgcgtgtcggtgacgccctccgagttgaagtccagcatcggcgtcacgtaccagccctcgaaggggttggtgacgaactggacgcggtccacggtgtcgccgaagtcgcagtcgaagcaggtgccgtcgttgcgcagcatgcccaggccccactggctgcccatgcggccgaagcgcaggatgcccaccggcgtcttcacctcaccgtaggcgcggcgcagcttgatggagtcctggagcgcgtccgccagcgggtcctggctctcggagaagatgccgaagatgttgcgcgtgttgccgggcagcagcgtgtccggcatggcgcccatgatgaagttgtccaggccgaggacctccatcttcaacgccacctgctcggagatgttgaaggtgggcgccaggcgcacgcgcatggtggcgaaggactgggtgttctcctgcgcgctgcgaggcgagcgcgggaagagctcccggccgggcgccttgcccaggtcgaacttgtagaagagcgtggggcggacgcggaagtagccgtcgagcgtgaagacctcgagcttgcgcttctcctccgggaactcctcggcccactcgtccgtggcgccaatggactgcttggcggcctcggcgcgaatctcctcgcgaagctcctccttcagcgcttncaggtcgtcacggttgacgccctcacgagtggaggacacaggcgcggtctccgcgggaacagactccgcgggggcggcttccgcgggcgcgggcgcgggcgggctaccctccggcaccggcgtctgagcggtggccgtggacgaagcgacgagtagcgccgccagcagggcgtgagacatgggcaacgatctccagggccacctggggcggccgggtctgaaaggcgggcgattcaagcgacgggaccaaggggtgtcaacgcttaccagggcgggccttcgcgccgtcaacggccggcgcccccgcctcacttcggcgtccgtcctccggctggcaccggggacagaagtgggtggtacggcctccctgggtgaaggactcgacccgggtgccacactgggagcatgggctccccgcgcggccgtacacctggaatggattctccgagcgcccctcctccaggtacaccggctcctccccctcctgctccttgaggccgaagtcgatggtggcgcggatggcctggaccaggcgtttccactcgtccggcgtcagggagccgggctggcgcgaggggtgaaggcccgcgcggaagagcgcctcggcggcgtggatgttgcccaggccagagatgcgctcctggtccatcagcgccaccttcagctccttccgggaggagcccacggcctgctggagctgccccgcggtgaggccatccgccagcggatccctccccaggattcgcaccgcgtccagctcccgcaggcgcgcggcgggcgccggctccaggcggccgaacattcgtggatcggagaagtggatgacatggccgtcgtccagatggaaccgggcgcggctgtagggcgccacctgcccctcggtgcggcggacgaacttgcccgtcatccccaggtgccccatcagccccttaccgccctcgaaagcgaagagcaggtacttgccccggcggaccagcgactccaaccggcccgtgagtgcgtcgaactgctggcgctcggcgcctcggaagatgcgggtgttctccgactcggcgcgcacgatgcgccggtcgctgaaccagcgcaccaggttgcgccgcgcgatttcgacttcgggtagctctggcatcctgcggggcacatacaccggcgggcgtccccacgcaccgcctacctgccgggcagtgaacacgggggtggtggcggcgcgaaagccggatgcccggatgcttgcaccacgtagcccttgaaggcaggtgccgatgtgggccagcgtcgcgcctcccgcggagcgacgcggcgtagacctctggaaagaaaggcagcactcgtcatgcagcgcatcctcgtggcggtactgggagtcaccctggcattgggcctgtcgacgggctgcaccaagcagcgcatctccgccgagaaggccgtggcccgcaccctcatctccgacgagcaggaggagcagctcggcaagcaggtcaaggcggagctggagacgaaggagaagatcaaatacgtgcagaacgcggccgtcgtcgactatgtgcgcggcatctccaccagcatcctgaaccaggcctccaaggaccggcccggggtgaagtggaagatcaacgtcatcgacgacccgaagacggtcaacgcgttcgccacgcccggcggctacctgtacgtctacacgggcctcatcctggccgcggacacggaggcggagctggccggcgtcatggcgcacgaggcgggccacgtcgtgggccgtcactccgcgcgcgccatggtcaaccagatgggcctgcaggccatcacccaggcggcgctggggcaaaacccgggcacggtggcgcagatcgccgcgtcgctggtgagcggcggcacgctgctggcgcacggccgcggcgaggagattgaagccgacgagtacggcgcccgctacgcctccggggcgggctatgacccgcggggcctcatcaccttcttcgagaagctccagaaggagcagggcgacacgcccgcgctgatgaagtggctgagcacgcaccccaccaacagggatcgcatcgtgaacatccagaagatcatctcgcagaagaacctgcggggcagcaacaacggcccgggtgggcttcccgccatcaagcaggccctgggcggcaagtagcgccccagccctcagtgcagcgtggaggagcgagggtcctgctcctccacggtcggctcgggctcctgcccccgggccacacggcgccgccatcggaagcgcgccagcttcgaccgcatggcactgctggcgctcttggccgcgccaggcgtcttcaggggcggctccagcggcgcgggctccccgaagccgcgggcgcccttcgacttcccctccaccgaggcgtgctcgaggatggcgttgacttcacctccgacgatgaagatgagcccggagaggtagagccacagcagcagcaccatcacgccaccgatggagccgtaggtgacgttgtacttgccgaagtgctccacgtactgcgtgaagccccaggtgctcgtcagccacaggcccgtgcccaggacggagccgggggtgatgtacttgaagcgctgcttcacgtcgggcagcaggtagtagcagagcgccagcaccagcatcaccagtgacgcggtgaagggccagcgcaaccaggaccacacgaggtggaaggcgtccacgagttgcagcttgcccgccagccacagccccagccgcccaccgagcaggaacgcggcgaaggacagcgggatgagcagcgagcccagcagcgtcaccagcatcgccaggccctgcgtcttccagaggggccgggattcagagacgtcgtaggccaggttgagcgcggtgcgcagcgcattcacgccgcgcgacgcggaccacagcgtgatgaccagaccggccgtcagcagcttgggctggggctggttgaccagggactgcaggtggccggtgatgaggcccatcgcgtcccccggcaccagtggacggatgcggtccaacatcgcgtccaccgcgcccggggcgaacggcaggtacgccaccagcgtgacgaggaagaagaggaaggggaacagcgagaacagcaggtagtccggcagttgcgccgcgatgtcggtgacgctgtcctcctggaactccctcacgaagcgccggctgaactcgcgccaggacaggtgcttgagtctgggcaaccgcatgctcgcctcctcgctccgagtcgtaccggggctcagaaggtgaaaacggaagcgcgctttggcagcagacggccaggcgggcgcacggcgtgtggcccggtcgaatgacctggtgcggtgtcgtcaggcgacgttgggcgggaggtatctgcccagcagtggacggaggcggccgcgcacctcgtcggggatgcggctgcgctcggtgccgatggccagggccagcgcggtgtcgcagcggcagatggcgcgggcttcaccgatgcgaggcagcgcgcggcggatgagcgcggcgccgctggcggtgacggccttccggttgtgggagacctgcgccagcaggtcgtcatgctcctgccccggcgcgcgcggctgccacgaatcgtagtcggtgggcagggccaccatcgcgtagtggagctccgcctcccgggcgagccgggcctcgggcatgcccgtcattcccaccaggtccccgccccaggtgcggtagagcatgctctccgcgcgggtgctgagggacgggccttcgatgcagacgtaggtggcctcggcgtgcacggtcggccccagcgggtccctggcgtgctccagcacctgacgcagggtgccgcagaaggggttgcccaggtccacgtggacggcgacgtcgtcgtagaaggtgcagggacggcggtaggtgcggtcgatgacctggtccggcagggcgaggtggagcggatggatgtgctcacgcaggctgcccacggtgccggtggcgaggacgtgggtgacgcccaggaccttcagcgcgtacatgttggcgcggtagggcgcgcgggtggcgttgtagacgtggccggtgccgtggcgggcgacgtaggcgacggagacgccgtcgagctcggtggtgacgatggggcccgcgtgaggaccgaagggcgtctccaagatgtgggactcgcccttgccggggatgcccagtgcctgggccaacccggggctcccgatgatgcccaccctgacagccatgtgcctcctcgtggcgcgaccatcgcgccaggggaccataacgcgcccccctcgcgccggaaccccagaagactggtagttttcgtaatcgccatgcgagcccttctgattcttggcctgaccctcgccgccggccccgccgcggccgccgtcccttctggctgccaggaggactacgcgacctgcaaggaggactgctccatccaatacggaggcagcgggcgcaccatcaagcagctcacccactgtctggccgagtgtcaggagaacgtgggcctgtgtgcggaccggcactcgtcgctgaaggggctgcccgccggggtggtggcggatccgccgaagcggcggaagggaaagaagctgactcgcgaggaggacccgttcggcgacggggatgcgcagcccacgcgcaagcgcaacagccgcgaggaggacccgttcggggatgagaagccctcgggccggcgggacggctaccgcgcgtcggagtcctccgctgcggcggagccttcgcgccgcgcgccggagcctgtgcctccgccgcctccgtcctccggtgtcgcggtggaggccacgcgaacgggcgtgtaccgggcgagtgaatcggacccacctccgtcccctacccccgcatcggcccccgccgacccgacgtccctgggcgacctggacgctctggatgatgagcccacggtgatggcggcgccagagcccgcgcccgcgccggccgcgcccgagccggtgaagcccgctccccctgcggtctccgcgagcccggcgaagaaggacccgctgctcgacgaagacgtgtccgacgctccgcctccggtggtgaagaagccggagcccagcaagtccagcaagccggcgctgccgccagagcccaagtacgacatctccgagtgggacccgaacggggactgaggctcgctaggccgctccggttccgcgctcgacatccaggatggcccgccagagcgcgaacggacaaatccccgcgtagccgctctcctggccgtcgttgcactcaatgacaatccaccggcccgatacctcctgggccacgtccaccacgaggaagggcacgtccagccgacgtgccacctcacgcccgagcccgagcgcctcgcgctgcgcttccggcgtcagggtgtacggcgtgccctgccaccagtagggcccccaccccaccagttggcccttccaccagaaggtgcggaactcgaaggagctggggatgcggtccggcgcgccctcctcgacccggcgcaagggcctcaactcccggcacaccactcgctgccagtggaggatggggtcctttgcgtaggcagccatcgcttggcggaactgctcgggcccttcgatgatggagagcgacttgcggtgccggctggtctgccgctcacccttcacgaacacgggccaccccagcagacgctccacggtctccgcgtctggccgctcatcgaaccagacgctgcgcggagtcaggtccgtgagcttcgggtaccagtgcggcagctccgtggcctgtaggtgctgctcgggtgtgtgcaccaggcggatacccgcttccgccaactcgcggtagcgctcggcgtagtcgttccagacgccgaccctggccaccacctccatggactccggcagcacgtacggacggcggcatgcgaagaagcggtcgaaggcgaagtcgtaggtgccttgcccggtcggcgcggacaaaagccacagccgctcttccacctgaagcaggtcctcacccggacgaagcatggacgcagtctatggcgttcaccgccgtccaccatttccaaccggccagcccttcagggcccgtcctcagcgcgagactgaagcacagggaggccacagccctgcgccagacatcatcgcgccttccggaacgtcaggttgatgcgatgcccacccacctgcggatggtggcccggctcgagcggcgtgacgccgtggtagcgcaggcgggctggcccgccccagacgaccacgtcgccatggctcaaccgtactcgcgccggcctgtccgctcgctcagcgccaccgaagaggaagaccgccgggagccccagtgagacggagacgatgggggcggtgaaatcacgctcgtccttgtcctggtgcagcgacatcttcgccccgggctcgtagcgattcaccaggcacgcatcagggatgaacccttcgaagccggccttcgcggcggcgaactgcgccagccgcaggaagatcgccggcatctccggccagggccgtccctgcacggggtccaccgcggcatagcgataccccgtccggtccgtcacccagccccacgaaccgcagctcgtcatcgccaccgacatgcggaagccgcccggcgtctccatgtggcggaagggcgaagcgagcgcgacgtcctggaccgcgctcagcaactccgcgtcgtgggacagcgcgaagccccgaagcaccacggcaccggggcccagcgattcctcgcgagggcctgtgccacccaggccgtcgaacaagtccatcgtcattcgcgcgcctcaagccgcatcatggaagatgacgcctactgtgtggcgctgtcctgaacggatgcggctgacgccgtgccggaggttgacgcggtacacgcctcgcgtgccctgcaccgggcggtggtggacggcgaacaccaccgcgtctccctggcgcagcgggacgacctccgcccgtgactgcatgcgcggacgctgctcggtgaggatgaactcgcctcccgtgaagtcccgcccgggctccgacagcagaatcgccacctggagcgggaagacgtgctccccatagaggtcctggtgcagacagttgtagtcgtccgcctcgtaccgcaacagcagcggcgtcggccgcacctgccccgccgcgtggcagcgttcgaggtacgccgcatgcgactccgggtaccgcacctcgatgcccatggccgtgttccagcggttcgcaatcggcgcgagccgggggtacagcgccccgcgcagcccggcgaccacgtccggcagcgggtactcgaagtacttgtactcacctcttccgaagccgtgccgcgccatcaccacgcggctgcggaacacggcatcttccggatacagcgccgccagggcgtcacactcggccggcgtgacgagccgctccaacgtcgcgcagcctcgcgcgtccaactcctccgaaacgcgtgcccagtcgacatcggccacccgctccgggacctgcttcacggctcggaccgagccgggcgggcgtgaccttcccgccgtcaccttctgcgtggacacgacgtctgcttccttccgggaaccccttgcggccatgacgggaagctaaagggcgacgacaggcccggcactccgagtcttgcggctatccgacgctcgatgagacgggaggccgctctggcgcggccggcgccacggcgggcggccggacgtgcgccgcctgcgtcagtcgcacgccgaggagcacgagcacgccgcccaccgcaatctcccagtgcagcgcctcatccaggatgacccaggcggccagcgcggtcgccgcgggctggaggttggagaacacggccaccttcgacgccggcaccctcgacaacgcgaagtaccagagcaggtacgccaccaccgacgtgagcagacccaggtagacgatggagtaccgagccgcggagctggccgcgagcaccgcctccggcttcgcgaagaacggcgccatcagcatcatcatcaacgtggaggccaccatgctccacgacgtcgcgcgaatcggtccgtggatggcgacgaacggcttgccctccgtcgtgtacaccacccacgacatcaccgcgcccaggatgagcaggtctcccatcaacgagccgctcgcgtccgccagcccgcgccccaacagcaacaccaccacgcccgcgaacgccgtgacgatgccgcccatcgcccggaacgaggcccgctcatgcccccgccccaggctgagcaggtacacgcccagcggcgtcagcgcgtagagcagcgccgcgtgcgccgccgtcgactgggacaggccatagaagaagaacacctggttcaccggccccgccagcaggcccagcatcagcacccgcccccactcgttgcgcggcggaagccggggcccgggcaggaaacacagtaacaacatgaacaccgagccactcaacacgaaacgccacagcaccaccgtgagcggcgccagctccgacatcgcgcgtttgcccgccaggtacgttcccgcgctgatgaggacctggagcatgagcccggcgtagacagggcccaatgactgcggagaggtggacgtcaggggtcgagctgaaggagcgcccattgcgcggcggtacgtaccaattcactcgaatcgccgcagagcttttcgagcaacgatttcgcatccgcctgcttcgccacacccaacgcatacacggcgttgcggcgcagcccgtcgtaccgtgcgcgcgccagcgcggtgccaggtattaggtgctcatactgttccactgtgagtcccgcgagctcgcgcacacccaattccgccaccgctcggggcgcgaagcgtgggtgctccgcgaacaccggccggcggttcagcggacacacctgctggcagatgtcgcagccgaaaatcaggttgtcgaacttgaaccggaacgcctccggcacctgctgctcacggttctcgatggtctggtaggacaggcatgcgcgcgcatccacgcggccgttgcccaccagcgcccccgtgggacaggacatgaggcagcggcggcacgcgccgcaccggtccgccgccgggccgttgccgtagtcgtcgacctcggcatccaccacgagcgtggccagcagcacccacgaaccatagggctcggtgatgaagcagccgttcttccccacgtagccgagccccgcgcgcgccgcccacaccttctccatcagcgggccactgtccacgccgccgtagctgcccagccccgggtacatcacgttgagcgccttgcggaacgccttcatccggtcgcgcagcgtggagtggtagtcgcgtccccgggcatagcgcgcgatgggggagtccaccgtctccgcgtcgtcgcgccagtagttgttcgcgaaggagatgaccgtcttcgcgcccggcagcaggagcgagacgtccagccgctcggcggcccgctcgcccatgcagtcc

SEQ ID NO: 968 - DNA, 13299 bp, Myxococcus xanthus
  unsure (1)..(13299): unsure at all n locations
ggaggcaacgtagcaggcgcgttcatgggcgcaggatatgcgccccccgtgcaacggtgatggcccccgtgtgcggctgccaaggaatgttcgtgcagatttcgtgcaggccgggatgcagcttcacccggcaccgggtacactctgcgtccattacgcgtgctggaggcggccctttccctgaagccccgccaaggtcgtcatgtccgtctctggaatcggcttccctggcccctggtggctccgctctggagccgaagaatacgaactgctcgtcatgcgagccgtgtcagccctcgttgagcgggagcgagtcctggcagagcacatcaccggcaggtagagcattggctgacctccggccgcaggcccctgctggagatgtacgaggccttgggtggcatccttccgtggaacgccagctcgctggaccgcgcccggcaggacgcccgcgtgcgagaccggctggtgcaggcgctggagcgccgtgagctggtggccctgcgcgtgcagcgccgcgccgccgcctgggcgtggccggaaccggccctgccgcccccccggcccgagcccgaggtcatccccctggcgcgcccccccgtggaggtcttcaccctcttccccgacccggcacggcaggccgaagccctgcgccaggccgcggcggcgggtgtgccgttctgcgaggagtgtgaaaagcagaagcaacgggccgcggcgtgagcgcaccggtcccccagcttccgggcctgctgcagtggatgcgtcaggccacggaggaagcgcccacctcggcgctctacgccatcctggacggggcgcgggcccccaacatccaccggctggtgctcacctgcggcctgacgcagagctgcctctatgcggggaagctgccaccggagctggtggaggtggcgccctacctggtgcaactgcggcccggagcgcccgccacggagcaactgctcgccgcgggctggggcaagagctggggcatcttcgtgcagagcccggcccacccggacgcgctgcggcggcacctgcggcgcttcctcaaggtcaaggacgccaacggcaagccgctggtgttccgctactacgacccgcgcgtgctgcgcgtctacctgcccacatgcacggacgatgagttggacttcctcttcggccccatcgagcagttcttcgccgagtccgaggacggcggcagcatgctcgcctacgcgcgccgtcccgaggaggcgcccctggacgcgccgccgctgaccgtcctcccgacgccgctcatgtagtggcctcggccccccccctggggcgcaccgttgaatcgatgcgccccggtcgggcttccccgcgtcagtgcgcggagagcttaggccggtcgaacgcgcgcgccaggcaggcctggttcgccacgctgtccaggttcgtgttgcgcatctggatttcgtagaacggacggctcagcgacgtcacgacggggtcctgcacccagaaggccgtggaaggactggccatgcccgtggcgaggaacggcgaaagcgcgccgtactcgtcgatgtgcgtgaactcagtgcgcgcttcgcggccgtggcagccgttgcaggtgttgcgcgagaagacgtgacgggcgtcgttgacggagatgcccgacgcacgccagtacgagtccgtcggcgacgaaatccacgggaacgcgccgaggaacggcgtgctcgacgtggggtacgtcggcggcacggtgtagctgttggccaggatggcgggcgtgttcgcgttgatgaagtcacgcagcaccgtcgtgttgttgtgcgaatcacccggcgtcagcaccgtcggctggccctgcaggcggttcaccgagggacccgagcccatcaggtgaaactcacgcagctcccacgggtagcgcagccactcctcgttggtgcggatctggttgatggcgctgccgttcggcttgcggggcgcggcgttgcgcaccaccacctgctgcgtgaggctcgtcagcgccgcattgtacgcggagctgcccagaatcatggacggcgccgacaggttcagccacccctgcgcccaggtgcggaccgcgtcacagctggcgtgcgggacaccgtactcgaagatgaccaggaagggccgcacgccacaggtcccgctcgaacgatccaccgcggcgaagacgaagcgcagctcgcccgcgttaccagaagcgtaggcggacggccccgcgctggcgcccaggtccaggcggttgacgatggccaccagcttgaacggcgaccgcgccagctccagcgcgccgctcgagcgcggccacggcgtgaggattcgcgcggtcatcgccgggcgcgccggcaccgtccagccgttgatgttctggttcacggtccactgacgcagccagtgctccgtcaggtttgctggcgacacgtacgagctcgccatctcccgcatcaggtggttgaacgtccacacaccattcgggttgccggcgttcgtgcacgggtcatacgtgcgcgtcgggtcattgaccacgttggggtgggtgatgatgagcgagttctccggcttcaccgcgtgggagatgcccgcggggaagatggggatggggacacccggccggaagacgtcgggcgacaccggcgtgaggacgcgctcggagacacggacgcggttgtcgaaggtcgcgaccgtcagcggcgtctggggattgcgttcctggaactcgcgaatgcggtcctgcgtggcgcggtgggtgacgaagtccacgtcgccaatggcggagaacacgccgtcaccggcctgctcgtcaccatcgaggccctggtcgttcagcacgagcgcctgccccgagtccgacaccaccggaacctgctgatgcacctgcccctgcgcgagcttcgcgcggatgaggctgcgcgtcttcgacgtcagctcgccgtcgagcgcgatggcatccatcgaatcgaggatgggcgcggcgcccgtctgcgcctgctcctgcgccgcggccgccggctcctccgatgagagggattcggagccaccacaccctgcgagcagggatgcggcgacgacgccagaccaggtgcgcaacacgcctggaaacttcttggaggactgcttcatgggggactcctcgcgggtagactgcaaacgcggccttgtgcaccccgcaggccagagtcccctttcaacgccttcaagcgcggcgcgtgcgccgccgctggtggcaatgacaaatcacgccacagcgtgactcgctctgtaacagcagacgtcacagactcaagggagagtcattgcagtcccagggtgttgaattgcagcacgaccacccgagtaccccgcactgtcaatccacgggaagcggcctcacctccaactgcttggacgcgaggaactccgggttgaacaccttcgacgcgtagcggctgccgtggtcgcacaggaaggtgacgatgcgcagcccctcgccccgatgacgccgcgccagctcccacgcggcgcgcacgttgagggccgccgatgtgcccaccaccagcgcgtcctcgcgcgccaggtggtagagcatctccaccatgtcctggtcccccaggcgcatggcctcgtccacctgggcccggcggaagttctccgtgaggcgcatgatgccaatgccctcggtgatggaagatccgggcccttccatgcgcccttagcgcacgtaggtgaagaggcccgagcacggcgggtccaccaccaccacgcgcacggcggggttcttctccttcaggtaacggctgacgccgcccatcgtcccaccgctgcccacggacgccaccagcacgtccacgcggccctcgcactgctcccagatttcagggcccgtcgtctcgtagtggtagtcgccgttggccgggttctcgaactggttcgcccagaagccgccctgcgcttccgccagcacgcgggcctggtggaagaagtggttcggattggcgaagggcaccgcggggacctttcggacctccacgcccatggcctccagtagctcgtacttctcgcgggcctggttgtccggcatggtgacgaccacgcggtacccgcgctcgcggcccaagagccccaggccgatgccggtgttgcccgcggtgccctcgaagatggcgccgcccggcttcagcaggccctgcgcctcggcgcactgaatcatccccttcgcggcgcggtccttgatgctgccgccggggttcatgaactcggccttcgcgaggatttcacaccccgtctgccggctcagcgagccgatgcgcagcagcggggtgtttccgacggagtcccagagcgttccaatgcgaggcgccatgggctgtgcttaacgcgaagggtggcgcccgtcaccgggaaccaccgccctcaatccgcccgcatggcctccaccggatccaacttcgccgcgcgggccgccgggtagatgccgaacaggagccccacgccgcagctcatgaacagggccaggcccaccgcccacgggggcacctgcatgggaaagcccatcatccagttgcccaggaacaccagcccgaagcccaggcccaggcccagggcgccgcccatcagcgacagcagcaccgcctccgtggcgaactgtcccaggatgcggcgcttgcgcgcgcccagcgccttgcgcacgccaatctcccgcgtccgctccatcaccgacaccagcatgatgttgaggatgccgatgccgcccaccaccagggacagcaggcacacgcccacgcccgcgatggtgatgacctgggagagctgattgaacgacgccgtcaccgactcgttcgtgtgtaattcaaagtcgttgggcatgttcgccggaacgtcgcggcgccggcgcatcagcgaggccacctcgtcctgcgccttgctgaacagctccggggacttcgcctgcacgctgatgtccagcgagcgcttcttcccgtagagctggtggaagacgctcagcggaatcatcacctggttgtccaggctgaacatgcccagcatgctcccccgcttctggagcaggccgatgacgcggaagggccggcccttgatgcgcacctcgtggcccaccggattcatgcccggaaacagcgcgtccgacacgtccgtccccagcagcgccacatagcggccgtccagcgcctccacttcgttgaagtagcgcccggcctgcaccgacaccccgctcaccagcgggtagttggcgggcgtgccgaacacgcggaccgacggccgcgtctccgagctcgccgtggccagcttctggccaccctcgtcgtcggtgggcacgaccgtccccaccgacgggcaggactcctcgatggcccgcgagtcgggcatctcgaagtccttgcgcttggcgaacttggcccagttgatgcgcccgaagccgcccgcgggccacttcgtcacctggaaggtgtgggcccccatccgtcccaggtcgttgttcaccttgacccgcaggccctcgatgagccccatcatggtgatgaccgtcgccacgccaatgacgatgcccagcagcgtcaacagcgagcgcagcgggttgcccaggaaggtgcccaacgccaaccgcaaattgtccaggaacgctcgcatcgcgctactcgtaacgaagggcttccacggggtccaggttcgccgcgcgcgccgccggccagatgccgaacagcaggcccaccagcgcggcgaagcccacccccgccaccacggtcatcggctgcacgtccgccgcgagcggcgtgatgagcgacaccaccttggccgtgcccaatcccacggtcgtccccagcaggcctcccaccgcggacacgctcgaggcttccatcaggaactggaagacgatggtccgtttccgggcgcccagcgcacgccgcacgccaatctcccgcgtccgctcgcgcaccgacaccagcatgatgttcatgatgccgataccgcccaccagcaacgtgatgagccccacgcccacggccacgccgtacaacgcgcccgtgagctgctcgtatgtctgcgccatggcctctggccggttgatggagaagtcgtcctccgcccccggaggcgtggagcgcacgcgccgcatgatgccggtgagctggtcctccgcggaccgcatctgcgaggcatcctccaccgccatggcaatctcgaaactgcggcccttgccgaagctcgaatagaacgtcttgaaggggatgaagacgagcaggtccatgctctcccccaccatcttccccttgcggctgagcgtgcccaccacctggaaggtgcggttgtcgatgcgaatcgactgccccaccggactgacgcccgggaagagcccgtccaccacgtccgcgcccaccaccgccaccggccgcgtcgtcgcgtcgtccgcctcggtgaggaagcgcccgccggtgatttcgtagccagagatgttgaggtactcgtgcgtcacgccctggatgcgcacggtggacatctgctcgccgccatgcgccacgtccgacaggcgagacaccgccggggacatggccgtcacgaagggcgccagcgtgcgcagccgctgcatctgctccagggtgaagttcttccggttgcggtacttccaccagtcgcccttgatcatccagggccacttggacacgtacatcgtgttcgccccgaaggtggccaactgcttgtggaaggacgtgttgagcccctggatgatgccgacgatggccagcagcgtggccacgccgatgccaatgcccagggtggtcagcaccgtgcgcaggcggttggccttcagggagaagaccgcgatgcgtgcgccctccagcacatccacgcggaaggcggaccgctggctcatgcgccccccgcgttcagtacgtccgtcgccgttcccatggccaccgtgcggccgtcaccgtccgcgacaatctctccgtcgctcaggcggatggcccgggggcagcgcgccgccagcttgggctcgtgcgtgacgagcaccagcgtgtggccccccttgtggagctgctcgaacaggcggacgatctcctcacccgtcgccgagtccaggttgcccgtgggctcgtcggccagcagcatggagggctcggacaccagcgcgcgggcaatggccacacgctggcgctgtccaccggacagctcgttgggccggtggtgcatgcggtgggtgagctgcaccttgtccagcgccgccttggcccgctcgcgccgctcccgcgcgccaatgccccggtacaccagcggcagctccacgttggccagggccgtctccttgggcagcagttggaaggtctggaagatgaagccaatctccacgttgcggatgacggcgagttcgtcgtcgctcatgcgcgacacgtccttgccgttcagcatgtaccggccgctgctgggcgtatccagacagccgagcacgttcatcatcgtgctcttgccagagccggactggccaatgatggccacccattcgccccggttgatgccgaaggagacgccgcgcagcgcgcgcacctcttctccacccacgtggaagacgcgggtgatgttctccacctggatgagcggtcccgcgccgctggcctgactcacgacttccggccgcccttcattcccgcgccgtgctacggctcacgcacgaggtcgccgtcgttcagctccttcaacagcgtccggtgcggaccttcaatcacccggtcgccatcattgagtccgaagacgatctccagctccgtgtcagagccgatgcccgtctgcacgcggcgcacctgcgccttgttgctgctgtccaccacgaacacgaccttggccagcgactccgtccgcttcgccgtcagcccgcccccttcgatgggcgccttgtagtccggcagcgagcgctccgagcgcaccgtcaccgcctggatgggcaccagcaccacgtcattgtgcgtctccgcggagatgcgcacctcggagctcatgccgggcagcacgttgggcggacgggtgtccagcgcgacggtgatggggaagctcgtcacctcggcctcggtgccctcgttcttgatgagcgccttctgggcaatctccaccacggagcccgagtacgtctggccctccagtgcgtcgagcgtgatctccgcgggctggcccggcttgaggtgcaccacctcgtgctcgcccacctcgaacttcacctccatggcgctgagcgcggcgatggtcatcaccacgtcctcggacaggtccgagccacgaacacgctcacccacttcacgcgacagctcgatgacgttgccgtcgatgggcgacaccagcgtcgtgcgcgtgaggtccgtctgcgcctggtccacgatggccatgttgcgggccagcatctgcttggccgatgccagccgcgcatcccccgtgttcttcgtggcccgcgccgtgtccacctcggcggcggacgaaaggcccttcttcgccaggtcctccgcacgcgcgagctccaactgcgcgcggcccacctccacctccgccacctgcacgtcggcgcgcgaggcgttcagcgacgccaaggcctgcttgtgcgcggcctggtagaggcgcggatcgatgcggcccagcacctggcccttcgtcaccgcctcgccgtccttcaccgccagctccaccaggtcaccggagaggctggacgagatcttcaccgtcgtggccgcctgcaccttgcccgcgccggtgatagtgcgggtgatggagcccttccgggccttcgacagctggacttcgagcgacggcggaggacggtccttcaacccgcccgcggtgatggccgcagcacccaggaacaacgcgccagcaatggcacccttccaccacttcatttcgactctcccgggctcagggcgcccatggcccgctgcaatgaatagcgggcgatttcgacatcgatcctgttttccaacaaggcgagctcagcgcgcgtcaggctcagctgcgcgtcgcggacctccagggtggagcccgcgccagcgcggaagcgcgcctcctgcatctccaggccctgggtagcgacctcgacgttctgcgcagccaggcgagcggcctccaactgggcctccagcgtgcggtgcgcggcgcgaacctcaccttcgatttcccgcgccgtctgctccagcgtcagctgcgccttgcggatgtccgcctcggcgcgacgggagctcgcccccgtggacagaccggtgaacaggtcccagctcaacccgacggccgcggtaaagcggttctgcaggcgcggctcggtgaacaccagcgaggcgtccggaccgccgcggttgtagaggccctgggccatcaggcgcggcaggtactccgagcgggcaatggactgcttcagctccgcggcgcggatgcgcagctccagcgtcctgagcagcggccggtacgcgcgggccgacgcgagcgcctcgttgaccgacggcgcgggcggcggctcggtcgtgagcacgcccgggtcctgggccgtcagtacctcggtgcccggccgggccaaccacacggcgagctgggactggtcgttgaccagctgcccgagcatcgcggtgtagttgatgcggtcggtccccaggttcaccgtggcggtgatctcttcattcttgcccgtgcggcccgcgtggaagagcgcctgggctcgctccacctgctgctcgctccgctcgacggtggccttcagcacctggagcgtggcctgggtgcggtagagggtgaagaagcggcggatggcctccagctcggaggtgtccgcctcttcccgcgcctgtcccttctgcgcgtcacgcaccacgccgctctgctccaactgcttccagcgggcgcggtcgtagatgacctgcgtgagcgacaagcccaggtcgtagttctgggtgctggtggagggcgtctccaccgcgttgcggatgaagcttcccgggttggccgggtccggaaccgtggtgaactcctgcctgcggccgaaccagatctttccggccgacgcatcgagcgagagctgcggcagcagcaccgagcgggacaggttcacgtcctcgtccgcgatggccacatccagcatggcctggatggccgcgacgttctgccggccctccgcgcgggcctggtccagggtgatgggtgtaccggagtccgagggagcggcggccagggcgaccgcgatcacgaaggcgttcattgcgcacctgcctgggcgggaaggccgatgaggaagatgcccgcgtacatggcgtacagcgccaccgccagcagcaccgcacgcccacgactcatcccggtggcggcggaaaagcccagccccagcaggcccgtgctccagaggttgaagaagtccacggtggacgccacgcgctgcatcttcggactcaagccttgcaacacggctcccaggttcgacggtacgaggttcatcacccgcgccatggtaatggagtgctgcgccgcgacgcanagggtcaggatgaggtggtagagcgcgatgggcagtagcgccagcacggccgcggacagcaactgctcgaaggacgcgggccggtcgaagagccagctgaccacccacaggatgcaggccaggagcagcgccatcagcggcatcaggatgacgcccttggcgatgccaccgaccagcgcctttcgcgactccgtttggatcttgtccgtgaggtccgcctccgacagccccatcagctgaccagaaccctggagctggcggatgacgtcaggcgcgacgtcccaacggagggaaaagagcgtcccggaagcggacacgcacagggccaggatgaggagaggccacacccagcggcgcgcctcgacggcagcacgggtcccatcgaggggatcgacgaagacgcgggccggttgagcaagagaagtcatatggtggtggaggtctcggagcgatgtacgtcgctcgtcctcaggcaattgcctggccagccgaagaaagacgccgaacaggcaggcagccagccaaattccgctggcggacgctttctactccagggctttacggcacatgtagcggcctgtagcggaaattttgccggacgccccaagagggtgtattgcgctcgtctggtcgcttgccggagttcgaatggtcgatagcacggacctcgcgcaggtcctccacgaagcgaatgacatcgcacagagcgtggttcagagggtcacctccgcccacgtgctcctggcgctcttcacggtggagaaccgtgcacagctgctgctcaaggagcgaggcgtggacgaggacgccatcctccagctgctgacggccgctcccgcggagccggacagcctgctccgggagctgcgcgagaagacccgggagatcgcctccaatgtgggctcccaggaggcggactgcctccacctgctcatcgccgtggcccgggtgcgctgcgcggcccaggagctgctgctgcaggccgggctggacctgggcggcctcatgcgcatggcgatgtcctatttcaccagtggtcacatgccgcgccgcctccaactgggccggtcacagaccctggggccccggcccgcgagccgccccctgggcgcgccgccgtctccccttccggcctccgccatcacgctgagcctgccgcgctcccggcctggcgccccgccgtcgtcgcccccgcccttcaccgcgccgccaccgcccgccgcgctacagcacgcccgcgctgtcgccgcgcgatctcatcgatgtggacgaggagccggaggcgccgccgcccgagcccgtggcacgcgccgcgccgtcccctgccccgacctccaaggccgcccccgcacccgcgggccggcaggcgcagtccgccgccgcgtcgcccgtgctcgacgccaaggcctaccccctgctcacctcgctgggccgaaacctgagccaggccgcccacgagggccgcctggacccggtggtgggccgcgcgcgcgaggtcgaggaggtcatcgacatcctgggcaagcggcgcaccaacaacccctgcctgctgggcgagcctggcgtgggcaagacggcggtggtggagggcgtggcgcagcgcctgctcgagctgcgtgggtcgctgtcggagaaggtgctggtggagctggacatggccacgctggtggccggcacgcagctgcgcggctcgttctccgagaagctcaacacgctgacggaagaggtccgccgctccaacggccgcgtggtggtcttgatcgacaaagtccacacgctgctgggcgcggtctccacgggtgacagcccgaactactccgccaaccagatgaacacggccatggcccgcggtgagttcccctgcctatgcgccaccacacacgacgagtaccggaagttgatgaccaccgacccggccctggagcgctgattcacccccgcggtggtgaacgaaccctgcgtaccggagacggcggagatcctccgcggcatcatcggccgctacgaggagcaccacgggctgcgctacacgcccgaggcgctggaggccgcgacgtccctggccagccgctacgtgacggaccgcttcatgccggacaaggccatctccgtggtggacctggcgggcagccgctgccaccgcgagggccgcgacgtggtggagcccgccgacgtggcgcgcgtggtggccaagctcgcgggcgtccccgaggagcgcctgctgatgaacgactcgtcgcgtctgctccggctggagcaggacctggcggagcgcgtcatcgggcactcggaggcagtcacgcgcatcgcccgggtcatccgccgcaactacgcgggcttcgcgtcgcgccgccccatgggcagcttcctcttcctgggccccacgggcgtgggcaagacggagatggcccgcgcgctggcggacgtgctgttcggcagccgcgactcgctggtgcgcctggacatgagcgagatgtccgaacagcacggcgtctcgcgcctcatcggctcgcccgccggctacgtgggcttcggtgagggcggacagctcacggagcccgtgcgccgccggccctcgtcggtggtggtgctggacgaaatcgagaaggcgcaccgcgaggtgcagatgctcctcctccaggtcctggaggaaggccgcctgacggacggcaaggggcgccacatcgacttctccaacaccgtcatcgtcatgacgacgaacctgggtgcggaggccttctcccgcaccggccgcccggtgggcttcggcgcggactctgcgggccccggggtcgccatggaca

SEQ ID NO: 969 - DNA, 7719 bp, Myxococcus xanthus
tctaaagccgcgcacgagctgcgcacgcccctcaccaatcttaggctgcagctccagttgctgtaccgccagcttcgccgcgaggaggccctggacgtggagaagctcgcgcagcgggtgctgtcctgcgagcgacagacctcgcgcctggcgaccctggtggacagcctgctcgacgtgtcccggctggcgcgcggccgcatggagctgaacctggagcccgtggacctggacgagttggtgcgcgaggccgtccgccgcttcgagacggaagccaggacagcgggggtccaggtgacggtggactcgccggcccccgtgacgggccagtgggaccggatgcggctggagcaggtgctcaccaacctgctgtccaacgcgctcaaatacggccacggagcccccgtggacgtgcgcgtgcgctcggacgaaacacaggcgatggtggaggtggaggaccgcggcatcggccttccgccggaggacgcgcagcgcatcttcggccgcttcgaacgcgccgtctccagccgccactatggcgggctgggcctgggcctcttcatcacccgccagctcgtggaggcactgggaggccacatcagcgtggccagcaccccgggccagggcgccacgttcaccgtcgcgctgcccttgagcggcccacgtgccgaggcttgacgctccctgcctggcggggaagtacggcaaagcccttcaatgacagacaggaggaatccgggacgcgcgcaacgtgctcaactgccacagacaccgccgctgagcctcgcgggcctcccgcctgcttctcgacttggaaccccacggagtcaacgtcgcgacggaggcctacggcgcggtggtgcaccgggcgtcggccgacgcggcgtcctcatcaccgaggccagccagaaccgcgatgaggcggagcctggagacgagcggttcttttcctccgggctggaggcccatgagctcggagctaccacgcccgccgtgacgaccgagccctgacgccccctatcgggtcagcgcgcgagccatcgtgacgagcgcctccaggttcacatcgtccagctgacgcgccagcgtcaccagccggcgcagcagcggcggttccttctccagctcacgccgttcgtccttgccgggccgggccagccccagcaattcatccgtggagatgcggaggaccatgctgaggcggcgcagcatgcccgcgctggggaccatctttccgcgctccactcggctgtagaccatggggtgcatgtccaccaaggccgccacctccacctgggtcaaccccaggcgcgcacgcgcctcacgcgccgcctttcccaccatcatgcccagttgttcgtccatacgcgggagaacgtagcgcatccggagggggtggctggggaggaagccacggcccgtcccattgctggccgtgtcccccttgctgccgaagcgggcgccggcgatggcgacgggatgcccgttgatggtgactgtcttcgaatacccctccggggagtcgccgctctcacggcctctcgcaacccctccgctgcgccgaccgcgtgacgacgctcttcagccccttagctcatgacgccaatcatgcagcccctggagcatgtatgtgtttcaccattcataccaagcacggcatttcgatcaaatgagctgtctaataggtggtcccagaggttctcaatccaggtgagcgtctcggaggtgtacttcggcagccggaaggcgcggacgtaggggagcgccgcctcaagagcagtccgggcgaggcggatgggctggccgcgtcggacgtgggcaagatcgagttccacgaccaccacgccttcgtcgcggtctccaagcgcgtcgcgaagatggcccttcagcgattgagagaggagtgcatcaaggggcgcaaaacaccgcatcgagcgcgtgcggtagtcgcctccccttccagattctcaaagtgtgaaatcatccaagtggtgagtatcgcgtgaattaactcactgtatgcgcggtcccaggggggctgacggcgctcgcgggtgctcgtcggcattttcgcgctgttggggccgcgagttcagggccgcagctcgcgagagcaaatcctcgaatcaaaggactcatcctgtgaatacgtcgttcattcgttggccgtgcgcgcttgctggactctccctcggggcgcttctcgttgcttgtggaggtgactcggagccgtccaatccgaacggagatggagatggaaatggagaggaggggcctgtcacggagacgattgtgaatggcaggcccgcgagcgagtactacgcacagttcgcctatgagaaatacgctggcgccccgggtggcgcggctgcgttccccgcccagcaggatggcatcaacctgttcgccgcgaccgcctatctgaagcaggacaagagcttcatcctctactacgccgagggcgcggggaccgtgcgttcgaatggctacagcgccgagattcctacctcccgcatgttcaaacgcactggcacctggagtgtcagtggaggctcgttgaagctcggcgacctgatgacctgccaaggccttatggtgaacggcaacgacgcgcttcgctgcacgctggaccggaccattggctattcggaggcggtggggaagagcgcgacgttcacgcgctcgaccaacacgtcgccgaatgacagacagtgggccgactacaagtgaagcctgggctccctgcgagctcatgacgggaactccatttcagtttcatgacaacaccagcagctcatccatgatgtccggatgagccatgggagcggatggcgcccctgcttccgcgcaggcttccacatcgcaagggcggtcggccttggacggatgaccgggcggcgctacgcggcatcctcttcgtgctggccacggccgcccagggcacccgcccgtgggcggccgtggccgacgtctttcggcccggactggggagtgcaagtcgacggacgcgggcgcgaagccgtcgctcgtctcctgggagaatgagcgaccgttctcccagcccccacccgcacgcgggagcctccgtccaggcaggggcacagcgagcacctgtcgtgttccccccgaaccatgggcccctcctcctgcctccactgaggactggtggacaccgcgaccgcgggccgacatcaatgttcgacagtggccacgcccacgtcttatgtcccaggacatgacccccgcacccacggaggtgctgctgttcaccctgaacggccagcgctacggactgcccgcacccgacgtgcgcgagttggtacgcgctgcgcgcctgacgccgctccctcgcgcgcccgccgtggtggagggcctgctggaccttcggggggagctgctgccggtgctggacctgcgcctgcgcttccgccacccgccccgcccgctgtcccccatggatcacttcatcgtggcctccgcgggcgaccgctgcgtcgtgctgcgcgtggaccgggccgagggcctgcgcgtcctcacaccggatgagtgggacgccacgccgcgccagcttccgggcgtgggctatgtggcgggcgccgtgaagctgaaggacgggctcgtcctggtccatgacctgcgcaccttcctgtccgaggccgaggccctggagctggatgccgccctggccgcgccgcaggagccggagcccgcgtgaattggggcccctggagccacccgggttatgcggcggtgctcgcgctcgtggaagagcgcgccgggctggtgccgcccagttgccccgcgtccgccgaggaaggcatcgcccgcgccatggagcgggccgggctgaaggacttcgacgcctaccgcgtgcggctcgcggaagagccctccgcgctggatgacctgctcatcgagctcaccgtcggggagacgtatttcttccgcacgcccgagcacttcgaacacctgcggagcgtcgtgctcccggagctgcgcgagcgccatggcccggaccacaccgcgcggatgtggagcgccgcgtgttcgtccggcgaggagccctactccatcgccgcgctgctgctgggcgaaggctgggacgagcacatggccgtgcacgccacggacgtgtcgcgcggcgcgctcgcccgggcccggaaggcccactacggcgactggtccctgcgcggcggctgggcggaccggatgcgcgcccacctgcgcgccgagggacgccggtacgtgctgtcacccgaggtgcggaagcgcgtgcgcttcagctacctcaacctcgcgctcgacacctggccgtcggcggacagcggcatctggaagctggacgtcatcttctgccgcaacgtcctcatctatttcaaccggcccaccatcgaagccgtcgcgcgccggctccatgacgcgctggatgagggcggctacctcttcaccggcccgtcggacccgccgctcggtgggctggcgccgctggagtccatcctcaccgaatggggcgtgctgtaccgccggcccctgcccggagccaccctctccctgcccgttccggccgcgtggagcccgtcctccaccggcgtacccggtaccgcgacgggcaccacgtccctgggcaccaccgcgccgggcctgccctccggctccgaatcctccacgcggaccgcgctcccgggcgcatccgctccgagccatccaggcggctccgcagccagaacgacgacacccgcctggagtccccccggcgcgggcgggacctccgcccaggcggaaggaacgcgcgcggcgggccagccccaggccagcgcggggtccgtcctcgggaacacagcgggcaccggtgcccccgcctcgcgaagcggcgccctccccagggccgagacaccgacacacgcccccagcgcggcggccatgcacgcggcccggcaggccctggcgcggggccactggcgcgaggcggcccagcacttgggagcattggactcagacgcggacaccgccgccctcgcggtgcgcgcgctggcgaacctggacgccgccgccgccgtctatgcctgcaccgaagcggccacccggcaccccttggtggcggggctgcgctacctggagtccctgctgctgctgggccaggggcgcgcggcggacgcggagcgcgctgtccggcaggcgctgtacctggagcccacactcgtcgtggcgtggctcatcctcgggcgcgtgctacggaggcacggcgacacgtccggtgccctgaaggcctggcgcgaggcggagcaactgtgcaacgccctgcctccggacgcgcccgtgccccacgcggacggcgagaacgccagcagactggcggaggtggcgcgcggagagcggtcacgcatggaggcagccctggctgccggtgaggagctgagctgatgccggacgtcgactgggaagccacgcgcgcgaggctggcgcggctggccgacctggtgaaggaacagggcaccttgtcgcccgaggaggccacggcgctgctggaggcccgcgcccgggcactctcgcgcgagccccgtccccaggtcgaccccggcaccttgcgcgaggtggtccgcttcaaggccgccggccagcgctatgccctggagtcccgcttcgtgctggaggtggttcgcgcgccggagttggtgacgctgccgggcgcgccccccgcgctgcgcggcctcaccctgatgcatggcgaagtgcttcccgtggtggagctggcgccgctcttcggacgcgcgccttcggacgccgcgggcccggtgctcgtggtgggcgtgggacgggcggagctgggcgtgcgcaccgaggaagtggaggaagtcaccgtgctggcgggcagtgagctgctggcgccgcccacctccctgaacgacgacgccggacacctcgtgtccgcggccgacagggaaggcaccctggtactggagggagaggcgctgctgggtgacagtcgcctcatgttcgatatgtccggcgaaggagcagcatgagcatcgggaaccgcatcgcactcggattcggactgtcgctactgatgttgctcatcgtggcgggtgtgtccttccagggcgccaatcagctcacgacgagcacggcgggcctgctgacagcccatgagaacttccgcatcatccgcgaggtccgcgcgctgctgatggacgccgagtccggccagcgtggcttcatcctcacgggggatgagtcctacctggtgccctaccgggaagcggcggtggcgctccagaatgacctgtcccgcctgcgcgacgccatggcggaccaccccaaccagcgggcgcgcctgaaccggctggagcccatcgtcacccagcgggtgaaccggctggaggaaggcatccgcctgcgccgccaggagggcctggaagctggagcgaagttcatccaggccggccagggccgggaggtcatgctccaggtcaagcagatcatcgacgagatgctggtggcggagcaggagcgctgggacgagcacgccaccgccgcccgggacatggcccagcgcatcctctgggtgctgggcatcggcacgctgctgggcgtggtcatcgtcggcggaggcagctacatcatcacccgcggcatcaccacgccgctgcgcgcgctcatggtgggcgccgaacaactggggcgcgggaagctggagcaccgcatcgacgtgaagggccaggacgagacggcccaactggcgcgcgcgttcaacgacatggcggagaagcgccagcagaacgaggtccagttggagaaggaatccgagcagcgcgagcacacgctccgcaccgtggcggagttcgtcaaccagctcgcaggcgccagcgcggaaatcctctccagcaccaccgagcaggtggccggcgcccaggagcagggcagcgcggtgacggagacggtgagcaccatcgaggaaatcaccaagacgtccgaggaggccgcgggccgcgcccgcgcggtgagcgactccgcccgccacgccgaggacgtgggccgcagcggccgccgcgccgtggaggaggccgtgggcgccatgggcgcggtgcgtgagcaggtggagtccatcgcctcgcgcatcctcgccctggccgagcaggcccaggccattggcgacatcatcaccaccgtcaacgacatctccgagcagacgcacatgctggcgctcaatgcctccatcgaagccagccgcgccggcgagcacggccgcggcttcgcggtggtggcctccgaggtgaaggccctggcggaccagtccaagaaggccaccggccaggtgcgccagattctggggcaaatccagaaggccacccacggcgcggtgatgaccaccgaggaaggcaccaagagcgtggccaccgccacccgcgtggtgtccgaggcgggcgccaacatccagacgctgtcggacctgctggcccaggcctcgctgacggcggcgcagattgccgcctccgccaaccagcaggccaccggcatcggccagattcgtcaggccatgcatgacgtgaatcaggccacgcagcaggccctcatctcatcgcggcagaccgaacgcgccatgcaggacctcaacggcatgggccagaagctcaaggggctgctcggagagtacgggcgctgatggaccgcgcccggttggcccaagcgctgctggccacgttccttgaggagctccag

SEQ ID NO: 970 - DNA, 8180 bp, Myxococcus xanthus
cctggccctgcacgccctgggcaagagccacgaggcccgtgccatgctggagcgcgccttggcgcttcgcaccgcccatccgggcccggccgaggacctcgcgagcacccgcttcgccctggcccaaacgctggtgaagcaggacgggccccgcgcccgggggctggccaaccaggccctgcacttctacgcagccgaagagcccacctacgccatggaggccagctccgtgcgcaactggctccaggacctccggcgccggaggcgctgagcaacagccagggcccacatccaccgaaatcacgcccctccgcacacatcctcaagcgggaacgcgacaactccagggagccgtccaaccgcatctgatgaagtcaccccgagggccgccagacaggcggacgcggctcacgtccattctcgggggcttccgtcactttccaccgctagacttcgcccaatgcttcacgtcattcccctgggcggcctgggcgaaatcggcctcaactccatggtcatcgcctgccgtggggagatgctgctcatcgacgccgggctgatgttcccctccgcggggatgcccggcgtggacatcatcattccggacttcagccacctgaagcagaacgccgcgcagctcaagggcgtgctgctcacccatggccacgaagaccacctgggcgccctgccctacctgctcaacgaggtgcccgtccccgtctacggcacgcgcttcacactggccatggcgcgccaccggctggaggagctgggcatcgaggcggacctgcgcgaaatcgagccgcgcgagcccttccccgtgggcacggcgttccgcgtggaggccagccgcgtcacccacaccgtgccggacgcggtgggctacatcctgcgcacgcccgaaggcaccctcatccacaccggcgacttcaagctggacccggaccccatcgacgggctgcgcacggacctggagcgctggggcgaggccggcgaggaaggcgtgctgtgcctcctctccgactccaccaactccgaggtgacggaggagacaggcagcgagcgcgtggtggagcagaccttcgagcgcctcttccagggcgccaccggccgcatcatcgtcgccctcttctcctccaacctccaccgggtgcggcacctgctggcgctggcggagcggctgggacgcaaggtggccctgcagggccgcagcatgctgcgcaacgtggagatggcgcgggagatgggctacctggacgtgcccgactcgctcttcgtccacctggactcggtgccggcgctgcccgcgcagcgggtgctggtgctgaccaccggcgcccagggcgagccccgggccgggctgtcccagctcgcgtcgggggacggccccgtgcggctgaatcccggcgacctggtggtgctcagctcgcgggccatccccggcaacgagcgctccgtgggcgcgctcatcgacgcgctccagtggcgcggggcgaaagtcgcctacgcccaggtggagccgggcatccacgtctccggccacgccagccagccccagcagcggcgcgtgctggacctggtgcgcccggcccacttcatccccgtccacggcgagggccgccatctgcacaagcacctgctcaccgcgcgcgaggccgggctggagcccgcccagtgcctgctggcacaggacggcgacgtcgtcaccttcgagaaggccgggggcgcttcaccggcagcgtcccgtccggacgcatcctcaaggaccggttcggccccggcctggtgacgccggacacgctccaggagcgcgtccggctgtcggagacgggcatggtggccgcggtggtggtcctccagcggggctcccagcaactggtggcggggccacagctgtccggccaggggctgtccgtggacgaacaggtcctgctcccccgggtggcccaggacgcgcgagtgctcttcgaggaactgtcccccatcctgcggggcgatgacgccctggtgagagaggaactcacccgggccgtgcgccgggcattcaaggcgcacacgtccaagcgtgccctggtggtgcccttggtcgtccgggtgtaggtatggtaagggccgctgcccatgccatccttcgacgtcgtctcgaaaatcgacctcgctgagctcgacaacgcggtcaaccagaccaagaaggagctcagcacgcggtacgacttccagggcacccatgccgacgtggtgttggccccggacaataccgccatcaccgtgaaggccaacagcgaagaccgcgtccaggccgccaaggaagtcctcctgacgaagctggccaagcggaacatcagcctgttcgccttggagtacggcgacatcgagaagacgggccttcacaacgtgaagcaggtcatcaagctccagcagggcatcccggtggagaagtccaaggagctggtgaagctgctgaaggactcgaagatgaaggtccagggctccatccaggccgaccagcttcgcgtcacgggcaagaaccgggacgacctccaggcggccatcgccctgttccgcaaggagcaggaccggctgaagctggacatgcagttcatcaacttccgcgattgaagaggcccatgcgcgctgccgccctgtccttctgcctcctgttctgcgccccgggcgttgcgtctgcccaggcggaccgtccttccaagccggttccctccctcgccaagcccccgcgcatccagggtgggctcaaggccttcgcgtcgccgatggtgctcaagcccgtcgccgtggagggcgccaccgcctcgttcaccgccaaggtgggcgcgcgcaaggacacgctctacgtcggcgtggaagccaccgacgaccagctccaggccggcgatctgctcaccctgtccctctacttcccgggcaccggtcccaccgccgccggctacacgtggcgcttcgccttcgatggcaagcgtgcgtccggggcggagagcggcacgccgcagttcgcgcaggacctggtgacggccgccgtgcagcgccagggcaacacgctgctgctgatggcgtcggtgccggtgcgcgccttcccccgctttcccgccgtggacccgctggtgatggacctgtgcctcacctacgaggaccgggacagtgcggacggcaaggccacgtccatctccaactgccagagcggcaccatggtgggtgacgcgctgcgcctgccggacgagcctcgaaagggcctcaagctgaagctgccggagaacgtcacctcgctcgagcccaaggaggacgggctgctgggctgggactacatgagctacccggcctgggcccaggcggatgacgagctggcccctgcctcgctgcgccgcctggtggcgccggacgccgtcgttccctcgtccgtggacctgaacgtgccggatacgctcaccctggaggacggcggtcgcgtcgtcacggtggtgaccgggaagaatccgtatgccgtcgccggtcaatgtgacgccgatgacgagctgcggttgggcctctacctggtgaccgggaagacagcgcaacgggtgctcgagtggccggccgctacctgcgcgctggggcgcacgtcgtcggtggaactggaagaagagggcgtgctgtccatccgttactcgaacggcacgtccatgaacttcgcctggagtgggacccacttctcgcgaaccgaactcggaaagcggtagacgcagtggaaaccaccacccccaagagcctgtacatgatgaccctcggctgcccgaagaaccgggtggactccgaggtgatgctgggcacgctgcgccaccgcggctacacgctggtgcaggaggcgtccgacgcccaggtcatcgtcgtcaacacgtgcgccttcatcggtcccgccaagcaggagtcggtggactccatcctggagatggccgagctgaagaagtccggcgcctgcaagacgctggtggtgacgggctgcttgtcccagcgctacggcgaggagctgtcgaaagagatgccggaggtcgaccacttcctgggcaccagcgcctacgcccagattggtgacctgctggccgccgaggcctcgccgcgtcaggtgattccggacccggactacatccacgacgccaatacgccgcgcatcaactcgatgccgaagtacacggcgtacctcaagatttccgagggctgcgacaacgcctgtgccttctgcatcatccccaccctgcgcggcgggcagcgctcgcggcccatcgacgacatcgtcgccgaggcgaagcagttggcggacagcggcgtgcaggagctgaacctcgtcgcgcaggatttgacggcctacgggcatgacctgccgggccggccgaagctgcatgatttgctcaaggcgctggtgcaggtggacgtgaagtggattcgcctccactacgcctacccgcgcatcttcccggacgagctcatcgaggtgatggcctcggagccgaagattgcccgctacctggacatgcccgtgcagcacgtcagcgacaagctgctgctgtccatgaagcgcggccgcaactcggagttcctcaagggcctgctgaccaagctgcgggagcgcgtgcccggcctggtgatgcgcacctcgctcatcgtcggcctgccgggtgagacggaagaggacttcgagatgctgaaggagttcgtgaagacgcagcgcttcgagcgcctgggcgtcttccagtactccgacgaagagggcaccgccgcctacgacctgccggacaaggtgccgcagaagctcatcgagcgccgctggcgcgaggtcatggccatccagaagcgcatcaaccgcgagcagaacaagaagctcgtgggcaagcgcctggaggtgctcgtggaaggccccgcgccggagacggagcacctgctggtgggccgccaccagggccaggcgccggacatcgacggcatggtctacatcaacgacggcctagcgtacccgggggagattgtcaccgtggaggtgacggaagcccacgactacgacctggtcgcccgcgtggtggagcgcccggacccgaagcagcgcgagcacaccgcgcgcgacgcgcacccggcgccgctgccggtggcggcgatgcagcgtccggcccctcgcgcggagtaggcgcgaaggccccggacgccgcgggagccctcagcgcgagggctcctccagcaccagggtgcgtcccgggctgacggcgcgcaggcgctcgcgcagcttctcccggtccgccttcgccgacttcggcgtcgccgccagtttctcgtggagctcgcgcgccgtggcgtcgtaccagacctcgcgcacgggcccactttcggccatgtgccgcgcaacccccgcgagcaaccggcagcagtcctcccagcccgcgtcctgctgagggccgccctgctcccgagtgaaggcgatagcgtcatccagcgtcttcccgtcctgcaggtagacgttgatgagcgcccgggccgcgcggttccccgcgtcccgcatgttgagccacaggaaccacgccttgccctcaggcgcgggcgactccaccgcgtagatttcggtgatgggcgcgggcgtgccgtccgggccgaggcccacgagccccgcctcgggcgacaccagcagcacgaacgcgtccgcgggcagcttcagcgtctgcgccagcaccgtccccggcgtctccttcaccaggcgccgggccaggtccgccgccacctcgtagcgctgccggcctcgttcctcgtgcaccaccaggtgccagtcacgcagcacggcctggaggttggtgtgagcccactgctggcggaactcgaaggtgtccacgcccttgcgccggcagatgtcgtccagcgtggagcgaagcgcattcagcatctcctcgtccttcaacatgtcgacgtagtgcgtgtggcccacgcgctccgcgacgcgttcgatgacggccagcaatccgaagcggatggcgccacttgcgtcctgcacggacaaccggccgcgctccacttccttggagagggcgtcgtacatccgcgagacgccctccttttccaggtagcggcgggccaactcgatggagcggcgctgttcggtgtactgacggtcgaactcggtgggagacgggcgcatgtgcgccagaggagagcgcagcacccccgcccctgtccaggcaacgctaacgggggtcttccggctccaactcccgctcccctggcgggggctcacgcgaggaagcgcctcgcgccggcatggccacgccctcacccagcggcgtgggctggcactcacacacggtgcggcgagaggcggtctccgtgacgaaggcacaggccgtggggcactcgggctggcggccttcctcgaacaggctcagcgtgaagtctcgcgcggtggacagcgccgcatggcaggcaggcagcgcctgcgccagggagcgccagggcacgcggtgctgcgtcgtcaggcccctgctggtggaggggaagctcagccccacgccacagccgctcaccagcttctgcccgtccggccccagcggctccaggtgaagccgccctccttctggcaggtcccggtacacggcgccgctgatcgagacgctgccatccggctcgcgccgcacatgcaggccgtagcaagcctcctcacggaaggagccatcgggcgcggcgcaatggctggtggcggagccttctgacggccggacgcgggggcgccgcagcaccaggaccccgccctttgcgtccagcgtcgcagtgaagcggccccagacatccggccccaggcggcccaggctgctcggcgaatcccaacgcccagcggcctccaccaccagcgggtggacacccagtccctcggccacctccactgcgtccagcacgaaggttcgcggcggcaggttggccgccgtttcgagcggctgaagcccctgtgcctcggcgagccgcacggacacccgcgagaagggctcgcgcgagccaaggacgaagggccccgtgagctccgctccgccctgcgtcatccgcgcggccagcaagggccaatcgcccagcggctcgcggctgagctccaccacgtgcacctcacgcgaggcctccgtggccgccgcttccacgacgtagtccgcgcgcgggcgagaggtggtgaaggtcacttcccgccgcagtgggtccacggtgagcgcatagaactccaggacatccgcgcccagcgtcacggcgcagaccttctcaccggacaaacccgcggtgcgcacaggcgaccgcaccggacccaccgagaaggcgggcaaaggcaccacgggccaggagcggaaacctcccgcgggctcgggcgcgcggatggtgccttcgggggcgggaagcgctccgtcgaagcagcctcgcgacacgagcgagagtggccgagccacgtccaacaccaccggcacgggccgcgtccccagtttgcccgccacggtgagccgcagcgcgggtgatgccagcagcggcagcgtctgaccgtggaagccttgcggacgctcggcgctggcggccggttcccgatggcacccggtcccgaccagccccatccaccccatcagcagaaacgcgcgacgcacgcttcgcaggttactgcttcttcgccttcgtgaagtcatccacgcgagtgtcgtccggcacatccagcttgaagctgtccgcgtcgaggcccacgttcgtcttcaggttgaggaaggagatggtgttctcgctgccgtccgggtccaccaccgtgctcttgagcacctgggccgtggatggatccacctccaggcgcacctggcggaagcgcggctcgttcttcagcggatccaacaccagcagcgtgcccttgcagtccttgcaggcgcccttggtgatgttgaactcgtccgcgagctttccctggccgaagaggaacgtcaccgacgcggagagctggctggtgtccacgttggccacggtgaggctctgggccgccgggtcgtacgcgtacaccttgttgcccgccagcacgaaggtgcgcggcgagggcttcaggtactcccaacgcatcaggccgggcttcttgtacgtgacggtgccttcggacgtctgcgtgcgccggaaggtcttgtacttgtagtcctggcggaagcccgcgcgtt

SEQ ID NO: 971 - DNA, 10054 bp, Myxococcus xanthus
  unsure (1)..(10054): unsure at all n locations
ctaattcgcaatcaggaaccgtgccatggggtgaggatcacccgggcaccgctccagcgtctttgagctcggaggcgggcccccgcccgcttctttcttcttcaaggaagaggcatcaacgaatgtccggtcgactcggtgaactgctggttcgcgagaacctcatctccgtgcagcagctgcgcaaggcccaggaagagcagcagaagaacggcacgcgcatcggcaccgcgctcgtcaagacgggcgccatcgaggagtcgaagctgaccgacttcctctccaagcaatatggcgtgccggccatcaacctgaaggacttcgacgtcgagccggacatcatcaaactggtgccgaaggaagtggcggagaagcacctggtggtgcccgtcaaccgcgcgggcccgtcgctcatcgtggccatgtgcgacccgtccaacatcttcgcggtggacgacctgaagttcctcaccggctacaacatcgagacggtggtcgcctccgaggtctccatccgcgaggccatcgagcgctattacgcggagaagggcccgtcgctggaggacatcgtcggcgacgtcggtgacgacatcgaggtcaccaaggaagagacggagaacatcgatgagatggccaaggccgcggacgacgcgcccgtggtcaagctggtgaacctcatcctcatggacgccatcaagaagcgcgcgtccgatatccacgtcgagccctacgagaaggacttccgcgtccgcttccgcatcgacggtgtgatgtacgaggtgatgcgcccgccgatgaagctgcgcaacgcgatcacctcgcgtttgaagatcatggcctcgctggacatctccgagcggcgcctgccgcaggacggccgcatcaagatcaagatgggcggcggcaaggagatggacttccgcgtgagcgtgtgccccacgctcttcggcgagaaggtcgtgatgcgtctgctcgacaagagcaacctccagctcgacatgacgaagctgggcttcgacgcgcagccgctggcctggttcaaggaggccatcgaccggccctacggcatggtgctggtgacgggccccacgggctcgggcaagacgacgacgctgtactcggcgctctccagcctcaaacggcctggacaccaacatctgcaccgcggaggacccggtcgagttcaacttcgccggcatcaatcaggtgcagatgcatgacgacatcggcctgaacttcgccgcggcgctgcgctccttcctccgccaggacccggacatcatcatgattggtgagatccgcgacttcgagacggcggaaatcggcgtgaaggcggcgctcacgggccacctggtgctctccacgctgcacaccaacgacgccccgggcacggtgagccgtctgctcaacatgggcatcgagccgttcctcgtgacggcttcgctgaacctcatcctcgcccagcgtctggcgcgtcgtctgtgcccggcctgcaagaagccggcggagaacgtggacgagcaggcgctcatcgacgccggtgttccgccggacaagattggcaccttcacgatgtacgagaaggtcggctgccgcgactgcaacgaccgtggctaccgcggccgcgtggccatctacgaggtcatgcccttctgggacggcctcaaggagctggtcatcaacggcgcctccgccgcggagctgaagcaggaggccatccgcctgggcatgagcagcctgcgcatgagcggtcttcgcaagatgatggacggcgccaccacgttggaagaggtggtgggaaacaccgccccggaccgcttctagtcaaccttcctcccaccgcactcccccgaaggacatccccccgtggccaacctgcaccagctcctcaaggcgatggtcgagaagggcgcttccgacctccacgtcaccaccggctctccgccgcagcttcgcgtcgacggcgagctcgtccccttgaagacggcgccgctgaccccggtggagacgaagcagctctgctactccatcctcacggacgcccagaagcacaagttcgaagaggacaacgagctggacctgtccttcggcgtgaagggcctgtcgcgcttccgcgccaacatcttcatgcagcgtggcgcggtcgccgcggcgttccggaccattcccttcaagattttgacgttccaggagctgggcctgccgccggtggtggcggagctggtgaagaagccccgcgggctcatcctggtgacgggccccacgggttcgggcaagtccaccacgctggcctcgatgatcgacaagatcaacaccgagcgtcatgagcacatcatgaccatcgaggaccccatcgagtacctgcacccgcacaagaactgcctcgtgaatcagcgcgaggtgggggcggacacgcggaacttcaagacggccctcaagtacatcctccgccaggacccggacgtggtgctcgtcggtgagctccgtgacctggagacgattgaagcggcgctcaccatcgcggagacgggccacatctgctacgcgacgctacacaccaatagcgcggtgcagaccatcaaccgcgtgttggacgtgttcccgccgtaccagcagccgcaggtccgcgcgcagatgtccttcgtgctggaaggcgtgatgagccaggcgctggtggcgaaggcgggcggccccggacgcatcctggcgctggaggtgatggtgcccaaccccgcaatccggaacctgatccgcgaggacaaggtccaccatatctactcgtccatgcaggtcggccaggcgaagttcggcatgcagaccttcaaccaggccctggcggcgctgctgctgcggcggctcatcacccaggacgaggccttcggacgctctaacgacgcggaggagttgcgcaacatcctggccacgggcggcggcggggccttgcccggaatgcagcggccaggcgggggagcgggtggtcgatagttccgggattcggagatcatcggttagagtggcgcggcacccgcggaggtccagctcatggcagtcccagcagtgaagtcggcatcaactcccaagaaggccaccgcccagttcctctgggaggcgaagaccaagagcggggagtcgaaaaagggtgagatggaggcgatggacgtcgaggccgtcaacgcgcgcctcaagtccctcgggctgaaccccgtcaaggtgcgcaagaagagcatgctggacggggacatcacgatccccggcttcagcggtgtcgaaggcaaggacatnctcgtcttcacccgtcagttcgccacgatgatcgacgccggactgccgctggtgcagtgcctagatatcctcgcgagccagatggacaacccttccttcaagaaggtgctgttcgccatcaagagcaaggtggagcagggcagcaccttcgcggacgcgctgaaggagcaccccaaggtcttcgacgagctctacgtccagctctgcgccgcgggtgaggtgggcggtatcctcgacgccatcctcaaccggctcgcggcgtaccgggagaagaacgagaagctcaagtcgaaggtcaagagcgcgatgacctacccgatcatcgagatcctggtggccatcggcgtgacggcggtgctgctgctgaaggtgacacccgtcttcgagaagatgttcgcggacttcggctcggagctgccggggccgacgcagatgatcgtgaacttctcgcacatggcgcaggagtacttcttccatgtggctggctcgattgtcgccgtggtgatgtccttcacgtggagctaccgccagccgcgtggccggaagttctgggacaaggtgttcctcttcatgcccgtcttcggccccgtgctccgcaaggtggccgtggcccggttcacccgcacgctggggaccatgatttcctcgggcgtgcccatcctggacgcgctggacgttaccgcgaagacggccggtaaccgcacggtggaagacgccatcatctacgtccgcgggaagatcgccgagggcaagaacatcgcggggcctctggccgagacgaaagtattcccgtcgatggtggtccagatgatcggcgtcggtgaggcgacaggcgccatggacaccatgctcaacaagatcgccgacttctacgacgacgaggtggacgcggccatcaacagcctcacggcgatgattgagccggtcctcatggtgttcctcggcggcgtggtcggtggcttcctcatcggcatgtatctgccgatcttctcgcttgccggcgccatccagtaggtcagcagcggtgggcgtgcgcccgtcggagaggggcgcctttcgttcgcggctcgtgtggttggtgttgttccgcacggtcgccgcgagcctctcgctcgtcatcaccctggcgcggcttctccttcatccttcccaggagctgaatcacgcggacaccctgtcgctcgcggtcatcatcatcgcgtacgtgtcaacggtggtggtggggctgcggctgcgcaaggggcagggggggctcggggacgcctgggtgcaggtcgtgggcgacgtcgtcatcgccaccggcctcgtgtacctcagcggtggctccgactcgcccctgacgtttctctacagcctggccgtcatcggcgcgtcggtcgtcctggaccgccgaggcgcgctctgggctgctgctgcgtctgccctgtgtttcggggccttggtcatgggctcacaactcctggacggcgcgtctggtgggttgatgccgcccacgcgggtgctcttcgtcctgggcagcaactccctggccctgggcctcatcgctgtgctgtcgggctatctctcacgtcagctctccgcgacaggtggcgccctgtctgctcgcgaggcggacctccagcgattggggcggcttcaacagcagattctctcctccatgccgtcggggctggcgacgtgtgatgcgcagcgccgcgtgacgtacgtcaatcccgccggttgcggaatcctccaggtcgaccccacgcaggtcgctggcgtcgaagtcgaagcgcttcttcctggcgtttcagtcctggcgcctcgatctcctcgcagtgaattggtggtgggaaagggcgcgaagcggcgcatcctggggctgtcggtaacgccactggagggtgagcccggggctttgctcatggtcttccaggacctcacccagctccgccggatggaggatgacctgaagagggccgatcggctcgccagcctgggtgcactctctgcgcaactggcgcacgaactgcgcaacccgctggcgtccatgcgcggctcggcgcagttgttggcgcaggatgcacgggatgacgtggcccagaagctcaccaacatcttgatgcgcgagtcggatcgtctggcacggctcgtcgaggagttcctgcgctttgctcgtcccccggtgcccagcttgcggagggttccacttgcctcgctcgtgacggagaccatggacatgctccgggtggatccactggcacgtgacgtacgggtcgaagtcaccgcgcccgagcctctcccggtctcggttgacccggatcagctgcggcaggtgctcatcaacctcgtgcgcaacgggtttctggccgcaggcccgcgcggtgaggtgaaggtcgcgctgactcggagcgagaatgaggcgagaatccgcatctgggactcgggggggagcatcacggaggagatgatggggcacttgttcgagccgttcttcaccacacgcgatggcggcacggggctggggttgtccaccgcgcactccatcatccgggcccacggaggctccatccgggtgcgctcgaaccgtgatgaggggaccgagttcgtggtggggttgccgctgtgacatccgtacagggaggagacctggggtcgcgcggccacatcctcgtggtcgatgacgagctgtccatgcgtgagtacctcgagctgttgcttcagcgggaggggtactcggtgacgagcgtggccagtgtgaaggccgcatgtgatgtgctggccctggacggagtggacctggtcatctccgacttgaagctgggcacgggcagtggcctcgacgtcctgcgggcggcccgggcccggtcggcttctcccgaggtggtgctcatcactgcctatggcacgcccgcggcagcggtcgaagcgatgcgggaaggcgcttacgactacatctgcaagcccttcgacaacgaggagttgcggctcctggtgcagaaggcgctggagaagcgaacgctccgtcaggagaacagtggtctcagggcgcggctatttcctggcctggatggcgcggtgggtcagagcgagcgcatgcaggcggtctgggccttggtggagaaagtcgcttccggccgcagcacggtgctggtgacgggggagagcgggacgggcaaggaactggtggcgcgggccatccatatgcgcggcactcgagccgcgcgtcccttcctgcccttcaactgcgcggcgttgaacgaggggacgctggagagcgagctctttgggcatgtgaagggggcattcactggcgcgaccaccgaccgctctggcctcctggtggccgcaggcgatggcaccgtcatgttggacgaggtcggggagatgccgctcgcgacgcaggtgaagctgcttcgtgtgctccaggagcggaaggtgaagccggtcggcagcgccgcggagattcccttccaggcgcgtgtcatcgcggcaacgaaccggcggctcgaagccgaagtaaaggccggacgctttcgtgaggacctcttctaccggctcaacgtcatcacgttggagctgcctccactgcgcgagcgttccggcgacgtgtcgttgctggcgaactacttcctgtccagactgtcggaggagttggggcgacccggtctgcgtttctcccccgagacactggggctattggagcgctatcccttcccaggcaacgtgcggcagctgcagaacatggtggagcgggccgcgaccctgtcggattcagacctcctggggccctccacgcttccacccgcagtgcggggcgatacagaccccgccgtgcgtcccgtggagggcagtgagccagggctggtggcgggcttcaacctggagcggcatctcgacgacagcgagcggcgctatctcgtcgcggcgatgaagcaggccgggggcgtgaagacccgtgctgcggagttgctgggcctttcgttccgttcattccgctaccggttggccaagcatgggctgacggatgacttggagcccgggagcgcttcggatgcgtaggctgatcgacagttatcgtcagcgtcactgccgaattttgtcagccctggacccatcctcgccgaggggattgttccaagccttgagaattggggggcttggagtgcgcacctgggttggcatgcgtagtgctaatcccatccgcgggcgcagtgccccccgttgcaaccttctctgaggacccccatgcgcgtctcgcgattcaacccccgcaaccgtggcttcacgctcatcgagctcatgatcgtggtcgccatcatcggcatcctggccgccatcgccatcccgaacttcatcaagttccaggcccgctcgaagcagtccgaggcgaagacgaacctcaaggcgctgtacaccgcgcagaagtcgttcttctccgagaaggaccgttactccgacttcgccaacgaaatcggcttcgcgccggagcgcggcaaccgttacggctaccgtgtgtccgctgcggcgggcgattgcgaggtgcgcaatgcggctgaccttccggtgcctgctgccggcgttccgtgcatctccaacgactcgttccgcttcggtgccaacagcgccatcgacgatccgaccccggttgtcgcccgcttcgtgccccagggcgctgccgggtggaacacgaccctcggtgtgcagccgaccatcgcagactgccccaactgcaacttcttcgctggtgcgcgtggcaacgcggacaacgaggcgaccttcgatgactgggtgatcgccggtttcgagggctctggccaggtgggtccgtgctccgaggcgggtaacgttgcctccggtaccccctacaacacgcgcaacgacgtcgcctgcgacggcgcggcccagtaactcgcattccttcagtggaatgagcagtggagggtccactgttcttcgggccgctctcccccaggagggcggcctttctcaattctacaaccccagggaactcatgcggagcgtcgtgctgtgtctggctgtttgcgccatcgcagtgatggcagagaagccggccaagccattgcggacgaaggatgggcccatcctcccccggcgagagttcctcgaaatcgtgggggcggcgcagaagccgctgttggccgacttctactggctccagtccatccagcaggtcggccgtgcgaacacggacacggaataccgggacgtgttcttctacgcggatctggcgacggacctcgatcccaagttcaggtacgtctacgagtggggtgccatcaccacccccgtcaacctggggagggacgaatgggcgaacacggacctgtcatcccggctgctaagcaaggggctggttgagttcccggacgaccgccggttcctgttccaactggcctacaacaagatgacgtatgacagggactacaagacagctgccgaccagctcatgaagttgtcgaagtaccctgagacgcccccctatctgctgcaactcgccacgcgcctctatgcgcaggctggcagcatcgatatggggcttcaactggcgcagatgctgcgtgacggtgcggaagacgacgagtcacgagccttctacgaacaccgcatcaaggaactacttcgagagcgcttgctgacgcagatcgacgaggctgttgcggcctaccagcgtgaccggggagaacgccccaaggcggtccctgtcttggtgcgcgcgggctacttgagggccatgcccatagatccgctggagggacagttcttcatcgacaggcaggggcgcgcgcgttccacctcgggaatctacaggttggagatgttcgaccagaagaagaaggatgagctgcgggaagacatcgcggcgggtggcattcagttcgaccttccggaggagatgccatgacagtcgcgggcgcgtcggatccgaacctgccagtttccatccgggggttgtccaagacgtacaaggtgggcttcttcctcaacaagcaggtcaaggcgctccagggactggaccttgagattgccccaggccaggtctacggactgctggggccgaacggggcgggcaagtccacgaccatcaagattctcatggggctggtgcgggcctcggaggggcaggccttgctcttcggagagccaccagatcggccgcatgttcggcggcaagtgggcttcctgccggagaacccttcgctttatgagtatctcaccgggcgtgagttcgtgacgttggctgggcgcatcttcggcctgagcggtcatgagttggaccagcgcgtagagcgggtgctcggcgatgtcgggatggggcgagcgtccgatttgcagatccgccgttactccaaaggcatggtgcaacgtacggcgctggcccaggcgctcatcagtggacctcgcttgctcgtgctggatgagcccacctccggtttggatccgctggggcgccgacagatgcgggacttgatcctggccgagcgcgcgaaggggacgaccatcctcttctgtacgcacatcatctcggatgtcgaatcgctttgtgaccgagtggtggtgctggtgggggggaggagggtccaggagggcagcgttcaggacttggtgtccgcgaaggccccatcggtggagatggtggtgcacgggctgccgctggaggtgctccagtctctgggattcagctatgagcacgcgcagcaattggacagtcgcgtgctgttgcggatcccgagcgctgattcgcatgggggtttgcgcactgtcatcaacg

SEQ ID NO: 972 - DNA, 10915 bp, Myxococcus xanthus
cctgcttccgcccctccatggacgcggagtacgccaggaagccgaagttgtgggacgtgtacatggggtagacgtggccgcgcggcttcgcctgcttctggtaggccaggtccgccgccgccgccttccgattgctttccgatgcatccgcgtagcggcccacgcgctggtagatgtgggccggcatgtggacgatgtgccccgccttcggcgccagagcgcccagccggtccgcggaaggctccgccttctccgggttcggcgaggcctccaccgcgtggatgtaatagtggttcgcgcccaggtggtagggggcccgggtgagcacggactccagcgtggcgacaatctgctccgtgcccggagccggcgccccgtccagcgaccacagcttccagggattccggtccatgagggcctcggcatggagcgtctgcacgtccaggtcctccgggtagcgcgcggccacgtccgccatggcgctggcataggcctcgttgaagggggccatcttctccggtggcagggcattcgggccggggtagcgctggacgagcgcggtgatgagcgcctgctccaccggcgtcgtacggggtgcgagctgccgcgcgcgctggagggcgtcccaggcggcgggcgcactctccgccagcatgggcatgttgtagttgggacccagcaccagcgcgacgccccagaaacacatggcgcaggtggggtccaactgcgcggctcgggcgaacgagcgtgcggcctcgtcgtggttgaagccatacgccagccgcaggccctggttgaagaaggcctgggcctggggggaggccgtggtgacctggcgttcgtgcgtccccagcccgtcgagcagcaacgcgccgtctgccagggaatccagggtcggggccgagtgctccgccgcagcggcggacgtgccggcgaccgccatggccaacatcaagacatagggcaggggagcacgcatgggggacctccgcggggatgtgctctttccccaacctggggacgcgccgacgcactgcccacggggtgacatggcgcgttgcctacttgaagtgatgcttggcgggcgcatcactttccgcgtgcggatgagggttgggaacgagcccgcgccgtagtagattcccgcccggcggaatctcactgcagcagcgcgagcgtccgctcaagaccacccatgctcgaaaggtgttcgagggttccgcccccagggccggcttcctcgttgcgccgctttttcatacccccatccgcgtagcgcccagggagattccgccgtgcctcacgacaccacgctcatcgccaccatcgcagttggactcggactggccttcgtcggtgggttcgtcgcacggtggctgaagctgccacctttggtgggctatctcctggcgggcgtggccgtggggccattcacgccgggcttcgtcgcggatgggggccttgccggtcagttggcggagattggcgtcatcctgctgatgttcggcgtggggattcatttctccatcaaggacctgctcgccgtgcgcaatatcgcggtgccgggcgccgtcgtgcagatcgcggcggccaccgtgatggggaccgcggtctcgcactggtggggttggagcctgggtgcgggcctggtgttcggcctcgcgctgtccaccgccagcaccgtggtgctgctgcgcgccttggaggagcggggcatcctcgattcggtgaatggccgcatcgcggtgggttggctgattgtcgaggacctggcgatggtgctcgccctggtcctcctccccgcgctgggcaacgtccttggctccgccgacacgcagacgcccgcgacggcggccgctggagacagcctcatctggaccctggccttcacgctggggaaggtgtgcctcttcgtggcgctgatggtggtcgccggcacgcggctggtgccctggctgctgacccaggtggccaagacgggctcccgcgagctgttcacgttgtcggtgctggcggtgtcgctggggattgcgttcggggccgccgcgctcttcggcgtctccttcgcgctgggcgccttcttcgcgggcgtggtggtcagtgagtcggagctcagccaccgggtggcggaggattcgctgccgctccaggacgcgttctcggtgctgttcttcgtgtcggtgggaatgctcttcgacccgatggtgatggtgaagcagccgctcgaggtcctcgccgtgctgggcatcatcgtcctgggcaagtcgctggccgccttcttcatcgtgttggcgttccgctacccggtgaacaccgccctcacggtgtccgcgagcctggcgcagattggggagttctcattcatcctggtgggattgggcgtcacgctcgggctgctgccgaaagaagggcagagcctggtgttgtcgggagccctgctgtccatcaccctcaatccgctcgtcttcaagaccattgatccgctgctggcgtggctacgccggcacccaaggttcgccgcgcgcatggaccccgaggaagatgagctgtccgacctgcccattggcatgggggacgtgcaactgcgcgagcacgcggtgttgattggctacgggcgcgtgggcggcgtgattggccagagcctgacggagcagaagattcccttcgtggtcgtggagcagaaccgcgagtacgtggagcgccttcgtgaggagggcgtgcccgccatctacggggacgccgcggtgcccggcatcctggagcacgcgcacctggatacggcgtccatcctcatcgtcgccacgccggacgcgctgcaggcccgcgccatcgtggagcaggccaaaggcgtgaatccgtcccttcccgcggtggtgcgcacgcatggggacgaggagcgggattacttggtgtcattgggcgtggaccgggtggtgatgggcgagcacgcgctggcacggagcatgttggactacgtgctggagcgactgtccgcactgaaggccgggcctctgttgccggcacccgcggacgccgtggtgccttgaggcccgcgggaactgcggtgcggctcccactcgagacggcgtcgtcgtgacatgaaaaaggccgaggcgcggcaagcgcctcggcccgtgcgtttcatcgccgcgtccgcccggctggggacgcggtgtcagccttacatgttgcgccggtactgcccgcccacctcgtacagcgcgcgggagagctggccgagcgtgcagaccttacaggcgtccatcagcgcggcgaagatgttgccgttgtccagcgccgcgcggcgcacggcctccagggccttgggcgccgtcgcctcgttccgcttccagaaggcgtcgcgcgaggtgatggagtagttcttctcctccgtcgttgcgcggatgacctcgggcggcgtcaccgtcggagagcccttggggtccaggaacgtattcaccccgatgatgggcagcgtcccgtcgtgcttcagcgtctcgtagtagagggactcctcctgaatcttggagcgctggtacatgcgctccatggcccccagcacgccgccgcgctcggagatggcgcggaactccgccagcaccgccgcctccaccaggtcggtcagctcctcgatgatgaacgcaccctggctggggttttcgttcttggagaggccgaactccttgttgatgaccaactggatggcgagcgcgcggcgcacgctctcctcggtgggcgtggtgatggcctcgtcgtaggcgttggtgtgcaacgagttgcagttgtcgttgagcgcgagcaacgcttgcagcgtggtccggatgtcgttgaaggcaatctcctgcgcgtgcaggctccggccagacgtctggatgtggtacttcagcttctgcgagcggtcattgccgccgtacttgtcccggatggccttggcccagatgcggcgcgccacgcggcccagcacggcgtactccgggtccattccgttcgagaagaagaacgagaggttgggcgcgaagtcgtcgatgtccatgccccgcgacaggtagtactcgacgaaggtgaagccgttggccagcgtgaaggcgagctgggagatggggttcgccccggcttccgcgatgtggtagccggaaatcgacaccgagtagaagttccgcaccttctggtcgatgaagtactgctggatgtcgcccatcacccgcagggcgaactccgtggagaagatgcaggtgttctgcgcctggtcctccttcaggatgtccgcctgcacggtaccgcgcaccgactggagcgtcttcgcgcggatgcgctcgtagacgtcgcgcgggagcacctcgtcgccggacacgccgagcagcagcaggcccaacccgtcgttgccctgcggcaagtcgccctggtagcggggccgcggcaggccgcgctcgcggtagagggcatcaatcttcttctcgacctcgtcgaccttgccgttctcgcgaatccacttttcgcactgctgatccaccgcggcgttgaggaagaacccgagcagcatcggcgcggggccgttgatggtcatggacacggacgtggacgggtccgccaggtcgaagccggagtagagcttcttcgcgtcgtccacgttggcgatggacacgcccgagttgcccaccttgccgtagatgtccggccggtggtccgggtcctcgccgtacagcgtcaccgagtcgaaggccgtggacaggcgcttggcgggcaggccccgcgacacgtagtggaagcgcttgttggtgcgctccgggccgccctcgccggcgaacatgcgcgcggggtcctcgccctcgcgcttgagcgggaagacgcccgcggtgaaggggaaggcgcccggcgcattctcccgcagcagccaggtgaggatgtcaccccagtcttcgtaacgggggagggcaatcttggggatgcgcaggtgggagagcgtctccgcgtacaggtccagctcgatgaccttgtcgcggacctggaactggtacttggacgcggcgtagcggcgcttcgtcgcgggccactcggccagcagccggcggcagtcggcgtggagccgcgactccaaatccttgtacagctccaccagctcgctcaggtaggcgggctcgccctcgacgcgctcggtgacctgcaccgtgtccgaggggtccttgggctcgacgatttccaggcgcttcctgcccacgttggtgcgcagcgcctcgatggtgccgtggagctggtacatacgccgggcgatggcggcctgggccttcacgaagccgtcataggactcacaggcctcgacgatttccgccaggtagcgcgtgcgctcgggcgggatgatccacttcttctcgctcatccccggcgtgagctcgaagccggacttgagcggcgcgcccgtcttcgtggagatggtgtccatgagcgcccggtagagctggttcatccccgggtcgttgaactgcgaggcgatggtgccgaacacgggcaccgcgtcatcggcggtggtgaaggcgttgtggttgcgcttccactgcttgcgcacgtcgcgcagcgcgtccagcgaaccgcgcttgtcgaacttgttgatggcgatgacgtccgcgaagtcgagcatgtcgatcttctcgagctgcgtcgccgcgccgtactccgccgtcatcacgtaaagcgccacgtcggagtgctcggtgatttcggtgtcggactggccgatgccggaggtctccaccacgatgaggtcgaagccggcggccttgcagatttcgatggagtcgcccacgtgcttggacagggcgaggttgctctggcgggtggccatcgagcgcatgtacacgcgcggattgtcgatggcgttcatccggatgcggtcgcccaggagcgcgccgccggacttgcgcttggacgggtccacggacagcacggcgagcgtcttgtccgggaagtcggcgaggaagcggcgcaccagctcatccacgaggctggacttgcccgctccgccggtgccggtgatgcccaggatgggcacgcgcgggcccctggcctggatatgcgacatggcctcgcgcagggccgcgccctgggacgcgaagttctccgcgatggtgatgagcggggcaatccgggacggctcgcgcatcgagggcgcatcgagcaggggcgcgaagtccgccggccgcttctcgaagtcgcactgggagatgaggtcgtcaatcatcccctgaaggcccatggcccgcccatcgtccggcgagtagatgcgcgtgacgccgtagcggtggagctcttcaatctccgacgggaggatggtgccgccaccgccgccgaagaccttgatgttggccttccgctcgcgcagcaggtcaatcatgtacttgaagaactcgacgtgaccgccctggtaggacgtgatggcgatgccctgcacgtcctcctggatggcgcagtcgacaatctcagccaccgagcggttgtgccccaggtggatgatttccgcgcccgaggactgcatgaggcggcgcatcacgttgatggcggcgtcatgcccgtcgaacagggaggcggccgtcacgatgcggacgtggaaacgaggcttgtagggctggggaacgggtgtctgctggacgtttcgcacggcgcgtacagtaagagcgccgtttgtgtcgaggcaagggattggagcgtgactgaccgctcctcgacgcgggctgtcaggccctcgtttcagggaggaacgcgcccagcacccgcagtgcggccgacgtcggtgtcgcacgcccttcgcgcacgtccgcctccagcgtgggcaccagtgcggacacctcggggtgcgcacgcagggccgctcggaggccgtcctgcaccatggaccacatccactgcacctgctgcgccttgcggcggcgctccatcgcgcccgagaccgcgctccgcccgagctgcgtctcgacggatgtccacagcttctcgatgccggtgccctccagggcactgcaggtggtgatttccggctcggcgcctggccgcatcaggtgcaacgcggcgcgtagctcggagcgggccctttcggcgcgcggcttgttgtcgccgtccgccttgttgatggcgagcatgtccgccacctcgaggatgccgcgcttgatgccctgcagttcgtccccggcgcccgccagcatgagcaccaggtagaagtccaccaggtcggccaccaccgtctccgactggcccacgcccaccgtctccaccaggaccacgtcgaagcccgccgcctcacacaagagcagcgtctcgcgcgtcttgcgtgccacgccgcccaaagtaccgctggaggggctggggcggatgtacgcggcttcctcgcgcgacagccgcgccatgcgcgtcttgtcacccaggatgctgccgccggacacggtgctggacgggtcgatggccagcactgccacgcgcttgccggccttcaccaagtgcatgcccagcgcgtcgatgaaggtgctcttgcccgcgcccggcacgccgctgatgcccacgcgccggctgccacccgtggcggggagcagccgcgtgaggacctcctgggcgagcgcggcatggcgcggcagctcgctctccaccagggtgatggtgcgcgcgagcatggcgcggtcacccgcgcgcacaccgtctacatacgcgtccgcggacagcagcttcacgcctcttcctccagcgacgcggccagcttgtcgagcagttcgatggccgccttggagatgaccgtgccagggccgaagatggccgcggcgcccgcggcgcgaagcgcgtcgtagtcctgcgcggggatgacgccgcccacgacgaccatgatgtcctcacggcccagcgccttgagggcctgcttgagttgcggcaccagcgtcaggtggccggcggcgagcgagctggcgcccacgacgtgcacgtcgttctccaccgcctgccgcgcggactcctcgggcgtctggaacaggggaccgatgtccacgtcgaagcccaggtccgcgaacgcggtggcgatgaccttctggccgcggtcatgtccgtcctgccccatcttcgcgatgaggatgcgcggccggcggccgaagcgcgcgaggaacgcgtccgccttctcgcgcgcgtcgatgattccctgagcgtccttgcccgcttcgctggaatacacacccgtcacgctgcgcaccgtggcctcgtagcgcccgaacaccttctcgagcgcgtcgctgatttcgcccaccgtcgccttggcgcgggccgcgtcgatggccagtgccagcaggttgccctcgccgcgccgtcccgcctcggtgagcgcgtccagcttgcggcggacgtcctccgcgttgcgctcggcgcgcagctcgcgcagccgggcaatctgcgcctcgcgcaccgccgagttgtccactttgagaatctcgatggagtcctcgcgctcgggcgggtacttgttcacgccgatgatggcctggcggccggagtcgatgcgcgcctgggtgcgcgccgccgcctcctcgatgcgcagcttgggcaggccggcctcgatggccttcgtcatgccgcccagcgcctcgacctcctggatgtgggcccacgccttgtgcgccagttcgtgcgtgaggcgctccacgtagtagctgccaccccacgggtcgatgacgcgcgtggtgccgctctccaactggagatagagctgggtgttgcgggcgatgcgcgcgctgaagtcggtgggcagcgcgatggcctcgtccagcgagttggtgtgcaggctctgcgtgtggccctgggtggcggccatggcctccacgcaggtgcgcacgacattgttgaagacgtcctgcgcggtgaggctccatcccgacgtctggctgtgggtgcgcagcgccaggctcttgtccgtcttcggggagaagcccttgatgagcttcgcccagagcaggcgggcggcgcgcatcttggccacttccatgaagaagttcatgccaatggcccagaagaaggacaggcgcggcgcgaaggcgtccacgctcagtcccgccgcgagcccggcgcgcacgtactccacgccatccgccagcgtgtagcccagctccaggtcctgcgtcgccccggcttcctgcatgtggtagccgctgatgctgatgctgttgaagcgcggcatcttctccgccgtgaagcggaagatgtcgccgatgatgcgcatcgacggagcgggcgggtagatgtacgtgttgcggaccatgaactccttgaggatgtcgttctggatggtcccgctgagctgctcggggcgcacgccttgctcctcggcggcgaccacgtagagcgccagcaccgggagcacggccccgttcatcgtcatggacacgctcatctggtcgagcggaatccggtcgaacaggatgcgcatgtccttgatggagtcgatggccacgcccgccatgcccacgtcacccgccacgcggggatggtcgctgtcgtagccccggtgcgtcgcgaggtcgaaggcgatggacaggcccttctgtcccgccgcgaggtttcggcggtagaaggcgttggaggcctcggccgtggagaagccggcgtactgccgcaccgtccacggctgctgcacgtacatggtggagtaggggccgcgcacgaagggcggcaggcccggcagcgagcccaggtgctccacgccctccatgtcctctcgcgtgtacaccggcttgacggggatgccctcgggcgtgtcccagcgctcggcgttgcgcgtggcctcgccggcctgacgcagttgctggtcgcgcatgggcgcggcggagtgcgtttcgggggcgtcgaagtcgatgcccgagaagtccggtacgtgggggcgcatcaggccactccgagctgctggtgcagtgaggacaggagcgcgaacaggtccgctcccgcgtagaagaagacgtccacgccggccgcgcggaaggcggcctcatggtcaccgggccggcccgccacggccaccgcgcgcgcgcccttcgacttcagcgccgccgtcaacgcgggcacccattctggatacagcgcgtccggcccggagatgacggcgagcggcgcgccggatgcctggaagcgggccaccgcgtccgcgatgtccgcgaagccatgctggtccgccggctcgataccgcccgcggccaggacgttggccgtccacgtggagcgggtggtgtgctcggccaccgtgcccaggcttgccaggaaggccttggggcgtgcaccgtgcgcggcgaggtggcggtcgctcgcgtcgcgcagcgcctcgaagggctcggccactcgcgccgggcgcagcggcagggggcccgatgtcgctggcgccgtggacgcctcggcgcgggacttccgctgaacgggtgtttcgcccaggtgggggaactcactcacgccgacaatgggcaggcggcgggtgcgcacggccttgtcgcgcgccgcgcgcgtctccgcgagcacgcgggccacgtcgccgctcgtgagcgcttgctccatgcggcccagcgcctcgatgcgccgcagctcggtccacgccgcgcgggcgatgtcctgtgtgagctgctccaggtagtagctgccgcccgcggggtcggcgacgcggttgaggctcgactcgtcgcgcaggatgagctgcgtattgcgcgccagccggcgggcggacgcgtcgggcgtgcccagggcttcgtcgaacggcgaggtgctgacgctgtccgcgccaccgacgacggcggcgaaggactccgcggtggcgcggaggatgttcacccacgggtcccgctgcgtcttcgtggtgctcgcggtgcgcgcgtgcagcaccatggcctgggcctccggcgagccgccacaggcgttagac

SEQ ID NO: 973 - DNA, 10318 bp, Myxococcus xanthus
tggtcgggcgtgctcgacgggttggggcaggggagcgcgcgaggcttcttccggcgtgatggcctggaggtgacggggcacattcccggcgcgggcggcgcgcagcggcactcggtgggcggcgtggagctggagggccgcaggccgctgggagagtaccaagcgctgactgtcacggtggcgacctcgggtgagacggtgacgcaggaggagggcgcacaggcctcctcgtggtggcgcgccagcgtcatggccatggatgaggtgcggctcttcggaggcacgctggacgtggtgccttcgatgcggctggagcgggtggggccgtactggttgctgtcgccgaagctgggtgcatccgtcgagctggggcgcggcttcgggctgcgcgccaacgccgggcagtcccaccgcgcgccgtccttcctggagctgtacatccggcaggggacgctgctgcccaaccccgggctgaagcccgagcgcgccttgtacgcggacgcggcggtgacgtggcgctccggtccggaagactccgaggaagcggcgccacgctggggcctcacgctgggcggcttcgcggcgctgtatgagaatctcatcgcctatgagctgtacccgccgctgatggcgcgtccgtacaacttcgacaccgcgcgcgtgtggggcttggaactggagggcgaggcgaggcctttctcctggctcctggccagcacgggctacacgtacctgcgcacggagaaccgctatggggacccgcgcttcttcggcaaggacctgccgtaccgtcccagacacaagtgggtggggcgggtgcgcgcggggccagattggctcaacgcccgcgcggaagtgctctaccagtccgcgcagctcatcaaccgcaccggctcgctcgatttgccatcacgcacgttggtgagcgcgggcgcgtccagcacctttcttcatggtccggacctcaccctgtccgtcgagctgaagaacctcctcgacgtccggaccttcgacttcacgggcttcccgctgccgggtcgcgccgtctacgtgacgctcgcggtagcgctcgagccaggcgcgtcaccgtcatcctcatccactcgggagccccatgactcgcccgcgtcccctgtcccctgagccgttccttccgaccttgctgctgacggccgtggcggcgctgctgctcaccgggtgccccgaggagggcgcggtgtgcacctccggcctgtccgtctgcggtgacgcctgcgtggacctgcgcggcgacgtcgcgaactgcggcgcctgtggcaacgcgtgcggcgatgggcagacgtgtcaggccggcgtctgtgactgtcgcccggggacggagtcctgcggtggcgcgtgcgtggccacggcgagcgatgtcgcgaactgcggcgcctgtggcaacgcgtgcgccgccgggctcgtgtgtgaatccggcgtgtgccgcgaaggctgctccgaaggcagcttgcggtgcggggactcgtgcgtggacgttcgcgcggacgtgctcaactgcggcgcctgcggcaacgtgtgtccggatgtgcagacgtgccacgagggacgctgcggctacgacgtggtggcggcctgctacacgcacgggcagctcgtgggcatccaggcggggacggaccagctcgggccgcggcgtcagttcggctcgggcgtgcagacgctcgcgtcctgggacggccatgtgctggccgcggacgccacggcttcgaagctgctccaggcggcgggcggcgcgctggggacggtggtggaggaggactcgctgggcggggtggcgggctcgcccaacgacatcctggtggacccgccttatgtctacgtcgtggactcggtgaacaacaccttgcaggtgctcaagcgggagggcccttcccagggtgcggggctgggcctgcgcaccgtgacgcaggtgaacctgggggccaacaccagcccgcaggcgctggcgaagtggggcaccacgctgtacgtccccttgttcggtacgggcggctccatgttccagttcggcaatgccgtcgcgcgcgtggacatctccaaccccgaacagccgcgcaaggtggacacgatttcgctcaccgggctggacctgaagcccttcgacggcggcacggtgttgccgctgccttactccgtcgcggcgacggaggcgggggtgtacgtcagcctcaccaacctgaatccctacaacggctacaagcccaatggcccgggcatgctcgcgaagatcgaccccgcgagcggccgtgtgagcgccatcgacctgggcgcggcggattgcctcaacgcgggctacgtggaggccgtgggtgaccagctcgtggtggcctgcctgggcgaggccgagtacgacgaggccaacgggcacagcgccagcgccgtgcgcgcctccgggctggtgctggtgaagaacgacgcgcccgtggcggcgtacgcgctcaaggcggggtgtgagcccggaacgctgggctgcaacctctccgtggccagccgcttcgcggtggcggagggcgcggtgtacctggcggacacgaacgcgggccgcgtcttcgtggtggcggtggaggacgggcggttggtggagcgccgcggcttctcttcgccccaggccctggggcccgcgctggaggcgtgtcccacggacccgcgccggcccgtgtccaatgccattgacgtcaccgccctgcactgaggaagcgcacgccatgccgatgaacacgacttccatttcgcgtctctgctcgggcatgtccgtcctgctcgccacggtgctgtgcctgctcaccggtacggtgagcgcggcggagacgtcgagcctgaggacgctggggccgccagcgccttccaaggtgcggcgcgtggtgacgctggcgccctcgctgtcggagatggtgctgtccctgggcgcggggagcacgctggtgggggtgtcccgcttcgacgaggcgaaggaggtggcgaagctgccgcgcgtgggcggcttcacggacccttccgtggaggcggtgattgcgctcaagccagacctgctcctggtgcagcccgggccgggcaaccagcgtccggtggagaagatggccgagctgggcgtgcccgtgctgctgctgccgctgcactccgtggcggacgtgctcgcggccatgcgcgcggtggggaaggcgctcggacgggagaaggaggcggaggcggtggtggtgggcatcgaggccacgcgcacgcgcatccgggaggcggcgaagaagctgcccgcgccgcgggtgctgttcgtctatggcttcgagccgctcgtggtggcggggcctggctctttcgcggacgagctgctccgggacgcgggcggcatcaacgtggcggcggacgcgagctccgcgtacccggtgtactcggtggagcgcgtggtgcgtgcccgggccaccgtggtggtggatgccgcggacgtggacgtgggcaaggacaagttgcgggcactgcccggcctgtccaacgcgcgctgggtggacctgccctccatgtcgctgctgcagccgggaccttcgctggggcggggactggaggaactcttccgtttgctgcatccgaagggaacgggtaaggccgcgccgtgagcgagccggcgacatcccagcgtgcacatggcggagcgggaggctttcgcgcctcgcgcgcggtgatgttgttcgggggcttcctcgtgttggcggtgggctgcctggccgtggcggtgcgcttcggtgagcagtccatctccctcaccgccgcgctgacggagcccacgtccacggacgccgtcatcttctggtcgctgcggctgccgcgcgcgctgctgggggccatcgtgggcgcggggctggcggcctcgggcgccacgctccaggggctcttgcgcaatccgttggcggacccgttcgtgctcggcgtgtctggcggggcggcgatgggggcgacgctggcgctcgcggtggggctcgccaccgtgggcgaagtggcaccgggcctgggcggcgccatggcgcgtctgtccgcgccggcgctcttctccttcctgggcgcgggggccgccatcctcttcgtcctctccgccagccggggctccgcgtcgcgcgcgccctacgccgcgctgctcaccggcgtggtgttcaacgcgttcgcctccgcggccatcaccctggtgaagacgctgtccgcccctgaccggctgggggaaatcctctactggctcgccggagcgctggggtacgagcgcggcggcacgctgctgctctccgcgctgcttcaggccggcgcgattggcgtcatgtgggtgctctccgcacggttgaacctgttgtcgctgggggacgatgacgcggcgtccctgggggttccggtggcggcgacgcgccgctggttgctgctggccgccagcgcgagcgtcgcgggcgcggtggcgctcacggggttgattggcttcgtgggcctcatcgtgccgcacctgctgcggctggccttcgggccggaccagcggctgctggtgccactgtcggcgctgggaggcgcggccttcctcgtcctgtcggatttgctggcgcggctggccttccccttgttcggggccgaacctcccgtgggcgtcgtcaccgcgctgctgggaggcccgctgttcctcgcgctgctgcggcggcgggtgcgtctggggaccagtcattgacaatggcttgcacccgccatatccccgctcgcgtcctcggtgtcgccgtggagccacggtgactcaagggaacccggtgtgaatccgggactgccccgcagcggtgagcaggaacgaacgccgtcacgtgaagcactggcccgaagcgggctgggaagcgacggcaagtaggtgggtgctccgtgcacccgcgcctgcgagtccgaaaacctgccgaagacccgtgcccttggcacggacatcaccgaggcctccgaggggaggcggcgggggcggtgctgtccggcgcgaaaggtccgccggggctttgccttcggccgtgtcctcctggaagcccattcgcccgtgggggcggaagagggagcgaggacaccgatgaagtacgccgatgtgaaacgcgcaggagcccgcacgaagtccctgatgttcgccacggccagcttggtgctggcggttgccaccacgggctgtggctccgaatgcgtggatgtctacgactgccgcaacgagaacggccctgctcccgcgggccaggagtggacgtgcgcctcggagaagtgtgagacgcggcccatccagcaactccccggggaagacgcgggcaccgacccggagaccgatgctggcacccatccggagccggacgcgggcacggagccggacgcgggcacggagccggatgcaggtacggagccggacgcaggcacggagtacacgtgtgagacggcgccgtacgacccggtgctcggcacgcttcagctccaggcgggcttcgagaccgcgaactccgcgcccatgccggacgacgtgctggcggtggccgtcacgccgggccccacgtatgcggtctatgcagtgcaaggggggacgagcgcggacgtctattcgctgggaatctggccggacctgacgccttcctcgtcgccgctgttcaacgtcctggcgcccgaggaccgaggggccacgtcgggcatctaccccaaccgcttcctcgtgcatggcgccgagcggctgctggccggctacacgaagtcgggtggcgcgggcacggtctcgctctatgacatcgtcacccctgacaactcgagctacgtcaactcgccgggcaacatgagcgccgccgcgttcacgtcgggcacgacgtccgccttcctcatcaacagcatggggctgtccgccatcgacggcttcggaatctatgcgctggtgacctccgcggagcccgtggcctccgtgaaggtggccgacttcccgcagaccgccggcggaaatggcttcagcgccgtggcgaccaacggcgtctccgtgctcggtttcgtcgttccgccggactacgccaacgtggcctacgcggtggcgccctccgtcgtgagcgcggcgctctcctccaacacgccgttcgcattggatgcgcagccccagattgacgtgggcagcgacttcaacgcggcctccgctttcggtgacggcgtcgtcgtcaagcggggtgcctatgatgacacctggcagttcatcaccaccgacgtgtcccgctacagcctgtccgcggacgcgaccccgggtgaggtcgtcattggcgagcgcacgccggtgctgacgctcgtggaccagtgcacctccgtgacgcagctgacccacctgggctcggacctgctggtgggcatcgaggacgtgaacggcgagcggctggtccgcatccgggtcgtccagtgagccatcgcggcctccatcgcttcgcctggggcacggcgctcgccgtgctcctgggcaccgccgcatgcggtgacgattcctccggcgtcggcgaagacgcgggaacggacccggtgcgggacgacgcgggacagccggatggctccacatcgctggagcccgatgccggacttccgcccgaggacccctacgcggacgaagtcgtcctcttcctgcccggcgacttcgcgggcttcgggcaggaccgcttcccggacgtcgtgctcgggcctccgtcggggctggggccggacaacggttcgctggacgtgctctcgctgggccggggcggcataatcgagctgcgtttcaccgacatcgccgtggtggacgggccgggcgtggacctgctcgtgttcgagaacaccttccgcgtcgcgggcggagcggccacgtactccgagcggggcatcgtctccgtcagcgacgacggcgtcacctggtacccattcccgtgtgccaccaccgacgccgcgggcggctacccgggatgcgcgggtgtcgccaccgtccaggccaatccggccaacggtgtcagcgccacggaccccgccgtggcgggcggtgacgggttcgacctggcgacggtgggcctcaagcgagcgcagtacgtgcgcatcgtcgacgcaggcaacaaccgctacggcggcacctccggggggttcgacctggacgccgtcgcggtggtgaacggcgtgtcgcttcggagcggcaccccgtgaagcggctcccgccacggccatgtcccctgtccatgacgggggaggtggaccgccgcgccgcgctcggcacgctgctcaagggcacctgtgccctggcggcggtcggggcggggtgtggtgacgggtggcgggaagccgtggtgctcgaccctcccgatgcgggagggccgggcccgtcttgtgcgccgccggtgccgtcgggcccacccggcgagggctgggtggaggtccccctggtggagcatcccgcgctggaggtccccggcggcgccgcggaggtccgcattccccaggcgctgctggacgtggtggtggtccacacctcacctggctgttacgcggcgctctggcgcatctgcacgcacggtgattgcgccgtggactgggtgccggccgacggcgtcatggaatgcccctgtcatggctcccgcttcacccaggaggggcaggtgctgaatggcccggcgactcgaccgctcgcggccttccccgtggtgagacagggcgcgtccctgttcatccacaggccccgctgagcgaacgttcgggccattcgtaccactggtgaaatgacgcggtgcggagaggcgtgttctggcgccgggttacgggatacccgcactgagtcagtgtctccttctctcaacaggcgggagagtcgtgtaatgtcgggcattcgatgtggcagatcatcatcaacgggcccggctacttcgacacgtcgtacgatctgcctgagggcgtgacgagcctcggccgcgcggacgagaacgatatcgtcctgggcggcgatctcgtctcacgccggcatgcgcggctgttcgtcgacggtgacgtgctgcgaatcgaagatttgggcagtcgcaacggcagccgcatcaacggcgcgcccttgcagggttctcggcaactcgtcgccggagactcggtggcgctgggcgagaacgtcctctccgtgcgccagcccaacaccgtggagaacgcggccacggagatggtggacctgggcgcgggcggcgtcgtgcgcttcggccacggccaggacgtgggcccctccgtcctgatggcgaagaacgtgcgcgacgcggacgtgctgcggctcctggacaatgtgggtccggtctccttcgacgacagcttctccgcgtccgcgccgctgcccgccgcgagcccgcgcgtggggcaggagacgctggtgctgttgttccgcaccgcggaggcgctctcgtcggccgccacgctgtcttcgttcctggacaccaccatggaccggctgctggaggtcactgacgcgaccacggcggtggtgctgctcaagcacgccacgggcgccatggtgcccgccgccgtgcgccaccgcggccggctggccaagggcgaggtgcccgtctcggatgccatcgtggaggaggccctgcgtcagggccgcgcgctcgccgtgggcgacgtgcgcgatgaccgccgcttcgcgggccgggagagcgtcatcctctacggcgtggaccgggtgctgtgcatccccatcggcaccgagccgccctacgcgggggtgctctacgtcaacctgtcggccaagggtgacgccagcgtggagtcgatgctggatacctgcaccgcggtggcgcatctggtggccaccggcgtgcagaagttctccccgcgcgagggcagtcccgcggcggacaggctgcggcgcgacctggagcgcttccacccgccggacgtggccgagcgccgcgccgccgaggcccagaagcagggcggcaagctgcccggcctggaggagcgcagcctcaccatcctgcacgcggagctcgtgggcttctccgtgttgtgcatgcgcatcggcgccgctcgggccacgcagatgctcaacgactttcacgcgcggatgagcggcatcgtcttcagcttcgaggccaccgtggagggcttccggggcgaatccctgcgcgccctcttcggcgttccctacgcgaagggcgaggactcgattcgggccgtccgggccgccctggcgctgcgctccgagtgggagcggtccatggcgcgccggcccctggacgagcgctgcgagctgcgaatcgccctgcacagcacccgggccctggtggggatgatcggcaccgaggtgcgcccggactacaccgtggtgggggatggcgtcgggattgcggggtggctcgccggtaccgccagcccgggccaggtgctcattaccggcaaggtcctggccaccgtgggggcacgcttcgacgtccagccgctgggcgagcgcctcatccgccccccgaaggacaaggtagcggccttcgaggtgctggaagaggatgtaggccagttgaccaatcccggcttccgttgagggggccgcgtccggttgacgggttgctgggatgtaccgggaaagggttcaatacggaccccgtcgtggtgaacccccgcaccgcatgaactcgtcaacccaacccgcccggttgagacccttccggccccagccctttggccggtacacgctcctgtcccaactggcgacggggggcatgggagagatctacctcgcgcggttggagggggcgcaggggttcgagaagctctgcgtcatcaagaaaatcctcccgcagcttgccgcggacacggacttcgtcgagcgcttcgtgggcgaggcccgcaccctggtccgcctgagccacggctccattgcccaggtgctggacatgggcctccacgaggacgaggcctacatggcgctcgagcacgtggacggcaaggacctgcgcaaggtggccgcgcgcgtgcgggacaggcagatgccgctgccggtcacgttcatcctctacaccatgggccgggtgctggacgcgctggcctatgcgcaccgcaagaaggacgacgacggggaggacctgaagctcgtccaccgggacatctcgccgcagaacatcctcatctcctacgaaggggaggtgaaggtcatcgacttcgggctcgccaagagccggctgtcggccgcgaagacgaaccccagcatcatcctgggcaagttcctctacatgtcgccggagcaggcgcggcaccagccggtggaccgccgcagcgacctgtacgcggtggggct

SEQ ID NO: 974 - DNA, 8820 bp, Myxococcus xanthus
ctcgataagcgccttggggtggcccatccgcggggcctcacccgcagcgaggatgatcgccactgccttcatgcaaccttcgtccgcccccatgaatgaacgccgcaggcccgggggcctcctctcaaaggctgtggcgtccgcgtgggattgcagcccacccctcggtcccagccgtcagccagacgccagtcactccggacgggtgttcgctggctgagcatccggccaggcgctccgtcccctatccgtcatccgaaacccaatgtcctgtcgtggggctcccgcaggaactcgaagccacagaagggctccgggtcggagccgggttcgccctggaaggtccacccgtcatcgcccatgcgcgggtccaccaccgtcaggccgatggcgcactcccgcttcttcagcttgcggatgacggccagccggctggcccacgggcacgcgtaggagagatagaggtgtgtgccacctgccctcgatcaacggccccatggcggatgcctccccgcgctcaacgtggccatcctcgccgccaggtgcaccacctccggcgcgggtttccgctcccaggctggtgtcctccggacgcggtgtgcgaagcggagggcgcccttctgacaccgctgcaaccttgcaccgccagacacctgcgcacaccggggcgccttgaggcacaccctgggcgtctggctacggtgccccccgttcagccactcgggaggtcgcgacatgacggagtccacgcagcacggccaggcacagcacggacggccctgggtgccctggctggtgacggcgttggtggtgctgatgtcgggcggcgtgatgtacctggcgcaccgtgggacgagccaggccgaggcgttggcggagcagtcccgccagtccgccttggacgccgccacgcgggcgcgtgacgcggaggccgcgcggctgcagttggagcagaagctggcggcgctggaagccgagcgcgcccagctcgccacggagaaggagcagctcagctcggagaaggaacagctcagccagacggtgcaggaacaggaggcggagctggcgaagctgaaggccacctacgacgacctgcaggacaagatgaaggcggagatcgccgagggcgccatccgcctgtcccatgccgagggccgcatccaggtggacctggtggacaaggtgctgttcgattccggcgacgcgagcatcagcgcgcgcggccaggaggtgctgacgcggctgggcagcgtgctggccaaggtggaggacaagtccatccaggtgtcgggccacacggatgactcgcccccgtcgcagaagcttcagagcaccttcccatccaactgggagctgtccgtggcgcgcgcggtgaacgtggtgcgcttcctccaggacaccggcggcgtgcccgcgcgccgactggtggctgcgggctacgggcagatgcggccagtgtccaccaacgcgaccccgctgggccgcgcgcgcaaccggcgcatcgaggtgctcctcatgccggacctgccctccaagcgcacgccgaccgcggccgtccagcgcgcggtcgcgggtggcaccgcgaccaaggcccaggcgaagcccgcgcgcggggcgaagtagccccgcgcctttccgctactgcttctccaccgactccagcagcttgcggaaggacttctccgaagcggccaccgtcttctccgggcccgtcagcttgaagaagacggcgccctgggcgccctcgatgatggcgcccagcagccggaagccgggcttgggcgtcgaggggcccatcatcggcccgccgcccgtgtacgtgcccttcacgtccaccgtcgtcaacgtcatgccgttgaccttctccgccttcgtcttcgacttctcctggggaatgggcttgccgtccgccgtctggaactggcccacccagcgcttcacgttggcgtccaccgcgccgccctggccctgaccgaagtagaagacggccagctccgcgccctccgtgtcgcccttcgccgcgggaatcttgtacgtcgccgcgcgcatcggccgggctccctgcaccgcccagtccgcgggcgccgtccacttcaggccccccgcatcctccgcatgcgccaccacggcaacggccaccaccagcacacccaatagtcggttcatgcgcggcagcgtaaccgccaggggcacactgcgcagcgtgtcaacgaccgcccgtctcacaaccccgcacgcgccatcacaagtgacacgacgcgtcaagtcccttgtcttcctgccaacccagggacgtggtacgccacggacgtttccagtccagtcatccaacccaggacttggagggggttgtacccatgagaaaggtgttgttcctcggggcctttgccctgggcgcctcggcctgtactcccgatatcgcccaggacccgccgcggagccccgaagactccgtcgtcgcggagttcgatccaaccgggtctccacccgtcgtcccgtcgcccaacgacctggccattgtcaacggtctggtcaacgcgcccatcaacccgcaggcgccggcggcggagcaggagttcacgcgcgactacgtgaacacgctcaacggcttcccgaccacggtcaccgcgaccacccgcatccggggcctggaggcgggaacggtcaacacgaacacggtgaagatcatcgacgtgtacgcgggtacgccgctggcgaagccggcgacgcccagctacatcgggtacaacgaggaaaccaacctcgtcaccatcatccccccgctccccggaggctggcccaagggtggccgctacgcggtggccatcatcggcggtgagaacggcgtgaagacgacggccggcaagccggtcatcccgtccgccacgtgggccttcgccagctccgccgagtcgctggtcacctgcgacgacctggcggcgcccaactgccagacgaccaccgagctcatcccctccacggtgacggagcccgccgcccgcctggcggaccagacggccagcgccctgcggctggagcagctgcgccgcggctacgcgcccatcctgaagctggtgtccgagcagttcagcgtgaagcgcgaggacatcgtcctcctgtggaccttctccatcatggaccacccggaggccaccttcgatccgggcaacggcgtcgtccccttccccaatgacctgctgcgcaaccccgaaaccgggctgctggccctgccggagcccaccgaggccggccccgcgcagatgctcatcaagggcctcaacaccctggacggctggtccaccaccgcgcccatcgtgtcggagaacggcgcgaaacgcggccccatcgacacgggttccctgctggacgcgaacaccgtgcgcatgaagatcggcttcacgccggacaccgaggaggagcagaagaccacgctgcgcttcgtcaagctgaccaaccccacctcgggcaccaacccccaggtgaagctgtgcttcaactgcgagcccgtcgtggagggcctgacgccggcgccgaactcgccgcagcagctccagattgtcccggaggtgccgctggacgaggccacccagtatggcgtggtgatgctgcgcggcatgaaggacacgctgggccgcaccgtggcgcccaccgccgcgcaggcgctgatgcgcatggtcaacccgctggtggacgccaacggcaagagccaggtggcggccgttcctgacacgctcgcccgggacctggagcgggcgcgtgtgggcatgaagccgctgttcgacggcctggaggccgcgggcatcgcgcgcaaggacatcaacctggcgtgggccttcaccacccagagcacccgttccatcctcgagcggctgaacgcggcccccacgcaggtgccggtgccggccgaccccgtctacctgctggaccagacggccaccatcaagggcacgatggccggcctgacgctggacaacgacgcggtgggccgcgtcttcatcggcgcgtaccactcgcccttcttcctggatgacgcgcagggcacgctcaaccgcgccacgccgcgcatcgaccgcgtcccgttcatgctcttcacgcccgcgggggcggcgcccgcggacggctacccggtggtcatctacggccatgggctgacgggcaaccgcaccaacatcttgacggtggccaacaacttcaacgcggcgggctacgccgtggcggccatcgacaccgtgttccacggtgagcgcgccagctgcgccggcatcagcgaggacgccccggttgtcgtcgacgagaaccgcgatggcgtccccgagctcaccatcaccacgccggacgcggcctgcgacgacggcgacacctgcgacgtgacggcgggcagccccaccttcggccgctgcgtgtcgaacatccagccggcctgcgacgtggggccgaccgcgtcgccgcacggtgacctgttctgctccagccagggccggggccgctgcgtcgtgaccgagcccgacagcaccaccggcacctgcgagggcggcgacttcgcccgtccgggtcccaatcagccgccgtacgtctccggcgcgggcttcctgaacctggtcaacctgttcgccacccgcgacaacttccgccaccacgtggtggacttcgcccagctggcgcgcgcgctggacaccgacaccctcaacggccgcctggctgccgcgggcgccggtacgctgaacaccagccagttcagctacgtgggccacagcctgggcggcatgcagggcgtcctgtccgcctccgtgtcccccgtcgtgggccgcacagcactcaacgcggtgggcggtgacctggtggacatcctcctgacggccacggactcgacgttcgtgcggtaccgctcgggcttcttcgaaaccctggaaaacagcggccgcgccccgggcacgccggagttctacgagttcatcaccctggcgcgcaccatcctggacccggcctcgccccgcaactacggcaggtacctggagaacgcgccgtccgcgcccgccaaccgcaatgcgttcatccagtacatcgagggtgacatggtcatccccaacgcggtgaccgagggcctcatcagcgcggccaaccgcccgctggtcggcgtctccgagccccgcacggtgcagacgtacctggcggaggacgggatgggcctgccgacgaacgtgcgtcacgcgttcttcggcatcgtggacccgtcgctggaccccagctcggcggccagccagttcctccggtccgtgcgcaacaccgcgcagaaccaggtcatccagttcctgaacacgggcgtcgcgtcgcccaccccgtaacggcctccagagagagaacgaaccaacatgaagaagacactctccctcatcacgttgctcgccgccgggacgacccaggccgcgggcttccaggtcaacacccagagcgcacgctcctcgggcatggccaacgcggcggcggcgtggctggatgactcgtccgccatctactccaacgcggccaacatcctgggcgtggagaagctggacgtcaccgcgggcgtcaccggcatcctccccagcctgcagttcacccccacgggtggctccgtgcaggggcagaagacgacgctgtctccgccgccgcacgtgttcgccgtgtacaaaatcacggactcgctggcggccggcgtgggcttctacacgccgttcggcgcgagcagccggtggaaagacgacttcgtgggccgcttccgcgcccaggagtccgggctgtccatctacaacatcaaccccacggtggcgtaccaggtgcacgaccgcttccgcgtgggcgcgggcctgaacatcacccgcggcacgctggagattaagcgcgcgctgggattcgtcaccagcgaaggccaggtgcacctgggcggcgcgggctggggcctcggcttcaacgccggtgtccaggccgtggtggtccccaagctcgtgacgttgggcgtgcagtaccgcagccccatcagcatgacgttcaagggcgacgcggacttccgggacgtgccgccggccttccagggccgtctgccggacacccgcgtggagggtgacgtcaagctgccgcagtcggtggtggcgggcatcgccgtcacgccgctggaccgcctgacgcttgcgttcgacgccaactgggtgggctggtccagcttcccggagctcgccatcgagttcccggacaacccggccatcaacaacccgctgccgaagaactggcgctcgacgtggaacttccacctgggcggtgagtacggcatcaccgacgcgctgcaggtgcgcgccggcgtgctgtgggacccggcgcccagcccggatgagacgctgacgccggacctgccggacgcgaaccgcttcggcgtgtcggcgggcgtgggctacagcttcggcgcggtgcgcgtcgacgccgcctaccagttcgtcaacctgttcgacaaggacagcacggcgccgggcatgacgggcgtctacaacggcacggcccaggtgttcggcctgacgctcggctactccatgtagtcttccggcaccgtccggacctcaccgcgcccgggtctcctcacggaggcccgggcgttgtgtttccagcgccagcccttcgcgtcagacgcgcaggtctccgtcgtgcagcacccgcccggaggccagcgcctgcgcggtgcgctggagccgctccgtgcccatgcgcatcaactggcccttgaggcctggctggctgagcaggtgcttctggaaggcgtcgcgctccagccgcagcaccacgcccgccacgtccgcgcgcaccgtcgcggacaccggcttgtccagcagcagggagatttcaccgaagacgtcgccctctcgcagcgcggacagcgccacgcgccgtccatgaggctgctccagccacggcgtgcagcgcccacgcagcagcacgtagaaggcgtctcccggctggccctgcgtcatcagcgcctcgcccgcggcaaaggagcgcagctcgaagtcgcgcgacaccgcggccttctgcgcgggcgacagctgattgaagagcgggttgctgcgcagcaggttctccaccatccgccgccggtagaaggcgtccaccaccgccgtcacgtccgggtgccgcgccgccaccgcctccatgtgctggcgcgtgagctccaacagcaccgcgcgctcggtggccaccacggtggcgagcctgggcccctcggagatgagcgccagctccccgaagaagtccccgggcgtcacggtgcccacgctccgccgttggccgtcctccagcgcgcgcaccacgtccgcgcggccctccaccagggcgaacatggaggcgcccggcgtcccctcctccaccaccgtctgccccggaaagaaggcgcgcacctggagcacctcgagcagcgcgacgaaggtctcccggctcacctgcgagaggatgggcagcccggtggcgccatcctccgcgacatgcgcccgggtggcctccacgggcaccgcagcgcccggcggcagggcgaagcgctccgccagcacgcgcgcggtgcgcacgagcgcggcctggggcgcgcccagccggggcaaggccacgcacgcggccaccgcgcgcaagggctgacccgccttcgtccaagccagcgcggcctcctggtacgcggcgacagcatccgcggaacggccgagccactccagcagctccgccaccttctgacgcacctccgcgtcgtccggcccgtccttcaccacgccctggtattccgccagggcctcctccaacctgccctcgctggcgagctggacggcccgctgcctgtccgcgccgtgcacgtgcgccatggccgtctcccctgctacgcgctgagcgcgcgcacgcgctccgcgagcttttccgtgaagaggcggaggatgcgcagcgcggccgcctcgtgcgtgtccaggtagtgctggaagtccacgcgcgtcacccgcaaggcccgcacgtccgtgcgcgcacacacctgcgcggacgtgtctccgtccaggatgagggagacttcgccgatgaaggctccaggccccagcgtgttgagcaaccgggcaccgggctccggaccggcgagcacgtccaccgtcccctccaacagcaccagcagccccgagccgggcgcgcccttctccagcaccgtggccccctgcgcgaactgcaacggccgcgccagttggtagaggtccttcatgtccaccagggacaactcgccgaagagaggaatggccttgaggtattcgtagccgtccggcggcggcggcggcagtggcggcgcgcgggcgggctccaccgacggaccgccattcaggttcaggtggcgcagcagccgcgagtgttccgcctggagcgcgatgtcaccccgaagctccggcgcctggagcgcatccgccagcagcaccaacgcccgccacgactccccctgcgcgtcgagcagcgcgctcatccgcagcaccgcctcacgccgcgccaccgcgatgtccggagacacagcacgcagggactccagctctgcgtgcgggttgcccagctcgcggtacaccgcggcggcctccatgggacggcgcagccgggtgagacagcgggccatggcctcgcgcgcctgcagcgactcgtacagcgacagcgcccgctccagcgcaccgccgcgctcgaaggccgccgccgcccgggccggttcacccgcgcgcagccacgcctccgcggccaggagcagcgcgcccgcctgctcgtggagctgtgcgacgtcggccgcggcgccatccgcct

SEQ ID NO: 975 - DNA, 10276 bp, Myxococcus xanthus
gtctgggcctacgtcgtgttcactgacaaccagccgcccgcggtgcgctccgcggtgatggccacggtggtgctgctggggctcgcgctgtggcggcgcgcggacgggctcaacggactggccgccgcggccgtggtgctggtggcctgggcgccctccagcgtggccgacctgtcgctgcggctgtcgttcctcgccgtactgggactggtgctgctgtcaccgccgctgcggcaggcgctgcccctggccgagcccgacccgtccgaaccccaccgcgtccggcgctggtggggacaggcgcaggagacggtggctcagacgctgtgcgcgagcgcggccgcgacgctgtcgggactccccatcgtcgcggcgaccttcggacgggtgagtatcgcggggctcatctcgaacgtggtcgccctgcccttgtgcgggctgctcacgggcctggccgcgggtggcgccgcgctcttcgtcgtcgcccccgtgctggcgacaccggtgctgtgggccggcgcttgggcgtccgagctgctgctggtcatcacccggctcttcgcggcggcgccgctggcctcggtcgaggtgccgtcactgggcttcctgtcggcgctctacgcggcgggactgctgacgtgggcgctcggcacggggcgctggcggctgggtggtttgttggctcccgcggccgtcgtcgccgccatcctggcaccggtgctcacgccgcagcccgggctccgcgtcacctttctctacgtgggtcagggcgacggcgtggtcgtcagctccggtggtgagcacatgctcgtggatggcggcggcgttccaggcggcatggacaccgcggaacgcttcatcctcccgtacctgaagcacgcgggcatctcccagttggacctcgccgtgctgtcacatccgcatccggaccatgcgctcgggctggcatccgcgttgaaacagattcccacccagcgactgtggatgcccgcgggcgacggagacggcccgctctcgcggcaggtggtggctgcggcggggacggcgctcgtggaggaagtcgaggtgggccatccacccctgcgcctgggcgaggcgaccatcgaagtgctcgggccaccagcgttggagacacgcgacctgctggaaggcgcgaacgaccgaagcgtggtgctccttgtgcgccacggcgacgtcaccgtgctgctcacgggcgacgtggaggcggatggcgaggagtccctggcggaactgttgggtccggtgacggtgatgaaggcccctcaccacggctcacggacgtcctccacggaagccctgctggcacgcacacgcccacggcacgtcgtcttctgcgtgggccggcgcaaccggtacgggttcccccacgacgacgtggaggcgcgataccgggcgctgggaagcgagtgctggagaactgaccagcatggcgccatcaccgtggaaagcgacggccaggacgtccgcctgctcaccttcctgccccacgagccctctccccgggccacaccggttgcgcgggctggggacccatcaccagattggggccgatgattccagaggatatcgacctccagcagctcaccgccgacctgaagaacgcgctcggcccgggagaacccatcgggtacctccgtggcaagtccgtgatgcgcaacctgctcgtggacatgcgcggcttctcgcagttggaggcggaggagctcatcgacacgatggagactcgcggcttcctccgcttcctgggggaccccaccgagcggtccgtcgcggaagcgcactgggacatcagcccccacgcgtgagcacgggcgccccctattcgaacacgagccaaccgaagcgcggcagcgcatggaaatcgccgacgaagaggggcgagaaggactgcccctccaccgtgcggcggtcatggtgctccaaccggtagaggttgaagcgccagcggtcacccggctggggcggaatgtgcgggacttcggccagccggtcgaagggaatctgcatctccaccgaccagccctcgtcacggtccgagtcatcatccaacgtgccccgcaccttcacggcggacgtcatccctgaatcccaggagcggtccatgccctgccgacgggcggggaagtacgcgtcgaagatgacgttgtgcggagacacctggagttcgttgtatgtgcggccatccgcgttcgcgtcgaggaagatttccaccacctcctcctcgtagatggggtcatcgcgcttgcgcagcgtgccccacacgtccgggtcatccaggtcgaaggccacgtagaggaacttgccgtcatggacgagccgcgcctcggtgcgctggcgcgcggcgctcccgtcgaagctccggcgcagcaccaccggtttggactgcttccacgccgcgtcatcgagcacgccgtcgatggtgggcggctggctcacgcgtgggacggagtactcgggcagctcctgcgcggccccgcccaactgaggccccaacatccgctgcgagccgtcatgcgcattggcgtcgtccacgggcagccgggagcctccccgccagaagccgagcatcacgcgcgcgggcgtgcccggcatgggcaccgagtggacgtcctcgatgaccttgcccaccggccatgacgccagcggcgcggcgcccccctgtacctcatggtccgcgttcgtgagcatgccgccactggccgggtccacgacgtggacgaagaaggcgaagccctgcggcggcggacgaaccgctcggaagtaatgggccaacctcacctgcgttccgggcgcggccttctccggtgacaccttggagcccaggtacaccaccgcgccaccggcgaacgtcgcgccgctgcggaacgtgaggtccgcgggcgccgcgtccagggtgcggagctgcgtgggcgcgggaatgcggggcgtctgctgacgcggcccggcatgctcatcacgacaggcggtggcaagacaggtgacggccagcagcggagcgaggacggaggacgggagacgcatcggggccgcgcatcctagcgggcttcgcgtccaatgggttcaccacgaggtgggcgagcaggcaaccatcgagctcctctcgccttgaagtcccggcaattgtcatgccgagcggtggctcccatcttctcgcctcaaccagcggttcaggcccaagggaggcgcgaatgaaaactctactcaaggtgggtgcggtggtgggtgtcctgggagcagggagcgccatggcacaggagcggctggagtcctccgcggacatgcgcggactgacgttcctggtgggcggcggtgtcgagggctacacgagcgcactgggctccgacatcaacccgggccttggctacggcgtgacggtggccatcaagcccacgaaggtgctgggcatcgagctgggctactcgggtgccctcaacgagttcgaccagcgcgtggtgacgggcgcccgaagcggcccggacctggtacgaaacggcgcgcacgtggtggccacgctgggcctgggtgccgcgcccgtgcagccctacgtcctgggcggcgtgggcatcagccggtacaacgtgcgggcacccacggtcgccttcgcggatgacacggcgggcaacatcccgttgggcggcggcctgcgcgtccacatgggcaacttcaccgccgatgcccggctccagtacagcttcctcctggaccagcagttcgcggcgaacgccccgcccggcgacgtcacgattggcgaccggaacttcagcagcggcggcagctacgcgggcaccgtcaacatcggcgcgacctggtagcgacgcggccacctgtgcctgagcatgaagcgagcccggacacctggcctccaccgagcgcgcccccgtcgcagaacaccggcttctgcgaggggtgagcgcgacgcacgcccaccgtcagacggagtagcgtcgggagacgcccctgcattaggacgaggcatgcgccctttcctcacggcggagtggcggtatctcgtcatgctcaactacgaggtggacccggaggtactgcgccccctcgtccctcgtgacacggagctggacacctggcagggccggaccttcgccagcatggtgggcttccgattcctcgacacgcgcgtgcggggactgcccgtgccgttccaccgcaacttcgatgaggtgaacctgcgcttctacgtgcgccacctcggccctgaaggctggcggcgaggcgtggtgttcgtgaaggaaatcgtcccgcgacaagccatcgccaccgtggcgcgcgtgctctacaacgagccgtatgtcgcgctgcccatgcggcacgtcgtggagatggaaggcgcgcacaccggcgcccctggccgcgtcgaatatgcgtggaaggcggggggaaagtggcagcacctggcggcgacgacgctcggtccgccgcaggccagcgagcctggctcggcggcggagttcatcaccgagcactactggggctacaccgcgcaacgggacggcggctgcgcggagtaccgcgtggagcatccccgctggtccgtgtggcaggtggacaccaccgcgctcgagattgacgtggaaggcatgtacggcgcgaggttcgtccccttcctgcgcggcaagcccagctccgccttcgtcgcggacggctcggccgtggccgtgtatcccggcacgcgaacgggctccggtgccagccagtcgccagcctccgagaagccgcgcgccgcctgagcaagctccgcgttgcctccgcgggtgtctcgcgcttcggacggccccatcgccaccgggacgcacatggacggcaagtccgcggaaccctggcctcctgggacggccggcccgttgcttccgggctgtctcatgcgcttcgaattcgaacacctgggctccaccacccccttcgagctctgcgatggcatccacctcctgtgacgcggtccggatgaccacatccgactggagggcctgcccccgagccttctcagcctgcgcatcgaggcacagcggctcatggtcgaggccgcgcgcaccttctccgtcaatggcgtgctggtccctccgggtgtcccgaggctggtgattcccggagaggcgctcggcctgcccgacgacatgggactgcgcgtgcttcaagaggccgtcagtgagcgcgggctgggcaccgtggcgctcctcaagggattgctgacgggaacggatgaaccggccccatcgcgcgcggccaccctcacctgcctcacgggactggatgtcgggcgcgtccatgcgctcgccgaggaacagacggacatcggccgaggcagcgacgtggcgatgcggctgagagaccgggccgtgtccaggacgcatgcgcgcgtcctccacggcgagggaggattctccctggaggacctgggcagccccaacggcgtcttcctcaacggccagcgcgtcgactcccgggttccgttggcggatggcgacgtcattgaaatgggccgttcactgctccgcttccaggccgccgtggaagagcccccgccccccgcctcgcctgctggcgagcaggaaccgccctctggcgcggtcagccccgcttccaccgaggtcacgctggagcccacgcccgaggcacctcccagcgtgcccaagcctcgcggcgaatggtggctgattggactgggcgcggtggcggcctccgtgggcgtggccgtcacgtggctgctcgcgacgggaagctgacgcgaggctcagcctggaatgggccccagccccgcgcgctccacgaggagccgcgcgagctgctgatggtgcatgaagaagctggtgaagtggacgaggcccgccttgccccggatggcgtagacagtcaccggtccgggcaggacatcgagcttgcggatgtccgcgaaggtgaagcgccgcgtccgcaccatgcctcggtaggtcaagccccgggcatccacgacgatgtgcgtgcgcccgtagtacatgagcgacacggcgaagaagaggacgaaaaagcccgctgagaggaaggtcttgagcgggacctcatcgaagaatcggaggaggtacaccagcacggcaacccagaggagacccgcggcggccatggccgctgcgaggacccgtcggggtctgaagacctgccgtccgttcggttccgcgtcgcgcccggtcattcatggaagctaatgcttggggctgacacggtccaccgacccgcaggcttcctgcctgccggtcaacgcaggcgcgccgccttctgtcgggattcctcctggagctgggggcggacgtccgcggaggaggaggcagcatagcgctcgtagaggtcgcgtgcctccagcgtgcggcccatggcgcggaaagattcggccagtccgtaaagcggagacgccgagccgggctccagctccaaggcgtactgatagtccgccgcggcttccgagtagcgacacacgctgatgttggcgctgcctcgagcgacgaaggccacggtcagcatgggctcgagttggatggactgggtgaggctggtcagagcgccactgaagtccttgctgccgatgcgctgtacgccctgatcatacgcccggcgcgccaacgcgcgcgtcgtgtcggacacggggccggagcccggtgcctgtcccgcggcctggggagaaacgcccgcctgcaccatcttcgcccgcgcgcggtcgatgttctccttcgcgctctgctggatggccgcgtccttcgtgagcgcggtggcccgctcccactgcgccaccgcctgtccgtaatagcccagcaccgccaaggcgttgcccagcttgaacaaggcctccacatggcccccatccgcgtgggacgcatccaggaaggcgaaggccgcctcgcggtagcggcgctccttcatcaaggcgtcgccgtcacggatgcgcgacgccgccagcgccggattggacgtcacggattccgcggcgggcgccgccgagggcgtcgcagaggccggcgcggtggccaccgcgagcggctcggcacccatggccttcaggtgctcggtcgccttgcggacccagacctgctcccccttgcgctgctcacgggcgatgtacgcctggtacgcgggaatcgccttgtccttctggccgagctgccggtaactctcccccaacccgtagaacccgtccgcgtcgccgggctcgagctcggtgtagcgctcgtaggcctgtgccgcggtggccgcatcccccgtcttccgcgcggcatagcccaggttgaaccaggccatcttgaagccggggtcggccttcgcggcgtcacgaaagagcgtgagcgcctcctgcacctgccccttgcggaagagcacgctgcccaggccattgagggcggagggatagccgggcgtgtcggccagggcctcgcggtaggcggtggccgcgtcatcccagcggccacgtgccagcgccgactccccgcgcacgaaggcggcccgggccgcggcggatggctccgcagcccccagcagcattgccgcggacagcgcgatgacgaagctgcgcaagacgaccatgacggctcccggggtatcgatccggaagccgtagcagaaaaaccagggccgcgtcagcacgcccgcgagcgacgccagcccttcgcctccgctcagctccggaacgggttctggagcagcaccgtctcaccgcggtcagcgcccacggagacgcacaccacggggacgccgctgacctcctccacccggcgcacgtagcgcttggcgttctccggcagctcgtcgaaggtccgcacgccggcgatctgctcgtcccagccctggagcgtctcgtagatgggcttgacgcgcgccaggtcctcgtagtcgccgggcagctccatcaccttctggccgtccagctcgtacgcggtgcagatctgcagcgtcttgaggccgctgagcacgtccagcttggtgagggccatgccccacaggccattgacgcgcgaggcgtagcgcagcaccacgccgtccagccacccgcagcgacggggccgacccgtggtcgtgccgaactcgtcgcccatcttgcgcaactggtcgccgatggcgtcgtgcagctccgtggggaacggaccgccgcccacgcgcgtggtgtaggccttgctgatgcccatcaccttgtcgatggccgtgggccccaggcccgagcccaccgccgcgttgcccgccacgcagttggaggacgtcacgaagggataggtgccgtggtccacgtccagcagcgtgccctgcgcgccctcgaagaggatgcgggcgccgcggcgcacctgaccggacagatagagcgaggcgtcgtggacgaagggcttgagccgctcgcccaggccggtgaactccgccagtatctgcggcacctcgagctgcggcaccgggtcgcccgcctgcgcgcacaggtccttcagctcgtccagcgccgccggcagccgggcctcgatgcgcgtgcgcagccggtccgcgttgagcaggtcccgcacgcggatgccgcgacgggccaccttgtcctcgtacgcggggccaatgccccggcccgtggtgccaatggcgctgccgccgcgcgccttctcgcggaagctgtccagcagcttgtgccacgggaagatgacgtgggcattgtcggagatgaggagctgcgcgtcgtccttgaggaagccgcgcaccttcagcgcgtcaatctccccgacgaggacggcaggatccaccaccactccgttgccaatcacacacgtcttcccagggtggaggatacccgagggaatcaggtggaggactgtcttctgcccacccaccaccagcgtgtggcccgcgttgttgccgccctggaagcggacgacgacctgggcgtgctcggtgagcaggtcaacgaccttgcccttcccctcatctccccactgcgctccgatgacgacgacgttcggcatggtgctcgccgcttagcacgcgcggggggccgggtgacagtgttccgcgaagccacaatgcagggcttggcaggctgccttctccctcccatcccattcacccctcgcttcgccgcgtgccactgcccgtgctgcccccgcgagccgcccggcggcctcctccaggcccctgggcccggacagccactcaggctctggctgggactctttcaggaagacgactcccacccgcaccggcaccccttctcgcaccatccgccgggccaccagccccagggccgccagctcgtaggtgtacgcggccgctcccagcggatgacgcccgccgtgtttgaaggccaccaccacggcctccccttggggtgactcccacagcaggtccaccgccccctcgacccccacctcgccctccagggcaagcatgaacggaaggcttcggtgaattgtctgtgacggcgcccgcgccagttcacgtgcgaacgccgacgtcaggaagcgctccaaggtgttcagcaccgcatccatgccctcttcgtccggaagcgcgcccgcgtcacgcagcagcgtctccaggtgggcccgccgctccgaagcgtctacatccggcgccgccaatcggaggtcgacgccgcgaagcagccgctgcaccaggtcctcgggacgctcggcgggaagccagccgtcaggctccaccaggggcggcgcgccacggggcagcacttcccagggccacggcgcaccgcgaagccccagccggtgcacgtagtggaagcggcgcggacaggcgatgaagtcctgcaacgcctccgcggaagccaccgcggcgcccagtgattccgcttgcgcgacacgctgacctcgcacccgcagcagcgcggcttcgacgcgcgcctcggcgagcaacagggcctcaggaccgggcggctccgggtccgccggtggagggagcgtgtcgacgtccagctcatcgaccaggtcacgcaggtccgcgtccacctccaggcgcccgtcgatgaggtgccaccaggagtccttgccaccgcgtggctccgcgccgcccgccagcaccaacatgtccttggcacgcgtgagcgcgacgtagagcaggcggcggtactcggcgtcctcgcgcgccttcagctccgcgcgcaccgcgtcgaagcggctggaggtgtagtcgtccagcgaatccggaacccacggtcgcagggagatgccatgcgtgcgctcgaagtgggcacggcccgaggtgccacgcctccggccgcccatcgagggcaccaccaccaccg

SEQ ID NO: 976 - DNA, 10216 bp, Myxococcus xanthus
atgtgggtaaggcctgcttcgcgatgttggcgacggccgcaaaacccgacggatccgcgatggccatgtcggacagaaccttgcggtccaggccgatcttcgccttcgcgaggcccgcgatcagcttcgaataggagaggcccaccgtgcgggcggccgcgttgatgcggacgatccacaggcgacggaagtcccgcttgcgctgcatgcggtcgcggctggcgtagtccagcgcccgctcaaccgcctcgttggcgcgcttgtagcagttcttccgacggccgcggtaacccttggccagcttcaaaatcctattacgacgacgacgggccttgacacccttcttcacgcgcatgactgcctcacttcggactgcgtagtttggaagccccccggcgcaggcttaccgccgctccgacgaggccacgttgtccctgacttcagaaccgcgaaatcagcccccgtaggggaacatctccttgatgaccttcttcgcgtccatgtcgcgaaggtggccggtcccgcggttgctgcgcttggacttcggcgtcttcgagaacgtgaagaggtgcttcgcgaaggccttgccgtgcttgaccttgccgctcttcttcacgtcaaagcgcttcttcgcgctgctgcgggtcttcaacttcggcatcgtcctgatccttccatgccccgtgccgttggacttgagcggcaggtgcgagaactctcgaaaattggggaacttgggcaggctcccctcgaaagtgcgcaaagatacttaggtgcaacagggagtcaaggcccgtcagcaagccaacaggcgtcctgaactcccgatcacggcagggccgcttccttcgccagcagggcctcgaagtccgtcaccttcatcgtcttgaggtcctcgccgccataccgccgcggcgacacgccctcgcccgacacctcgttgtcgcccaccaccagggtgaacggcaccttctggagctgggcttcgcggatcttcgcgttcatcgacaggccgcgctcgtcgaactccacccggtagcccttcgccctcaaggagtcccgaaccttccgagcgtagtcgttctgccggtccgccaccgtcaccagcaccgcctggatgggggccagccaggccgggaaggcgccggcgaagtgctcgatgaggatggccgtgaagcgctcgaacgagccgaagatggcgcggtggagcaccacggggcggtgctcggcgttgtcctcgcccacgtaggtcaggtcgaagcgctcgggcgccaggtagtccagctgcatggtgcccagctgccaccggcggccgatgctgtccgacaccgcgaagtcgatcttcgggccgtagaacgcgccgtcacccggggccagctcgtactcgaggcccagcgactccagcgcggccttgaggccgccctcggcgcgatcccacagggagtcatcgcccaggcgctgctcgggccgcgtggatagcttcaccgcgtaggtgaggcccaccgccttgtagacgtggtccaggagcttcacgaagcgccgcacctcgtcggtgatctgcgcctccgtgcagtagatgtgcgcgtcgtcctgcgcgaactggcgcacgcgcgtgaggccgcccagggagcccgccgcctcgttgcggtgcagcacgtcctgcgtgtggtagcgcagcggcaggtcgcggtagctgtgcttcttgaagccgtagaacaggtggtgcgacgggcagttcatcggcttgagcgagaagtcatgctcccccgactcgctgtcgagcacgaggaacatgttctccttgtacttgccccagtggccgctggtctcccacagccccttgttgaacatcaggggcgtcttgatctccacgtagccgtcgttctgcgtcagctgacgcatccagttcgacagcgtggtgtagagcgtggtgcccttcggggtccagaaggcggagcccggcgagtacgggtggaagtggaagaggtccagctccttgcccagcttgcggtggtcgcgcttcttcgactcctcgatgcgcgtcaggtactccgccagttgcttcttgtcgaagaaggcagtgccgtagacgcgctggagcatcgggttgcggtggtcccccctccagtacgctccgctggaggagaggatcttgatgatgccgatcttccccgtgctgggcgcgtggggccccaggcagaagtccacccagtcaccgtgcgtgtagagcgtcagcgtcttggcgcccttggccgcgatgtccttgacgatctcgaccttgaacttctcgcccttctcctcgaacaggcgcacggcctcgtccatggagatttcggtgcggacgaaggccatgtcccgcttcagctcggcgttcgcctctgcctcgatcttctccaggtcctcgggcgtgaagggcttctcgcggaagaaatcgtaatagaagccctcctccgtcgcgggaccgatggtcacctgcgtgcccgggaagagcttctgcaccgcgctggccaccacgtgggcggcgtcgtggcggatcaactccagggactcggggctcttgggcgtgaagatctgcagcttcacgtcctcgtccagcttgcgggccaggtccatgtcctggccattcacgcgcgcgaagagggcggccttcgccaggccggggccgatgctctcccgcacgaagtccgcgatcgtggtcccccgggccgtctgcttctgcgagccgtcggggagcgtcaccgtgatgatgtcggacatgcgaacctcggaaaaaaaacgggcggcaggctcttttaaagccgtgccgcccgctgaagtcactctttgatgatgggtcgtagtgggatcgaaccactgacccctaccgtgtcaaggtagtgctctaccgctgagctaacgacccgttgcagccgcttcggtggcgcggggaataacagcgggctcccccaactgtcaagcaaacacagaagggttcttcaactcttcccgcgcgccttcggatccgccgtttccagcagcgtgtggacccgggacatgacggcgtcgaacatcgccggggtcagccgccccgtctgcgtgttctgctggctgacgtggtagcagcccagcagcgtccggccgcccggcaggcgcagctccgccccatgcccgaacgcgggccgaggcgacggtacctccatcccctgccgcgccagggccacgagcgcggcgttccagccgatggcccccagcgcgagcatcacccggcccggcagcagcgccagctcgcgatccaggaacggtgcgcagcgggccagctcctctgggaggggcttgttgtcgggcggagcacagcgcgccgccgacacgatgaaggcgtccttcagccggagcccgtcatcccggtgctcgctgagggcctgattcgcgaagcccgcgcggtgcaacccggcatagaggaagtcgcccgagcggtctccggtgaacatccgccccgtccggttcgccccatgggccgccggcgccagcccgacgatgatgagccgggccttggggtctccaaagccgggaacgggcaatccccagtaattccagtcgcggtaggcgcggcgctttactcgcgccacctcctcccgccactccaccagccggggacaggcccggcagtcggtgatctccttgtgtagcgactccagcttcgtcacggcgacttgggctcccccgtgtagagccgcgtccggcggtagcgctccaccaccacgctcaggaccaccttgaggatggccgccaccggcaccgccagcaggatgcccacgaagccgaacagctcaccgaaggcgaggatggccaggatgatcgccaccggcgccagcccgaccttctcccccacgattcgcggggtgatgacgaagccctccagcatctgcccgatgacgaaggtggccgccaccgccgccagttgccacggcccctgccacgacagcatgagccccaccagcgacagcacgatgcccacgcccgtgcccaggtacggcaccatgttgccgaagccggcaatcaccccaatgacaatggccatgtcgatgcgcgccgcggacaggcccgccgcatagatgaccgacagcacgccgccgacgatgagttggccgcgcacgaaggcggagagcacctcatccacctccgcgaagcgccggctcaccagtcccactgcgcgccggggcagcaggtccttcaccatgcccatcagccgggggtagtcctgcaggaagaagaaggccagcaccggcaccaccgacaggcccagcaacgtcaccaccagccgcgccgtgttgcccgcgaagctcgccaggatgcgcgccgccgccggccccgcgctctggaccagctctgacgcctgctttcccagctcggtggtgcgctggcgtaccaggtccggcaacgaatgccccaccaacccttccaccttcggcaccacctgggtgctcgcgcggtggaagaagtccggcagcttcgacgcctcctcccggaacaccgggatgaggtacagcaccgcgccgaccagcatcagcgtccccaccgcgaagacgagcgtcgtcccccacgtgcggtccagccgccgcttctccaactcggtgacgatgggattgaagatgtacgcgcccgacagtgcgagcagcactggcaccgccactccgccaaagacggagagcagcgcgaacaccagccccagcgagcccaccatcacccccgaccaccacaggtcgatgcgccgggcgtccgtctcggacagggcattctcggccaccgccacgggctcggcgacccgcgcacgggccggctcggccgcggccttgtcctggccacgcggcggcggcacctcgtgaagcaagggggcggaccgagccggcggcggtaccgcagcggcggcgggtttcacggcggcgggggaacgacctttgctgcagcgtgcgatggcgctctcctctgcagtcccagctacggcggcgtcatgtcctgattgcacttcacgaaagcacaagaaacgggctttcgtggaggcccgcccgctttacacccagcccggcgtcactccgaaccaccggccttcggcccagaggcgcggagctggatggtcagccgcgcgcgggcccggctgggctcgaagtacgtcgtatagggccagtacccctgcttcttcacttcaatctcgtgcaggccgctgcccactcgcagcgccttgggggaacccgagaagtcgctgcagagcccctgccagacgccatctagatacacctccgcgtccacgggctcgcagagcagtgccaggttgccgctgggattctgggcttccgccatcagctcgcgggccttgagcagggactcgggctcctgacgcttcgcacacccagcgaacgtggacaccatcaccaacagcagaaccttccgcatcagctggccgaggacctcgaagtcactgcgtgacgatcacgacccggccctcggccaggaagcgcgtgttggcctcgacgagcgccttcgcatcctccgaggcgagcaccaggtcggaacctttggaacccttggccttcaccaccaggggcttgtcccccaccagcgaggccttcttcgccgcatccaggctctggaaccaggcggccacggccgtcgcggcacggcgctcgctggccagcgccgccgcgccgtagagcgccttgccgctgtcatccaagaggcggggcgccagcacgggctgcacaccgagccctcgcgcatctaccaccaggcctgtgtacttcttcgcgcccgcgccgttgatggcgatgacggtgtccgcggcgggcggcgcgaacagcgacgcggtgagggccgacagcggcacctccacgtcaatctccacgccactgtcggagaagaaccgccgggcgacgaccttgtagccgcccatcgcggcctccactcgcttgcggacgtcgtcgcgggccagctcgtccgccacggtgcgccccgcgctgatgtggaggcgcccggcctggtccatgagattctggacggcggatcgcttggcgatccgctcggcccctagccgggcctgtccggggttggaggccttcaggtcgggagcacccactcccgtggcccgcagaacctgcccttcccaattgacgcccggtgcccccggtgccgttttctcggcggcgacggtgggcttcggggccttcgcttccttgccctggccgaacgcggtcagtggcacggccagcaatatcccccacagcgagtgcctcacgggaaatcctccagcccctcgtccgacgtcgcgggtcgtgtcagggcagaatggcttcccattcaacgggcctgcttccggggaagtcaaggcaggcccctgcggcacggcgggtatgcgtcagttctcgttgccgtgacggtcgacgtaggcgtcgatcatcttgcggtgacgatcggtgagcaacgtgaagcgcacacccgagcgctcgcgcttggcccccagctcggcccactcacggaccacttcaccctcggcgtagatgatctcctccgagcccgggagctggaactggaggccgatgcgcttggcctcgtgctgaggctcgagcagccgggcgaggctcagcccttcctggctgatgtccgcggcccgcgacatgtacggcacgccacccatgtacttgttcaggtagatgtcgaggggcgcccgcttgttcttccgcttgtcgctcatggcttcttcgcctccggtcaggtggtgcaacaggttgctccgggggtgaagcaacctggatgcagggtagaggcgcgcgccgaacgcgcaagaaaacggacggcgcgcggaggactcgcgcgcttgctgtgcttcctcgatgaattcttcgcgcgggcttgtgtctttcgagcacgcggccgcgctctatagtgcgccggttctcatgaaaggtggatgcatgcgatcgatgtggacggcggccctggtgttcgcgctcggcgcgacgggcgcccaggcgcaggactcgaagtcggcgaagaagcccgcggccaaggccgcaccggcgactccggccgccgcgccggcggcgcccgctgcgctgtccgaggaggaccagcagaccctctacacgctcggtctctccattggccgtgatttgtccctcttcgcgctgtcgcccgaggagttgaaggtgctgcaacagggcctgtccgacggactcggtggaaagacgtccgacatcgacccgaaggagcaggctcagcggattcaggccttcgccaagagccggcaggcccttgcgggcaaggccgcgctggagcgcgccgccaaggagcccggcgcggaggtgcttccctccggcgtcatctacaagcaggtccaggcgggaaccggccgcagcccgcgcgccgtcgacaccgtcaaggtccactacgagggccggctggtggacggcaccatcttcgacacctccgcccgccgtggaatccccgtcgagttcccgctcaacggcgtcatcccctgctggacgcagggcgtggcgaagatgaaggtgggcggcaaggcgaagctcacctgccctggcaacaccgcctacggtgagcggccgccctctggctcgcgcatcccgcccaacgccgtcctcaccttcgacgtcgagctcatcgacatccccggcgacacgtcccggcagccgtaggtcagcgactcagggcggcctcggcggcgcggatcagcggctccgcgctcaccggggccccggtcgcatgaatcatccactggtccggcgtcaccgagccgtaggtggccatgcgttcgaactcggcgcccagcggtcccttgcgcttcaggtgctcttcaatctggaacgcgatgaggtggcccagcggataatcgggcaggtagagcggatagctgatcatgtggctgtagacggccagcagcgtgctcccctccccgcccagcaccggcgcgaagtactggttccacacctcgcgggcaatgcccaccaccgcctcgcgaagctgcacgggcgtggcatccgggtgcgcgtacatccagtgccacaccgacatgtccaccagcgcgatgcccgcgcgctcccacgtctgccacagctcgccgagcacccgctcccgctcgctcgccgcgtccggcttgcccagtccgagcaactccaggtcgcgagactggaacacgaaggccagcgcctccgtgaaggcgttgttgggcacccccgcgagcagcgtgtggtccacgccgtagaggctgaacacctgctccacgttgtgccccagctcgtgcaccgcgatgttgtagcccttgtagtccatgccccccttctccacgcgcgtgcgcagccgggggaagtcgcctcgccgaagcgccggctgtgcgtgccccgctccgcgcgacgcgtccacgcgaattcgctccgccagccacgcggccttcgccttcgtgaagcccatgccctggaggatgcgcggcaggtccttcgcgaacgcctccgccgtggggtagcgcttgcgcgtcagcgcatccagttcggactccttccgcttgccgcccggattgaagcccgagtaccagaggtcctgcggctccagcttccggcccaggcgcgcttcaatctccttcgccacgcgcggcaccagcggtgactccagcacctgtgtcagcaaggcccggacgcgcgcctcaggcagctcgcggcccagctcgaagctccgggcgattcgcgtgggtgccaccggcacgtaggggtccgcctgacgcgccgcatggaaggtggccagcaggtgcgtgtagcgcgtgtccggctccggcgacgcatccggcttcgtcgtgcgcgcgggagcatccgcctccaccgtctgcggcggcgccaccgtgacggtgttggtgaaggggtcccaatccaaccgcgggttgtcgatgacggccgcgggaatcgtctgcgtgatgatgcgctccatcacctggacgatcatccgctgcttcagcgcgcccgtcgccgcgtcggagtagtcacccttcagctcgtcacgcaggttccagtggctgatgagccgcagcccctttgggaaggggcgccgtccctgcgcatccaccaggtgatgcatccagatgttgtattcggcgatgtacaggttggccgcggcgatggcgcgcgaggacgcctgttcaatctccgcggggacgcgctggttgaagcgcccggccagccgcgtctcggcccactgccgccgcgtccatgacggcccctgctccacgcgctccgccaacgtggtgagcgggaagttgagcaacaccacgaaccccacgcgtgcgcggaacaggtccgtggtgacgtgggcggccggatcatacgccgccaccaggggctccaccggcagcaatggccccaggtccaaatccgtgtaccactgaagctcgcgcccgatttcgtacaggtgcccgtcgagctgctcgaacaaccgctccagccgctggaaggtcgcgtcgagcgcgttcggatcggacaggaactgttcacgtgcgaacgccgcgaggtctccgtcctccggccgccacatcgccgccacctgctccacgccccgctcaatgcgggcccgctgcgcctcgccgtgccgcgtcacgagctccgccttcagggccgccgcgtcgaacgtggacgtcatggcggtgggctccttctccgggacgttggcagggagtggtgccttggacgacgcggcagggagggcggccgggcccgtgctcgacggcacgactggtgtggtggagcaacccagcgcggcgagaacgggcaacagacagacgcgtgagcggcggaacttcgtcgacaaaggcacggagcgctctccagaaagcacgaagggcccgaccccgtggggccggaccctcatgatgcaagaagcagttcgaacgacgctcggctcaggccgcgcggacgttctgcgcctgcaggcccttggggccacgggtcacttcgaactccaccttctgaccctcctgcagggtgcggaagccatccatgttgatggccgtgtggtggcagaacacgtcctcaccaccaccgtcctgcgtgaggaaaccgaaacccttcgcatcgttgaaccacttcacggtaccagtagccatttgctctcttcttctttcgtcacggacgcgaatatccgccgtccggtcctacgagcgaacccgcctagacggctgcaatttaagcgt

SEQ ID NO: 977 - DNA, 10178 bp, Myxococcus xanthus
aggccctttgttggcccccgcggggcgctcgcgcaagggcacctacctggacatcttcgcggcggcggcgcgcgcgggaatctcgcgggccatcgtcgacgggaagctcgcgtccacggatgacccgccgcgcctggcgaagacacgtgagcacgacatcgacctcgtcatgtacgagggcaagctgtcgaagctggagcgcgacgtcttcgagaaggcgctgggctggggccagggcgcggtgaaggtggacgccggcaagggcgagacgctgctgtccaccgagcgcacctgtcccaagtgcggcaccgccgtgccggagctggacccgcgctggttctccttcaacacgaagcagggccgctgcgagtcgtgcgagggcaccggcatccagggcggcgccgaggcgatggccgagggcgaagtcgcgccgtgtcgcacgtgcggtggcagccggctggcccccgtcccccggggcgtgcggctggagggcgcgcgctaccatgaggtggtgcagcagtccgtggcgtccacgctgacgcgggtgcgcggttggaagttcaagggggaccgggcgctcctgggcgagccgtcccgccaggagctgctgcgccgcatggaattcctggagcgcgtgggcctgggctacctgtccctggaccgcaacgcggccacgctgtcgggcggggagatgcagcggctgcgcctgtccgcgcaactgggcgcgggcctcaccggcgccatgtacgtgctggacgagcccaccatcggcctgcacccgcgcgacacgcaccggctgctggacaacctgcgcgccctggtggccacgggctccacggtgctggtggtggagcatgactcggacaccatccgcgcggcggaccatctgctggatttggggcccacgggcggccggggtggcgggcacatcctggcggaggggccgccggacgtggtgctggagagtgattcgcccaccgcgcgggccttgaaggagtcgcaggtgcggcctccctcgggtcggggcgaggcgaagcagtggattgagctcaagggcgcgcgggccaacaacctgaagcgcgtggacctgcggctgccggtggggcggctcaacgtggtgtccggcgtgtcgggctccgggaagagcacgctgattcgccaggtgctgtacccggcgctgcgcgagaagctggaccgcgtcacggcgaagcccggccccttcacctcgctgcacggggcggaggcggtgaagcgcgtgctgtcggtggaccagtcacccatcggccgcacgccgcgttcggtgccggcgacgttcctgggcatctgggacgagctgcgccgcgtgttcgcggccacgcccgaggcgaaaatcaagggcttcacgcccacgcgcttctccttcaactcggacagtggcggccggtgcaccgcgtgcgacgggcagggcgccatctcccatgagatgtccttcctcccggacgtggtgacgccgtgcgaggcctgcaacggcgcgcgcttcgacgcggccacgctggaggtgcgctaccacgggctcaccattggcgacgtgctgcgcctgtccgccgacgaggccaaggatgtcttcaaggcgctgccccgcgtggccgcgccgctggagtgtctggccgacctgggcgtgggctacctccaactcggccagggttccaacaccctgtccgggggtgaggcccagcgcttgaaactggcggccgagctgacggcctctgcccggcacgaacccacgctgtacgtgctggacgagcccaccaccggcctgcacctgggcgacgtggagaagctcatcaccttcatgggccggctggtggaccgcggcgacacgttggtggtcatcgagcaccacccgtccgtgattggcgcagcggaccacgtggtggagctggggcccgatggtggcgaggcgggaggccacatcgtcgcggagggcacgccccgcgaggtggcgaagcagaagacgcctaccggccgggtgctcaagtcgctcttttcggatgaggacacacgctcgcgtgccgcggcgcggcgggcgtgaaacgggcgggggactggggcatcctggggagcggtatgaaaaccctccccttgttgaccctggcctcggcgctggccttcaccccggcgctcgccgcggcgccgaagcctcctccccccgcgaagtccgaacccacgagcgagaagaagcccatgtccttccatcacctctccgccaaccggctcgacggcaagccggagacgctgtccggctaccagggcaaggtcgtcctggtggtgaacaccgcgtcggaatgtggctacacgccgcagtacgcgggcttggagaagctccaccaggaatacaaggacaagggcctggtggtggtgggcttcccgtccaacgactttggcggccaggagccgggctcgtcggaggagatcaagaagttctgtgagctccgctacaaggtcaccttccccatgttcgagaaggtgaagacgaagggggacggccagtcgcccgtctacgcgttcctgtcgcagcaccaccccgcgcccaagtggaatttccacaagtacgtggtgggcaaggacggccaggtgaaggccggcttccccagtgcggtgacgccggacagcgcggagctgaaggcggccatcgacagcgcgctcgcgcagccatagcccctgagagggcgcgtgggggctggccctctggtccccgccctggaggcatgcggccctggctggcgccctggcatgggcgccggtgggggctcaccctgaatgccgactcggcttgaagggaggccccatggacacccgggacacggcgtggccgccgctgccgctggaggcgtggcaggacacctacgccacgttgcaccggtacacgcaggtcgtcggcaaggtgaagctggcgctgacgccgccgcagaaccactggtggaacgtcgcgttccgcgtgacggcgcggggcatgacgacggggctcattcccttcggaaatggcgccttcgaggtggacttcgacttcctctcgcacgagctgcacgtgcacgccacccgtggaccgtcccgggtgatggcgctggagccccggcccgtcgcggagttctaccgggacttcatggcgacgctgcgctccatgggcatcgacgtgcgcatctgggagcagcccgtcgagattcccgacgacaccacgcccttcggtaaggactggcaccacgccagctatgacggtgaagccgtggagcgctggtggcgggcgctgcttcaggccacgctcgtcttcgaggacttccgcgcgcgcttcaccggcaagtgcagcccggtgcacttcttctgggggagcttcgacctggcggtgacgcgcttctccggccggcccgcgcctgcgcgcatcggggcggaccccatcacccaggaggcttactgcgaggaggtcagcagcgcgggcttctggcccggcatgcaggccaccggcggcgcggccttctacagctatgcggccccggagccggagggcttcgcgcgcgccagcgtgcgcccggcccaggcccggtacgacgccaacatcaaggaatacctgttggcgtacgacgacgtgcggcgcgcggaggacccgaaggcgtacctgctcgacttcctccagagcacctacgaggcctgcgcggacctgggcggctgggagcgggagcgcctggagcggccgctcatcgtccccgagtccctgcgcgcggcccgcgccgtggaggagggaacggtcgccgagcagcccgcgccgtgaagcccggcctcgcggaggcccgtcgccgcgaggccggtgcgtgcgaagggccctcgtcacttcgccttgggcgggaagcgctccagcacctccttcacggactcgtccagccgccgctgctgcttctccgcgctggcattctcgtccagctccgcctgggccgtgccgcgccagacgagctgcctggactgcgggtcgacgatgtcgaggatgagcgaaccctcctcgtactcacgcagctccgtctccggcatggtgacggcgccgcccgcgaagaaggggtccgtgaagggaccgccccagggatagccgtagtaggcgtccaccgtctccgccttcagcgcattgtggatggcgccgtgccagccgatgaggaagtccgggttggcagtggactccaccttctggtagccgcgcgactgcaggtagcggtccactgactgctcgacgcgcgcgccgacgatggggttgtagacgcggtcgtccttgcccgtgggctgtgggagccaggcataggtgcggtacccctccagcttctgcgtggcggtggggtcatagttggtgttcacgtcgatgctggagcacgcggcgacagcgagcgccagcagcggtggggcgattcgggtcagcagccgcaaggaagcctcctcggtggcggcgcggtgcgcgccgttgcccccctgacggtagccacggcatgacgaggccccctcgggctggatgcccggtcctccccggcctcggtgctaatccttcccgggttcccgcttcatcttctggcggccctcgctgcgcgccagggcgagcgcgagccgggcgcgcttctcctgggggagtgacttcgccagcgccaggtacagctccttgtcgagcgccgcgatgcgctcgcgtgcctcgaaggcacccagcgccgccgcgtccacctgcgccagggcctcactgtcacctcgcgccgcccggtggaggatgcgcgccgcttcacgcacctgcttgcgcagtgggcggcggcgctcgtcgaagcgctgtagcgtctcctccagcttcagcgcctgcgcgttgtccaggtccaggacgtccgacagctccagcacctgccgcagccgatgccgctgctccgcgcgctccatccgctcctcgacgcgggcctcgcgcccggtgggcgcggccaccgccacccagggcagcagggccagcatcatcaccgccatccgcgttcgcaccctcgtcctcacagcgtctctcccacatcgatgtcgaactcttcgtcccagccctgggagtcctcgaacagcaccgcgtccagcggctccagtcccgcccaggcctcgatggcggccatcgtctccgcgtccagttcctcgacgtcggtggcgggcgccgccgtcgccgtcaccggcgccttcagtcccaggcctggcacccgccacgcgccgggcacgagcagtaccaacgtcaccgccgcgacggtggccaccagcgcgcccagcgtcttcaagcccagaccctggcgccgtgcgccgcggcgccactccgacagcgtgcgccggggcagctcctggagctccgtcttctcctggggtgacagcgcgggcagcgccaccagcgagagcagctccttggaggccgcgagcgcctgccggcacccctcgcagccctccaggtgctggatgagtccaagcgcctcgtcatcctccaacgcccccgcggcatgcaggtccagccgctcttcctggtcagggcacgcagccatcagtgcttctcctcgggcgcgcccacccgcgccttgaggcgcttcatcgcatggtggaactgcaccttcgcattgttctccgtgatgccgagcgtctcggcgatgtccttgaatgccagcccgccgtccacgcgcagcgtcagcacctcgcgctggcggcggggcagggcgagcacctcggcgcgaacctgccgctcgcgctcggctcgctccagccggtcctgagcggactccgacgggtcctccaccacgtcatccggcccggaggccaccagcaccgggcgccaccgctgcacctgacgggcgtggttcttcgccaggttgagggcgatgcgcaccaaccaggcccggaagggcgccggtcccgacggcgtgaagcgcgcgaagacgcggcgcgaggcctccaacgcgcgcaggaaggcgctctgcaccaggtccgccgcgtcctccgggcgcgtcacgtagcggcgcaccagcgagaaaacgagcgagcggtgccgcgtcaccagcacctcgaaggccgccggatcgccctccaggaatgcgcggcagagcgcctcgtccggcgcacgctccaggcccgcccgggccatgcgcgccggcagggacaccacctggccgcctgtctccctgatgctcacgtggctccaaccccggacggagataaagattaatttcggccgatttctgtcagcaatttctggttgttcgtgaattgcaagatattgagccaggaaacatgccttcccgagttgatggcgagcaggccgcgcggggacaatgggtgggcggttgttacctgggacgggggcatgttgacccaaggaactggctcacgcatcaagggcggcgtgctcatttcgcggctcaacatgctgcgccagcacggtgggcaggccggggtggacgcggtgctgcggcggctgccggcggaggaccaggcgctgctgaggcagatgctgcttcccgtcggctggtatcccctggagctgaaccttcggttggacgcggccatcgcgggggtgatgtcgcccgaggacaaggaccgggccttcctggagatggggcgcgcttccgcccatgaggcgctgcatggtccgcagcatgtcttcgtcaaggcaggcgagccgcacttcctgctgagccaggcgccgaaaatctaccgcttctattacgcggtgggctcacgcacctatgaacagacaggcccgtgcgccgcggtgctgcggaccttcggcgcggagaacgtcaccgagccggactgtctcaccatcatcggctggcacgagcgcgccatcgagctgtgtggcggccgcgccgtgcacgtcacccaccccatgtgccgcgcccggggcgcaccgcactgcgagtaccactgcacgtgggagtgagcgcccgccaaggggccggggacgggttcgcgcgcaggtcgcggagcacgtcgtccaggtatcggtagacgggcaccacgacatgccatggtcgcggctgatgccgcggtccgcggcggtgtctccgatggaaagcatgtgtccggggccttactgcgtttgccatggctcgccggacaggcgttaggcgttcaggctaaggtccgcgcccgtgcgggctcccagggacgagctgtcttcgcggcggtttcaacaacgattggcccaggccatgggcgtgacgcgggtggcgcgtgtcaccgggttggaccggaccggcgtggaggtggcgtgcgcggtgcggccgggcggccacatcctccaggtgtgcaacggcaagggcctctcctacgacgacgcggcctggggcgcgctgctggagacggcggagttgtgggcggcggagacggtggtgccggacgccctcgtgtggggctcgcgagcggagctggatggccacctgggcgcgctgtggggcgcggacgaattgggctcggcgggggcgctggtggcgccgcgcttgtggagcccgcacgtgcgctgtgcctggctcgaggcgcgggagctgtactccggtgagccggtgtgggtgcccgcgcagggcctgcacgtgcctcccgccgggagccccgcgttgggtccggtggcggtggcgtggacgagcaacggctccggcgcgcatccggacgcggggcgggccctgctgcacgcgctgctggaggccacggagcgggaccagctcgcgcggatgatgccggaggggtggacggaagaggtcgtccagcggcggttgctgcgaacgcccgaactgctcgagcttgctcccgccgtggaggccctggctggcccgctgcgcgagcggggctttggtgtgtacctcttcgacgccacgcccgccgcgcgcacgccgggcgcggtggggctgccggtgggcgcggcggtgctggtggacctggaagagggcccggtgccgctcaccgcgggttatgcgtgcgcgttgacgcgcgaggcggcgttgctgaaggccttgctggaggcggcgcagtcgcggctgacggacatccacggcgcgcgcgaggacgtggccgccgcggaccgggaggcggcgcgaggcttcgcggaggcctgtgcccaggtccgtccacggaggcgcgcagcggacatgccggacctgggggcgaagggcgccgcggcggggcaggtgcgccaggtgctggcgaagctccagcgagcgggcttcacgcgggcggcggcggtggcgatgtcgtcaccggtcgagggccttcacgtgcagaaggtggtggtgccgggcatgcgcatctcggagctcctatgaagcggcgcgcggacaagctcgtggtgttcctggggccctcgcttccagaggctgaagcgaagcgactggcgccgtgcacggtgctgccccccgcgcgccagggggacgtgtggcgcgcgcagcggctgcggccccgggccatcgccctggtggatggcgtcttcgaggcacagccctcggtgtggcaccacgagctgctggcggcgctggaggcgggcgtggccgtcttcggaggcggcagcatgggcgccctgcgcgcggcggagctggcgccgcacggcgtggtgggcgtggggcgcatcttcgagtggtaccgcgacggcgacgtggtggacgactcggaggtggcgctgctgcacgcggatggtgagcacggctggcgtccgctcacggtgcccctggtcaacgtccggcacgcggcggcatgcgcggcccaggcccgggtgctgacgcgcgatgcggcccgggcgctcgtcgacgctggccagtccgtcttctaccaggagcggacgtgggcgcgggtgctggagaccgtggcacctcgctggtccgcgtccacccgggccgcgtgggacgcgtggtttccgcacggcgcggaggacctgaagcgacaggacgcgctcgcgtgcctccggacggcggcggagtgggtggcttcgggtgcgcccgcgccgcacggcgctccgcgcgagccgtcatccctggtccggcgtcgtcggctggtggatgacgtgacggcgacgcaggccggggccgtgtcctcgggtcaggtgctggacgtccttcgtgcgtccccgaacgcgccggcgctggccgaggcggggttgcggcgggcgctgctcgcgggctgggcgcgcaccctgggactgggcgtctccgatgccgaggtggcggaggaagaggcccgttggtggcaggcccagcgcgtgcccgtctcgcgccgtgaggcccacctcgcgcgcctgggattggacgcggtggggctgcggcggctgtgtggggagctcgcgctggagcggctcgtcctggcgcattcggcgcgcctgctgccggacggcccgtcctgggacgaagcgctggccgccgaggcccggctgagcggggcctgggcggacgccgccgaggctgtggacccaacggagcgcgttgggtcctcctgagcagcggacttacctcgcgggtaagtgaaaacgtgacatccccggggaaaaggatagggtcaaccctggaggttgcccttgtccagccccgctcactgggtggttaccgagtctttcgcgcgaatggcgccgccacgggccgtgcgtcccgcgcgtgacgtcgcgggtggggcggggggagggcagtggccgtggccgtgaggtcgcctcccttccatccggatcaactcgtcccgggcagcgaggtcggcccctggcgcgtggtggcttcgctgggctcggggggcttcggccgggtcttccaggtggagcgggcgggccgccactactcgctgaagatggcgcttcgcccggcgggactccacgcggcggaggaagaggacatcaacggtcggctggcgcacgaggtcgcggcgctgctggcctgcgctccccatccgaacctcccggcactgcacgccgtggaccgctggcccgagcctcctgacggctacctgtacttcgtcaccgactacatcgatggcgagacgttccatgagtggcgctggcgggtgaagcccacggcggcgcacctgctgaccgtcttcacggagctggtgcgcgtggtggcggacctgcaccgccggggcgtgcaccaccgggacatgaagggcgacaacgtcctcatccgccgcgaggacgagcgccccacttagagcac

SEQ ID NO: 978 - DNA, 9710 bp, Myxococcus xanthus
tttggagctcgctcaccagccgtcccaccagggcgttgatggtcgggtgctcgaagaacacggtgggagccaggtccagccggtactccccagcaagctggtgcgcgaggtcggtcagcgagatggagtcgaagcccatctccttgagctcggcgtcggcgtcgagctcctcgaacggaatcttgaggaccttcgacacgaccgacatgaggacctggcggacctgcgtcctcagggtgtcgtcatcaatcgtcacggcgcgcgccgcgccagtcgccgcgcgatgtgccccgccctcctccgacaaggtcagtcggcgctggatggcctccaggtgccccgagagcaccatcaactgggccgcatccgtgcgcaggccgcgatagagcgcgtcgaaggcctgggtgctcgacagtgccgccagcccccactcacggaccttgcgcttcgccgtggcggcatcgacctgcatgccgccctcctcccagaagggccagttgaccgacagcgtgcgcccggcacgttcgccagtccgaaccagtgcgtcccggtgcgcggcatagccatccatgaaggcgttggccgccgcgtagtccgcctggccgatgttgccgatggcgccggcaatcgacgagaacaccaggaacagttccagcggctctccgcgcgtcgccaggtccaggttcacgatgccccggaccttgggccacgccactgcctgcagttcctcggaggtcttgtcccggaggtagcggtcacgcaggaggcccgccgcatgcaccacggccttgatggggccgaaggcgctccggacctctcgcaccagggcatcgaccgcggtcaggtctccgacgtccgcctggcggtacaccacctgcgtccctgtgccggcgatgcgctcgattcgcgccgccacttcggacgttggtgccgagcgccccaccagcacgatgctcgctccacgcgcgcgctgagcaatctcctccgcgacccgcaagccgaggcgccccgccccgccgctgatgacgtagacgccactgtctggccaggaagccgtggcgaccgcgtcggtggaccgggccttccaggtcgcgagcaaccggcggccctcgtcgtagcgcacggagtttgaaccaagcccccgcgcctcgttccgcaacacctcgaccatctggtcgatcgaagaagcgggatgtgcgagcagcaccgtctggcccacgatcttgtcgtcctcgagcgccgcggtcttgagcatcccactcaggccatacagcagcaggtcggcccctgaagcggccaccatttggaccagcgccttgcccgagagccttgatgtcgtgactcgctggagcacacccagcaactgcgcgctcgcatggaggaagcggtccgcaacggaggcatgcgacgcgtccaccgccacgcactccgcaccgtcgagccgcgatgacagctgcgccacgtccacgccctgcatgccgcacaggatgacaacacggtgttcgaacgtccccgcatcgccagcgggcagctcgcgaggcacccactccatctggaacagtcccgttgccacggaggccgacggctgctcgggaagaggccgcagggagagtgcgtggatggagacacggacagcgccctgttcgtcgcacaagtcgacgtcgagcttccgtgccatcccctccccggtcccgctccgcacgaccgcccacattcttgggatgcacgggccatggaccacgacctcttccactgcgaacggcagcgcgggcgcggtgccgccttcgtcgcccaacacaccgaccaccgcttgcagcgcggagtcgaccagcgcggggtgcagcacgaacgatcggccgtcgcccaccaggtgctcgggcagctcgacctcgcccagcgcttggccgtgccccacccgcacccggacaagcgcacggtgaccgggcccatagttcaaaccaagccgggcgaaggtctcgtaacactgctcccggctcaggacgcgcagggtgcaatccgcctccagccgccggaggtcatggcgcggcgccacgcgctcctgcaactccgccagaccgcggcaatggacggtgcgctcccccgctgcgtcgggcgcggaatgaatctcgaacgtcagccgccccgcatcctgcgcatgaagcgcgactccgacctccgccgcgtcatccaccaccaagggcgaggtccagaccatgttcctgaggacaggtatccggcccaccgcttcgtccgcccatgcgtcactggccgcgaagcgagccatctccagataggccgcggcgggcaggactttgcgcccgttgacctgatggtccgccaggtagaaggcgtcgccccggagcgtgctgctgtagcgctgctcagccaggacggagctgttgcggtggacgagggggtgaagcaccgcgccgcctctcaccgtggagacggcctgcgcctccaccacgggcggggagtaacgcttcttcgagaacgggtaccccgggaggcgcagccgacgaggcgtgtgcgtcgcgtacagccgccgccagtcgacatccacgccctgcgtccagaggtccgcgaccctccggagcttccccttgtgcagccagctttcgaagaggacccgtccgtcctcgtcagcggccagggcggagatgctcgctgccgtgcgcttcgcctgccccgacagcacggccgccgacggccggccagagagatacgcggccagcgcctcctgcaaggcttcccgcgagcccgccaggatggccaaccggtgctccagcatctcgcggccgacttgcagggtgtacgtcaggtctcgaaggtccacgtccggcgtggccgagatgaacgccgccatcgattgagccagctccttgagctgcacctccgtccgggccgatagcgtgaacaccacgggcgccgccggtgacacggcatcccccgcgacggtccgcgactgggacggtgcctcctccagcacgacgtgcgcgttggtgccgctgaaaccgaacgagctcacacaggcccgtctgacggggacgccagtccagggcttcagctccgtgttgacgtagaacggcgagccttcgagcgcgaggtgcggattgacggcctcgaagtggagggtcggcggcagggactgatgccgcatggccatcagcaccttgagcacaccggacacgccggcagccgtcatgaggtggccgatgttgctcttcaccgagcccagcgcgcagtagtgcttccgcgccgagtgctctcggaaggactcgaccagggcctcgacctcgatggggtcgcccagccgagtgccggtaccgtgcgcctccaccagagaaatggtgtccgcgtcgatgccaaagcggcgatacacctcgcgctcgagcgcggcctgcgacttcgcactgggcgcggtgatgccattcgtcttcccgtcttgattgacgccccacccccggatgacgccggcaatcgggtcgtcgtcgcgcacggcatccgacagccgcttgagcaggagtacgcccacaccctcgccagggacgaagccgttcgcgcgcgcatcgaaggtaaagcagcggccatccttcgacagcatgccggcgtcgctgctcatgatgtgcatcgccggtccgaaggcgacgttcacaccacccgccaaggccaggtcgcagttccgcaggacgaggctgtcacacgcctgcgagatggccaccagggaagacgagcaggccgtttcaatggccaggcaggggcccttgaggttcagcaggtaggagatgcgggcggcgaggatggacgtcgcgcctcccatcagcgcctgggcgttgaggtcaccgccacgcaggtcacgcccgtagtccgtgggcccgcagcccacgaagacgccgcagcgcgtatccgacaacgaggagggccggatggccgcgtcctcgatacagtgccagcacgcagcgagaaacagccgctgctgcgggtccatccgctcggcttccgccggggagatgccgaagaagagcgggtcgaagctctccgcatcctccagcacgcccagccacttgctgtagctcttccccggcgtgttcccgtcggcgtcgtagtgctccgccaccgaccagcgcccggcgggcacctccgagatgcagtccacgccccgggcgatgttctgccagaactgcgcaagatcactcgcgcgcgggaacttgcccgccatcccaatcaccgccaccggctccatgtcctgggtcaccgggcgctccgtccgaacctcaggtggggacaccggcacggtgggcttcgaaggcgcggaggactcgaagcgcttgcggtggcgaaccatcgcctcgatgcacgcctccgtgcggtcgacgacctcctccgccgtgtgactgaggaccaccttgccaatgtgcttgccctcgctcacgtactggagggcgtcctgaagcttccggaccgggtagacgcgcgagacaatgggaacgatctcccccgcgctcgccatggcggccatctcatccagcaggcggtgcgcccccaggcgcccggcgaacccgaccctgcgcaggtcgatgctgtggagggtctggttctgcaccagccgggacaggtccagcttcgggctggtcttcagggcgtgcaccgcgatttcgaggtagcgcccgaaaggagccagggagtcgatccccttctggatcgcctcgccggacaccatgttgagcaccacgtccacgccccgcccaccggtctgattccgaatctccggcgcgaagtcaccggtgtagtcgatgacgtgtggaacgccgatgcgctcgagcaccttgcgcttgtcatcacggctggagctgccgtgacagatgcaccgcttcaggtgggccaactgcaaggccatgagcccacagccaccggtcgcggtctgcaccagcacgtgctcgccctcggcgagcttgcccatctcaaaagcgtaatagacggtcgaaaagaccaccggcaggctgcaagcctcctcgaacgtcaacgtcgcgggcttccgcacggcgttgtccgccggcacgttgaccttggaggcgtgtccgcccaggagcggtcccgtgacggcgatgacctcgtcgcccaccgcgaagcgggcgacgccgggccccacggcggagaccacacccgccacctcgaagcccggcacgaacgggtattcgggcatggtggggtacagcccccggacacacatcacgtcggggtagttgagggcagacgcgcgcacctggatggtgatgtccccaggcgacggcggtgccacggcccaggctgacaggcgcgcggcctccacgccgcccacgcccgcgaccaccagtccgaagtcctccggctgcacctgcgcctcgatggcggccaacgccttcttggcgtccgccaaggccatccgtcccgactggagcgcctgcaagatttcgagacgcgtcatgactgccccccttcctggccggccaacctggggtactggcggttgaggtattcggcggcttccgtcatcagcttcatggcaatcacgtccgcgtggcggttgctgaaggactccaattcggtgcccttcacccactggttgaaggccccgagcgcgggcccggtgtgcacctggtagttcacgcggtcctcgccggtgccagcgaaggcgagccgggtcgagtaagcgaagtaccacctgaagatcagggccagcttctgcttgggatgggcctctgccttgtcaatcgtggcctgctggcccttgcggcgcaggtacaccttggtgtcttcccagacctgcgaaaggctcttcttgaagaagctgctctcaagctgcttgcgcaccttctccggaatgtcatccacgctgtcgtagtgcgtgtagagcgcatagagcttgttcgcgcgcgccgggaagaagacgcctttcttgagcacctgcaccttggcgcccatctcgaacatatcgcccgcgggcgcatagtccgtgtcctgcacacccatctcctggaggagcagcttcgcatccgagctcatcccggactccaccgtgcactgattgatggagccggtgaggatgaagtccgcgcccatgatgaacgccgcggcggcggcctccggcgtgccgatgccacccgcctggcccatgcagatgggctcttcgtagccgtaccggctcaccagtcggtcgcgaagccgcagcagcgtcggcaggatgatggtgggaatcgcgccgtctgtgtggccaccggagtcggcctccacacagatgtcgtggctgagcggaacgcgctccgccatcgcggcctgctccggcgtaatcatcgcgtcgcggagcaactgctccaccaaccgccgaggcggcggagacatgaagacctcggccacttccggacgggagagcttggccatgatgcggttgtcacagacgacgcggccctgggcgtcctgccgcagtcccttgacgcggtagaacaccagggacggcgtcgcctgggtgaacgcggcggcctcgacgttgcggacacctcgggccaggtagagcttgacggtctccagctccagggacgattcgccatgactggccagcaggttcatgccgaagggctcacccttcgtcagctgggattgaatctcatcaatcgcccggccgatctcctccaccgagcagccgcccgtgccgaagaagcccatgaagccggccttccccatccgcgccaccaacggagcggacgcgatgccccggtacatggcacccgagacataggaataggccagaccaaaccggcgccggaacgtcgaactccccagcgattgcgcggtgattgtcaaaccagcattgagcgtgggcgtattcatgaaatgtgcatgcagcgtcaatccgcgcaagcaatcacttgcgcgttcggacacgaccagaggacccgattcaagccgccttgccgcgaagccgaggcagcttttgaacgttgtcaggattggctgttcgtcaggaactgctgagcgacggagggatccagctcgccggcttccacctggcgaagcagctcatccaacgaaggcggctcaccctgagccggagcgcccgcgctgaccgtcttttgaatctcgttgcccaggtacttcgagaactcgcggatgttcggatagtcatacacccgcgtcgccgcgacgttgatgccgtagctcttgttgacggactggatccactccacgctgatgatggagtccagcccgatgtggcggaacccgacgtccaggtccacctcggagggttgcaggaaaagcgcgcgagccaggctgacggtcaactccgcttgcaactgttcgagcgtgacgccggcgggtgcgggcgtgcgaggcgcaacaggtgccgggcgcttcggtgcgggcaccggtggctccgagacaggctgcacgggcgcgcgcgcaggctcgcggacttccgctaccaccggaggcgcgtcctcgggcgagcgcgtcggagtcaggaccttgggcatcggcgggaggcgacgcgcctcgacgccgttccccacggagacctggcccacgggctccaacttgatccgagcgcgtggcgtgaccggcgcgggaatctcgcgggggaggctcggcaccggggggagctccacgtgctgcttgggttccggagtcgaacgctcgtcgaaccgtggcacccagtagcgctcccgggcgaacgggtacgtcggcagagacaccttcctaggcttcgagccgccatggaggcggctccagtcgatggataccccggcggtccagaggtccagcagcttgtcgaacttccgcttggcgacccaggcgtcgacagtctgctgcatgtcctcgtcaacgagggcgtccgtcagtccattcgacacccgctcgacccgtccgcgccacacgcgcttgcccttggacttcggctgcgagccatccgccgccaggaagtcctccaaggccgcctccagttccgcgaaggtgctgacgacgaaggccagccgctcgaccatgtgctcgcggccgttcagcaatgtatgggccacgtcatccagcgagccctgacgcagctcggggtcgcgcatccagtccagcagctggcgggcccgagcctggagcccagcctccagcgtggcggacaggagaatgaccaccggtgcctggctttcgcgatcagtggccctcggattcgcctcctccacgtactcctcgaacaccacgtgtgcgttcgcgcccccggcgccgaacgacgacagcgcggcgcgccgaggctgcgtgacgcggcggccctcgtgctcctgcaccgggctcttccactccgtcagccgctgttgcacgacgaaagccgttccatcgaagtcgatgtgcgggttgagcacctgggagtggagcgacggcaccagctggcggtgcttcatctggagcagcaccttggtcagcccagcaatgcccgcagcgctctcacagtggccaatgttcgacttcaccgagccaatggcgcagaacgccttgtcggaggtgaactcggagaacgccttctggaggcccgcgatctccaccgggtcgcccagggacgtgcccgtaccgtgcgcctccacgtaacccaccgtgcgagcatccacacccgcgcggcgaagggcgcgtccaatcacctgggcctgcgcgttcgggttcggcacgctgaagcccgccgtccggcctccgtgattgaccgccgtggccttgatgacaccatagatgcggtcaccatccgccttcgcccgctccagcggcttgagcaggacagcgcccacaccctccgcgggaacgtagccatcaccaccagcgccgaagctctcacagcgccccttgctggagacgaagcgcccctggctgagacccaggtacttgttcggatgcaccgacaggttcaccccgcccaccagggccgcctcgcaatctccgttcgcgaggctctgcatcgccaggtgaagcgccgtgagcgacgaggaacacatcgtgtccaccgccatgctcggcccgtggaagtcgaaccagtaggagacccggttggcgatggacgacgcgtttcccggcagcgacaggggccgtccctgaatcgtctcctgcgccccgtacaactgatactcctggtacatcacgcccacgaagacgcccacgcttccgccggcacggtccccgccgagctttgccagggactcccgcgtgtagcccgcgtcctcacagcaggcataggcgcactccaggaagaggcgctcctgcgggtcgatgaagtgggcctccttgggagggatgttgaagaagcgggggtcgaactccgccgcgccttcgatgaagccgccccacttgctgtacgtctttcccggccgagacttgtccgggtcgaagatggcgctgtgatcccagcggtcctgcggaacctctccgatgctgtccacgccttcacgcagattccgccagaaggcgttgaggtccctcgcgcccgggtagcggcccgcaagaccgatgatggccacgtccgtggggctgcctccgtcactcactcggggcgccggttcacgcttggccggacgcgtggcctcctctcgctgttcgaccgatggggcaaggccgaagatgcccgccaggcggtcagcgaaagcctctgccaggtgtgcggtcagctccccgagcgtccgatgctcgaacagcaacgtctttgacag

SEQ ID NO: 979 - DNA, 8321 bp, Myxococcus xanthus
caggcgcgggtagctattctccaagggctccggcagctcgccaccagcgaacggctgccgctctatttctacggcgtggaacgggatgacacgacgctgagagaggcgctcacctcggcgacgttccaggaaatcttcatctacgacgacaacgtcatggatgtcccgggggacaacttcgacgcctacctgggacagttcaagagcgacgtccggcgggtgctcaagaaggagatggctcacgctcgggatacgggcgttcgcttcgagcgcgtctcccggatgggagagatggcggagcaactggagcggttctacgaggtgacctactccaagtacggcaacgagcacctccgccatccatccacgttctgggcagcgctcgaccaacacgtctcgcccgaggccgaggctgtggtcgcctaccagaatggcgaccccatcggcttctccctgctactccacaagaacgatgagatgtggttctaccgggtcggccgcgccgaggccggggcatccgagacgccgctgtacttcaacctcgcattctacgagcccctgcgccgggcctatgagctcggcgtcaagaagctctggctgggcgccagcgggtacgagacgaagcggcgccgtggcgcgcgcaggcacgggctgtacagctacctgtggattccggggcgctggtcacgcacggtgcttcagccttacgtgtctgcctactcccgcgtggccatggccatggctgctagcggcacacagaatggccgcatccgcaagacgccctgaaacatcgaggtggggacctccgcatcgccctcgccccaaacgatgcccacgagggacggccccttcatgcgagccgtccatcacagcaagtggtgcagcggtcacgcatcatcatcgtcgtcgaagcgacgaaggttgcgctgccgcgccagggtctgcttgcgacgctggagcgaagcatccgccgctggcgcctcttcacggcgctcctgcccctccgcttccgctggcttcagcaacgccgccagggcctccacggtgacgccttcgtagaggctcgacgcaggcaggtccaagcccaactgcttcttgatgcggccactgagctgcacggcgatgagcgaatcaccgcccagttcgaagaagttgtcctggatgccgatgggcgccacgcccagcatctcctgccacagctccaccagcgaccgctggagtggcgtgcccggcatgacatacgcactgcgaagctgcgggcgcggctgatacgagcgagcacggactgcttcgccccccggttccgcctgcgatgcctgaggcgtggcgtcgggcaccgccgtcacaggctgggatgcaatcgtgccccgaggcgcggtctcgacggcggcgggctcgatccagaagcgctggcgctcgaagggataggtggggagcggcacccggtagcgaacctccgcgccatggaaccccttccagtccacgcgaacgcccgcttgccacagccggccgagcgtctcgtaggccagcggcgccatgccggcggtggccccggcgtccttgggcggaggcgtggaagccagcaccgcgtgtgaggcagtgaaggcggggtgacgcttcgccagcttccccagcacctggcccgggcctacctccagcaacacgcgcctggcgtcggtgaggagcgcgtgcaagccgtccgcgaagcgcaccgtcccgcgcaggtgctcggcccagtaacgagggctcgtcgcctgctcggcggtcacccaggtaccggtgacgttggagacaaatggaagcatgggcgccgccagcggcaccgtggccacctgcgcggcgaacgcgtcgaggatggagtccatcatcgacgagtggaaggcatgcgacgtcaccagcggctggcactgaatccccgcctcctggagctgctttcgcaccgcttcgacggctgcgtgcgtccccgacagcacgcactgcatggggccattgagggccgccagactgagctcgattccgcctgcgcgcaggtacggctgaacctcgtcctcggacaggggcaccgccagcatcgcaccggaaggaagtccctgcatgagccggccacgcgcggccaccagtctcagcgcatgctccagcgagaagacacccgcgaggcacgccgccacgtattcgccgatgctgtgtcccagcatcgactgcggcatcacgccccaggacatccaaaggcgcgcggtagcgtactccagcgtgaagagcgcgggctgcgtgagcgccgtctgcgccagcttcgccccgctgacctcggcggcctcggactgagggtacagcaccgttctcaggtccagtccgtccaggtggggcttcagcaactccgcgcagcggtccacctcgacgcggaagacgggctctgcctcgtaaagcgctcgccccatgtccacgtgctgcgagccctggcccgggaagaggaacgccacggaccgctccaccgcgtcctgcgcctcggtgaatacacgagggcattgtggctgtgacagcgcgtcgaccgcatcctccgcgctgcgagccaacacgaagcgacggtgcaggaaacgttggcgtccggcctggagcgtccaggccacgtccgccagattcacacccccttgtttcttcaatgactccaccagccgcgtcgtgaccgactccaacgccgagggcgtccgggccgacagaggcaacaggtgccatgcacgtcgcgagggtgcgctcgcgggcaaccggggagcctcctccagcaccacgtgcgcgttggtgccgcccacgccgaaggaactcacgcccgcgcgccgcggcgagtcccccgcgggccagggcttgagcgtggcgttgacgtagaacgggctgctgtcgaagtcgatggctgggttgggacgctcgtagtgaagactgggcggcagctcgccgtgcttcagcgccatcaccgtcttcatcaggcccgtgatgcccgccgccgcgtccaggtggcccatgttgcccttcaccgagcccagcgcgcagaaacgccgtcgctgggtggtggcacggaaggccttggtgagcgcctgcacctcaatggggtcgcccagttgggtggcggtgccatgggcctccacataggtgatgctccgcgcgtccacctccgcggtcagcaaggcattgcggatgacgcgtgactggccttggacgctgggggcgttgaagctggctttctgggcgccgtcgttgttgatggccgagccacggatgacggcgtggatggtgtctccatcctccagggcgtcctccaggcgcttgagcaccaccaggcccgcgccgttaccgaagagggtgccctgcgcctgcgcatcaaaggtgcggcagcgtccgtctggcgatgcaacaccaccaaattgatacaggtagccggtgcgctgaggcgactggagggccacaccgccagcgagggccatgcggcattcgcccgcgaggagcgcctgggcagccaggtgcaccgcaaccagtgaggtggagcaggcggtgtgcagcgaataggccggacccttcaggttgagccggtgcgccacccgcgtgctgaggaaggccaggtcgttgccgaggcccacctcgaacgcgccgagcatccccagtgcggccgggttggagaagagattgaagacgtacgtgttggttcgggctcccgcgtagacgccgatgtgctcccgatagcgctcggggtcgtagcccgcgtcttccagggccgcccaggcacactccaggaagacacgctgctgcggatccatcacctcggcttccttgggggtgatgccgaagaaggccgcgtcgaacaggtccgcgccctcgatgggggccgcggcgcgcacgtactgcggcgacttgcgcagcgccgggtcctccatgacggaaggctccagctccgactcctggaggaaggtgatggactcgacgccatcccgaaggttccgccagtacgcctcggcgttacaggccccgggaaagcggcacgccatcccgatgattgcaatctccagcccgttccagtgggtgtcgccagccatgatttcttgagtccccaagatgttttcgggagccggaggacccgcacgctcgcgcgcagcggttccattccggagcacgccggggccctggcgcgcgaaacagcaagcaacgaagcaggccccccagcgcctcaagtaaagcagctttcaatgtgaaagtcgctagagcacgaaaaacttatatggtgcgtcaagttactttttctaggtaaattgactaggcagttatcgctggattacggctggggttaccacagcaggcaatgtcatactggtaccaggatgagctacctggagtgtagttgccgttctcggagagagcgggcgagcacgcggcaggcaggtgcatgtcgggcatccggtgaatgggatgctggcgtccccctgacgtgagtccgtccagtccttcagtgcatcgaagcgccgccgagtctcgtcccaggggcgctcggagcagcagctcgagcggttcgagctccatcagccgcgcgcaaggaagcaggggtagacaaacatgggtcgtcacacccggtatgagggggacgcgagtctcgcggtagccattgtcggcatggccgcccgcgtgcccggtgctgaagacgtggaggccttctggcgcctgctgcgtgagggcagggaggccatcaccttcttcaccagcgaagcgatgaaggcgttgggcgtggagcccggctggctggccaatccaaacttcgttcgcgcagcccctgtcctggagcggccggggcgcttcgacgcggctttgttcggatacgccccacgtgaggcggagttgctggacccgcagcaccgcatcttcctggagtgtgcctggtcggcgctggagcacgcgggctacgccccgggccggttgacggtctctaccggcgtcttcgcgggctccagcttgagcacttatctgctgttcaatctgctctcccgggcggagttccagcaggccgaggacacgttcccggccatggtcggtaacgacaaagacttcctggccacgcgcgtggcctatcacttcaatctcaaggggcccgcgctcaccgtgcagacgggatgctcgacgtcgttggtggccacgcacctcgcctgtcagtcgctgctgggctaccagtgcgacgtggcgctggcgggcggcgtgtccgtgcacatgccccagcgcacgggctaccactctcaggacggcggcatcacctctccggacgggcactgccgcgcgtttgacgccaaggggcagggcacgctcttcggcagcggcgcgggcgtggtggtgctcaagcgcctggaagatgcgctgaatgatggtgacaccatccacgccgtcatccgtggctcggccatcaacaacgacggcgccatgaaggtgggctacaccgcccccggggtcgagggacagtcggaggtcattgcccgcgcacaggccgtagcggaggtgtccccggactccatctcctatgtggaggcgcatggcaccgccacgccactgggagatcccgtggaggtgcaggccctcacggaggccttccgagcggggacggacaagcgtggcttctgcgggctgggctcggtgaagaccaatgtgggccacctggacgcggcggcgggagtcaccggcctgctgaagacggtgctcgcgttggagcatggcgagctgcctcccagccttcactacgagaagcccaacccacgcatcgacttcgagagcagccccttctacgtcaacgccgcgctcaagccgtggccggagggggacacgcctcggcgcgcgggggtgagctcgttcgggattggtggcaccaacgcgcacgtcatcctggaggaggcgcctgtctccctcccgggcgatgcggcgcgcccattgcagctcctggtgctgtccgcgaagacaccctcggcgctggagtcccagacggccgcgttgctggcgcacttgcaggcccacccggagcagcagctcgcggatgtggcctggacgcttcaggtcgggcgcaagcccatggagatccgccgcatagtggtgtgtgaggaccgggcgagtgccgtggcggcgttggagtccaaggacccgcagcgcatgtttaccttggccccgggcaacagcacgccgtcggccgtcttcatgttccccggcggaggcgcgcagtacccggacatgggccgtggcctctacgcctccgagaaggtgttccgcgaggccgtggactgctgctgtgagctcctgaggcctcggctgggctttgacttgcggcccgtcatgtacccggacgcggcgaatgccgcggatgccgtgcagcgcctcaagcgcacctcgctggcgctgccggctctcttcaccgtggaatacgcgctggcgcagctgtggcaatcctggggcgtgaagcccgaggcgctcatcggccacagcctgggcgagtacgccgcggcctgcctcgcgggcgtcttctccttggaggacgcactggcgctggtggtgctgcgcggcaagctcttcgaagaactgcccggtggcggcatgctcagcgtcccgttgcccgaggcggagcttcgcccgttgctgggggattcgctgtccattgccgcgatgaacggacccgcgcagtgcgcggtcgccgggacggtggacgccgtcgaggcgctggccgccgagctgacccggcgcgaggtggagttccgtcacatccccatcgacgtggcggcgcactcgcacctggtggagcccatcctcgcgcgcttcgagtcctttgtggggaccctgacgcgcaatgcgcccacgttgcccattgtctccaacgtcaccggcacgtggatgacgcccgaggaagcggtggacccggcttactggacgcggcatctgcggcagacggtgcgctttggtgacggcatccgcacgctggccgcgcagcctgggcgtgtctacctggaggtcggtccaggccgcacgctggggacactggcgcgcctgcagctcaatgggcccaaggccccctcggttctctcctcgctgcgtcacccccaggacccggtgccggatgacgcgtttctctccaccaccgtcggccggctctgggcggcgggcatggaggtggactggagcgcggtacatggcggtgctcggcgtctgcgggtgccgctcccgacctatcccttcgagggccaggattactggctggcgccggaggtgtcctcctcgcgtcgaaggggtatcgcgcgcaagagcgcggacgtggccggctggttctatcttcccgcgtggcagcgtgcgccgttgatgcccaaggcagggcccgtgacgccgcgcggatgggtcgtctaccaggatgtggggggcctgggggcggccctggcggagcggttggagcgcctgggccacggtgtcattcgcgtgacgcccggccccggtttccgtcaggtgacggagcacgagttcaccgtggatgggcgagagcgtgaggaccacgcccagttcctacgtgcgttgaaggctcggagcttcaacgtggagcgcgtggtgtacctctggagcctcgatgtgtccggggcggactttgacgaggctcaggcgcgcggtttctttagcgtgctgcggctggcgcaggccctgtccggtgcggagctgcccgggcccgtggagttgacggtggtggggcgcgaagcgctggaggtggagagcgccgatgcggtggctcccgagcgcgccacgctgccggcgctgtgcaaggtgattccgcaagagttggacaccgtggcgtgccgctacgtggacgtcagcacgccatcagtggacgcattggtgcgggaggtgacgtcggatgccccggatccggtggtggcctggcgcggcccacaccggcaggtgcaggcgtacgagccgctgcgcatcgaagcggacacgccggtgtcctggcccctcaagcagcgcggcgtgtacctcatcacgggcggcctgggcggcgtgggcttgcggatggcggattatctggcgcgcaccaggcaggcgcggctggtcttggtggggcgctccggcgcggagcaggacgcggatggccgccgtcaacgtgcggtgcgagcgctggaggccgcgggagcggaggtgctggtggctcgcgcggatgtggcggatgaggcgcagttgcgcacggtcctggcggaggtggattctcgctttggcgcgctggatggagtcatccacgccgcggggctcccggccgacggcccggtgtcgttgcttggcgccat

SEQ ID NO: 980 - DNA, 10280 bp, Myxococcus xanthus
  unsure (1)..(10280): unsure at all n locations
ggtgagcccgccgggcggaatggatgcgaagaggtcctcgtccgtgcggtcatcgccgatggccaccacgagggcgccgggcgccgcgtccttcgtggcctcgcccaccacgcggcccttgtgcacgccccgcggacgaatctccaccaccttgtccccggggaggatgtccatggactgccctgcgaacttctccgccaggtacagccgcagctcgcgggactggatggcgccgaactccgcgtccaccaggcggtagtgccacgccagcgacgctgtcttctcctccacgaaggagcccggcacgcgcgcggagaaggtctccagttcggggcgcacgcgctccttccagtcgaacgtcacgccctccagcatcctccacgcctcccccggcgccgggcgggaccacaggccgtgctcggcatacaggcccatggccaggtcgcccaaccattcctccagcgtctccttgggccggccgctgacgatgctcaccgagatgccgggccgggccaccagcttcgccagcaactccttcagcgccgcatccggcgcggccagctccggccggggcgcgtagcccaccagcgtcccgtcgtagtccaggagcagttgcagccgctccacctgcttcatctgcgccagcgcctcgggcgcgctcgcctcggcgcgcacgtccaccgcgggcagcgactggagccggtcgaggaaggaggacgtccaccaatgcacgtcccgcgacttcacctgcttgcgcagcgtgtgcatgcgcgtgcggcgctcctcctccgccatccccagcgctttctcgatggcgtccgccatggcgtccacgtcgtaggggttgacgatgagcgcgccccccagctccgctgcggcgcccgcgaactcgctgagcaccagcacgccgtcgtcgtccggacgcgccgtgcagaactccttcgccaccaggttcataccgtcccgcaccggggtgacgagcatcacattcgcgccccgggacaaccccacgagcttgccttcgttgaatgagcggtagaggtagtgcacgggcacgttgtgcaccgtcccgtagagcccattgatgcgccccaccagctcgttcaccagctcgcggtagttggcgtacgcctccacctgggtccggctgggtaccgtcacctggatgaaacgcaggcggccacgccacgcgggcgtgcgctccagcacgcgctgcaccgccaggaggcgccgcggaatgcccttggtgtagtccagccggtcgatgcccaacaggatgcgctgtccttcggaggaccggcgcaagttcgccacctcctcctgcatgccgggctcgctcgcaatcgattcgaaggcctgcgcgtcgatgcccatggggaaggcgcccacgcgcacgtcgcgcccctcccagatgatgcggtcgatgtccgtgtccagcccgaggtgccgcagcagcgctccggagaagtgccgcacgtagctcaccgtgtggaagccgatgaggtccgcgcccagcagccccttcagcagctcacgccgacgcggcagcgtgctgaagatttccgacgacggaaacgggatgtggtggaagtagccgatgcgcgcgccgggcaaccgctggcgcaacatgccaggcaccagcatgagctgatagtcgtggacccagatggtgtccccgggctcgtagtgcttcgccaccaggtccgcgaagcgctcgttgaccttgcggtacacctcccaatcgcggtcctggcgcggaatgcgctccagcatgtagtggcacagcggccacaggacgcggttggaatagccttcgtagtagcggctcacctcgctggcggacagcgtcagcggcacgcagcgcagctccgcgagctgggcgtccacgcgggcgcgttggctttccgacaagcgggagacgtccccgggccagccaatccacagcccccccgagcgttcgtgcggacggcgaaggccggtggccaggcctcccgcgctgcggaccacggagacagtgtccttctccaccttgacggtgacaggaagtcgattcgagacgagtaggagtcgggacataggcccctcctgaattagtcactccgtgcaggaatggccatcgtcgaaacgggcttcatgccagatgttggtccctcgtgtcgggtggccatcggtgtccagcccagccgtgacagcagcgcgggctgccggcccggcttccacacgaaggcatccagcacatagtgcgtggcctgcggcagcgcgagcagcggcaccacgagcgacaacacgtccggcggcagcgtcatgtcgctctcgccgaagagcgcgccgtgttcgcgccacacgacctggtcccacaggaactcctccgccagggccagcgccaccaggaacagcaggaagcccggcagccccgcgcgcagcaatgccgcccccgcgccgtagccaccctcgtccagccgtccccgcgcataacggaagagcagcgcgaagtagggaacgccgtgcagcaccacgttcatcaccgtgaacgtgaagtcgtcccgcgcgacgacgatgccgccgaaccacgccacccacgtcgccaccaccagcagcaccttgcccgcttgcacgccctcgccgcgcaccacccgcgcgacctggaagccggcccacgcgaagagcacccccgcgtgaagccccagccccacggtgcccacccaggacggcaggcccgacaggaagtccccgggcacgaaccaccagaagccgcgcggcaggttcgcatgccaccagacgacggggcccagcgtggcggcatagacggcggcggcatccaggcgccgctccagcacagagacgcgcgccttgcggccgtacagcgccacccagccgtactgctgccgcacgaagtggctgagcgcgacataagcgaacagcgtccagaacgtgcccggcgacaccaggtgggcgaccacgcccgccatgtaggcggccagcggcgcgcccaggtagagcccggggcgggtccgcagctcgtccggatccagataggtgcggaacagcgtggaccagacgtgggccacgtccacgcagacgacgaagagcagccatgcccacagcggcgtgccgtccgccacgcccagccagggcgcggcgagcacgaaagccacggagacgagcgcgctgccagcgaagacggacaggtccactcccggactgaacagccagccctgggagggcgcgagaagacgaggcatcggggccatgaagcctaccagagtctccgcgccagggactcggcaccgggcccacatccggatgcggtatgaaccgtcccatgcacgccgccgcgcccacagaggcccctacgcacggtgacagggtgggccttgaacacgccgcggaccttccgctgccccctccacgcttccggcgccggctgctggcggtgatgctgctcgccggctgggtgccgctggtgctgctcggcgtgctggcacaggccgcgctggagcgggtgctgtcggtgtccatcgccccggtggagggcgtgctggaagaggtcgcctcggagctggcgcggcgggagctgccgcaagactcgctcaacgaggcgcggctcaacctcgcgcaggcggagctggcgcgacgagccctggtgcgccgcgtgcccgccttcatcaccgcgctgatactcatatcaggcgcggcgctgacggtggccgcggtgctgctcgggcgggccctcacgcgtccggtgcgcaccctcacggaaggcatgtgggcctatgcgcgcggcgacctctccgtgcggctcgccacccccgagcctccacgcgacgagctgcagttcctcctgggccagttcaaccgcatgggccaggagctgctgtcgcagcgcgagcggctcaagtccgcggaacagattgccgcctggcaggacgtggcccgcgcgctcgcgcacgagctgaagaaccccctcaccgcaatgaagttgtcgctcgcgcgtctgaaccggacggatgcgtccacgccccacgacaccacccgcatcaccgaggccgtggccctcctccaggaggaagtagacctgttgatgcggatgacccagagcttctccaccttcgcgcgcctgcccgcgccgcgcttccaggacgtgcccctgcgcccgctgctggccgaggtgtgcaccctgtacgcgggcacgtcccccgtgcccgtggagcttcggcctggcgcggaggctacgctgcgcgcggacccggatggcctgcgtcgcctcttcggcaacctggtgaagaacgccaccgaggcctcttccgccagcgccgcgccagtccacgtcacactggagtcgccgcagccgggcaccgtgtgcgtcaccgtggcggatggaggcagtggcgtccccaccgtcctcgaaggcccggccctcacgcgtggcctcttcagcaccaagcccggcggcagtggcctgggcctgcccatctcccagaaaatcgtccacgagcacggcggcagcctgcgcctggagcccgcgcccggaggcggtacgctcgcgcgtgtggaactgcccctcaccccgcctccgtccccatgaagcccggtcctcgcatcctcatcgtcgatgacgactctggcgtcctcagggccctgcgcggactgctgagtgatgagggcttcacgcccgtggaggcccgctccgcggcggaggcctcccagttgctcgacgcgcccgaaggtcccccggcgatgatgctgctcgacctgcgcatgccgggcgagacgggcctggagctgctcgcgcgcctgccccggcccttccccgcgcccgtggtggtgctgtccggagaggcgtcgcccgccgaggccgtgcaggcgctgcggctgggcgcgacggacttcgtggagaagccgccctcccccgagcggctgctcaccgccgtgcgaaacgcactggcactgggctcgctccaggaagagcgcgagcggctgctggacgcactggcccgccccgggcacctggtgggtgacagcgctggcatggcgtcactgcgccaactcatcgcgcgcgtgggccccagcgacaccgccatcctcatcaccggcgagacgggcacgggcaaggaacgcgtggcgcgagcgctgcacctcgcttcgggacgcaagggccggctcgtcgccgtcaactgcgcggccattccctccaccctgctggagagcgagctgttcggccacgagaagggcgcgttctccggtgcgctgtcgcggcgcgcgggccgcatcgaacaggcgcacggcggcacgctgttcctcgacgaactgggcgacatgcccctggagctccaggccaagctgctgcgcgtcctggagacgaaggaagtggagcggctgggcggcagcctgcccgtgccggtggatgcgcgcgtcgtcacggccacgcaccaggacctcgcccgcgcggtgaaggagggccgcttccggcaggacctctacttccgcctcaacgtgatgcctctccaggtgccgcccctgcgcgagcggccggaggacctgctccccctggcccgcgccttcgcggcggagttcgcggggccgcaggtgccactggtgctcgcgcccggcgcggagacctcgctgcgcgcctatgcgtggccgggcaacgtgcgcgaactgcgcaacctcatcgagcgcctcaacctgctccggggtgagggcccgctcaccctgggcccggagctcgtctccgcgccccaggccaccgccgcggccagccgcccctccctgggacaaaagagctaccgagagcacgtggaggacttcgagcgcgagctcatccgcgcggcgctccaggaaggcgaaagcatcgccggggccgcgcggctgctgcaggtcgaccggggcaacctctaccggcgcatcaaggcgctcggactccctgtcacctgaagccccgcgggagtgcagctgctctgcccccgattttcggaccggccgcaaccacggccccagtaccgaaagcgcccccatgcctccaggtggatgccggacggccgcacgcaatcgccgctggcgatgtcagtactacatcacgactcgacatccggatgtctccatgacatcggcctgactgctcggccctcgttctttcaggcacttgcccgacgcctctgggtggaacggcccgtgctctcccttcgtgcatgaaccgcttcgcgctcctcatttgtctcctccccgcgctcgcagtcgcgcagccagcccctgcacctgagccacgctccgacgcgccctcatccgcggaagccgctccgtcgcaaggtgaaacgggaaacaacccgcagtcagagcgtgcggaaggcgcaaccactgccacggacaaccaggaggctggcggcaagccacgctcccccacgaccgacgcccgaggcgacaccccagcggacacgcagaagtcctgccccgacgacttcgaggacgacgactcgggagacaccagcgttctggccccgcttcagctcgccgtggatgggcgctcgctcacgcccggccgcatcgaactgcacgggcttcactggctgacggatgcgcaggtgcgtgccttcatcggtgcgccccgtgcggactcgggggccctgctgagcggaagcgaagtccacctgttcctccggcggctcgctcgctcggggctgttcgcccgcgtggagccgcgcgtgcgcgtggccgaggcgccgcagccggcggtcctcgaagtccacctggaggagaaccccgtcgtctccgccgtggaggtgaacgggctccaggacctgcaggccaccgagattctcgaagagctgctccggctcccgtaccggttccccaccgaggacgaagacgaagagtccttcaccgccacgctgcgcgtggactcccggcgcggcacgctctccgtcgtccgtccctgcccgcctcgctatccgccccgtgactgggtggcccggctggagcgcggcacgctgcaccccggcatcttcctgggcggcgtcgcccacggcctggagcgcacgctgaagcgcctgcgtgacgacggctacatgctcgccagcctgtccgcggtgttgtcgccggacggcaagctgatggtgacggtggatgaaggccggctcgagtccatcgaggtgcgcggcgtggacgccgacatcgccgcgcgtgtccaggatgcgctggacctgaagcctggcaccgtgttcctccgcagtgacgcgaagcgcgccgtgcggcggctgacctcgcgactccccttcctggagcccgcggacgcggacgactccgacagcccgcgcgcccagcgcgccaacatcatcgagacgcgcgagccggacggcacccgcgcctatcacacgcaggaagcaccgcgcgcgaagccgcgccaccgggagcaggtggagttcgagctgaactggaagcagttcgccgactggtgggacgacgtggactcggccgacagcatcaccctcgagggcaagaagctggtggtgcacctgcgcacgcggcggcccgacttcgacgtggacctgcttccgatgcacacgcaggtgacgggcttctcgccaggtcttgcggggcggctgcgcctctgggatgcgaaggaccgcgcgcacgtcaccgtggatgccgcgctcaccatcccgctgcggtggggcggccagtatctgccggatgacccggaaggcacgcagcgccagcggcgcatcaacatgctcggtggggcgaagctccaggtgccgcgggtggggctcgcggagctgggtgcgcaggtctacgacttcaccgacacgctggaccggtggcggatgggcgacatcgactcgtcgctctactcggccctcatcaaccggccggaccgcgactacttccgccgcaagggcctcacggccttcgccacctggcgctgggcggacgactggctcgcgggcgtcgagtaccgcaacgaccgctacgagtcgatgcgcagcttcacgccacccttctccctgttccggaacgactcggcgcccttccccaatgcgcccgtcaccgagggccgcttcgactccgtggtggtgcgcatggagtacgccagcaacgtgcccgccgccgcgtccgtgggctcgctgttccgcacgccggagacgtcgctcttcgatcgggatggcgactgggagagccgcgcctcgctccggggtctgctcacgctggaggtgggcaacggtccggggagcgcgggcggtgacgcgcgcttctggaagctggtgagcgacatcgcgatggaggtgcccaccggctgggacaccggtctgtcgctgcgcgtgcgcaccgcggggggccaccgtctgcccgaacagaagcgcgaggcactgggtggatggacggcgctgcgcggcttcggcttcaaggagtaccgcggcgacgtgtccgtgctcaccagcgcggagtaccgctggagcgccctgggcgtcttcgtggacctgggcacggtgcgggcggatgacgcatggacggatgcacggctcggcctgggcgccagcctccactttggagacaacgtgcggatggacgtcgcgtggcgcacggatgagcgggccaccgccacgcccgaggcccggctgctcttccagcggaccttctgagacgcatggactggccacgcaaacacgtgggacgcgggctcggcacggcgctcatcgccgtggcgggcctgcacgcccccacggtccatgcagaagagccgcgcaccacctgcaccgccacgttggccggacggcgcgtcatggtccgttccgaagccttcgacttcgtctcacccgagctggaccggttggtgcgactgggcatggcggggaagctggaggtggagctgacgctctggcaacgcaacaccgtctggttcgacgcgcgaatggacaccgcccggctgacgcaggtgctcgccttctccaagggcgcctacgtgctggatggacgccccctgccagaaggcccgtcctcactgacgctggagcgcgtggcgtggaccttggaaaaaaggcccgagcccggcgcgcgctatgaagtgcgcatcagcgtccgcctgcacgtcgtgaccgccgcgagcctgggccgggtggccgcgtggctcacgcaggggaagcaagcgcctggcgaggaaggcaccaccctcacgggcaccgtgctgcttcgctcggtggccgaggacctcgcccgcggcgccagtgcgcgctgtgacgtcacccggccgccctgagccacggccgcgccgcacatccgtcatgaacccatcgagcgcccggccaccaggtcgaggccaggagtcccgtcatgcgacgttggctgtccttgctgttcgccctggccgctgggtgtgctccggcgccggcgccacccgagtctcctgaccgcggcgtccaggtcttcgcgcctccgggcatcgaggcccggggaagccgcgtccccgtcctctacgtggaggaggaaagtgcactgtacttcccccagggcgtcggaggcggaggctcacggcacccggtggtgcccagccctgccgagttgctggccctggggcgacgcaccgacatcatcatcgtcaccgtcgccccaggccactccaccacctccgcggctattgccgcgccatgaccgtgttcgcctccgtcgcggcgtcgtggacgtgctcgcccgacacgtccaccaccacctccgtcagcgtcccacccttgaacgcgaagggcggctggtaccgctgactcaccggcgagttctcgtctcggccgcacgtgagtccctcgcccaggctgatgagcagcggcatggtctccgagatgtcgctctgcgccaccaggtcgccgttgatgaagaggcgtccccgccccggcgcgccccggcccgcgggaaggtcgggcgcgcccgtgggctggaactcgaagcgcagctccgcgtgtcccttcggcacgtctacggaggactccacgtggaactccctctctcccacgaagttgtagacgtagtgcagcttgccgtccttgacgaagagcgagtacccgcccgtcaatccaccgtggcagagcaacacgccctngacgccgtcctccacctccacccgcgcggtgatggcgtgggctcgattgaggacgtgcaccgccacgttctccggcgcgggtgaggtgttcggccggtagacgtaacgctcccgctctcgagaaatctgcggccgctccacggtgaagagttcgcggccgggcgttatcagcgacaccactgaggatggcctgagagca

SEQ ID NO: 981 - DNA, 11612 bp, Myxococcus xanthus
cgagatgcagaatccgagtacggagcaggcatctgctacatggaaatcacgggggactggccgagccggcagattgaaatctacggagaaacgtggcgctggggcgacgagaaacacctcgaacaccttgcggatcaaccgttcgaggttctcgacctgggtgaggagtacgaaatcccatcagaggaattcgaacgcgcctggcaggaagccatgaaacgcaccccacccaaatgaggcagggctcactcagccccgaagcctggccttttgtagggcgttccaatgggcatcgatgcgcgacgccaggtcatgaacattcctcagggctcgatgtccaagcccgccacgccctcgaagcggacagtactgcccttgcggatgcccagcttctccgtccagccgccgggcacctccagcacgtactggctgggtacgcccacggagcgggattccagtgagcgaggcaccgcgcgcgacacgatgcccgcaacgcgcaggtcggacgtgatgaaaatcatgtccagcgggatgagcgtgttgcgcatccagaacccctggacctcttcgtgcgggaagagaaagagcatccccttcccctccgccagctccttgcgccacatcatgccccgtgcacgcgtgcccgccgtcgcggcgatctccacctccacccggcgcgctccgccgaaggcatcctccagccgcacatgtccacgcggaagcggctgcatgacgtagtcctcggcggtgacgtcggtgatgcgcggacgaggctctgccgccttcggcgtggcacgaggcgcgctgccctgcgcctcctgctggcaggccgatgccagcaacggcaccgccaccaccatccaccgaaggccgtgcttcatgagtgcgagtgcagcggcttgttgagcagcttctccgtcagctcgccgccgaggctgtcggacatcagtccttccaccaccgtctcgaactccacccgctgcgcttcactgctgtagatgaaacggatgcccatgccgggctcgtccgcgtccgccttggaccagacgacctcgcccagcagttcgaagggggcctcccggtgtggcaccgtcagcttgaagaggaagcgcgtgccgatgggcagcggcttcttcgtcttgatgaacgtgccacccttgctgatgttcttcgtgtagtccgcgaagaacgagttgagcttcttgtagtcgaccttcagctcgatgggcgcgcgcccgttctggcggtgctctggacctgtcttctgttcggacatgctggccgggagtataggagaggccatgcggcaagtcctcacccgcgcctctggcctgttgcgtcgccctgccgtcctggccaccgtcctcctgctcgcgggcgggggctcggcgctcgtcctgctccccctctttggcgtccccggcttcgagctgagcctggccctctccatcgccgtcggcctgctcggaggggggatgggcatcgccgcggccgcccaggagcgccgcatcctgctgggcaccgctccgacgccaccaggcgccctccggccccagacgcccgcaggcgcggtgggccgggccctgggcaccgccctgctcctcaacatcggcgtcctggtgccccccttcctggtagccaccctgttcgcctggctgcgcaccgcgtgtgacccgttcgcactggtgggcttctatccgatgctcaccctcccctcggccgcgctggccgcctccgcgggcgtgctgtgcggcttcaccgccgagcgcccccgccgggccgcggggctgtacgcactcctcatcctcctctcagccgtgcctaccgcgtggcccatcgtcgccgggccccaggtgttcgccttcaaccacttcctgggacacatgcccgggcccctctacgacgaggccctgggtgtctccgccgcgctcggctggttccgcttggagacgctgctgtgggtcaccgtgctcgcggggctcacctgcgccctgctggacctgggcaccgggcgccttcgccgcgccggcctgcgccgcgccaccctggccgccctggtactgcccctggccgccatcgccttcatggaggcgcgcggccccgccctgggcctgcggatgacggatgcgtggctcacgcgggagctcggcggcctgcgggagacggaacacttcgtcttccactactggcaaggcaagccgcgcgaggacgtggaccgcttcgcgcgggacttggagttccgctgggcccagacgcggcacttcctgggcgtggcccctaccgagcccatccacgtctggctctaccgcgacgagcacgaaaagcagcgcctggtgggcgccggccgcacccagttcgccaagccctggcgccacgagttgcacatccaggaccggcccttcccccactccgtgctccaccatgagctggcgcacgtcatggcggcccccgcgggcagcggccccttccgcgtcaccacccggctgggcgtctggccgctcatgggcgtcatcgagggattcgccgtcgccgcggacggcccggtgcagggcgacctcacgctgcaccagtgggcggcgggcatgcgcaggcagaagctggcgccggacatgcgcaagctgatggggccgcagggtttctaccagtcggcccccgcacgcgcgtacacggtggcgggctcgttcctgcgctacctggcggacacctatggcgcggaccggctgcgagccgtgtatgcccatgcggacttcaacgccgcatacggccgtcccctgggagagctcgtcaccgagtgggagcagtacgtggacgcgctccccctggacgaagcctccgtggcgcgggccttcgcgcgcttccgcaccggcagcctcttcacccgcgcctgcgctcgcgaggtggcgcgactgtcggattccgcccggcaggcgctggcgagtgaccccgaggacgcgctgaagcgctaccgccgcgccggcgagctccagcccgaagagcctggcttccgcatcggtgaggccgtcgccctgtcccaactggagcgctacgcggacgcggacgccgtgctcgccgaggtgggcgaacgcatgaagggccaggccgtgctggaggcggaggtggccatggcgcgggcggacgtcgcgctgcgccgcgaccagcccggcgaggcccgccgcttcctcgacaccgtgctgtcgaaggacgccgggccggagctgacgcgcaccgcccaggtgaagctcgccgccatggaggacgccgtgcgccaggcccccatcgaagcgtacttccgggccggccaggacgaggtgcgtctgctgatcctcgcgcgcgccctggccgcggtgcccacggacccgttcctcaactacctcatggggcgccggttgcagcaggtgggctcgcccgtgctggccacgggctacctgcaacaagccctggcggcggaaggcctgccggaagcgctccgccgcgaagccctgcgcatgcgggtggagtcagcctacctggcaggagactgcggcgcggtgcggcacgaggtcggtgcactaccggactttggcgccgccttccgggcctccgccgacgagtggcgggagcgctgcgacttcgaggagaagaccttccgtggactgctggtgccacgacaggctttccgctagccacgcttttcggctaggcaggcagccagacagcggtgacgtgccagcctggcaaggaggacgtggatgcgtttcgagtcgcggcatcggattcaggggacggtggatgaggtggagcgcgcgctcctcgacgagcggtacttcgagttcctcctcaagcaccatggcgtgctgctggagctgcagcccctggaagtgaagccggacggagacgtcgtgcgccgccgcgtgcgctaccgccccaagcccgtcatcgagaagattggccccaagacggtgcccccggagtggttcgcgttcatcgagacgtccacctatgacaagcgccgcaaggagttgacgttcgagaacatccccacctcgaacaagatctccaagatgctggtgaacaccggcaccatgcgcttccgcgacgtgggcggtggccagacggagcgggtgatggacggtgaaatcgccctcaagctgcccttcctcctcaagccgttggggctcatcgcggagaaggtcatccagtcggagggcctgaagatcctcgacaacgaggtgccggtgctcaaccggttcatcgccgaggtcatccgccccggttagtcgtcttcccgcctccggcggggcctgggaatgggttgacttccgttgggttgtcccaataaggccccgccatgctcaaacgcttcctcgccttcagcgtcctgtccctgctggccgcctgcgccccgaagcgcatccccggcacggacatcgtcgacaactccgacacgcgcgccattctcgccgtcatggaggagtaccgcaccgcgctggaggcccgggacgcccaggccatccagaagctcgtctcgccttcgttccaggacgacggcggcacgccgaacgaccccagcgacgacctgacggcgcagaacctggtgccctacctggagcgggtgttcccccgcatccagggccctcgcatcgagctgaacatccgccgcatccaggtcggtgacggcgtggccgccgccatctactactggaacgcctcctggcggatgccgtcgcttcactcgcgcccgatgaaggagtccgagctggagcagatggtgctgcgcaaggaagacggcacctggaagatcctcaccggcatctgactccgtcgggccctcacaggcccaacagcgcggcgaagccctcgggccccatggcattcaatgcccgggcccggttgaggtaggtgcggtagtccttgcgcaccagcttgtccgcaggcagcggggacaggtggtagtcgcggatgcggctcgccgtgaagcgcaccgccccgtagagcgcatggccgaagaggttcgtgcgctccacggcggatagcggccggacgtccacgtagccgcgaatgaaggcccggcacagctccggcaggtactgcccgccgtcgaagcaccaggcattgagcgtgatggccacgtccaggccgtagtcctcccggcacgccatctcgaagtcgaagaaggcgcccacgcggtcccccagccacttcacgttgtccatgaagaggtccgcgtggatgacgccgcgaggctccagcccctgccgcgccgcgcgcgacgtctccatgtcgcgttgcagctcacgcgccacggccgccagctccgcatccgggtgcgccaccagcgcctccagccagccgctcaccgtctccggtccgtagggattctccctcgagccggagaaggactgcgtgtcgcggtgcagcttgcccagctccgcgcccagccgctccaggtggtcggcggtgagggccgggtggcgcagctcctcgcccggcagccagcggaagacgctgacgcggccaccctccagctccaggaaggtcgcgccgtcacgcgtcgtcacctgcacgggcccggggaagtggtacgcggccaggtgcgcgagcagcgcggattcgaagcgcaaatcgtccgcggagcgcaccgtggtgtggcgcacgaagtagcgcccgctctgcgtctccacgcggtggttggtgttgatggagccctggggaatgggcgtcacctcacgcacagccccgagcccgaatgcctccgcgacccgctcgaatgcctcgcggggtagcgccgtgtgtaccgccatacctctgacctcccacgtccgtgttcacgccgccgccccccgttgacagtcgaggggaccgttcctatctgagcgcggcttctatacccggcacaacggccggcgcacatccaactccagcgcaggggacaggtccatgggcaccgaagggcgcaaggactggcagcggcgcgaaagcctcaccagcgcgctggttcaggtgggcgtggtggcggtgctgctcgcgggcgcggtggttttcttcgtccaccgaggcaccgtccgcaagcagacggaggaacacctgcgcgcggcccgcacggccgccatgcgtggcaaccccgctgacctcgcccgcgcgatgacggagctggacgccctgttccagctcgacgccgaggcccgtgacgcccaggccctggctgccgacatccagacggtgctgtggctggagcaccggcagcccggcgcggacgccaaggcccgcgagcacctctcccgcgccgcgcagttggagtcgcagtccggcgagcgctacggcgcccacgcactgcatctgctggccgcgggcaagtccgccgaggcggagcagtacctggccgggctcgaggcccgcggcgccaacaacgcccggctgacgctggcccgggccctggcgctccaggcgcgcggcgaccttcccggagcgaggcaggccttcgctcgcgcggcggaagcgtcctggcgcgatccacgcttcaccaccgcgtacggcgaagccctgatggacgaaggccagtacccgcaggcggtggaggccttcgccaaggccaccagtgtcaacccggaccacctgctggcccgcgtgtccaccgcgctggcccacacctaccaggggcgcaagatggaggaagcgcagcaggtgctctccggcgtggaggcccggggcgcggagctgacgcccggactgaaggcccgcgcgggcgcgctgaaggcagagctggcgctggctcgcggcgcgcccgacgaggccctctccgccgcggacgaagcgctgaaggccgttcccgatgagcactacgccctcttcgcccgggcccgggccctggcggtgaagcatgacgtccaggcccgcgcggccttcgaggcggccgtggcccggcgccgcaatgcccccctgctctacctggacggcgcgcgggcgctgcagaccgctggtgacaccgacggcgcggtggccctgctggacgcgtacgaggccaccttcggtccggtgcagaccaccaccccggacggcaagaaggctggcctcttggagaaggacagccgctactggctggcgcgcggcggcgtgctggaggccgcctcccgtcaggacgatgccctggtcgcctacgacaaggccctggcggcgcgcggcgtggagctggcccaggcgcagtacgccaagggcgcgctgctgctggcgcgcaaggactacgagggagcccgcccgctgctggccgccgtggcacccgacagcggcgcgggcacgatggcggaggcctacaccgccatgggggacctgctcttcgcgcagggcgagcacgccgccggctgccagcactacttcttcggcctcgcgcgagagcgggcgcagggcacgccccgcgaggcgctggcggagcgcgtggaggacatccggaagcggctggagtccgccggccaggccagcatggccaaggcctggaaggcggagtcgagctcgctcctagagtaggtcggtggggctgatggactccggccgggcgcgcaccacgcgccactcgccgtcctcttccttctcgaaggcgccttcgatgaggtaggcgttcagcacgctgtcggcggccaggtgctccaccttctccgcctgggagcggccgaagatgaagcgcgcctggaactccccttccgagggcgacacctcgcgcacctccaggttcgtcacgaagacgcgcacccactggccacgcagcacctgcgcggtgaggatgccgcgcacgtccttcttcgaccagccgccctgcccgttggagcggaagcgctcggagacgtgctccatcaccccgcccacgtccttcgcctccgcggcgcgcgtcatcaccaccacctggcggcggatggcctcctccacggtgagctgctgccgcggccagaagtacagcaccgcgccggccgccagcagcgccagcacaccgcccaccacctgagagcgcgtcacgttcaccatggcccccctcacgcggcctcgggctcgagcaccagttcgtccgcgtcgatgatttccgcgggccgcagcgcctcgccaatctgcttcagccggcggtccgacagctgctccaggtacgtgcggatgtccggaacggccgtcaccagttcgtggaaggccgcgcgctccaggaaggccgcagccgtcttgcgcgccgccgccaccgtggccgtcgcgcgcaggcccgtcagcagggagatttcgcccgcgacctcgccctcgcgcagcatgcccagcgtcaccacgccgcccgccgggtcctccttctgcaccaccagctcaccggccagcaccaggaacagccccggcgagtgctcgccctccaccagcaccttctcccgagcctggagcgcccggaaggtgaagcgccgcagcagcgcgccccgctccgactccggcatcgtctggaacatgggcgaggtggccatcaggttgcgcgccatgcgctgctgcgcgaagtccgccagcacctgcggcaccgcggggtggctcttggcgaccgcgttgaggtgctcgcggcgaatctcgaagacttccgtgtccgacaccgcggacaccgtcgccgtgggcggagcgcccgtcagcagcgcgatttcaccgaagatggagccaccgccgaggaagcccagcgtgcgcgcctcgccctccatctgtcgcgtcacctccgccttgccggcgaccaggacgtagagggagtcggcgggctcgccctcgcggctcaccgcctcctccggcttcacgcggcgccacgccatcagccgcaccaggtccacgaaggcatcccggtccagctccgcgaacagcggcaacggcggacggctgttggggtccgcggcgccgcccgggtccgtcgcggccagcacttcgatggcgcggctggacaattcctcgccctgcagccccatcaggtccgtctccaccttgccgtcgtagagggtttcgggcggcagcggcggaggcaccaccgcgcggcccggcgcgttgcgcaccgcgcgcgagtgcactcgaaacagcgtctccttcaagcgccgctcgttgggcgccaggtccagcgccagcttgcacgcggccatggcggacaacaggtagtcccggcgcagcaagccctccgcgcaggcgtggtaggcggtgacggcgcgctcacgctcgcccagttccgccaggcagcgcgcggccagcatccgcgagcggtggtccgcggggacgcggcgaaccgcctcggcgaacacggccagggctcgctcgaactggcgctcctcgatgaggtccatcccgagctcacgcagcgacgactcgttcatcccttttctccccggcaaatcatggtcggcccgccgccactcacggctggagctcgctcagatacatctccgccttgcgcttgacgtcggagccttccgaggccgtctcgatgacgaccttgaacatctccgccgcggccttcggatccctgtcccgctggatgtaggcccggaggaagagctcctccgccttcttctgcaggttctccagtccttcacgcgcccgcccgtcacccgggttgagccgcagcgcctcacggaagtgcgagccggccgcgcccaggtcgcccttcttcagcgcgctctgccccgccgccagcgatgacgacgcgagctgttcgtcgatggtgttccccaacgagccccggaagccaatctggcggtacagctccgccgcgcgccgcaggggcttcgcccccgcctccagcgagttcgaatccagctttttctgcccgtcctccagcgcgcgccggaactggggaatcagacgcttgagggccagggcccggtccttcacgtccttgtccgcccggtacttgtccatcacccggtcgcactccaggacggcgcgctggtagtcccccccgttgaagcggcgctccacgtcggtgaaggcctcggcgatgaactccttgcgcttctccttggccacctccgccgcgcgggcgttggcgttgcgggtgcggcgcgacgcatcctgggcctccttcgccagctcggcctccaggtccgtcagcttcacctcgtaggccggccggttcaacggcggcaactgcgcgatgagcgggcgaatcgtctccgggtcgcgcgaggcgaaggactcctccacctgctggagccgccaggcgatgtccttctcctccagctccgtcgccagcttgcggcggatgtcatccgtcttcgccgtgccctgcggcgtcgcctccagcttcgcgcgcgcctcgtcgaactgcttctcctcgatgagggtgcggacggcatccagcgcggtcatcacctccaactgcgtgcgcgcgccccgggccaggttgtccgcgtcgatgcccggcaccagcttctccgcctcgccgacgaggcggacggcgttggcgaagtcatccgcgcgcacggactcgcgcgcctgctgcatcaacaccttcgccttctccaccttcgggtccggcgaaggcggaggcggaggtccggacggaatcagcatcagcccgatgaccagcaccaccaccaacgcgccaccgccgccgatgagcgccttctgcttgcccgtcagtccaccgctgttcgaacgcgtcggcgtgctgcggatgggcggacggggccggggtacggccaccgcgcccttgctgccggagttctccttgagcgagtcaggcagcttgtagttggcgttggtggcctcgttgaagcgcgggtcgttcggatccacctcgctgccacgcgcggcggcctggttcttccgcttctcctccgcctcgcgggcggccgcctcgcgctcgcgcttctccgcagcctcgcggacctccgcctgggcgcgcagctccttgatctgctccgattcgtccacgaagcgcaggcgcgtcttgcccatggagatttcgtctccatgcttcagcagacactcgtccacgcgctggtcattgacctgggtgccactgacgctgcccagatcccgcatcaccacgccggcctggccgtacaccaactccaggtgtcggcgggacacggactggtcctccagcacgaagtcgcagtccttgttgcggcccaccaccatccgcacgctctggaagcgcttcttgcggcccttgtccgggccgtccagcacatgcatctgcactggcggtccggcgcgcgtggcgtccgcgttgtcgtcttcgtcctcgtcgcgggagcgccgctcctcctccacggactcgatggaggccacgcgcgtctcacccgtgcgggagcggcccggtgactcctcaccatagaggtccgggttgggcggcccatcgtctgggtagccgtcctcgccggatgcgggagcggcgaagtcctcgtcctcggacgcaggacggcgccgggagggggacttcatggagtctgggtcctcacccgcagaaccaccggaacggccggcgccagcacgggaagagggaggaggaccaggaggcatggggtgggttccagtctcgaagcgccggacatcttagagcgccgactccatggtgggaatgcggacaggccgtggatcagggaaagaacgggggcccttgagcagtgctcctggcggcgcccccttct

SEQ ID NO: 982 - DNA, 9556 bp, Myxococcus xanthus
gtgctctaagggcctcttatcatcggcttctccgtggccgccatcgccgtgggcgtgggcgccactgcatggtccgcccgcacgctgcgccccatgcgcaacctcatccggggcgtgtcccgcatcggccgtggtgactacaacgcccagctcggcgtgcgcggcgacgacgaggtggccgtcctggcccgggagttcgaccagatggcccgctcgctccaggcgcgtgaggcccagctcaaggcccaggccgaggccctcatgcgcgcggagcaactggccgccgtgggccgcatctccgcgcaaatcgtccacgaggtgcgcaaccccctgtcctccattggcctcaacgtggagttgctccaggacgggttcgaaaccgcccgcttcgcgacccccgaggacgcggccgaggtgaaggacctcatctccgccgtcacccaggaggtggaccgcctggcggatgtcaccgagcagtacctgcgcatggcccgcccgccccggcccgacctggacccgcgcgacgtcaccgccgtgctggacaccgtgctcgacttcacccgagaggagttggagcgcgccggcgtggaagtggtgcgcgacttcgccctggataccccgcatgtgctcgccgacgagggccagttgcggcaggtcttcctcaacctgctgcgcaacagccgcgaggccatgccgtccggcggccgcctcaccatcgtcacccgtccggcggaggacgccgtggaagtcacggtgcgcgataccggacagggcatgacggaggatatccgacagcgcctcttcgagcccttcttcaccaccaaggaggggggcacgggcctgggcctggccgtcagccagcaaatcctccaggtgcacggtggctcgctctcctgccagagtattcccggccaggggacggccttcgtgttaaggcttcctcgcgcatgagcttcactacgtaccgggacgtgctgccctccgggctgcgcgtcgtcactatcgagacgccccacctccacaccgccctgctcgccgtctacgtgcggacgggcagccgccacgagacgctcgtcagcaatggcgtcagccactacctggagcacctcttcttccgcggcagcgagggctggccggacaccgtgaagatgaacgcggcggtggaggaggtcggcggcaacctcaacggcgtcaccacccgggaccacgggtactactacacgcccatccaccccgcgcacctgcgcgtgggcctggacatcatcggcgacatgctcacccgtccccgcctcaccgacatggaggtggagcggcagatcatcctcgaggagatgctcgacgaggtggacgagaagggccgggacatcgacctggacaacctgtccaagcacctgctcttccccggacacccgctggccctgaagatcgccggcacgcgcgagtccgtcacgaacatgacccacacgcagattctggagcacttcgcccagcactacgtcgcggggaacatcgtcgtcaccgccgccggccgggtgaagcactcggaagtcctggagatgaccgagcgagccttcgcccggctcccgcgcggcccgtccagcgtcgaggcgccgccgcccctcactccgcccggcccgcgcctgcacttcgtcagccatgacgagtcgcagacggagttccgcctcaacttccgcggcgtccccgagcagcacgaggactaccccgcgctgcagatcatccgccgcgtgttggatgacggcctgtcctcacgactgccgttcgaaatcgtggagaagcgcggcctggcgtactccgtgagcgcgtcgctggacgcgtaccacgacgcggggctcctcgagatcgaggccgccagcgctccggagaaggccgcgacggtcatcaccgaggccttccgcgtgctgtccacgctctgtgagaacgaggtgggcgaagaggagctggcgcgcgccaagcgccggcaccgcatgctgctggagttctcccaggactcgccgggcgagctgtccggctggttcggcggcacggagctgttccgcacgccggagtcgtttggccaccgcgccgacctggtggactcgcagtccgccgcgcgcgtgcgcgaggtggcccggcgctacttcaaccgggagaacctcacggtggtggcggtgggccagcgcaagggcctcaaggccctggagcgcgtggtggcggatgcccccggccttcccgggccggaggccgcgccgcgggcggtggtcagcggcggccgcggatgatgatcgggcccgaggacttcttcttgggcttcggcagcagcgcgttcagcgccttctgggtgcggaggtagtccgggttctccggctcccgcttcagggcctcgtcgatgagcttgaggccctgcgtcaccttcgtctgcatccgcgcatagagggcggcgagctgggccttctcctcgatggtggcctcgctcatgctgagcagcagctccagtgacgtctccgcgtccgtgatgcggtccgcattcaagtggatgcgccacatccgggcgtgaacgggcgcgaagcggggctccgcggacagcgcgaagcggtaggcctcctccgcgccgcggcggtccccttgctcctccagcgagcgcccgcgcacgtactgcgcccgggccagccgggggttgagctggagcgcctggtccaccagggactgcgcatccgcgcggcggccctgcacccgcaccgtctccgccagccacgccagcgcgtcggcgttctgcggctgcgcctccaccagcccgcgcagggcctcctccgcgtccgcggcccggcccaaggccagcagcacccgtgcgcgcagcgtcaccacctccggccgctccgcgtcagcgcccttcacggcgttcaggtcggactcggccaggtccgggaagccgctgaccaggaagtagcgcgcgcgcagcagccgcgcggaggccagcgccgggtcctggttgaggagccggtccatgaggttggcggccaggagctcgtcgcccttgagccagagcacctcggcctcgacggacttggcctcggcgtcgtccgggttctcccgcaggatgttctccagcgtcttgaaggcggcatcaatcatgccctcacgcgcctggatacgggccagccgcagcacgtccgcgtccggcaggtttcccgcgtcccgcatggtgatgagcgccgcgagcgcgtccttggtgaggccctgctggagatagatgtcggccagttggcgctggatggtggggtccgagcccggcaacatggaggcggcctgcttcaaggccaggatggcggcgccctcgttgcccgccatgcggtgggcctgtgccatgagcaggtgcggctccggattgtcaggcgccgcggtggcggccctgctcagcgcggcaagcgcggcgttggcctgtccgctggacaggtggccgcgggcctcggtcaatgctgcctgggcccgcttggcctggttctccgcggcggcaacttccggctctttgcaagcaagcagcggaaggagcgccagggtccacggtctgattcgaaaaagacggtgcatcgctgaggcgcagggtaccggatgttatcctccttcgtcgatggacccattcgttcggcgcctcgtggagaggctccatgaccccagcaagccgctgtcgcggaaccggcacttccacacgttcgagacccccgaggggcgagcggcgctgaaggtcgtccgacggctgcgcagcctccagaaggacatcctcgcgtgccacgcggagggctttcgcgcgcgaatcttccgccacgcgactgggaagggcgaacaccgcatcgagctcctcatggagcgcctctccggccgccgcgtctccatgctccagtccgacgaattcgagctgctcaccgcgctgcccggcgtgcgtgacgcgctggaagtgttcgacgaagcggcataggctcctcgccatggactcctgtcggcacctggcccccgtgtccctgcgccgcctgcgcggctgagcgcggcagcaagcggactgctttgcgctgttcggacgccgcagcactgcgtccgttccaggcgatgtgtgccctggtagggcctccccggtctctttgctgccttcgtgcccgctttccgcgtcgcggaaggcctgggcgcgatgtgccgcgctcctgttcctgagccacggcctcgcctggtgtgcgccgcgtgcgtgacgaacctccgtcatgcgtgcgcggcgtccacgcgcgtgcgggctgccgggcgctcatgccagggtcctgacacaccccgcgcctgagggcctcccgcgactcgttcccggccatgcgccgccacgagcctctggagccctttccgcatgtcagcgcccgcttcgccccgctttccgccgccccttcttccactgctctgctgccccatctgccagtcaccgcttcgccaggaagcaacggcgctgcgctgtgtggcgcgccatggcttcgacgtcgccagacagggctatgtcaacctcctgccgggccaccgggccccgggcaatgccgacacccagtcgatggtcgccgcgcgagagacattcctcgcgcgaggccactacgaaccgttggccgcgctattggcggagcatgccgcgcggctcaccggcgccgatgccacagagggctgcgtgctcgatgtgggagcgggtaccgggcactacctggcccgtgtcctcgaccggtgcccggcgctgacggggctcgccatcgacatctcccgcttcgctgcccgccgggccgctagggcccacgcccgcgcgggagccctcatcgcggacggcgagcggacgttgcccatccgaaatcacagcgttgcactggcgctcagcgtcttcgctcctcgcaacgtcacagagctccaccgcatcctgaatcgccgaggcgcactgctcatcgtgacacccacggaccagcacctgacacagctcatccaacccatggggctgctgagcgtcgacgcgcgaaaggaggagcggctccacacacggctgcgggccacgttcaagccaggcgtccgggaagcgctggagctgaccttgcggctgacgcgcgacgacgcgttccacatcgcggccatggggcccagcgcgttccatgcatccacggaggagctgcggcggcgcgcggacgtgttgcccgagctcctcaccgtcagcgcgtccttcaccgtggccagctaccaccgcgtggagaggaacggctccgcgcccgcctgagcagcgctcgcgcgaggagcccagaccgcgatgcgccgcgcggtctgggcccctgccccgcgcagggcatggggttgaaggccagggagaaacccggcgtcccaccccacgggctgacgccggaacggctactccggaggtccacgccggggcggaggcgcgttcttcacccgttcgtattcctcgtccgtgaagacgcggctgcgggtgaggaagcgaacgcccagcggggactccaggctgaagccggcgccccgccccttcaccacgtccagggtgaggtgcgtgtgctgccagtactcgaactgcgcgccgccaatgtagacggggcagccctccacctcgcccaggaagacgtctcgctggcccacgcggaagtcccccacggggtagcacatgggcgcgctgccgtcgcagcagcctcccgactgatggaacatcaagggcccgtgcgtggcgcggagctggcggatgacggcggcggcctcgggcgtcacgtccacccgggccaccgccgtggcgccgtcctgtccgcccgtgccggggccggcaccggcgccacccatcagaagaagcccatggccttggggctgtagctgaccagcaggttcttcgtctgctggtagtggtccagcatcttccggtggttctcccgcccgatgccggactgcttgtagccgccgaacgccgcgtgcgcggggtagatgtggtagcagttggtccacacgcggccagcctcgatggcgcgccccgcgcggtaggcggtgttcccgtcacgcgtccacacgccggcgcccaggccgtacagtgtgtcgttggcctggcggatggcgtcgtcgaagtccttgaaggtcgccacgctcaccacggggccgaaaatctcctcctggaagacgcgcatgcggttgtggccctggaacacggtgggcgccacgtagtagccgtccttcaggtccccggacagcgccacgcgctcgccgccgatgaggaccttggcgccctccttcttgccgatgtcgatgtagctgaggatcttctccaactggtcgttggacgcctgggcgccgaccatggtgtcggtgtccagcgggttgcccggcttcaccttgcggacgcggtcgagcgccttctccatgaactggctgtagatgcgctcgctgatgagggagcgcgacgggcaggtgcagacctcgccctggttgagcgcgaacatggcgaagccttccaacgacttgtcgaagaagtcgtcgtcctgcgccatcacatcctcgaagaagatgttggggctcttgccgcccagttccagcgtgacggggatgaggttctcactggcgtactgcatgatgagccggcccgtgctcgtctcgccggtgaaggccaccttcgcgatgcgcgggctgctggccagcggcttgcccgcctcgacgccgaagccgttgacgacgttgagcacaccttcgggcagcaggtcctggatgagctcggtccacagcaggatgctggagggcgtctgctccgcgggcttgaggaccacgcagttgcccgccgccagcgccggggccagcttccaggccgccatcaggagcgggaagttccaggggatgatctgccccacgacgcccagcggctcatggaagtggtaggcgacggtgtcgtggtccagctcgctcaccccgccttcctgcgcgcggatacacccggcgaaataacggaagtggtcgatggccagcgggatgtccgcggccagcgtctcacgcacgggcttgccgttgtcccacgtctcggcgaccgcgagcatctcccggttctgctccatccggtcggcgatcttgttgaggatgttcgctcgggcggtcggcgaggtgcggccccaggagagccgggccgcgtgggccgcatccagcgccttctcgatgtcctcggccgtggagcgggccacttcacagaagggcttgcccgtcacggggctgatgttctcgaagtactgaccacgcgtgggttcgacccagcgcccgccaatgaagttctggtagcggggcttgaactgcaccttggagccgggctgattgggggcggcgtagatcactgcgctctcctggggtggtttggtgaccgggccccccagagcagcgcgcgtgccagtgctcgcgtccgtcgacgttgcggcgcgtcgtgtcccgctctgcgacacctgtccggacacgcatggcgcggagcgcgacaggtgcgtcgcgcgatggacaccgtcctccagtgaacgttcaggcgcgcgagggcagcgtgatgccgaagcgctccgccatccggtagagcgtgctccgtgcgatgcccagacgccgggcggcctgcgccacgttgccgccactgagcgccagggcctcctggatggcgcgggcctccagctcgcgcaacggaccgccggcggcacccgcgctcggttgactcggcggactggaaacaggcggcacggcgggccgtggttctccttgggccccgggcgagagcgggcttcccaggcctgacggcagggcatccacgtccaacacgggggcgcctcccgcgcgcaccagcgccaaccgcagcactgtcttcagttcgcgcacgttgccgggccaggggtgggctgcgagccgggtgagcgcagcggcggagatgctcgacgtggccaggctttcttcttccgacaacctccggaggagtgcatgggccagttccggcaggtcgttgcgctcgcgcagcggtggcagccgcagcaccgcgccctggaggcggaaatagaggtcggagcggaacgtgccgttgcgcacggccgcgtccaaatccctgcaggtggcgcccaccaggcggaagcgcgagcgtcgcacgcgggactctcccacgcgcgaataggcaccgtcctccagcacccgaagcaacaacacctggagcgcgggcggcatctccgccagctcgtcgaggaagagcgttccgccgtccgccgccgccagctttccctccgcgccgccgacgcgcgcgccggtgaaggcaccaggcgcatggccgaacagttcactctccagcaacgcgggcgacagcgcgccgcagttcaccgccacgaagggccccgtggcgaccgtactggccgagtgcagtgcgcgagcgaggagctccttgcccgtgcccgtctccgacagcaggagcaccggcaagctcgtgggcgcgaaccgctccgcttctcgcaacgtggcgcggtgctgcgggtcgttccccttgagcgccgcccacggtccaggtggcaccaccgtatccgccccccacaggtcccgggacagcgcgcgaggcccacggccctcagtggaaggctccgccaccgtcggacgtgaatccgcgctcccaggggtcatgcccagggaccggacaccagaagattccagccgcaccagcaccgcgagcgccgagctcgcatcccccgtccccaccgcctccgcatggatgcgccaggccggcccctgtgaagcaagacgcgtctccaacgccgcgcctcgaaacgcggcgtccgtcagcacccgccacgaaacaccgagcgccgcctccaccgccatcggcccctgtccaccgagcaacgcgcgcgcggcggcattgaagcgactcacccgccccatcggctcgacgacgagcaccgggccatcctcacgcgacaggcgcgactccaatcccccccgcgccgcagcggccactcgggcccaggcgacctcgcgcagccgcgcctcggcggcatgggccacactggccaccgccaccagcaccagcggatccgccgcgccagccggccccgtgacgtccagcacggccaccagctctccaaaggggtcatggaccggcgccgcgtagcagacgagcccatggtgccgctgcgcgtagtgcgccggccccaccaccgcgacggcggaggactccgccaaggcagtgccaatggcattcgtcccgcgagaggtctcatcccagcaggccccctccaccaggcgcacataatccgcgtggtgggtgaagtccccgcccgagctgcgggtcgccaggatgacgccctcgcggtccgcgagcagcgccacccgccccgaaggcaggggcgccgccgacaacatctccaacatgccgcccagctcgtgccacaccggctccagccgggcccggcgctcgaccagcgccaagctgcccacacggggcccttcgtccggctgtccggtgctcggggcgcccagcgaccgtgagcgctgccagcgggggaggatggagcgcaactcc

SEQ ID NO: 983 - DNA, 9039 bp, Myxococcus xanthus
gcgctctacggtggagcgtgagcaccccacccgagccccacgaagacagtcgggtaagacaggggaagccctccaactggtaatcccgccgcgccgtcttcagtcccgtaggaacccgcggcttcagctccttcgccgcgaagatgcgctccaccagcgactgccacgtgttgtccgcctccacctcggcgcctgcgtcctggagcgccgtgagcgtctccaccgcggaaggccccacctccaggccatggcgcgtggcatgcgcatggtccgccagccgctccaggtgctcccgcagcgcgccttcaatctccacgtaggacgtcgagtccacctggacgaaacgttccttccgccgcgccgcatcgagcagccgcgccagctccactcgctcgccttccacggagagcccacccagcacgccaaaccagtcccgcttccgctccaggatgaccttcagcgccggaggcgcagcggcatggaacagccgcaccggcgcccccacccattccagctccggcttcggctccagctccacacaggccgcgagcaccgcgaggccgccctgcgcgctggtgaagcggaaggtgaagggcagctcctcgggctccgccgtgtcgagcggcaaccgggcctgaagcaactccgccgcgtcgcgctcctgaacgaagtcacgcaccgcgtgcacggcccccgtcccccgccggacgtggacgtcgcgcgccccctcccccggaatgaacgtgggactgtccggcaacgggcgcgtgcgcagctccacccggaccgccccgctcgcatgcgcttccatgcgcaccacgggggcgtagcgcagcggcaccgactcccccaagacgctccgaggcagcgccaccggcacgcgcagggacagcttcgacagctggtccagcagcgcgacgtggctctccggcggaaacgaattgccgtggcggttcagcgccgtgagcagcgcgcggacctcggggcccgcgtccagcaccgtgagcacccgctggctgtcatcccagatgtagagcccctcctccggctgagccttgcgcacccgctccagcatcgccgtgggcagcatcgcgccatccacccccgcgctcacgatgaccacgccgtcccggtcctcggcgacgagcccgaccttcacgcgctcgatacgcaccagcaggtccggattctcatccaggtggatgcggggatgccccaccagttcgaagagcagcgcgcgcgacgcgggggcttccgactccggcagcagcgccgccaagcgcgcgtccgccgccgacaattgcgagccatggtcctgcagcagcttgcgccggctcaccttcgcgcccgtgctgcgctggcccttcttgttgcgcttgtgcacgtaggccgcgagctccacgccatacccgttgatgacgtccagccgccaggagacctcgccacctccaggcccaccgggactgtcgtcaacggcccgctccagcgcccgcagcgcgcgctcccaaccgggacggaccagttcctccagctcctctccaaaggactcggaccagggctggcgcaaccactgcaatgccgtgtcgatggccgccagcaggtggacgcagaacgtcgcgccacaggagcagtcccccgtcacctcggtgggagcgaaaatcagccgggcctcgggaaggatgaagcccgcatgcgcccccacaggcagctcggagatgcgcgtctcgcggagacggaagcccggcagcggagcgtcgtactgcatcaggtccggcaccagcgcgtgcatcggccggggggcgacggacgccggaacgcgcgcacgcagcgccagcaacaggccatggacgcggtgcgtgcgagactcggcgggcggagcgagccgctcgtcgagcgaagcccgtgacgcctccgcgcccagccgctccgcctccacgaagcgccaagcgagcgtgggcagcagctccttcatccggggagacggcatcgcctccgtcatccaacgcgccagcgagtccgtgctcagcaactccacgagccttcggcgggcgagcacgggacgcgcctgcggcagccaggccgcttccaccagcggcatcagcaccgccaggctcagccgcgacaagtgctcgagcccctgcgcccgcagccacgccagcgcgtcacgggtcgtatcgaacaagggagtcacgggcttctctggcggctcggacatgcacccgcttcttcgcaaagcacgcacgaaacgcaagcagacccgtgacgcgaggacgcaagacggctgactgccctgcacggccccgctccactttccgtatgtccctgccgatatggccgtcctgaccgtggcgttgtcaccctacgacagacgtcccgcgtcccctcacggaggcccgccgatgacgatgaaccccgcgttcgtaagcatcctcatgctgctcgcactggtgggttgcacgaaccaccgccagacgctgctggagcgcacgagcagctatgtggtgtacgacatgcccgcacgacaggtcatgaaggccgccgagacgatcctgagtgagcgcggctatgccttgctacccagcacggacccgatgttcctcatcacgccgtggaaggtctccggcaactacgacgtcttcacccactggtcccgcgtctacgtcgaggggcacaagcgtcccgacggtcggttcaccgtgcgcgcataccatatggccgccaacatgcccgcccggacgcagtcgctgccgacgccggagacgacgaccatgacggcccccgaggagaagcagaacatcatgcccacggtcctgctctccaccgagcccgtactggtgcgctccgccaggcccaacctccgcagggacctcaatctcgaatgggccatcatggagcagctcgacccagacttcgccggacgcgtcaagacgcaggtcgacgtgtatctcgcccattcgtcctcgaagcggccgggtgacgtacttgaatgacctcgcctgcttcgatatcccgcgagggctgccaaggagcgtccccgcgtgaagcaaagcgtgtttggtctggtcgtcgccctgtcactgaccgcctgcaaggaagagccccgtgggaagatggagcccattccccgcccgccggggatgaaggacgctccgcctcccgcggaagccgctcccgcggctgccgcggagccacccgtggacccctcaaaggtggtcctccggtggaagattgcccagggcgcgccctcgtcgtaccggctcgacatcgagcgcaccggcggcgcgcccgccagcaccgaggaagccgcgccccccaagagcgccaagggcaagggcaaggagaagcccgcccccgtcgccgcggcccccgcggtcctgcccgggcccgtcacctacttcatggagcggaccgactcgggtgactaccgcctccgcgtcgtccctgtgggcagcaacgtcgacgcggacacggccacgctgagcgagcgcggcttcgtgctcgacggcttgcaaggcgccacccgcaacaccgccaccctggtcctggagctgccgagagatccggtgggcaccggtgacgtgtggtcgctcggcaccgagctgatcctcatggaggcgctggggccccagttccaggccggccagcccgagcggagcaaccgcgtgaagctcgccagcctgacgcccgccgacgggggcgagcaggtggccacgctggagtacgccatctccgagaagctggccggcaaggtccgcgcgaaggatgagccccccacctcgcccgcgcgcgccgaggaggaagacgcggaggcggacgactcgggacgcccccggccccgggccgcgcccgaaaccagcgccagcgccgaggtgagcatcaccggccgtggcgagttcctggtgaaggccgggcggtggcgctcgtgggaaggcaccgtcacgtcggtgacgaagggcggcttccccaccgccgcgctccaggtgcccaccggcgccctgaagctgcgcctcaccgcggtggaatcggctcccgcgccgacgccaacggcccagccacagcagtaggcggcccgtccgactcgcgcaccatgcgcaccacggcgtccacccaggccgggtgggcgttgagggaggggaccaacgtcagcgactcccctcccgcctccaggaactgctcccgcgcgcggaggccaatctcctccagcgtctccaggcagtccgccacgaaggccgggcacatcaccgccaggcgcttcacgcccttcttcgccagctccggcaacaccacgtccgtgtacggcttcacccacggcgtgcggcccagccgcgactggaaggacacgctccacccctccgccggcaggcccagccgctgggccagcccccgcgccgtcgcgtagctctgcgcgcggtagcagtggcggttggcgtccgtcatggcgtcgcagcacgaggcggtggacaggcagtgcgtccccgtggggtcgctcttgcgcatgtgccgctccggcaggccatggaagctgaagaggacgtagtcggcgcgcgcgtcgtcaatcaccggccgcgccacggccgtgaaggcatccaggaagcctgggtgctcgaagaaggccggcaccgcgcgcacgaagggcacgtcccacgactgggccagcacctcataggtgcgcgccagcgaggacgcggtggaggacgcggcctcctgcgggtacagcggcagcacggtgaactccgacacgccgcgcgccttgagcgccgcgatgccgtcggggatggagggcgagccataccgcatggccagcaccacctcgtactcccccgccagccgctcggccacctgggccgccagggcctggctgtacacgagcagcggcgagccctccttcatccagattttgcggtacgcctccgcgctcttcgccggacgcatcggaaggatgatgaagttgagcagcgcccagcgccccagcgggtggatgtcgatgacgcgcgggtcattgaggaactcgcgcaggtagcggcgcacgggccccgtctgcggagcatccggcgtccccaggttgacgagcagcagccctcgcttcgaagtgggcgttggcatcagtgcagggagttgggaagggtgagcgcgaactcggcgatgcgcgcttcgaagtgcgtgccgtccggccgcaccatgtcataggtgccgcgcatggtgccgaagggcgtgcgcagcatggcccaactcgtgtactcgaaccgctctccgggccccaggtggggctggcggcccaccacgccctcgcccctcacctcttccaccttgcccgtggcatcggtgatgacccaatggcgcgccttgagctgcgccggcgcgtcgccctcgttggcaatctccaccgtgtacatgaaggcgaactgcccggactccggagcgctgcgctccggccagtaggcgggcttcacggtgatgcggatgccgtcggtgatggcgctggaggacatgcccccagatttggcggcaacggcgcccacttgcaaggaaaacgccgggttggaagccccggcgccctgcctacgtcttcgcgctttcccggtcctgtccgggctccggctgcttcggccacaccagcgaggcgacgatggccgccaccagcacgccggcaatcacgcccagggagatgccgatggggacgtggatgtcgaagaaggtgatgagcatcttcacgcccacgaagcccaggatggcgctcaggcccaccttcaggaagtggaacttctccatcaggctggccacgacgaagaacagcgagcgcaggcccagaatggcgcacacgttggacgtgtagatgatgaaggcgtcctggctgatgcccagcaccgcggggatggagtccagcgcgaagagcaggtccgtggcctccaccaccagcagcacgatgaacagcggcgtgaacttgctgcggccgtcctcctgcaccatgaagcggctgccttcacccagccgggccaccggcagcacccggcgcgcgaacttcacgatgccctgctgctccgggtccatctcctcgtccttggacaccagcatcttcaccgcggtgaagacgaggaacgcgccgaacaggtagatgagccagtggaactgcttcaccagcgccgtgccggcgatgatgaggccagcgcgcatgacgaacgcgcccaggatgccccagaagagcacccggtgctggtgctcgggcgccacccggaagtagctgaacaccatcaggaagacgaagaggttgtcgacggagagcgcgtactccaccacgtacgccgtcaaccactggagccccacggtgggcccctggtagtgccagatgcccgcgcagaaaatcaggctgagggtaatccacaccagcgtccagaggcccgcctccttcggcgtcaccgcatggtccttgcgatggaacagcccgaggtccagcgcgagcatcgcgaggacgaagacgttgaaacccacccagagcgcgacttgcgtgttcacgtagcaatcctgttgcagggtatgacggggcgcaccctaccggcgggctgcccgggcgtcgacccctcgcgtgaaacccgctggacctcctgctttcgtccagcgggccccttccggccccgcgggggctactccgtcgccgggcggcgcagcaccgccagggagcggcccaccacctgcacggtgccccccgccggcgtatgcgtgcgaagcgactcccccgccaacgccgtgtccaccaccagctcccagtccgcgccccattcgacagcaggcagcctgaaggtgatgggctcgtggtgggcgttcatcagcaccaggatggtgtcccccacaatccggttcccttcatcgtccggcgcggtgatggcgtcaccgcccagcaggaatcccagggagcgcacgtagggcttctcccagtcgtccttgcgcatctcctggccatcgggccggaaccacgccaggtccttcagctcgctgtcccacatatgggcgccgcggaagaagcgccgcttgtgcagcaccggctgctcacgccgcagcttggtcagggcgcaggtgaagtccagcagcgcgcgctgcgtgtcgttcagctcccagtccacccacgacagctcgttgtcctggcagtaggcgttgttgttgcccttctgcgtgcggcccatctcgtcgccggccaccagcatgggcacgccctgggacaggaagagcgtcgccaggaagttgcgcttctgctgttcgcgcagggcgttgatttcggcgtcggtcgtctcgccctccaccccgcagttccaggagtggttgtcgttggcgccgtcgcggttctcctcaccgttcgcctcgttgtgcttgtcgttgtacgtgacgaggtcgtgcagcgtgaagccgtcgtgcgcggtgacgaagttcacgctcgctgcgggcttgcggccggacagtgagaacaggtccgagctgccggtgaggcggtagccaatctccgccgcctgccggtcatcgcccttccagtagcggcggatggtgtcgcggtacttgccgttccactcgctccacagcaccgggaagttgcccacctggtagccaaagtcgcccacgtcccagggttcggagatgagcttcacccggctgagcaccgggtcctggtggatgatttggaagaaggcggcgcgggtgtcgtagccgtgcctgtctcttcccagcgtggtggccaggtcgaagcggaacccgtccacatgcatctcctccacccaatagcgcagggagtcggcgacgagcttcagcgcgtacgggtgcgtggcgttccacgagttcccgcacccggtgacgtccaggtagtagcgcgggtccttctccgtgagccggtagtacgccgcgttgtccacgcccttgaaggacagcgtggggcccagctggttgccttcgcaggtgtggttgtagacgacgtcgagcagcacctcgatgccagcgcggtgcagctgcttcaccatgcgcttgaactcgtccacctgcccgcccagcgaacccgagccgctgtagcgcgcgtccggcgcgaagaaccccagcgtgttgtagccccagtaattgaccttctcgcgctggatgaggaaaggctcgtcgacgatgtgctggatgggcagcagctccaccgcggtgacgcccaccttcttcaggtgctcgatgctggccgggtgcgccagccccgcgtaggtgccccgcagcgcctccgggacgcgcgggtgcagctgggtgaagcccttcacgtggacttcatagatgagcgtgtcgtgccacggcacgccaggcggggtatctccctcccagtcgaaggtgtccgcgcccatcaccacgcccttgggcacggcggccgcgtcatcgcgcgtgtcgaacgcgaggtcgtcctccttggtgcccggcgtataggcgtagatgggggcctggtagtccacctggccgtggatggcccgggcatacgggtccaccaacagcttgtgggggttgaagcgcagccccttcttcggctcgtagggcccgtgcacgcgcagtccgtagagggcgcccgcggccaggccaggcacgtagccgtgccacacctggtgcgtcgtctccagcaagggaaagcggcgcgtctccttcgcggggtcctccggatcgaagagacagacctcgaccttcttcgcgtgctcgctgaaaacggcgaagttgacaccctgcccatcgaacgtggcgcccaggggatacggcttccctggaagcacctcggccctcctcatccggcgctcctctccagcagaatcaccggaaactccgccaggagcggccccagaggcaacaccgcaccacccggtccacgctcgggccgcacctgacagccggtgaacacatcgcggaacatcatgcccgcatatgcctccggaaggtccaggaacgtgctgccataagcgcccgccagcccttcaggggactgcagggcggacagggtgtaacgcggcgcgcaggccaccaacaccgtgtcgccgtgctcgcgggcga

SEQ ID NO: 984 - DNA, 8832 bp, Myxococcus xanthus
cgatgatgccgaacacggcgagccccgtgagcggccctcgaacgcggcgatgccggtgagcgcgacgttgaaggcacgcacctagggccaggtcacatgtcgctccacgcgagctgtctcaacgcccaggcgcgagaggagcaggtggaacgtgcgctcgtggccgtgagccaacgtgccgcgtccgtgctcgtcgaagatgttctccaccagcggcagccgctggtggggccgaggcagccggctggcgagcatcgccatgggcctggagaagtgcgccaccgcggaggagaactggagctgcgtttcgacgaagtcctcccgcgcgaaggtgccgtctctcagcgcgcgcaggtagggcgcatccaatgcgttccactccgccttgagcccggcgatgtgctgacgcagcttcaaatttcggatgagggaaggtgcacccatgctggcgctctggcaggaaaggagaggtcgagagaatagacggtgcacaccgaatcaggagcgatgcccacctctcgcagccagtggacgtggtcctccagccgctcgtcgatgctgaaacaggcgagcgcctcctccccgagcgccgccagctccacaccgcaggtacgaaggtactcgccccaaccctgcgtccaggcttcgggcggcgccgccagatggaccagcggccacgggcgccccgtggacaaacgctgaaggtccttggcccccgccgtggtgcaccaccccgccccttccagcgtcctggcgggcgcgggccccagacggagccctgctcccgtggggcgcgggggtgcactccgcgtatccaccgcctgaagccgagcgggcggcacgaagtagagcgcgagctggctcgcggggcgccccatgcgcagcggattccacccacgggcgatgcgcatcacatcgccccgggcgccgcgcatggccgcgccgtagaggaaacgaatccggcgcagcggaggaatgaggaagaggtgcttgaggccttgaagcaggagcttcgtggagaggccggagccccgcgcgtgcttcgccagcttgaggtcgcagatgtagagcgcgtccaccttccgcgtcccgtgccacaccggacgcaagacccccgtcacggaaccgagcaagtcgtcgccacggagcgccagcaggaagtacgcctctcccatggaggagaagaacgggtggtacccgggcccatggtcgatgaagaagtggtcggccccatccgcgagtggatagaggatttcacgctccagcaggcgcagccgctcgacatagggcccgagcgagtcgggccgggcaacgatgaagcgcacgtcactcatgggctgtctggcacgcggaagccgacctcgatgcgctcgtagaacaggctcctgtccctggcaagcagctccgcgccgagcgcgtcatcgaactcgaaggcgggctggaagaagccgcgaaggtcccggcggttgttgagctggcggatgaggacggcgcaaccgggccgggcctcacgtgcgagcacccccgcccactccgccaccagcgcgtcttccgaccagtcgaagatgttggagagcgagatgacgtcgaagcggtccaggcgcggcacatccggcaacgagccctggacgagcgtcagcgccagcgggccttcagcccggagatactcgggggcatcctcacgcaggtacctgccgagcagcacgtgctggaggaagggatttcgaggcgcatcctcgcgctggagcccgcgttcgaagaccgcctggaaatagccaggatacgagccgggctcggcatgctgggtcgccgcgggaccaaacatggtgttcagcagcggcgccgccagggccagctcgaaggccacgggccagtagggcgaagcgaaccagcgggcacaggcctcccggcgttgtgaggccgtggtggccggcgcgaagaacgcggcgagttcatgcgcgggcgcgacgaactcctcgatgaagcggcggagcgtgcggaagagcccctcgaattcgccgcgctgattcagggccgccgcgtcctccgcatccacgctgtagcgcgccagcggaaggcgaccgagcccctccgccttctcccggacatgcgcgagctgacgcgggttgaaatcgaagcccaccagctcgagcgctggatggcgccgcgccagggtgaggagtgtgcaacctcccgaggccaccgtgagcacggcccgcgcccgcgtgcgctcgacgagcgccaactccagcgcggcatcctcccggacaacggcgaacttcaagcgaaggggcggcgtcgaaaccaggccaggttccatggcatggttctacctcggaacccccatgccgctcgcgacagaatccctcaccccttcgcagttgcgtgaattggagcaggtcgatgcgcggcacgttccgcggctcgccgtgttcctcatgctctacctgggcgcggcggcgctgtccgtggtgctcgcggcgcgggacacggcctggacagactggctcgctcgcgccccgctgtacctcatcgccgcggcgtcgttacatggcatcagcctgttcacccatgaggccgtccacggtggcctcgcgcggcggccctggttgaaccggctgggtggcatcgcctgcgcgctcccggtgttgcagaactacgcggcctacaaagtgctgcacctgaaacaccatgccgacctgggcggagggaaggacccggaccactacgccaactacacgggtcggcggtggctggagttgttgatgcatgtgggccggctgctgctcggttatcccgcttacatcacgatgattcccatcttgggttggcgacagggaacgaccgccgagcgccgatgggtgctgttcgaagtggcgctggccgtcgcgggcctgacggccgcggtcatcttcatccccggacaggtgctgctccatgcctgggcgattccgatgctcctcctcaacaccctggtcaacgtccggggcatgagccagcacaccttcctgccagagagcacgcacccggtccgaggctcccggaccatcctgtcgaacccggtgacgcgcttcttcatgtgcaacgagaactaccacctggagcaccacctgtacccccgcgtgccctggtacaatctgcccgagttgcaccggacgctgcgcgcggacctcgtcgcgcagggggcccccttcatcccgtcctacttctcgttcgtgcgcggcgtcctctccggttcgctcatccgaggggcgaaacccgccacgcccgatgcctgagcggctgtacccgcacgaagtcctgctggcggcgttcggcatcgtcctctccacagcgctggtgttcgtcgcgggaatctccgcgaccgtcaccgcgcaagccgttggtggcacggtgctgttcatgggcagcgtggcgctgctggcgcgactggacgcagtcgcccatgtcttccgggcacggctgctgctcgcctacctcgcgacgttcttcttctatgcctccgtgaagcaggccgtccccgcgctggggctcgtgacgcgtgatgcgtggctcctgtccgctgacgtgttcctgttcggcatcacaccggccgcatggctccagcggtggagcacgccctgggtcaacgagctcttcagtgccagctatctagcgttccacggatacctgcacctcgccatggcctgggcgctggtggggccgcgtgcgcgagcggagcgcttcttcatcgacgtcttctccgcctatctcccgggcatcgccggctactacctgatgcccgccatcggtcccgtggccgcctggccggagctgttcaccgtccccatcgagggtggctggttcacgcaactgaatgccgccgtcgtggcgagtggttcgtccacctacgacctcttccccagcctgcacacgtacatcacgctggtgctgctcgaacacgaccggcgccagcacccgtggcggttccggctgatggtgcccgtcgccgtggccatcctcatgtccacgctggtgctgcgttatcactatgccgtggacctgctggcgggcgccgtgtggttcatggtgtttcgcgcctgcttcccccggcttcaggcgcgctgggaggcgcggacggcgctatcgaagcacgaagcgccgacggtgggcgtcgggtgacagtccggtgcgcgccttgaaggaggaatggaccgtggtcatccgctacacgcatgacgtggagaagacgtccgagggctggcgcatccgccgcgtcatgctcgccccatccactaccggggcaactctgtggggctggagtgcgtgaaagacaagcgccgcgtctgaggcgtcaatccggttcgcgcgttgcggcgcttgtccgcagcgcgcccggaagccgccacgccaccacgacggtcgcaagcattccacccgcccccgccaccagcagcgtcacgggcgcggacgtcgcgtccagcaacaatcctcccgcgacgtaggacagccccgccgccacaccaatggcgccgtagaagttgccgaatacccgcccccgcatcccagccggaacccagcgctggatgagcgtgtggctggccacatccatggcggcgatgcccacaccgcgcacggcctgcatcgcgaacgccgcggagacggcccaggccaagccggtcagcaggttgcccatgctgctcaccgcgaagcccagcaccagcatcaccggcatcgccgcccccgcgcccagccgcgccatcagcacgtagcccgcgaccaggcccagccccaccgcgcccagcagcaaccccaccgccgagtcccctgcctggaaggtgtccttcgcgagcaacaccagcgccacgtcatccacgccgttgaaggccaccacggcgcagaagcccaacgcgacgacgcgggccacccgcgcccgccagaggtagacgagcccgtcccgtgcctgccggaacaacgacacgggcggcgcggcgccgtcatgcgcaggcggcacggacggcagcgccaccaacaagcccgcggacaggaagaaggacgccgcgtccaccagcagcacgccctggagccccacgagcggaaacatcgccgccgcgagcaacggccccaacgcttcggcggcctgcgtcccgaagcccacgctggcgttggcggcctccaggtcctcgctccgcaccaacgcgggcaccaccgcccgggaggctggctggaacacctgtccggcaaccgctcgcgcggcgaccagagtcagcagtaccggcagtggcggcatcgtgagcgcgatgagcaccaggagcgcgccctggagcaactcgcaggcaatcatcactcgcttgaggtcgaaccggtcactgatggccccggtgagcggccccagcaaggcgggtgcgaagtcccccacgagcagctacagggagacagccagcgcctgccccgtctgctccgcgacgtacagcatgagcgccaccaggctgagcgcatcacccgtgaaggagaggactcgcgcgccccacaaggcccggaacgccgagtggtgacgcagcaacggcagggcccctgtcccgcgctcacgggtgtttgaatcactcgctggagccgacatgcgccgcgcgtctccacccttccggaatcaggcgccgacaccgtagaggagacgcgtggcgggcttcaattccccagccacgaacagacgggcatccggaccggttcgcggtggtggggcagcgcagcgcggacacccacggcaccctcaccaacctggtgcgcccagacagcttccggttcatgtacaccgagatggaagttcttcgtcccgaccgctgcacattccatggcgtgggaattgtcccggatggagagattgtgcccaccacggaagacttcgcgacgggcagagacgcagcgcttttgaaggccatcgacgtgcaacaggcacacgagcaggtgctcgctagagtgagtgcggacggcgcctttcgatgcgggcgtgtgaagcgagaggatggcgctccacaccccgtggaaaggagcagtcatgaactcacgtattcttgctgtcgctgtcctgggtgccgcgatgttcaccggctgtggtgagccggaaaccaccacagaggcgcccgctggagaaggcgttgtcatcccgccagtggagacgcaagaagggtccgccactgtcaccgccgccgcgtactgcgacgacgtgacgacatggaattcggcgtggacggccctggaagaccaggtgctcgtgctcgtcaacgagcgccgcgccgcgggagccgtctgtggcggcgtggccaagccgcccgcgcccgcgctcagcaacaacccccagttgcggtgtgcggcgcgcaagcactccaaggacatgggcaccaacaacttcatgagccacacgggctcggacggctccacgccctggcagcggatgaactgggccggctacacgtaccgcaacgccgcggagaacgtcgcggccggctactccacggccctggccgtggtgaatggctggatgaccagcaccgggcactgcaacaacatcatgaacccggcgctgctggagattggcgtcggctacttcaacgcgccgaacagcacgtaccggcactactggacgcaggccttcggccggcagtaacaccggtctagaatgcgtggccgggcgctcatccagggcgcccggcccgcctcgttcgtcatggacttcctcctgctattcgtcggtctcatcaaggtggtgttcggcggcctggtcgccgcgctgggcatctggctcgcgctgcgtggactgagccgcatcctcggcgccaaccccgtggaggagctgcgccagggcaacgtcgccgcctgcctcgtccacgccgccagcctggtgtcgctgggcctgctggtgcagcacgcggtgcaggccacgtcggacgcactggacctcaccgtgcagaatccgccgctgcatctgctggtcgtgggccggctggtcgcggtggccgtcctgcacgtggggctgtcactgggcgtgggcgtcacggtgctcggcacgggcgtgctgctgttcgaccggatgacgccgggcatcgacgagctggcggaagtgcgcaagggcaacgtcgcggcggcgctcatcctctccgccatcctgctggtgctggcgctgctgaccgccccgggcctccaggcggcgctcaacgggctcatccccttcccccagctccttaaagggacgctgcgcgcgcccgcgtgaagacgttcttcaagtggatgctcggcgtggtgggcctcgccagctgcttctgctgctgtggcctgggcacgctgggccatctggcgggcatggacatcgcgccaccagagcccggccatcccagaggcgcccgcgcggtggatttgggattggtgctgctcccgccgggcacctcaccgcagcgggcgcgtgattacgactggcgagcggacagcatccagccccccgagcaccacgtctcctacggcctggggacggcgctggcccagacgctggcggatgaacacgcggcgctgggccgccggctgcactaccgctcactgggcagggagcgcttctcgttcaacgcaccgcccggctgtagcgccgacatgcgctgcatctacgaggaattgatgcgcaccaacgccgagcccgtgcggaggctgggtgacaccttcgtcgcctccatccgcgagcggaggctggatgccgcgcaggccacgcagctcatcctcggcttcgttcagagcatcgactacgaactgccggagcacgaggccttcggcatcgtcccaccggcgctggtccccgccgagaatcgcggcgattgcgactccaaggcggtgctcgcggtgatgctgctgcggcaggcgggagtcgacgcggtggtgctgtactccgacccgctgtcccacgcggcggtgggcgtggggctgcccggcaagggcacggcgctgcgctacgccgggcgcagctaccagtacgcggaggtcaccgcccagggctggccactgggcatgattccgccccaatacgacaagccccggctgtggaaggtgctgcccctcaacgggggcccggacaccgcgggctgacgcctctgggcatcagtccgcctcggcgcctggcgccgcgagcaggccccgcaccaggtgctcgtaggcctccttcattggcagctcggagtcgaccttgagccgccgccggagtgtctgggtccgccggccatcccgtgggtccacgccctccttctggtacgcctcccaccacaccccgcttccacgccgttgccacaggggcacgtcgttgaagttgatgcctcgctggaagagcagctcgttcttgtagctcacgggcttgccgtccagctcacgggtggcctgcgccgcgctccggccctccttgcgcagcgtccagtagcaccagccatgcagcgaacaccggctgccgtccgcctgtcgccagatgaagtagtccagcaccgcgcgctccgatgcgcccagccatgcacggccgtcgaacaccgccgggacacccgcggcgtgcgtgaaggtggcgctggccaggcccgccgccagcgataccaccttctcgacggagcggtcgaagagcgcccagtccggccggaagagcacggagatttcgtcgctctgcgtgtatgcgtagacgccttggagttcctccagcatcacgctggcggtgcgcaccatgaactggtggaacaccgggtcgaagggcttctcgtagcgggcctcggtgaagcgcgagaagccccgcccatccacgcgcagcaccacccaggcacccggcagcatgccttagagcgc

SEQ ID NO: 985 - DNA, 10301 bp, Myxococcus xanthus
tgctctaaagggccgacggcttctgcctggcgctgacctgcacctgcaccacatgaccgctctacatgctacacaccgataatgtgcccatgacagacgatattccctgaaggccgcctgctgtgcgacccctaagtctcccaactgcgagggacagatacaggtgcgtcgccactgcgagctgaggcgccacctacccccacgggggccccacagaagcactcacccaccaggagcactggatcgccatctcctgagaccgtatgcaacgacttttacggaactccgaccccgcaatgctggagacacactcctggggcctgggaacgggcctgttcataacccgtaagatggcccaggccatgttcggcaccatcacactgtcgttttgtcaaggaaaaggctccacgttcatactccgactgtgcacgcgggccccggagccctccaaagcccccgtggccactcggtatatttacgacgcgaaccccccgggcgcccgcgcgtggcaccccagggggcttccccgcgcttcagttgccgcggaggaccgtcaggcctttgtcggtgaggacgtacagcgccgccggcgccacccgcgggtcgtagatgagctgccgcacccgggagccgctcacgtccgccaccttctccagcgtcttcagcggcgtgaggcgccacagacccgtgcggtccgtgccaatgtagagcgagccgtcaccggtggccgccagcgcgttgatgttctggagcgcggcgttctgctccgcgttggcgccggtcagccgggtgcccgtctgggcctgattggaggcccacataatcgtcatctcccacaggccgtggtccttgctgcccaggtagtagcggccgtcggtcgtctgctggaagccgcgccaactgtcgagctcactgatgctgttgagctggggcaggtaggaggactccaccttcatccggttgacgcgcttgtccatgttgtcccagtcgccgtggtggggcgtcggcgtgacgatgccgaacatccactcgttggcgatgaggacgtccccgtcctgcgcgatgccgagcccgtaggtgtagcccgccatctggctgcccttctcgttgagccacaccgggtgccggtgggagttgtactccaggccgcggatgcgagtgacgccgtggttggagcccacgtagacgtcgccctcgtcacggccgtgcatcaccgtcacgcagctcaggatgctgcggtcctcgtcgaagtggtggtcgttgctgttgcggatgcccaggttgtgcacgtcatccagccggcgcgggcctgtctgcacgcgggggttgccgttcgcgtccgtcgagttgcgcaccgattggtgcaggtgctcctcgaggacaatctgcctgctgccgtccaggcgcaccacatccacgtcaccctgcctgtagtactggagccggcgatggctgtacgggaagcacggctgcgccgggtcgggctggtagcactcgttggggctgacgatgtagttgggctgcagtcccgggaagtccgggtccgcgcgcaggtcggtcgtggcgtagcccacgtaggcgcggcccgcgctgccaccacagatgacggtggagccggtggccgctcggtccggaccgaagccgccctgggcctggccaatgggcgcgcgcgtccagacgacctgccgcgagtccgcgcgcagcacgccaatccggtcgccatccagcagccagatgttgtgcgcggcatccacgcccaccgcctgcgcccgggagatgttgtagcgagacgagtagttcgtcaccgcgtccgtcggccacggtccttcaacaggaccgctgcccgcgtcagcctgtggctccgagcctgcgtccggctccgtccccgcgtctgattgcgtgccggcgtcgggctctggtcgcgtcaccggtggaatgttgtcgatatcgttgcccatcttcggggacgtgggctcgttcgaaccaccgcatgcccatgccgtcatcaccactgccccgagacacccgccccacagtcgtcgattcaccgcttcctcctcccgggggacgcagagcaattcgcataccgggctttggacgcctggccgcccgggaaacagggtctgcgtgggcaaaacgtttccctgtctggagaagaagagggtctcgcggtgacgaaaaacgaacgggcccgcctccggtgtggaagcgggcccgttccgaggcacgatgcgcgtgtcgccaggattaccgcgtcggcgtgccgtcgagctccttgtcgacggactcatgcggctgcgtgccagcgccgccggtgcctggctgcttcttcttggcacccttggggctggtggcgcgcagctccagcgcgacgacctcatcgccctccaactggaacttcgcgcgcaccgaggcgccttccggaatctcatccgtcttggcgaccttcttgccgtctagcatcagcaccgtcttgtcgcgcacgtccaggtccgcgtcaggcaggcccgggcgggacaggctcacgccgtccgcggtggcctccttgagggtgccttgcaggctcatggccttgtccatcttgaaggtgccttcatcctccgtctggatgcctgtcacgtccttggcggccttgccgatggcgggccccacttcggtggcgtccacgccggtgctcttctccgtaccggggcggggcacctgcgtttgcgacggctgctgctgtgcgaacgcggcgcttcccacgcacaatgcgactgcggcgatgagcttcttcatcatccttctccctgggttcagttcggttggaccgactgctgggagcaagggtggggccgctttctgctctcgccaatccaggccgagtgccccaggggcgcccctggccccagggcagccgggcaggcgcccacgctcagttgggcaactgactgagccgcttcaccgcgttgagcagctcgcgcaggtccagcggcttgcgcagccagccggcgacgcccaggccttccgccgcgcccttcacgtccaggcccgcgctggccaccagcacggggatgcggtcgaagctcgtgtcgtgacgcagcgcctcatggaaggcgaagccgtccatgcgcggcatcatcaggtcgagcaggatgaggtccggcatggattcgacctggcggagctgtgtaagcgcctccaggccatccgccgcgagcaggacggcgtagccttccagctcgaatacatcctggagcgcgtcacggatgtcgaggtcgtcatcgacgaccagcagtgtctgaagcggttgcaccaaagcctccggcgaaggcggggcagtctcccctgcgacgccgtcgccacgatgtgtccgcctcccggaaggcggaagcgcgtggctggcctgggggcgggcaattgctcaacccccgacgcatgccaggccgctctccgaacatcttcccggggcggggcggagtgcgcgctcctggggccgcggaggccccgtcactcagttgcagccgtcgcagagaccgcgaagctgcacttccaccgagcgctgggacaccgcgcggggcacgcccttcgaggacgcgatgcggactgactcctccgggaggcaggccacggtgccgcagtcggtgcacgtgaagtgcgggtggctgccgctgtgccccccgcccgcgcgcttcagttcgaagcgccagacgtggtcgcccaggtccgcccgcaccacgagcccggcctcggtgaggtccgtcaggtttcggtagatggtcacccggtcgtagccctcgtcacccagcgcgtccaccaggtcggcgtggctcatcggggacgtggcgtcctccaactcccgcaacaccgccacacggggcgcggtgctgcgcaggcccgcggaacgaatccggtcctgaaactcagtgagcttcggctgcacggcacttctctttgctcccatgatgccctttcgataaccgatttgacggccactttcaccctgctgagacctggagcgttgagtcctcacgctccgcgtcatgcatcccagcgggtctcccccgactcctcgcacatgctcccggtgttgtatctgcttccaatgcaatctggatgcagaagaatcttcgttgccgccgtgtctgagtgagccgtgagtccaaggtccccatccggtgcagggtggcaggcgtgtccggcgtcacccgacggcggggagggtgcgggaagctggagctccggaagccgcgcggcatgtcactgggaaagacctcggggagggcgggctggccacaggtggcccctgcctgcccggatgcgactgttgacgggataccgctgccgccgtggatgcatccgccacgtaagtgcgtttctggaggggggaggccgagggccggcgaccgactggcggtcatttgcaccggagaacacttgccgccggactgcttgactcgctgcgaccggtgcccagactgcgcctctttccttcatctggggtgtcctgacgccctggccgcccgcccgccttcgattcgtcgtgatgacgccctccctcctgctcatcgaagaccccggtgcctcccgggaactccaggtgctttccctggaaagtcagggctggcgggtctgggcttccgcagacgttccgggcgcactgacgctgctgcagacgcagtcggtgcaggtggtggtggcggcggccggcctgctgatatcggatgggacgcacctggagtcactgcggcacgcactgtcgctggcgggcgccctgttgcaaatcagcgccttccccgcagagcgggaggcgctgcgcccgctcggcttgtcggtggagcgctacctgagccggcccctgtcgctgggggcgctggtggaaggggtgcggcaggccttcccggtggaggcggccggggggccggaggcacggcggccccgcgtgctggtggcggatgacgacccggtctcccgcaagctggcgcaactgcacctggcgcctttccgtttcgaagtggtgctggcggcggatggcgccacggcgctggacctggcgcggcgccgcggtccggacgtggtgctggcggacgtgctgatgccgggcatggacggcttcacgctgtgcctgggcttccggcaggaccccaggttggcccgggtgcccgtcatcctcacgcacaccatcgcgcccgacgagctggacttgcgcatggcccacaacgtgggggccaacggcttcgtgcgcaggacgcaggagggcgacgagctggtgggcgcgctgctgcgtgagctgcgcgccggcgggccttcccacacgtcgccacccgcggacctgagcaccgaggaccacctgtaccggatggtgcgccagttggagcggcgggtggggctgctggagcaggccgagcgcaccgcccgggagagcgaggcgcgctaccgcctggtggtgagcggctcctacgacggcatctgggactgggatttgcgcggccaggccttctactggagtccgccgctgctggacatgctgggcctggggccgggggacttcggcgggacgttctccgccttcctggagctgattcacccggaggaccggccggaagtcatggccgcgctgtccgcgcacctggagcggggcacgccctatgacgtgactctgcggctgcggcacgtcaccggcacctggcgctcgtgcgtgagccgtggccgggcgctgcgggacgcgcagggccgcccggtgcggatggccggcatcattggcgacgtgacggagcagttgcgtctctaccgcgagacgcaggaggcggtgcgcgcgcgcgacgacttcctcagcgtggcggcccacgagctgcgcaccccgctggcggcgttgcggctgcgcgtgcagggcgcccagggcgtgctgcgcgcgggcctgagcagcgggacggagcggctggagcgcgcgctggattcggcggaccggcaggtgcagcgcctgtcggacctggtggagtcgctgctggacgtgtcgcagctccagggcggcgcgccccggctgcacctggaggacgtggacctggcgctggtggtgcgcgaggcggtgtcccgttcggaggacgcggcggcgcgcgcgggctgtctgctggtgctcagtccgctggagcccacgccgggacggtgggacgcggcgcgcctgtcccaggtgatgacgcacctgttgtccaatgcgatgaagttcgggccgggcaagccggtggaggtggcgctggagtccgggcgggacgtggcgacgctgatggtgaaggaccatggcatcggcatcgcgcccgggcggctggagagtctctttcgccgcttcgagcgcgccgtgccggtgcggcactacggcgggttgggcctgggcctgtaccgcctgcgccgcatcgtggaggcgcatgggggcggcgtgtccgtggacagcacccccggagcgggcgccacgttccgcgtccgtctgccgcgcgagggcccgcccgcggtgaggggctgacggcgtccctcggctgacccgagtgagtcccggcaggtgacgagcgcgtcccgctcctctggcgacaaccggcggaacgcctcgtgtgaggacggccaggccggcggcgtccgcaccgcaggcacgtcgggactgataccggcggtcccagcggggcacgtcgttgttatggactgtctgccagtgtgcgctgcaacagccccatgcccggcaatgtctttcaacttcgcggaatcgctctaggttcggtggccgtttccaggggacgccatggccgatgtgctcgtcgttgatgacagcaaagttatgcgcgacatggtggtcgcgtgcctgcggccctatccgggcctcaccttctcgcatgcttccagtggcttggaggccatcgagcggctgtcgctccagccgtgtgacttgctggtgctggacctcaacatgccggacatcggcggcatcgaggtggtggagttcgtgcgtgggcaggaccggctgcgcgagctgcccatcatcatcgtcaccacgcggggagacgaggcatcgcggacgcgggcgttggcggcgggggccagccgtttcatgacgaagcccttcacgccggacgccatcctgtcggaggtgcgtgggttgctggaggggaggcgcgcttgagcgcgtccgtggacctcgcggatttccttcccgcctatctggcggaggcggaggagttgctggggatggggcaccgccagttgctggctctggaggccagcatccggcgggggctgccgcacccgcgcgccgtgcgcgagctcttccgcgccgtgcacaccatcaagggcctgtcggccatggtggatgtggagcccatcgtcgacatcgcccattggatggagacgtgcctgcgccacgccgaccgggcggggggccgcctgcccgaggccagcgtggagccgctgatggaggggctgcgcgaaatcgagcagcgtgtccgccaactcgccgtgggcaagcaggccgcgccggtgcccccgggcctgttgtctcggctggaggcgctggatgccgaaggcgctccgggtgggagcgtcgcgagggcggcgcccgccgcgctggcgctggaggaggccgtggcctcccggctctccgcggtggagcgggagcagctcaccacgggcgccaccgatggccgccgcgcggtgcggctggacttcatccccggcgcggaccgcgccgccaacggcatcaccatcaacagcgtgcgcgagcgcgtggcctcgctgggcgagacggtgaaggtgctgcccctgtcggggcccgccgtgggcggaggggcgctcaccttcgtgctgctgctgctcaccgaggcctccgacgccgcgctgctggaggccgcggggggcccgcccgcgtcggtgcgcccgctggccgccgtcgccccgaggacacccgccctggcgcccttgcccgagtcggcgctggcggacgaggagcccgaggaggcgcggcgtggcggcggctccctgcgggtggacgtgtcgcgcctggacgaggcgctggagcggctggcggcgctcgtggtcaaccgttcgcgcctgacccgcgcggtggcggcgctgacggcggccggcgcgcccacgcgcgagctgcaggccatcctccaggagaacgcacgccagcttcgcgacatgcgcacggccatcctccgcttgcgcatggtgcgggtgggggatgtgctggagcggctgccgctgctggtgcgcggcctgcgccgcagcacgggcaagtcggtgcggctggagctggatgtgggggacgcggagctggacaaggccgtggcggaccggctgttgcccgcgctggtgcacctggtgcgcaacgcggtggaccatgcgctggagtcgccggaagcgcgccgcgccgcgggcaagccggaggaaggcgtggtgcgcgtggccagccatggccgggcgggggggctgttggacctcaccgtggcggatgacgggcgcggcgtggatgcgcgggcggtggccgcgcgcgcgggcatgcccgtgcctccgacgccggacgcgctgctggaggtgctctgccggcccggcttctccacccgggatgccgccaacgcgaccagcgggcggggcatgggcatggacatcgtccagcgcatcatcgtggaccaactgggcggcgagctggggatggagacgcggcccggcgccggcaccaccttccggctccgcgtgccgctcacgattacgctgctggacgcgctcgtcttcgagtgcgccgggcttcgctacgccgtggcggtgggctccgtggaggagctcgtcgaggtggacgccgcgcggctggtgtggcccgcgggcgcggggggcgtggccctgctggagcgcagggggaactcggtgccgctgatggggctggcccggctgctggggcgcggggaagcggacggccacgaaggctcggtggccaaggcgctcctcgtgcgccagcgcggtgagctcgtcgcgttcggcgtggagcggttggtggggcagcaggaaatcgtcctgcgtccgctggaggaccccttggtgcgcgtgcccggcgtggcgggcgccacggacctgggggatgggcggcccacgctggtgttggacctggccgcgctcgggctggcgcgaggtggcggcgcgccgcaccgacgcagggcttccgtctgggaagaggggcgcctcgcatgagcgtgctgcatgtcgtgttcaaggtagacggagccgagtacgtgctgcccgcggcggacgtgctccagatggagtccttcacgggggccacgcccgtaccgggcgccgcgccgcacgtcgccgggttggtgcaggtgcgcgggcgcgtcatcccggtggtggatgcccgcctgcgcttcggcctgccgccggtggagcgcacgctcgactcccgggtggtggtggcgcagctcggcagccgggtcgtggggctcgtggtggacagcgcccgcgaggtgctgaagctggacccccagcagctcaagccgccccctccgctggtcgtggagggagcgcgcggtttcgtgaaggccgtggcccaggtgggcccgcgcctggtgatgctcatcgatttccctcgggtcatcggggaggagacgttggatggcgacggacagcggtaacgcaggggtggcgctggaagaagcccgtaccctggccgaagacgcggcgcgcagtgtccaggagagcgtggggttggtgcaggcggtggaggggctcgcgacgcggctggcggccggcggcaacgagcaggccgcggcctccgagcaggtgcgcgccgctatcgaatcggtggccgcgcacgtggaggagacgggccagtctgtccatgagttggtgcgctcgcagcgcacggtgagcgactcagcgcgggcccaggtccaggaggccgaggccaacgcgggcaccctccatgaggtgaacgcctcggtggccggcgtgcgcaaggacgccgcgcacctggcggcctcggcggacaccacggcgggggcgctggaggaggtgtcgcgctcggtgaagggcgtgagcgccaacgcggaggagctggccgcctccagcgaggagctgctggcctccatgacggagatgaacgccaccgtggcggacctggtggcgcgcaaccagtccagcgccgccgccactgatcaggtgtccgccgccgccgaggagatggccaagggcattgtccggctgtcctcgtattctcagggtgtgggtgagcgcaaacggcaggatccccaggctgggccgagcactggtcgagctcccctggtcaaggg

SEQ ID NO: 986 - DNA, 13234 bp, Myxococcus xanthus
  unsure (1)..(13234): unsure at all n locations
tctaaagaagcgccgcttcaccacgtatgagcgggtggaggagctctacccgctcatcgtgaagaaggacgggcggcgcgaggcgttcgaccgggagaagatcgtcaacgggctgaagaaggcgtgtgagaagcggcccgtgtccgcggatcagctcgaggagacggtggtcgccatcgagcggcagctgcagggcatgggcgagaaggaagtgccctcgtccgtcatcggcgaggagatcatgcgccggctgcggcagctggacgaggtggcctatgtccgcttcgcgtccgtgtaccgcagcttccgcgacatcgcggagttcatggacgagctgaaggccctgcgcgaggcggaggcgcgcgagcagcgccaggcgcctccctcggcaccggtggacaagggcggttagagaaagcacatgcggctgttgacacgggcaaggttggaagcgacacgggcgccccgggcgaagcgagcggcggacttcgaccgggcggtggctgagttcttcatgcgcatcgcgctggaggaagccgccaagggcctgggccgcaccagccccaaccccgtcgtgggcgccgtgctggtgaagggcgggcgcatcatcgcccgcggctaccacaagaaggcgggcagcgcgcactcggaggtcgtcgcgctggaggccgccggtgcgcgcgccaagggcgcggacctctacaccacgctggagccgtgcgaccactacgggcgtaccccgccgtgcagcatggccatcatcgaggcgggcgtccggcgcgtcatctgcgcgtcggcggaccccaacccgaaggtgagcggcaagggcgtgtcgcggatgcggcgcgccggcctcaaggtcctcacgggcgtgctcgcggaggatgcggaccgcctcaaccggcccttcttcaagatgatccgcacgggcctgccctgggtgacgctcaaggcggcggtgacgctggacgggaagctggccaccgcgactggtgactcgcgctgggtgacgggggcgccggcgcgcgcctgggtccaccggctgcgggactcggtggacgtcatcctggtgggcgccaacactgtccggaaggacgacccgaagctgaccacgcggctgcccggaggcggcgggaaggacccgctgcgcgtggtggtggacagccacctgcgcctttccccgggctacaccatcttcacgcagcgcagcgccgcgcgcaccgtggtggccacgctggaggatccggagggccgcaaggcgcggcgcttcctggcccagggtgtggacgtctggcagctccgcgagaaggcgggacaggtggacctcaaggccctgctgcggcggctggcgaagggcggccacaaccacgtcatggtggagggcggcgcggagatgtacggctccttcctgcgtgggcgcctggcggattcgctggcgctgttcctggcgcccaagctgattggcagcccgggcctgtcgtgggccggcgacctgggggtgaaggagatggcccaggccctggcggtgaaggacctcgccttcgaacgccatggcgacgacatcctgctccaggcgctgttgtaggacacgagcggccgtgggcgcaggcggggccggtccgttataagcggccccatgtttaccggcctcattcaggaccttggcagggtggagcgcgtcattcccggcgggatgaccgacctgtggattcacacctcgctgggcgcggcggccttcgagctgggcgagtcgattgccgtcaacggcgcctgcctcacggtggtggagcgcaccggtgacagcttccgcgtgcaggccgcgccggagacgctgcgccggacgacgctgggctccgtgaagcccggagaccaggtgaacctggagcgggccctggcgctgggtgaccggctgggcgggcacctggtctctggccacgtggacgccgtcagtgaggtgctggagacgtacccggagggtggctcctgggtgatggggttccggctgccggaggaactggcgccgtacttcatcgagaagggctcggtggccatcgacggcatcagcctcaccgtcaacaccgtggaggcggaccggttccgggtgcagctcatcccggagacgcaggagcgcaccaccttgaaggcgcggggcgtggggtcgaaggtgaacctggaggcggaccagatagggaagtacgtggcgcggctgttcgcgctccagcggggccagggggcccccgggggacgtggcgggctgacggcggcggccatcgcggctgcggggtttggcacgccgtagcaggcgacgccgggccccggggtggtgtaggaagcgcggcatgcctcgctacttcgacggtgactttctaccccccaagggccgtttcgccatctgcgtggcccgcttcaacggtttcatcaccgaggagctggccaagggcgccgtggacacgctggtgcgccacggcgtggccgacgcggacatcgacgtgtaccgctgccccggaacctatgagctgcccggtctggttcggcgcgtgaccgagacgcggcagtacgtgggcgtcatcaccctgggcgccgtcatccggggcggcacgccgcacttcgactatgtggccggcgagtgcgccaagggcattggcgcggtggccttcgaggccgcggccgccacccccgccaagacggtgacttttggcgtgctgacgacggacacggtggaacaggccatcgaccgggcgggcgtgaaggctgggaacaagggagcggaggccacactggcctgcatcgagatggtcaatctgtacgcgaagatgtcagcgacggacggaaggaaggcgtaggccatgggcgcgcgaagaacgggacgtgagcgtgcgctgcaggcgctctaccagttggagatggccaccgcgacgacggcggaggcgctggagtcagcctggtcggccgccgaggagagcaacaagcgggacccggacgcggtgaagttcgcccgggaactggtggaaggtgtgcagtcccaccgggacgaaatcgaccagctcattgagcggcacagccacaactggcgcctggaccgcatgtcgcgcatcgaccggaacgtgctgcgactgggcattttcgagctgaagtaccgcccggacatcccccgcaaggtgtccatcaacgaggcggtggagctgggcaagaacttcggcaatgaagaatcgagcgcgttcgtcaacgggctcctggaccgcgtcgcggtcgccttgaacaagccgtgagccgctgacgccagccgcgagggacgcgccgtgagccagacgacgacgcacgacatcggattggagggcctggacacgctcggcggggtggacgcgctctgcctcttcatcgccgaggatgaccggcccctgccgtcctccgcgggcttcgtggactggcggctgtgtggctcgctctcgcgggtgctcaaggccggcttcttcacgggcgcgaaggatgactggctgttgctgccctcggacgggaagctggcggtgccccgcatcttcgtcgtggggctgggcgcgcgtcagcgactggacgcggttacgttgaacgacgcgatggctgaagcgggaagggtgctgtccaaggcccgggtggagtccgtggcgctggaagtgcccgccggtggccaggtggaggacgccgcgcgggccgcggctttccagaagggctttctgcccgcgttcaagggcgaacgggtggccgtcctggcggacaagggactcgtcaagtcgctgcctgcacgcaagggctgacgctcggcgggcgggcgggccttctgctagcatgtctcgcccggggcgagcgcacatgcgtgtcaaggtgttgattgtcgaggactcgaaagcatcgcgcgagtacatcgccgcgatggtcgaggccgtggagggggtcgaggtggtggtgacctcgagcggcttcgaggccctgaagctgctgccgcgtcaccgcttcgagctcatcatcaccgacatcaacatgcctgacatcaacgggctggagctcatcaacttcgtcaagaagaaccccaactaccgcgaagtgccgctcttcatcatcaccacggaggggcgcgatcaggaccgcgagcgcgggctcgcgctgggcgccgcggagtatctggtcaagcccttcctccccgggagcctggaagcgctcctgcggcgctacctgaagctgccgtgagtccgggaagcaaggcgctggccgagttcgtggccgaggcgacggagattctcgacgccctggccagggacctgctcgtgctcgacgagcgccggggctccgaggcggacccggacctggtcaatggcatcttccgcgcggcgcattcgctcaaggggctgtccgggctgttcggccaggagcgcatctcccggctggcgcatgggacggaggacctgctcgacaggcttcggctggggaagctgctgctggacggcgcggtcctggatgcgctgattgaagcgctggatgcgttccaggcgctgctgggcgaggccgctcgcggcgcggagagcgaaagcctgtccgcccgcgtggaggcgatggccgcgcggatggcgtcgatgggcgctccggcggaggttgccgcggacgacccgctggaccggttggagctggaggcgcaggtccgctccgtcttcacggagtatgaggaacaccggctgcgggagaacgtgcggcggggtgtgtcgctgtggcgcgtgcgggccgcctttgatttgtccgacttcgacaagggactggcggagctcaacgcgaggctcaagccgctgggcgaggtcatcagcacgttgccgtccgcgcagccgggtggcgcgcatggcatcgcgttcgacctgattttcggtgcgcaggtcgaccgtgtgtccctggagacgggactggagggaacgcccgcggagctgtccgcgttgacggtgcgcccggccgcggcggctgcgacgagcgcgctgcttcaggccgcgcaacccgccgcgacgattcgcgcgtccgggggcgcgaagtccgagacgcggactggagacgcggcgacgcacgatggggacgcaagcactgctcaggacgcagtggcagggggcctcgcggcacctgatgcacccgtccgcgtgacggatacggccccagaggcgtcgcggaagggagcaacgccctcgcgcggctcccgaggcgccgcaagccgaggcacgtccgcggacgccaaggatgcgcccgcggcagggcattcgacgtcgcccaagggcggcggaaagaagaagggtgtgcgcgcgacgcccgccgcgatgtctcccgaggcgcagcagccgctcctttcgcacgtaccggaagacacggagcccgggcccctggaatggcccacgtcggacgccgacgtgcctgccaatgccagcggctcgccttcactgactcccgtgcccggaccctccagcgtgcccgtcgtcgcctacctccagggcgccgccaaggcatcacccaagggcctctcggtagccccagcggcaccggccggcgcccccgtgagcacccctgcggcgctgacggcggacacgtcgctgcgctccctgacgcagaccgtgcgggtggacatcggtcgcctggatggcctcatcaacatggtgggcgagctgctgctcatcaaggccaatctccagcggctcgcggagtccgcgaggcaggacggcgcggtggcgctctccaagctattcggccaggagctggcgcgcgaaacgcgaggcctggagcgcaagctggaagcccttcaggaaggcctcctggaagcgcggatggtccccgtcggccaggtgttcgacaagctggcacggctggtgcgacgcatcacccgcgaggcgggcaaggaaatcgagctcgccatcagcggcggtgaggtggagctggacaagctcatcgtcgaggaactcagcgacccgctgatgcacctcatccgcaacgccatcgaccacggcgtcgaatcccccgacgcccgtctggccgcaggcaagccccggcgcgcggtggtgggcctgcgcgccgagcagaagggcaaccacgtcgtcatcgaggtgagtgacgacggctccggcatcgacgaggtgcgcgttcgcgaggtggccatcacgcgcggcctcatcaccttcgcgcaggcccaggagatgagccggagggagctgctcaacctcatcttccagcccggcttctccaccgcccgcagcgtgtccgagctctcaggccggggcgtcggcctggatgtggtgaagaacaacctgggcaacctgtcgggcatcatcgacgtgtggagcgagcgcggaaagggcaccgcctttcacctcacgctccccgtcacgctggccatcattcgcgcgctgctggtgggcgtcagtggccgcacctacgcggtgccgctcaacagcgtgctggaaatcatctccgtccagcccaaggaaatccgcaccgtggagcggcgcgaggtcctggacctgcgcggacagacgttgcccttcgtgcggctgtctcgcatgttcgccttgccggagcgtccggtgagccgccacttcgtggtggtggtgggcctggcccaggagcgcttgggcatcgccgtggacgaattgcacggtcagcaggacatcgtcaccaagcccctggggggccggctccagtccgtccggggcatctccggcgccaccgaactgggcaaccggcgcaccgtcctggtgctggacgtggcggcgctcctggaagagggcatggccgtggagcggcgtcgcgcctgaccctcgctgcggacgggcgcgccggctgctatcctgcgtcgctgtgtcccggttctcggaactgctcgacgacttcttctaccgtcctgacgaggacgtctccgggctccaggacttcgcggcgggcagcgacggcgtattgccctcggcccccgaagaggtgcccgaggagtacctggccttccgcctggaaggggagtgctacgcggtccccatccggggggtgcgtgaaatctccaaggtcccgccgttgacggagattccccgcgccgagcctcagctcctgggggtgatgaacctgcgcggtgagctgctgcccgtgtacgacgtcaaggtgcggctgcggctggcggagcgggcgcccctggtcgccgggcccgacgcgccggcgccgccccggagtgctcgcatcctcgtgctgcgcacggagacggggcccgcgggggtgtgggtggatggcgtggtgggcgtggtgaanctcaagccgtccatgctggaggcaccgccaccggggttgcgcgtgggtgacagggattgcgtggtgggcatgggccggcgtggccccatgctctacatcctcttggacgcggaacaggcgctcgccccatgaaggactccgtcaacctgctgtcgcggcgtccccacgtggtcccggatgaagtgtcctcggccgcggacacggtggtgcaactctgtgccttcttcatcggcgcggaggagtacgtgctggacatcatgcgggtggaggaaatcctcccgctccagcgcatcacccccatcccccacgctccggcgttcgtggagggtgtgctccatctgcgcggcctcatcctgccggtggtggacctgcggtgccggctcctgggctcgccggggccggagacaccgaagacgcggctgctggtctgcaagctgggcacgcggcgcgtggcggtgaaggtggaccgggtggcggaggtgctgcgcgtgcggcgcggcgacatcaagcccgcgcccgcgctgagggtggcgggacacacgccctttgtcgtcggtgtctgtggaccaccggaccggctccggctgctgctggacctcaaggcattgctgcgcgtggagttggagcgcgagtcttcaaggaacacgacgtaggcgcacacatgggggattgagatgggccatcaaggactggagcagcaccgtcgaatcctcggcatcctcttcatcgtcatcaacgggctgtcggtgctcatcgccgtgggagtgatgctgttcttcggggcgatgggcgggatgttgccgagcgcgaagcccgaggaacgggcgctgattgttgccgtgggcatgggcgtgggcgggtgcctggcgctgctggggttgccgggtgtcatcaccggcttcgggttgctctaccgcaaagcgtggtcgaggacgctgacactggtgctgggcatcctcgccattcccaatgttcccctgggcacggccctgggggcctacgccctctggttctacctccagccagggtctgaccaggtcttcgacacatgaacccccactccgagcccccggtcgaggaagaggcgcgctacctcgcactccagtcgctggacccgtgcaccgcgggcgttctggagattctcatcgtcggcttgcatgacgagagctggcgcgtgcgccacgtcgcggcggaggccctcaagcggatgcccgcctcgagcgagctcgcggcccggcttatctccgtgctgggggagcgaggggagacgggggctcggaacgcggcggcggaggcgctcgcggggttgggcagtgttgcgttgggcccgttggtggacctgctggcccatccggacccggaccaacgcaagttcgccgcggacatccttgggcagttggggcagcgcgagtcggagggccccctggtgcgttcgctctcggacgcggacctcaacgtgcgtgtgtccgcggcggaggcgctgggacgcattggcggcgcgcaggccgtcaccgcgctggagacgctgctggccgagccggagccgctgcttcgcctgtccgccctggaagggttgacgctgcttcagcatgcggcgcccctgccggtggtgaaggccttgctggaggaccctcggcttcagcggagcgcctaccggatgctgggcctccttccggaggcggacgcgacggtgcgcatctgccaggggctcacgtcggagttgcgctcggtgcgagaggcggcgctgtccgcgctggggacccaggccgcgcgttccgcaggcgcgcggcgcggggagctcgaagcggtggtgcggaaggccctcttgcccctgcccggtatgacgccgcgattgactgcggcgctggcgtccgaggacgtcatggtgtgcgcgggcacgctggtggcggtggcctcgctgggcgatgcttcgctggccgtgcccgtggcggagtgtgcgcgcgaggcgcggctgctgcgcgaggtcctgcgcacgctgggcaggttggggccggacggcgggtacatcttgcttcatcgcctgccggacttgtccctgccggcgcgggccgccgcggccgaagcgctggtggacctggtcgacgcctcggcggtggcgccgctgtgcgcgttgctggagtgggtggaggacgagcttcgcgcggtggtggtgcgtgccttggggcggacaggcgcggcctcggcggtgtcgccgctcgtcgccctgctggaagagccatccctcgcgggcgcggcgatgcgctccctggccgggctggcggagtcgtgtcggccggcggtgctggaggcgctggaggacgcggtggcgcgcagggccacgcccgcggcggtcgccgccctggcccgcgtgggcggagtgccggccctgcccacgttgaagcggctggcgcgggacgaggaccctcggtggcgggcggcggcggtggtggcggcgtgtgagctggatggcgacgtcggtcgggagttggtgcgcgcggcgctcgcggatgagtccgtgccggtgcgcatcgcgggcacgcgggccctggcgcgactgggtgggcctgacgcgggcgcgctgctgtctccggtcctgagggacgaggacccctccgtgcgggtggccgcggtggaggcggcgggggactgcggcgcgttggaccgggtgccggacctggtggccctgacgcgggatgcggatggcgcgctggcggtggccgcggtgcgggccctggcgcggatgggagcggcgggcccaggggtgttgcgggaggccgcggggcatccggacgtggaggtggtgaaggcggcgctggtggcgggggcggagtcgtcggccggggtgacgatggcgctgtccctgctgcgtcatgcgcgctgggatgtccgcgcggcggcggcgcgagtgctgggcgattcggcggggccggagtgtctgtccgccgcccgggaggcgctggaggcggagtcggacgccctggcgctgcgagccctctccgatgccgtggagcgcctgctccggcgctgagagggcttcatggcgcgcttcgacgacggacgtccggagatgtcagcggaggagttccgtctcctccgggaccacgtgtattcgcactgcggcatcctggtgcacgaggacatgaagttcgtgatggagcgccggctgtggccccggctggagttgctggggctgccagactacggcgcgtaccaccgctacctacgctacgacgccaaccggcacgccgagttggaggcggccgtcgaatccctcaccactcacgagacgtacttcttccgcgagcccacgcagctcaaggccttcacggacgaactgctcccggtggtggggcagcgcaacgcgcggttgcggcgcctgcgggtgtggtccgcggggtgctcgtccggggaggaggcctacacgctggcgatgctcctcaaggacagccgccgcttcgacgactgggacgtggaagtcctgggcacggacatctcccggcgcgtgttggccatggcgcggcgagcggagtacgggccttccgcgctgcgtgccacctcgccggaattgctggaacgccacttcgtttcgctgggcaacagccgcgtgcgcgtccgggacgaagtgcgcgcctgggtgtcgtttggccaccacaacctgctggacgaggtgggtagccaactggtgccacgcatggacgtggtgttctgccgcaacgtgctcatctacttcgacctggcggcacgccggaagttcctgcgcatcgttcgggaccggctggtgccaggggggtacctgctgctgggacactcagagaacctgctgaacctgggctcggacttcgagttcgttcacctgcgcggggacctggtgtaccggaggccggagctggacgaaggagcgcgtcgatgagcagcaagggcgtcatctccgtactggtcatcgacgactctgcccacaaccggcggaccctctccacgatgttggagtcggagccggacgtgcgagtggtggaccgcgcggcggatggcgaagaggggctgaagaaggtcgtggacctgaagcccgacgtggtgacgctggacctggagatgccgaagctcggcgggtacacattcctccgcctgctcatgcgcacggcgcccacgcccgtcatcgtcatctccagctattcgcaccgctcggatgtcttcaaggcgctggagttgggggcattcgacttcatcgccaagccgcagcacccgacgttcgaggccatggaggcgcttcgggtggagctgctggagaaggtccgggcggcgcggcacgtgcgccccggttaccggcacgcggcgccaggggctcgcgccatggcggtggcgggcgagccgccactggtggtgtccgtgggcgcctccacggggggcccccccgcggtgcagcgggtgctggagggactcgccgtggagcccacgccgtgcgtgttggtctgccagcacatgccgccgcagttcacccgcgccttcgcggaccggttggaccgcatcggccccttctcggtgacggaggctcgtgacggagacctggtacagcccgggcacgtgtacatcgctccaggcgggcggcacatggtggtggccgagcggggctcccggctggagctgcaaacgccgccgcccacgcccgtggacaagtacgcgccctgtgtggaccgcctcttcgtcagcatggcgcaggtgctcggcgccaaggccctgggggtggtgctcacgggcatgggcgccgacggtgcggagggcgcgcgcgcggtgcaccgcgctggcggcgaggtctgggcgcagtcggaggagacctcggtggtgttcggcatgccgggggaggccatcgccaccggggcggtgaagcgggtgattccactgggtgacatcggcccggcgctcgcggccctggcgcggcggcggcgctgaaactccggcccctggcgcacgggtgctaacgtccccggcccatgacgcagcagattcgagccttggtggtggatgactcgcaggccatgcggcgcagcatcatgtacgcgttgcagcgcctgtccggcgtggtgtgtaccgaggcccaggacggcgccgagggcttgaagaagctgacgcagggccgcttcgacctggtgctcacggacatcaacatgccgctgatggacgggctgaagctcatcagccacatccggcaggcgaccgagtaccggaacgtccccatcatcgtcgtcaccacggagggtgcggcggcggaccgggagcgcgcgatgaagctgggcgcgagcgcgtacctggtgaaacccgtgcaggcgaaggtcgtgctggataccgttcgggacctgctgaagctggactgaaggcgagcgcgcacgaatggattccgtcctgcgggtggagggcctggagaaggcgtacggcgaggtgaaggccgtgcaggggctcaccttcgaggtggcgcccggcgaggtgctcgggttggtggggcccaacggcgcggggaagacgtccacgttgcggtgcctggcgggcatcctgccgcccagctcgggccgcatcctggtcgcgggatatgacttgtcgcggacgccggtggacgcgaagcgcgcgctggccttcctgccggacgagccgcgcttctttgaatacctcacggtgtgggagcacctgaacttcacggcgcggctctacggcgtggaggactgggaggagcggggccgcgcgctgctggaggagatggagctgacgggcaaggagaagtccctgccgggcgagctgtcgcgaggcatgaagcagaagctgtccatcgcctgtggcttcctgcattcgccaaagctcatcctcctggacgagccactcgccggcctggaccccatcggcattcggcggatgaaggcgtcgttgcggcgccgggcggaggagggcacggccctggtgttgtcct

SEQ ID NO: 987 - DNA, 9818 bp, Myxococcus xanthus
gtgctctaaagcgtgctgggccggtgtggagaccccgtggtggtgcccgcgctgctgggcctgctgcccgaccccttctacaccctggaggcggcgcgcgcgctggggcgcaccggtcaggaggccgcggtgccctcgctggtggggctgctgcgcaagggcaatgacgcgtcggtgcgcgcggcggcggtggcgctggtggacatccacgaggcccaggtgcagcgcttcggcggctcgcgcaccgtgcacaccgcggtgcgggggccggagtcagcggtgctgggacggcggctgtcgcagtgcgtctccagcgcggacacgacggagaagacggccctctcacgcctgctgggctgggtgggtgggcaggacgccgcattcgggctgctgaagctcctggacgggccggacccgtcggtggcgcgcgcggcggccggggcgctgtcggagctgggcgcggacgcggacacccagattctccaagcgctgcgcgagggcgacagcctccggcgccgcgtgctgttaccgctggtgggccgcagggccgcggcggtgccggacgtcatgtcgtgcctggaggaccgggacgcgtcggtgcgcgccctggcggcggacacgttgtcccgcattgggagcccggccgcggtgccggccctgttcgagcggttggtggacgaggacctgcgcgtggtgcaggccgcggtgggggccatccagtccctgggcagcgacaccacggagaagctggcgttgcaggcggcccgttcccccgacgcgcgcctgcgccgcgcggcgctgcgcatcatctcctacttcggctattccaagggattggaagtgctgctccaggccatgcgggacccggatgagcgcctgcgcgacgcggccatctacggcctgcccttcatcgaggacccgcgcgcggtggacgcgctgctgacggccgccaatcacgagtcggagcgcacgcgcgcggcggccatgcgcgcgctggggcagacggagaaggaggcgcgcatcacctccacgctgctgcgtggcctcagcgaccgcgacccctgggtgcgctactacgcgtgccaggcgctggggaagctgaacgaggaagccgccgcggacgccatcgtcgcgctggcggacgacgccgctggccaggtgcgcgtggcggtggtggacgcgctggcgcacatgcacacggagagcgcgatgtcggcgctccagcgcgcggcggtcagcgcggacgcggatgtgcggcgcgccgccctgctggggctgggcgtgggccggcggccggacgcgctgcccgtgctgctggaggcggcgaagtcggaggacgcggccacgcggctcgtcgcgctgtccgcggtggccgaatacgaggcgccggagacgctgcccgcactgctgcatgccgcgggagacggcgacgacagcgtgcgcagcgccgcggtgggcttcatcgccacgcgccccggtgtcccggccacgcaggccttggtgtccctgctgggggacatgacgctgcgcgagcgggtggtgagcgccttggcgctgccgctggagggacggctgccggggctgctggccgcgctggaggcggcggacgaagtcacggcgccgctgctggtggcggcgctggcccggatgcgacgggcggacgcgcgcgccgcgctgatgcagctcctggtgtccgccagtccggcgggccgtcgtgccgcggtgcccgcggtggcggcattggggacgttggaggcacgcgaggcgctggagcgcgcctcccatcgggacgaggaccccgaggtccggcgggcctgccggctggtgctgagccgctgaagccgcgccatgttctccctgcccatgtctccccaggtgttcgccatcctggccgcgctcatcgagcagcgctccggggtgcactacgcccccgaggaccgggagctgctcgccgacaaggtggtgccccgcgcgctggacgcgggcttcgactcgctgctcgactactactacttcctccgctacgacccggcgggctccgaggcgctggacgcgctggtggactcgctgctggtccacgagacgtacttcttccgggaggccctgccgctgcgggtgctggccgaggacctgctggtgcccgccgtgcgcgccggacggcggccccgggtgtggagcgcggcctgctccaccggagaggagcccctcacgctggcgatgattctcgcggagttgggcgcgctcgacgaggtggagctgctggccagcgacctgagcgcccgcgcgctggagcgggcccgcaccggggagcacaacctgcgctccctgcgcgcgctgcctccgggcgtggagggccggtggttggagacgtgcgaggggcgcccacgcgtccggccggagttggtgcgcgcggtggactggcggcgcgtcaacctggtggatgccagcgcggtggcgcagttgggcaccttcgacgccatcctctgccgcaacgtcctcatctacttccaggacgacaccgcgcgccgcgtggtgtcgtccctgacgcgcgcgctcgctccggagggacacctgctggtggggacctctgagtccctgatgcgcttcggcaccgcgctcgcctgcgaggagcggcgcggcgccttcttctataccaaggcaaggccatgacggtggtgtctcccattcgcgtgctggtggtggatgactccgccttcgcccgcaaggtgctgcggcaggtgctctccagcgcggagggtttggaggtggtgggcgtcgcgcgcgacggcctggacgcgctggagaaggtggccgagctctctccggacgtgctcacgctggacctggtgatgccgggcctggatgggctgggcgtgctgcgcgcgctcgcctccagtgccgccgcgccccgcgtggtggtggtgagcagcgcgggcgaggagagcgagctggcggtggccgcgctccaggccggcgcggtggagctggtgaacaagcccaccgcgctcgccaccgagcggctgtatgagctgggcggcgagctggtggcgaaggtccgcacggccgcgggcgcggtggctcgcgcgccgccggagccggcaccgtcgccggaagccacctccgcgccggtggctcgcgcggccgcgaagagcctggtggtggtgggcacctccaccggcgggccgcaggcgctcacccgcctgctgtccgagctgcccgtggacttccccgcgccgctggcgctcgcgctccacatccccacgggctacacggaggcggtggcccggcgcctgaacgcgcactgcgcgctggaggtgttcgaagcggtggacgggctggagctgcggcccggccgcgtggtgttggcgcgctccgggcagcacctcaagctggagcgccatgggccggtgacgctcgctcggctggaccggcagccgctgcgcacggcgcaccaccccagcgtggacgtcctcttcgaaagcgccgcgcgaagctggggctcggacgtggtgggcctggtgctcactggcatgggtgacgacggcgtcgcgggcgcccgggccatccgcgaggccggaggcaccgtcctcacggagagcgagtcctcctgcgtggtgtacggcatgccgcgcgccgtgaaggaagcagggctggccaccgacagcgctccgctggagggcatgctggcgctgctgcggcgtcatgtgcgctgaaggccgacctttctaaagacgggtgggtgatggtcccggagcgtcggctgggtcaggatggccggcatgctccgatacgccgctgaccgccggacgatgctgtggtgtctggccatgcccgtggtggccctgtcgatgtacgtggcccccgggtggattccctatctctgccccctggcgtgctacctggcgctgtcggcaggcgtcatcgcgcacaaccacaaccactgccccaccttccgcaaccggaagctgaacgaggccatgggcatgtggctgtcgctcttctacgggtaccccaccttcgtgtggattccgacgcacaacctcaaccaccacaagttcgtgaacaaggcgggcgacgccaccatcacctggcgctactcgaagaagcacaacttcctggtggccttcctcttccccttcgtctccacgtactggcagcaggagccgacgaaggcgttcatcgacaaggcgcgtgagcgcaaccggccgctgtaccgccagattctcacccagtatgccgtctggggcggcacgcacgcggcgctgctggggctggccatggcgatgcacggcgtggccggtggcgcgcgcatctgggcgttcgccttcctggtacccgcgctcttctcgctgtggaccatcatgttcttcaactacatccagcacgtccacacggacccctggagcgagcacgaccacagccgcagcttcaccggccgcctcatcaacttcttcctcttcaataacggcctccacgccgtgcaccatgagacgccgggcctgcactggagcctgctgccccaggcgcacgcgaaaatcgaggccgccatggacccggccctcaagccggtgagcttcttcgcctggtgcttccgctcgtacgtggtggcccccttcctgccccgcttcggaacggcgcaggtgggacgcgcgccctatgagccgcccgcgggtgtcgcgctggacgtgcgcttcggggacgacctgcaggccgtcgactcgggcgtcaatgtcgcccgcgtctgacgcgccttcgtggcgccgtggacaccggctgcggctccagtcggaggctggtgtcctttatttctcatctgtcattggaatctgacccagggggattttctctgactgggcgtttctcatacttcgaagtcgcaggatgagcgcggtgggcgggccgggggggacgaagacaagggaggctccgcatgatgacggctccaggacgcgtgcgtccttcaccagggccggtggaagcaacgccgcgggtgctgtgtgtgggggccacgagcgaatcctggttggcgctgtcacgagctctgcgtccattgcgctgcgtggccttgcaggtgccttccctggagtccgccttcctggaggtgcagcacacgcggccttccctggtgctggtgcactggcggcagttggtggccggcgcgggcatgggcctgcgcgcgctgaggctgcgcctggggggggatggtccgccggtggtgctggtggcggagccggagacgcccgccgaggtgctcgaggtgggcgacgcggagggggtcgaggactgcctgctgtcgcccctgcgcacgcacgagctgcgcgcgcggttggcgatgctggcgggtggcggcgtcccggccgcgtcggtgcgtgcataccgtgtgcgttcgcgcctgctgctgctggccggcgccagtggccccctggcgtggagcgggctgggcgctctgctggaggcgtgtggtcatcgcatcctctacagcgccaccgtgggcggtggcgccgcgcgcgtggccgaacagggggagcggcccgacctggtgttgtctcgggaaggcgcgccaggtgtgcccaggggcctgccctcgccacggttgcagccgctgctggcgggggtgccgtcgcttactctggacgcggacgcgccggtgcgtccggcctcgttgctgccccgcatccacgcgctgctgggacgggaggacgcctcgctgcgtgtcgaggctcgggtgcgattctgctgtccggtgtccttcggcgagtcggggccgcgcggcgcggagtggcgctccggcgtgtccagcgcgctgagccctgggggcctcctggtgcgcacgctggtgccggcgaaggcggggacggcggtggagctgcacatcctgctgcccaccctgggcgagcgcctggagacacacggcgtggtggcctgggcccacgcctacgcgcctcgcaacggcgtgtcccacccctacggcatgggcgtgcgcttcctgggcatgggcccaccgcgcctcatgcaattgcgccagttgtgccaggcggaggtgcgcccgtgacagcgcaaggcgcaccgaggcgcaagaaggtcctgctggtggatgactcggacaccgtcttgttgctccagcggatgctgctggcggagctgggccacgacgccatcgtcgcgcgggatgggctggaggcgctggcgcgcgcggagcaggagcggccggacctcgtcttcctcgacgtgctgatgccgcacctggacgggctggagacgtgccggctgctgcgcgaccgggagccgacgcggcgcacgcccatcatcctctgcagtgcgcgcgccgaggcgcgcagcgtgcgcgcgtgcttcaacagcggctgcaacgacttcgtggccaagcccttcgacggcgccgcgctggtggccctgctgcggcgctacctggattagtcgcgcgggcttccggtgggaggctggggcggtcgggccggcatggagcggcgcggcagcgtcacggtgaaggtggtgccttccgcctcatcggagcggacctcgatggtgccgccgtgcgcctggacgatttcccggacgatgaagagccccagcccgtagctcatcttcagcgtgcgcgagctctggggcccgccgcggaagggctcgaagaggtggggcagcaggttgtccggaatggggcggccggcgttgtggacctccagcaccacccgggtgcgcagcccgcgcgccgtcagccgcaccggcgtctccggcgggctgtacttgagcgcgttctccaccaggttggacgtcacctgcgccagccggtccgggtcccacacgccctgggtgttgcccttggggtccacctcgacggtgcgctgggggaaggccacgccgaactcgtgggccaccttggccaccaaatccttcaggtccaccggccggggctcaatggccacgccgcccatcagccgcgtgcgcgtgaagtccagcagcagccgggctcgctgctcgatcagccctccgtcagcggcccgcctcagctccgattctcccctcaacatggctttccaacctatatggataagcggggaagccattgacctgatgcgcgggagcggactaccgccgtccgctccctctgccgctcgaaaggagcgcatcttggtccggcgatttcttccctccctcctcccgctggtgctggtggcctccacggccgcggcgcagaccacccccacctccatcaccttcgatggcgattggaacgagacgccgtcggtggagctgattcccgtgggcggacaggtggtcgtcaactacgacatcagccgcctgccgcagtgccggggcaccacctcctcgggcaacccaacctggaccatcaccggccacgtccaggtgaaccgcggcccggtggtgagcttctgggtggccggccacgcgccggacggcaactcttcccagcgcgtcctgcatctccccgcggggttgagcggcgccctggtgatgtggttcgacatctcgagccagggctgccaggcctgggactccaaccacgggagcaactaccacttcgccatcggcgcgccgaccctctccttcaacgcgaactgggacgaggtgattgcgggcacgctgcgcgccggccagcagctcatcgtcaactacgacgaggcccgcctgcccgagtgtcgcgcgacctacaacggcccggcctggtcgattgtcgcgcagtaccgcttcgacaacggccccatccaggagacggtcgtcaccggctccggcaggtccgagccgacggccatcaccgctccggccggcgcccgccacctggagatgtggttccgcaacacggaccgcagctcctgcgtgagctacgacagcaactacggctccaactatcacttcgccgtggagtgagccgcacctgctgggtcgcgaccggctgcagtgtcatcacgttcgagactgcagcaggcggcgtcgtggtgaacccagagccgaatcaacccatcctcgaaggcaccgccgacctaaggttgaaccgtcatgcgcaggcgatgtgcaatcgcggcggcgagttcagcgatcgaaagccataggttgcgattggaactgaagctggagctgacagagagcacggcgtgcgtgcctctgggcaccagacgcgtgagcccttcatccggattcgacgcgaggattgaaccatcgttgtaaacgcacgcagccacgtaccgttcggtgagcgatgcgactggcgaccaactgccgccgtcccaccaggccgaggtgcaagtccccaccaggaccaacgcgcctgaggaagtacctgcaaaggcagaggggccctcgacgccggtcctgagcaccgtggccccgccgcggttccagcgaacgcattcgccttccgctgcaagccagagctcgccgccacttcggaagatggcctcgtaccaggagtgttcggcgctggcgccgtctggaatctcgagcggaaccatttgcgagccttcgagccgaagcagtttcacgtccgagcccgtaagccagaccccctctgcgtcgacccacaagccataagccactccgaaatcgggcgaagggattcgactccactgagccccatcccaatgaaagaccaccccttctccgactgcccatacgtctcgcgcatggcgaccggagacccgatgaagcggaacgcccgcccccgtctccacgcgcgtccagccgctgggaccgaggtgaaacgtctcgtcccccacgacccacgccacccccggctctggagaccagagatcgtcgaggaatccttcggacacgcggggcccgtcgtgaacggccacgccgtcccaccggctcaccactccgtcgtcgcgcagcatcagcacgtcgtctccggagcgcgagagcgcgatgtaacctcgctcatccggaaagtgtcggaggacctcgaaaccacgctgagctgaggggatgacgctgaagtggatctcgccccagcgccccccttcgtccggggcccgttccgattcaccgggttgcacctcgagtgagctgcgcggcaacttgacgagcaagcgggtcacaccggctccgcgtttgaactcgacttcgagtcctccgcgcgcttctgcctcctggctggctgcctttacgaacgccgcagtgtggagcgtgtcgtcgtatcgaacccacctcacgtcgtaacccatcggcctggtcctcgagcgcggtgagtttgatcgacaccgccgcgatggctcggcagtctatccacgggccggcccccggcagcggccctcctcgcctcctccgctccagccctccccctcaacccacatggcttctatcccgccgatacgccggcggggcacagccaattcaggggcctgtcagcccagcagtcgccgcaccacatccaccaggtcctggcgcaccaggtcgcccttggtgatgtagccgtccaccccggccgccaacccccgccgccggtcctcctcccccccacgggtagtgaggatgaccaccgggagcctcgaatggacggggtgccccttcaggcgccgggccagctccaggccgttcacccccggcatctccaggtccgtgacgaccaggtccacgggatgagactccaggacctccagggcctccgcgccgtccgaggcgatgacagtgtcgtaccccaccgcctccagcaggttggcgatgagctcccgggtgaggggcgagtcgtccaccaccagaaagcggcgccgccgggcctcgggaccgggctccaccgatgggggtggacgcggcgaggcatggtcccccaatacccaaaggaa

SEQ ID NO: 988 - DNA, 9101 bp, Myxococcus xanthus
tgctctcagcccgccttccttccgcgccgaccgagagctgcacaccttgctggagccccagcagcaggcttcccacgtccaccacgggcaggctgatgagggtggtgggcggctgatggaagaggcccgccccgcccttgagcgtgagcgcttccgacaccttgtgacgcacggtgagccgcggctccagcgcgcgacgatcaatccccggcgacaggtggtagttgtccacgcgcaggccgggcaccacggcccacttctcatggggctgccacaccagctccgtccacgcgcccatgaaggtccccagcgccacgggcgctacctctacgcccgcgtcggagccgccgtcctgctggagcagttcgacgatggcgcgcttgtgctccacgtccgccccggccgcgcagcgtggcgctgggtgacagcgtcgcgctgtagcccaggcgcgcggaccagtgcccctggtcgatatggacttcggtggcctcacccgggggactgcggctgacgatggcgaagcggtccagcccccacgtcccgcccacctccagctcaccgggccccacggggtgccggtgccgcaggtccacccggtggaagacaatggattgcatcgcggtgtcgccccatgcgtcctgggccttcgaaccgaaggtgtccgaggagccaaaggcaaacaggcgcagcgtgccctcgcccagccgctgctccacccggccctgataatcccagaagtcgagcaccaccttggggttctcccgcccgggagggggcggcgactggagctggttcgccgccagggcgatgagccagggcgtataggaatagcggccggccaggctgacgttggtgccggtgtccttgaacggcgtctcgatgaagaagcccgcgttgatgaggtccgcgtaggcgctgccgtggacgccgtcatcccgcgggcggctgagacgcccgtcgatggcgccccccatcaaccgcccataccggggcggcggcgagcccggatagaagtcgatggcgtcgatgaagtccgggtggatgacggccggccccaggaacaggtggaagaggatggggacgcggatgccatccaggaagtagcccgtggccgcgggctggctgccgcgcaccaccgggtaggccacgccggacagcatgctgcccacgccgggcagcagcatgacgacacggaaggggtcccccatggtgccaggcacctcgcgcagttacgcgtcatgcagggtgacgcggctcaccttcgtgcgctcgcggtctccccgcaccaccgactcttacgggatgatgatgagcggatccagcccgtacaccacctccagcgcctcgttcgccttcaggccctcactgaagacgccgggcttgtggccgggggcggagatacacaccgcatgcacgcccgcgggccagtagcgcctcgaagcgtccgtccacgtccgcctgcaccggcgcgtccggatgcgcgtccgacaccagcatggcccccaccagcggccggcggttgcccttggtgcgcaccacgtacctcatggtgatgggcgccgcgggcgtggccccctcggatatgcccggcgcgggcgcctcgaagcggtactcgaagaagatgcgcacggccaccggcaggccgtccagggtggcgggggcgaagcgcagcgacggcgccgcgtgcagcgccgcccggtccaacaagggatgcagcccttccaccaacgcggcggactccacgtcgcccgcgtcgtcgatgagcaactccagcttcaccacccccgcgacgccgtcggacgccagagcgggcggatagggagcgggcgagtcctgcaccatcgcgggcggagagaacgcgggctcgggcacgcccgcgtcctccgacaagggcgaatccgtctccacggcccagcccgcgtcggtgcgttgcagctcccgctccgcccgggcggcgcccccgtcctccggcgtccccgcgtcctgcgcgttcgcccgagtcccgagcatcaacagggccaccacggcgaccgccgttcgcgctgctggcctgactgtccaccacccaagtccgcgggtcattccctcaccaagcggggcactgcgcaccctgccccccatgaggccagggagacggcggagtgacaagcgccctggggtggatccgcgcgggccgcgtcagccctgggcgcggcgcgttgccggcccttctctcgacacaatgacaatcacagccttgggctccccaacatgcccggagtcccggccgctgctggacggcgcgcacaccgccactgccctccacacctgggaagcaaccacctccggacggtcaatgcctcaccgtccggagcccggccctcaccgctcaggcaggatggcggccgcgacctggttcatcaggttgagctggctgcgcgacatgcgccgcagcgttcggagcaccttccgcatctccggcaactggtccctgtgcctggagtcctcttcccagagcgcggcgccgacgctggccgccgtggcgagccccagcccgacgtccgccgacaaccgcagtgccagacacagccggaacagggtcggcacgctgggcatcatcttcccccgctccatgcgcccatagacttccgcggcgatacccacacgccccgcgacctccgcctgggtgagccccgcgagcagccgcgcgcctcgcgccgcctcgccaacgctctccgccagacggctctccagttgctcgcgcgacttccgggcgcgatccgccgggcttcgaggctgggaccggggccgctggcggggaggagcaggaccttcaaggtgggtcttcactgcgtcaaccttgtgagtacgggccaagctcacgccctgcccgggaacaggtcgcgctcggtcacgagttttcccgcgacttataacccggtacgtcctcaggcgaaataccgatatggagggtagtctcccgccccgcaccctcagcgaaaagtgtcgcacccggcaccacatgttctcgcgccggatgcgccgccccgcaccaggcagacgcccaggcgtcagcccacgtggccacaccggcaccgggtccatccggccctactcgccatgtctgtcattgagggagcggccaatccctccactaaaattcgctgaccagggttgcctcgggaaaccactccatgcaatgtgcatcattacggcaacacttccgcgacctgtctgtgcagcctcctggaccggaggcccgcagccggacgcgtgagtttgggcatgggcagccaaggcattcgccgcccatgtgggggccagcatccaccctggagcacagcacgtctggcttcggcctgacggcgcccacttcttctggagtccccccgcaatggaattgagattgacctcgcgcctggtgcgagaacccgcgccgcctcagcccctggggcctgatgccttgcgcgaactgcgtcagcgctgcgcgctcgccacccccgaggacaccgcgcgcggcatgttcttccggggggtcctggagacggtgcgtcgcgtgggcggctccgccatggagcagctctgccgccagcccctgccggagaagcgctacatcgacttcttcagctaccccatcacccagttcctgccgctggccttccaggccgccggcctgctctccgaacattgcgggggcctggccgccgcacatcgcttcatgggccagaaggccgcgcatgacttcctggagtccgtcgcgggccgcaccctgctgatgctcgcctatgacgagccccggctgctgctcgggcagctccccaccgggttcctcgcggcggtgagctacggcgagcggcgcatggtgtggacggggcctcgcagcggccgcttcgtcatgaagcgggacttcatgcccaccgcgtaccacgagggtgtcctgcacgccgccctggaagccgtgggcgcgcgggacatcggggtgcaagggcgcgagctgggcctgctcgacacggagtacgcgctgtcctggcgctgaaacgcaacaacgccggaggcccagtgctccgggcccccggcggaagaaaagccccgccccacttcaagggggcggggcggtgcttcgactacagcagcgagcagagcagcccgggggagcgcgaaccggaggggcagttgtcgccctggcagtacacgacgcccgaatcgatggcggggttggccagcagcgcgggaaccttcacgttgcaggtgccgatggcgctgttgccggacgcgtccttcacggagtacgtgaagttgtagacccggccgttgcccagcagggccgcctcggcgcgaaccatcgcggacttgcggtccgggctcagcttgatgtcgtcacacgccagcagccggagcagggacagggcgtcgttggactcgtcggaggtgacgcggatgatgctggccgacgcgcccaggtcgagctcgccgccgcagttgtcgacggccggcatcgcgcagtcatccagggaaaccagcacgtagtcggagcccaggaccggctggatgaccaggccgcggttggcgcccggcgtgggggcgctgacgtccacgacggtcacgttcgccgagcacgtgcgggtggccgcgccgtcggagaccaggagctgcgcgctcgtggtgcccagcccataggggcccgcgggcgactgctccacggagaacggccccgggaagccgtctgggtcgaacgagccgttgtcgatgctggcgctgccctgacaggccgcgtccgcggggacggtgacgttctggcagttggccaccggctgctggttggtggcacaaggaatctcgaaatcaatggaggcgaagttgttgtcctcgtcgtcctccggataggtgccgtcctcgtccgcgacgaccaccaccttcgtggtgccctccggcaccgtgtacgacagcgagaaggggaaggtctccccccccaccagccaggggacgctgatggtgcccagccgcacgccgccggcgcccggcgtccccgcgtacaccgccgcggtggagttcccgatgcccgtgggccgctcgttcttgatggccgcggagagcgtcagcgccgtcgccgcgcacgaggcggacaggtccaccacgctcaggtccagccccgtctccttcgcctcctgacgctggacctccatgtcgatgtttgccgggctctgctcgggaagcgtgccctcacagcccgtcagaagaaacaacgccgtcaacgtcgagacgccatgattccgtgtcatgtctgattcctggcatgccgggagcacgcctgctctgcgggggggggaaatgcctctcaacgaggcaactcttctatgtcgattcgtttccccggataccacggactcccagtgtacgtggagacaattattttcaccagcctgtatgaagtccgcgctcccaccggggtaatggacgacacctcaccttgactcttgataatccagacatggggcgatgcatgcctgacacccctgggtgtcattatcgacgatgaatacacaccccccaagacaggcgccgtgtatccacggccccatgagtcaacccagacacatccaagaaaaagcagacatcacagccaacccccgcatcgtgtcgcggtggacatccgaggcgtccacgggcggacgcattgccctggggccctggcggacattggacttcagtacaaggctacggcctcatgtccacgcccaacctcgtcctcctcgtggaagaccacgctgacagccgggagctgctggaggagttcctcaccctggagggcttcaccgtggagacggcgggcaacggactgtccgcctgggagcgcctgagccgtccgcccctgccggccgccgtcctcctggacctgatgatgccggtgatgagcggctgggagctgatgcgccacgtgcgcgaggacgcgcggctgagcaccctgccagtggtggtggtctccggggcgggaagctcccaacccctgccggagggcatccgggccacggtgcccaagcccgtggatttattcgagttgcgcgccaccctggagcgggtggtgagccccgcctgagcgcgtcaggccatcggcaggcggggcagcgtcacccggacggtggtgcccgcctgggcggtggaggtcacctcgatacgtccgccgtggcccttcaccacctgctcgacgatgtagagccccagccccagcccactgctgctcgctccgccgacccccgccatggcgccgcgccggaaagggtcgaagagccgggggagcatctccggggagatgggctcgccggggttttggacttccagcaccacgaagtcgccatcgtcatacaacttgaaggacacaggcgcgtccgcggggctgtattggagcgcgttgccccccaggttgctgaccacctggagcagccggtccccgtcccactccccttcgtagcggcccggctccactcgaaacgccagcttgcgctcgggccaggccgcctccaattcatccacgcccagccggaccacggcccgaaaatcaccggccgtgcgttggatgggaatgccgccgcccagccgcccgcgcgtaaagtcgagcagctctgaaatcatgcgcttcatccggtcgccggagcgggcgatgcgcgtcaccaaccggcgctcgcgctccggaagcgcctcgctgtgcaacaactgcgtcgcggacaactggatggcattgagcgggttgcgcaggtcatgactgacaatggcgatgagccgctcgccgaagcgggccgcctgcaacgaggcctcctgggcgcgccgccgttcggagacatccaccatggtggccaccgccgcgacgatggtgccctcccggtccaggatgggcgcgctggagagcagcacggcgatgttctgaccatcctcgcgggggatgagcatctcctcgccctgtaccacctcgccgtggtgcaggctgcgcgtcagcggcagttcctccatggcgtagggccgcccatccgggtgcagcgagacgccattgtccgacatgtagtcctgcatcgacgtggagggatggaagggcctgccggtgatgacctccacctgccggctggccatcaccaaccggccggacggtgcgtccgcgatgaacacgcccgcgggcatctggtccagcaccgacgccagccgcgcgcgctcggcctcgatggcgcccagcagccgctgccggtccatctccatggcgcggcgctgggtgatgtccaccacggtggccacccgctgctccacacggccggactcatccttgaaggccgtgacgtgcgtgaaggcggggaagcgggtgccatcctttcgcatgtgcagtgattcatattcgtgcgacggcttggagttcgccgccgcgacgtgtcgaggcaacacgccgcgcgcttccggcgcataggtgtcctccagccgccgtcccgtcaactcctccggcgagtagccatgcatgcgagcgaaggcggggttcacctcgcgcagccgctcctcggtcgcgtccaccaccgccacgcccacgcccagccgcttgaagacctgcgcccaccgccgcaggcccgcttcactctcccggaggcgctccagggacgcctccgccacggcgcgcgcctcgcgctcgcgggcatgcgcctgggcctgcaacagcagcgcggtggtacgcgccgccatggcccggaagaggaactggtcctcttccgacagttcatgggtggcgcggctgcccatcagcaccacgcccatcaactgcgctcccaagagcaacggcacaccgaacaacgccgacaggtccgcatcgcgcaaggacggctcgctcacccggctgtccgtgcgcgccgcgcgcaccagcagcggctgccgcgtggccgcgatggtgcccgtgaagccctcccccatgcgcaccacgtcccccacggccatccccgagcccaccacgctctgcacccgcaggacgtcctcttccagcagcaggacggccgccacgtccaccacggccacggtctcccgcaggacctggaggagggccggcaacagctccgcggcgtcggcgctgcccagggccgcggtgctgatgcggtccagcgcctgcaacgtgcgctcgcgcgccagcgagtagcggctgacggaggccgccaccgcctcatccatggcctcgtggaagacgagctccgcctccgggcggtgggtggcgttctcccgggacgtccacaagcgcagcacgcacgcgcgcagcagccggtactccgtcaccacctgccgcaggtcgaagccttcccccagccgctcgatggcatgccggtccggaatatcccccaggccatcccccacgccgccgggcgagccgcggcgcatcagcgaggcgacgacctccagcagccggggcaacccgtcgcgcagcgcgagccttggcagcgcctgggccgcggggatgcggcgcacctccacctcccacgcggacatgatggattcccgctgctgtagaagaaactcggccaggaggatgggcacaatctcgtggatgtaggcgtcagcgcggccgacgacaacagcaatgcgctccgagtgcccgacagcggaaatgtccgaaagcgtgcagccacctcgcacgtccggagtgcgtgtcacggacactccttgaaaagagcgctggaggcagccaggggcggcgctgttagggtcgcttcgacatgagcgggcgcgcacggtttgcctgggcgctggtggtggggctgttgggccatgcgctcaaccgatttcccgtggaggtcatcccaggcatcgacatcctgctgggcttcttcctcatcatccccgcggccccgctgctggggccctggtgcgcggggctcgcggccggcatcgccacgtccgccaccgtccaactgtggggccacccctggagcatgctgggttcgatgatggaaggggtcgtcctgggcgcgctgacccggcgctactggccccttcaggcggacgggctcttctggctgggaggcatcccctacctcatcatcgtcagccatcgcctgggcgtggacgtcacggcggcgagcacgctcgccattgcggtcaagcaggcgatc

SEQ ID NO: 989 - DNA, 10322 bp, Myxococcus xanthus
tgtgctctaaaggcggcggtgcgtgccttcttggcgggggcctcagagggagccggcacagcgggcgcttcagcggccggtggcgtcgcgggcgcctcggcctgcttgggctccgcctcgggcgtgggctccgcgggcgtgggggccgtcaccgcgggtggcgggggctgggcgccttcgggcgcgggggcggcggcatcctgggcgagggcgggggacgcgagcgaaacgagcagtgccagggaccagtggcgcatggaacctccgtgggcggcggagcctagcagaggaccgcgggcggggcccggcgtccgtgcgagcaggcggcttcaacacagtcctcgcatgtgggggcggaggttggtatgggggcgccccgatgcccaagcgtaccgatatccgcaaggttctggtgattggctcgggtccgattgtcatcgggcaagccgtcgagttcgactactccggtacacaagccatcaaggcactccgggatgaaggcgtggaggtggtgctgctcaacagcaaccccgccaccgtgatgacggaccctgagttcgcgcatcgcacctacatcgaaccgattacggtggaggcggcggagcgcatcctcgcctcggagcgaccggactcactccttcccaccatgggtggccagactgcgctcaacctcgccaaggcgctggcggagcagggcatcctggagaagtacggcgtgcgcctcatcggcgcgtccctggacgccatcaacaaggccgaggaccgccagctcttcaaggcggccatgcagaagattggcgtggccctgcccaagagcggctacgcgacgacgctggaccaggcgatgagcctggtggaggacatcggcttcccggccatcatccgcccgtccttcacgctgggtggcaccggcggtggcatcgcgtacaaccgcgaggagttcgagaccatctgccgctcgggcctgaaggccagccccaccaccaccatcctggtggaggagagcgtgctgggctggaaggagtacgaactcgaggtggtccgcgacacggcggacaacgtcatcatcgtctgctccattgaaaacctggaccccatgggcgtgcacaccggtgactccatcaccgtggcgcccgcgcagacgctgacggaccgcgagtaccagcggatgcggcaggcgtcgctggccatcatccgggagattggcgtcgaaacgggtggctccaacatccagttcggcatcaacccgaaggacggccgcatggtcgtcatcgagatgaacccgcgcgtgtcgcgctccagcgcgctggcgtcgaaggcgacgggctaccccatcgcgaagatcgccgcgaagctggcgctgggctacacgctggatgagctgcgcaacgacatcacccgcgacacgccggcctccttcgagccgacgctggactacgtggtggtgaaggtgccgcgcttcaacttcgagaagttcccgcacgcggaccggacgctgaccacgagcatgcgctcggtgggcgaggtgatggccattggccgcaccttcccggaggcgtacatgaaggcgctgcgctccatggagctgggccgcgtgggcctggagtccccggagctgccggcggagaaggaggagcgggagaaggtgctgcgcgaggcgctgcgcatccctcgcccggagcgtccctggttcgtggcccaggccttccgcgaaggcatgacggtggaggacgtgcacgcgctctccgccatcgacccctggttccttcgctacatccagatgctggtgaacgaggcgcagtcgctccaggagtacgggcggctggaccagcttccggacgaggtgctccggcaggccaaggcgcacggcttctccgacaagtatctgggccggctgctcggctacccggcggaagaggtgcgggcgcaccggcacgcgcgcaacatccggcccgtctacaagcgggtggacacctgcgccgcggagttcgaggcgtacacgccctacctgtactccacctacgaggaggaggacgaggcgccgcccacggaccggcagaaggtgctcatcctgggcagcggccccatccgcatcggccagggcatcgagttcgactacgcgtgcgtccacgccgccttcgcgctgcgcgaggccgggtacgagacggtgatggtcaactgcaacccggagacggtgtccaccgactatgacacgtcggaccgcctctacttcgagccgttgaccatcgaggatgtgctcgaggtgtcccagcgcgagaagccggtgggcgccatcgtccagtttggcggccagacgccgctgcgcatctccgtgccgctggagaaggcgggcctgcccatcctgggcacgtcgccggacgccatcgaccgcgcggaggaccgggagcgcttcgccgcgctcatcgagaagctgggcctgaagcagccggagaacggcgtcgcgcgcagccacgcggaggccttcaaggtggccgagcgcattggctaccccgtcatggtgcggccctcctacgtgctgggcggccgggccatggagaccgtctacgacgtggccagcctggagcggtacatgcgcgaggcggtgagcgcatcgcccgagcacccggtgctcatcgaccgcttcctgaaggaagccatcgaggtggacctggacctggtggcggaccgcaccggcgcggtgatgattggcggcgtgctggagcacatccaggaggcgggcgtgcactccggtgacgccgcggccacgctgccgccgcactcgctgtcgccggacctggtggagcggatgaaggaccaggccatcgccctggcgcgcgagttgggcgtggtgggcctgatgaacgtgcagttcgccatccaggggaagaccatctacatcctggaagtgaatccgcgcgcgagccgcacggtgcccttcatctccaaggccaccggcgtggcgatggcgaagatcgccgcgctctgcatggtgggcaagacgctcaaggagctgggcgtcacgcaggagccggagttcaagcacgtggcggtgaaggagagcgtgttccccttcgcgcgcttcgcgggcgtggacgtcatcctcgggccggagatgaagtccaccggcgaagtgatgggcctggcgaacgactacgcgtccgccttcgccaagagccagctcgccgcgggcgtgaagctgcccaagagcggcaaggtgttcatctccgtcaaggatgacgacaagccggcggtggtggacctggcgcggcgcctgcggagcatgggcttctccctcgtggtcacctccggtacgcacacctacctggcgacgaagggcatcgaggcgcaggtggtgcagaaggtgacggagggccgcccgaacatcgtcgacaagattgtcgacggcgaaatcgtgctggtcatcaacaccaccttcggcaagcaggagatcgccgacagcttctccatccgccgcgagtcgctgatgcactcggtgccgtactacacgacggtgcagccggcgcggatggcggtgggcgcgctggagtcgctcaagtgcacggaactggaagtgaagccgctccaggagtacctgggcatcaacgcggcgcccccgggcacgcggcgctgaaacgcagcgctcgctggacgtgagtcatgcggccccgctcctcctgggagtggggccgtctgcgtttccgggccgcctcaggccggttggtccgtcacgaagccgcgccagttgcgcatgtagttcacgaagacgtcggacaggccctcggcgttgagcgtggtgggggacagcggcggcacctggagcgcgtcgcctcgctgcacgcggcgcggccagtcatggttcgcgatggccgctcggcccacggccacggcatccgccccgcgcgcgagctgggcctctgcctcctcgcgcgtgcgcacctcgcccgcgaccacgatgcggacaccggtgcccacggcctgccggaagagcggcgtcgcgtgctggtccggccgcttcagggtgttgtgggccgccttccacagggacaggtggaggatgtccacgccctcgcgcgtgagcatgcgcgcgacctccagcgactcgtccaggtccaggcccctggcctgcctcgcgtcctccggcgacaggcgcacggcgaggaccagggagggcgccgcgcgccgcaccgcgcggactgtctcctgaaggaggcgccagcggttctccagcgagccgccccatcggtcctgccggcggttgaagacggtgctcaggaactgcgagaataggtagccgtgcgccccatggagttccacggcgtcgaaccccgcctcggcgcagcggcgcgccgcgttcgcgaaggccgcgatgacgccctcgatgtcggcctcggtggcttcgcggcagtggaggccgtccgcgtcatacgcgctggcgctccacacctcgcgctggctgacctcggcgttggcgcgaagtcctccgtggaagagctgcgcggagagcagggcgcccccttcatggatgcgcgcggccattcgcttcagtccgggcagcatcgcgtcgtcgtgaacgcccagctcgcccggccacgtcttgccgtcctgggaaacgtaggcggcgcacgtctccaccatgccgaacccgccatcggcgcgcatcgcgaggaagcgaagctccgcgtcggagagcgtgccatcgggatggctctgggtgttcgtcaggggcgccagccagatgcggttgggcgcgatgacactctttcggagctcgaggggcgcgaacaggtcggtcatgacggcatctcgctttcgatgtgggcgggtccattcgctcgggctgatgggggcgccaggccgcttgccgtgccgcgcggcggcctgcttccccttgacgtcaatgtcgccctgtgagccggactcgaggcgcggggtataacctgcgcctcggggctccgcatggcctcgttcgaaagcaggggccgagggcaaagcgtggctggacgcccgcggaccctggcggctacggttcgcgccgagctgttgccccccttcgcccgtgtccatctccgcgaccgaggagagccgttcatgccgtcccaggctgcccccgacttcgacatttcttccgtggacgtggaggggtttcaccgtgagttgaaggcgcttcgtgagcaactggacgcatcgctgggcgaggcggatgcggcgcacctccggaagattgagcgctggggtcgggcggcgaccgcgctgggtgcggcgacctgctggctggcgccgaacccgctcagcgcggcggcgctcagtgtcgggcggtccacgcgttggctgctgatgcaccatgtggggcatcggggctacgaccgagtgccggggcttccggcgtctcgcacgggtaagggcttcgcgaaggggagccgccgctatctggactggctcgactggatgctgccggaggcctgggtgttcgagcacaacgtgctccaccactcgcacactggagaggatgcggaccccgacctcctggagcgcaacgcggaggggacgctgcgcaacccggagcgttcgctggcgctgcggtacgtgcagctctcgctgctcgcgctgacgtggcgggccagctactacgcgccggagacgctcagttcgctgcgccgcaagggccggcgcaagggtggggagctgacgcgcgaggagctgaaggagctgctgctgagctgctatctgccgtattcggccgtgcagttcgggctcttcccggcgctctacctggtgttggggccgtgggcgtcgttcagcgcgttctgcaactccgtgatggcggacatcctcaccagcctgcacacgttcctggtggtggggccgaaccacacgggcgaggacttgtaccggttcgactcgaagccggagagccgtggcgagcgctacgtgcagcaggtgattggcagcgcgaactaccgcacgggcggggacctgaacgacttcgcccacctgtggctgaactaccagattgagcaccacatctggccggacctgccgatgctgaagtaccgcgaggtgcagccgcaggtgaaggcgctttgcgagaagtacggcatcccctacgtgcaggagagcgtctggacccgcgcgaagaagatggtggacgtcgtggtgggcaagacgtccatgcggaagctcgcgccgaagcgcccggcccaggatgccggagtggccgctgtgcctgctcccgcggcgtgaggcagggacgttcggctactcggtgtaggctgcgaggttcgccagggtcgaggtcagtccctcgatgtggtcttcctggcgaatgccttcgggcacgtcttcacaggtgacggtgacgcgggttcccccggcgacgggcgtcagcgtccaggtcatggtcatcgtgcccgcgtaggcggggtcatccgattcgaactcgaatcgctgcacgatgcgttcgttggggacgagctccacgaagaggccctcgacgacgtcctcgtgcgcggaggtcttcccgggcgcggtgtggtccgcattgtcgtaggagagtgtcatccggtacgtcccgcccgcgcgtggctcgaacgcgtggatgtggcccttcatgccttccggtgggagccaggtcgccacggcctcgggctccacgaaggcccggtagagggctcctggcgaggccgcgatgactcgcgacgccgtgtcgattctcttcccagggcctgtcgtgttcgtcacgggggcatcctgttcgtgggcggtgcggcctacgcgcgccgcgtggttcgtgtcagcgtcttccgtggtggagcttcggcggcgtcgtgccggacggcctcgacatccaccacgcgcgagccatctggcggaaccggtgggcccagcgtcaccacgagcactcggtaggactcctccagccgcttgtgcagcttggagaagatcagttgggcggtgccgggcatgtcctcggtgtacgtgaagtaccagcgcagctcatccaggcggccgtagaagtggtccaccacggcttgttcctgctcgggcaggtggatgagctggtcgaacgcgccgtcggcgtaccgtgacgcgatggtgcccaggagcggttcgcggctgcgcaggcgggagaagagggcgaacatctcatcccggcgggcatcgagcctgcgcatgatgcccgcggcgtccatcgcgagcaggtttcggacgcgggaggccatttcatcggccttcttgcgacgagccatggcgcgtcagcctagcatcagtagacgcgcaacaagtgggaccggatggggctgttccgcccgtgcttgcaaatcgtcaaggcgtacccggctccagctgcgaatcccaccagcgtggagcgtcatcaatcggattgtccggcgaagggaagtagaaggggattccccatcgctcatgcgcaatctggccaagttcctctgcgatttcttttccggaccaggatgggacgctcccctggatgaaccgcatgtccccagattctccgcgcatggtgaccaagcggacgctcgtgaaccgcggatgctccctagacgctccgggcaaaatcgcttcgagcgtgaggagccaacccgtcgagtctccatcccaaattgcctccacggcacagggcggacgggccaactgggacagattctccagcccctgcgtgcgccaagaagaaggagacgtctccctctctttccttgccgtttcctccgcacgaaatcgagggtggagttccatcagcgcttcggtgcgatgtgtgatccactcgagtgcatcgtggagaccacagcgcgttcgctccttgaagagcttgatagcaaggatgaactgcccgtctagaaggagcgcatccgcagcttcgagcacatcttccggaacaggcttgctcaacgtgtcggtcacgccgaggagcttctcgccgacggtcgcgaggcgcaaggcatggacactcttcatgtcggacactgcttcgcccatgacctgctgtacgtgcagccgcgctgatgagcgcccgtgatctcgcatcagtagacgcgcaacaagtgggaccggcacacgaaccgtgggttgcggaagtcgatgacctcgatttcgcccgtcgtctcctcgaagcgtccggccaggatgccagcagcgctcgtcgcggcgatgtaccaggcgtcctgtcccttcagttccttgagcttgcgcaggtacacgacgcggccttccacggcccacaaggtatggatgccgtcggctcggacacctcgcgcgccagcgggtggcgcagcgagcttcgcaagtgacgccggaatggcgttcaggacgtaggcgtcgtaggccgggttgccactcagcgagatgagcttcgcatcgcgcagggtgccatccacctcctgcgtcagctccagcgtcacgacgagcttcgagccgccaccggtggccagatgttggagctcctgacccgcttgggccaagaggcgcgggcgctccatggagtcgtctccggcgcgctgctggaggtcgtagagctgttcggtcgtggtgggcgccttcggcggtgggccgtctcctgggttgccagccgcaccgaagctgctggctcgggaagcccaggcggtccctgcctgattcaccaggctggttcctgggaataccggcgcatcttcgaggcccttctcaagcgcctctcgaaagcggctgaaataccggtcgatgagaccgttggcgacgcgaagctgggcctgattgtcgacgatgaattcctccacacgccccgcgacgatggcctcctcctgcgcggcgagctgctcacgggaaggtgccgggtcgccagggcgcaacgtgcgtccactcggtgtccttggaccggcgagtggcgctcctcctggcaccaggaacgagggcagggactcggcgccaacgtggagttgttgcggcctgcgcggggcgtccggcggcgatgcggtggtttccggcgcagcacccgtgtcgggtgcgtcgggaggtgccggggatggcgctgcgacgaggccatccccggccggtgtctttctcacccgctttcccttgggacgaggcgtggacgccgagggtgcaggctgcctcgggagaggtgggggcgtcagcacaggtggcgtggtgacgatgtccaccgcgagcggcttcgacgtgacggcccggcgaggtgcacgctccggcgggtcgacagacccgagcagcaagagcagccccacgtggatgacgagcgataccagcgcggccccgccgagtcgtcgcatcctccgcatctcgactctcacgctccctgggacggggtctccacgtcctaccagcatacccagcacggaccttggcctggacacgcctacgtcccgctgtgcgcgccattgcgtgcagtccccatcaggacatggggtgcgaccgtgcggtgtccaacgcaatgactcactgcgacaagcgattcctttaccgccgtctgtctcgcgcgtcggttacgctcagtgcttcgaggccaccatgaacaacgctcctgatgatggctttccggctgaccagcgcttgctgcggagaccgggtagaacgatgccagacgcgctccggcagttcgtcgcggagacctgggtcttccgcaggcaggaggaactggaggcggtgctgcgcttcgcccgattggcgggagcgctcgagcaactggccacgcccgaaacgctggtggaactcgcgagccgcgctgcggaggacgaacggcgccacgcgggcatgtgcgagctgatggcgcgcacctacggacaaaaggtaatgccccccgtcccctggtggcgcgggagactgccccgcaagttctcggtttccgtgagcgcgtgctctacgaagtcgtggccgcctgctgcatctcagagacggagagcacggccgggttgacctcggtgctggccgtggacggaccaccccgggtgcgcgcggtgcttcgagacatccttcgggacgaggtcgcgcacagccggttggggtggggctacctcgcgcatgcagccaaatcgggctccgtggcgttcctgtcgccgtacctgcctgagatgctggaggagagcgtgtcgcccaggctcttcgcgaagggcctgtccgatgcggagggttccatgctcctggcgcacggcgtgttgccgcatgagcggaagctcgaggtgttcgtccaggccctgcacgacgtcgtctttcccgggctggaacggtgcggagtggacaccactcccggacggcagtgggtggagcattgtcgccggtcaggagcgtagcgggccctgctacgctggcggcatggt

SEQ ID NO: 990 - DNA, 9146 bp, Myxococcus xanthus
  unsure (1)..(9146): unsure at all n locations
agtggacgaacgtgcacggcatcgaccagacaccggacacggtggagacggtgtccggcttcccgcacaaggtgtaccgggacggcgcaggcaacgcgctggtggagacgtgggaactcaccggcatgggccacgcggtggccatggatgcgcagttcccgtttccaggcggcacgggcagcgcggcctgtggctcggtgggggcgtacctgagcgatgtgaatctctgctccgtctaccaccaggtgaagttcttcgggatgacgggaggcggaggtgagcccacgggggataccacgccgcccaccgtcaacgtgacggcgccggcgagcggggccacggtgagtggcacggtgaatgtcaccgcggatgcggcggacgcggtgggcgtcacccgggtggagttcctggtgaatggcgaggtggtgtccacggacacgcaggcgccgtatgccttcgcttggaacagcacggccgtgtccaacgggcagtacacgctgggggcccgtgcgtttgacgccgcgggcaatcaggcgacggacaacgacacggtggtgacggtgagcaactcaggctccccggcgccggtgacggtgcagttcgccagcatcgcggcggatgatggctacctgaaggcggacgcggatggcagcggggcggcgctgggattcatgacgaacctggcgctcggccgggggacggatgggaagtacaaccggtcgttcctctccttcgacacgtcgagccttccggacggggccaccgtcacgcgggcgttcctgacggtgagctactcgtcgggctcgggagacccgtggtcgacgcccgcggggaacacgctggtcatcgacgcgaagacggggacgttcaacgcggcgaacacggaggtgacggactgggcggcggcggccacggcgagcagcgtcgcgggcatcgaccggttcagcgcgggaacgaagagctccggggacttcagcgcggatggactctccgccatcagcaagacggggaagacgcagctccggctgcgcttcacccaggcgcagacggccacgcagtacctgttcatccgggatggggcgaacgcggtgctgacagtcgcctatacgccgtaggaagacggagcggacgccggctcagaccggcgtccgctgcatcagcgcggcaagtgagtccctgcatcgtgcgcagtggccgcggaacgtgtcgctgagttcgggggtctgctccagccggctccagtaggccagtgcgtgttgtgcggcatcggcccagacatcgagcgtctccgaggtgggcggccggggctcgaaggtgcgatcgatgatgctcgtgcccacgggggcgaacatcttcgggagcatgtcgtaggcaggggcgagccggaaccgcttgggtccgtcctcgaagaaagagaggttgccgaagtgccggtcggtgttgccggtgagctgcccgaaggtgtcgagccagcgaatgcgcctgacgtcctcttcgctgatgtactggctctggaggaggtagcgggccgcgctggtccaggtgctccccttcccttcgtggccgaggtactcgttgtcgatggccttgagtgagagcagcgccttgcggcctctttcacccacccggtcgaagcgctcgacctcgaggaactggtagccctcgacgcggatggagcgcgaagccgcggccggaatcccggcgttgcggaccacttcgagcgcgaggccttcgcagacgagcagctctctccaacgttgggcggcggcgccgtcatcgttggccgcgaacttcaccaggacgtggcgtcgctcggcataggcagtgaacttgggttgatcgccaccggcgaaggagcctgcctcgctcgacatcgatgagcgggcgagctccgggtactgggcctcggtgacgggccgaagcgggcttgcgagaaaccggtccagggaggccgcgccgatgatgtggtttccgacgcagtcatcgcctcgcaacgccagtgcgatgagctggtggtcctccgtccagtccgtgatgcgaggggggagtcccaactcgaggtgacggctcgtgaagcctcggcccaggtagccctgagggctcatgtcggcggcgaaaggcggcagcccggcgaaccgttcacctaccccgtcctctcgcgcaatccagcagcccccgttccacagcgggtgcaggacgcctgcctcgtggggacggccggtctcgtcgacgcggtacatccgtacctgttcgcccaagggggcaatcgagcgggtccgcgcatagcgtgtggcgggcccctgccccattcggcagacgctcgggcctgcggaggccagcaaccgcgacactgtcgggcgtgacacccggagctgggtagccagctcgctccccttcacctcgacctgacgtccgagtacggcgagcagttgttccagggttgccatgaacagattcctgaaaggatccgtgaagagatatcggcgtgcaactcatcgatatcactaagaaataccagccgcgcaggctcgatctattgaagctctggcccctctagagccaatagattgaagaagtggcggcccttcatcgatgcagcgcctgcctgacaggccgccgggggccttgccctggacagttgtcttcttgtctgggagacgacagtcccgcacggaaagcccatgcctgaacccaccctgcccgagcccggcccggacgaaacgctcgactccattggcacggcgggggtgcgggtgctccagcggcggacgggttaccgcttcacgttggacgcggtgctgctggcccacttcgcggccaccgaacgtgtcgacgagtccgggcggatgttggagctgggcgcgggcagcggcgtggtgtccttcctgctggtgaagcagttcggccgggggcccgtggatgccctggagttccagcccgccgttcatgcccggctgatgcgcgccgtggcgctcaacgcgtgcgaggcccacgtcaccccgctgctcggggacctgcgacggatccgcgaacacgtctccggcggccagtacgcccacgtcgtgtccaacccgcccttccgcctggccgacgcgggggttcgcagcccggatgacgaacgggccgtgtccaagtcagaggtggcgtgtgacgcaccatccgtcgtcgccgcggcacggtatgcgttgatgcccggcggcggcgtgagcctcgtgtacccggccgcgcgtgtggccgaggtattgggcctgctgacccaggcgaagctccaccccaccgtgctgcgcttcgtccacgcgcgggtgggagccccggccacgcgcttcctggtgcatgccctgcgagacagggaccggggcctcgccgtgcgcccacccctcatcgttcatggcgaagggcccgggggctactccgcggaggtggcggcgttgatggatccgcccctcgcggagagtcgctgacaaccgcgccgccgctctacggcgtgcccgtgagcggcttggtgttcgtcacctggacaccgtgctcttcggacgcggtgacgaacagctcatggctcgcgggcaccgccagcgtcgagcgccgcagcttcccgcccaccgtgaagtccacctccagcgcatgttccccgggcggcacgtcgcggaggctcaggttcgtcgcgttgctcgtgccccggcgctgcccgtccatcatcacggtgcacggcttggtgcagcgcacgtggaccaaggaggtcggcgccgcgcgcgtttcaggctgcttcgccgcctccaggtccttctgctccgtgagcgtcacgcggcccttggagtccccctggatggtgacctccgagccacccggcacctccacgtagcccacgaactgccgccggttgaagacgccaccgctgccttccacgcgccgctggccgggcgccacgtcgcggaactcccaggtccggttgtcccggcggagaccttgcttcccatcgagcagcaccgtgcagtcgtcctggcacttcacggtggccacgctcggtgccgtcgacgtggaggccggcgtgggaggtttcggctcggcccagtccggtgtgccgggcatggtggagctgccgggctcgatgatgatgcgcttgttgctggccaggaagacgtccgccgtcgccacgtccgggatgaccacgaagctgccggcgagcggacggctcagcacgcccgtggcatcgatgcgcagggagcccggcgtgatgcccttgaactcccaggtggtgtcattcacccggaacccgttctttccatccagcatcaccgtgcacttctccgtgcagcggacccggacggcgacgccgtcgaccgcgagcgctggagcagacaccaacaacgacagggacaggagcggccagcggagggacatgacggggtgactgcctcgtaccagtgggtattcacgcggggccgccccagggatgcgggtccactcccgcctcatgaggcaggccccttggggccggcagtatgcctaccgggcaagggaggcggaatcaccgcggcgtgccatgcgcccatgccggacccaacctacccaggtttccgtcaacggccccggcccatccaaggagtggcaggtatgaacgtggcgaccctgaccgagcaaccgagcatcctgaaggcagcggccctgctgcccccgcgcctgtcgctcgggtcgacgatggtggtgcatggcgtgtccaagctccgcgccgagggcaccgcgcaacacgcggacctcttcgagcaactgggcttcaagccaggcaagccctgggtcatcgccacgggggtggtggagctgctctcaggcgtgagctccatcctgggcatcgccacgcgccccgccgcgctggctatcctcgtcacgcaagccatcgccgtggccaaggtccatggctccaagggcttcgacatcacgaagggcggcttcgagttcaacctggcgctgggagccatcgcgctcggcctgctgctgcgaggcccgggaccgctctccgtccacagcgccatcgagcgccgggtgaagcgcaaggagctgcggcggctgcggttcctgccgcgccagcgccgtcgttcggtgctgctcgacgtgctggggtgaacccgggccgcgccgcgacacacatcccatcaccctgaccgatgaggtgtgtgtcgcctgtctggctgctgggcagggtgaggtcatctcccctgtcacagaatcccaggagggcctctagaatggcgggacatgccctcgtccgtcttcctcttgatggcgctcgccaccacgccgggtgctgcttcggcgcgtgagtccgcccccgcccagcacgtctctccatcgcaaggccccagcgccgattcgagctcgacccgaggcccagattcccagggcactgcgcccgcgccagagactgtcatcacggacctcaacgcctaccctcgtgccggtgactccggcgcggtgctggacctgggccgtgccgccgcggaggccggcgccgccgccctgcgcgccgcggccctggccatgggcaagagcgccaccccgcgtggcccgctggccgacccggacacgagctacgcccgaggcatggaggccctccaggcgaaggacgcacccacggccatcacccaactgtccgcctgcgtggaggccgcgccctcgcgcgtggattgccgctgggagctgggctgggcgcactcgctggagaaccagtgggcggaggcctacacgcagtggtccgaggtacagaagctccagccggaccacccggacctcgagggcgcgctggcccaggcccgtgggcaggccatgctccaggcgaagctgtcgcaggggcctcagctcatcaaccgccctcccccgccggccaacgcgaaggtgcgcatccgcgcggtgggtgacgtcatgctgggcaccaccgtgcccgaaggccacctgcctcccgatggcgccggcagcgtgattgccggcgtacgcccgttgctggaggacgcggacctcaccttcatcaacctggaagggccgctgtgcgacacgggcgagacgaagaagtgccgctcgtcgaaaaactgctacgcgttccgctcgcccaccgaatacggccagtacctgaaggagtccggggtggacctggcgtccacggccaacaaccactcgggtgacttcggcgaggagtgccgccgcgcgacggagtccacgctcgacgcgctgggcatcgcgtggagcggcgcgccgggcacggtggccacggtggagcgcaacggcctgctcatcggcatggtggcgttccacacgtcgccgtcctgcaaccacctcaacaacctgaccacggcgacggggctggtgcgcgtggccgcggccgagcacgacatcgtcatcgtgtcgttccacggcggcgcggagggcagcaaggcgctgcacgtgcccaagggccgggagaagttccacggcgaggaccggggtgatttgcgggccttctcgcgcgcggtggtggacgcgggcgcgcacctggtcatcggccatggcccgcacgtggtgcgcggcatggagttctacaagggccggctcatcgcctactcgctgggcaacttcgccacctatggccggttcaacctgcgcggtccgcagggcctgggcatggtgctggaggtcgagctgaaccgcgacggcgacttcacggcgggccgcatcctccccacgaagcaggtggacaggggcatcgccgtgccggacccgaagggcgccgtcatcaaggcggtccgcgacctcaccgcggatgacttcccggagacgggcgcgcgcatctccgacgacggcaccgtgaaggtccgcggcaagggccctgtctccatgcgctgacacggcgtctcatgcgcacggcggcgtgtgggtgcttcacggacctggagcccgggctgaagcgcggctgctggatgtgtcccagcttccgtcatagcggctcaaagcaactgccggcccctacaggcatgtcgcacggctccgggatacaaaggtccctgccgtgcgcacccttcgactgccacgtctctcctcgcttcgcgccttcgaccaccccggctacttcgcggtctgggtgggagccctgatctccaccatcggcacctggatggagacggtggccatgggtgtgtacgtcaccgaggccacgggccgcgccgagtggacgggtggcatcgtcgccctcaccttcctccccgcggtggtgctgtcgccggtgggcggcgcgctcgcggaccggttcgaccgtcgcgcctacgtcgcgctgggcacggtggtgcagttggtgctcgcgggcgtgttgacgctgctggccttcacgcaccggctcagcgtccccgtggtggccgtcatctccttcgtccacggctgcgccagcacgctcatcaatcccgccttcgcggcgatgctcgcggagctcgtgccaccccgggacttgcacagcgccatgagcctcaactcggcgcagttcaacctggggcgcatcatcggtccggcgctggccgcgctggtgctgagcatgggcgggacgtcctgggcgctgctcatcaacacactgtccttcgtcgcggtgttggtggcgctgtcgcaggtgaagacgctgacgcgcaaggtgacggagggcggtcagggcctgtggaagcagattgcccatggcttcaccgtggcgcggggggacccggaaatctcgctgatgctgtggggcacgttcctcgtcgcgggcctggtggcgcccttcatcggcctggtgccggtgttcgccatccgcgtcttcggccagggcgcggcagccacgtccttgctcgtcacctgccagggcgcgggcgcggtgacggcggcgctgctggtgggcacgctggtggaccggtggggccagcggaagctgctgggcatcgtggcgacgtccatcggcgtcgtgtccacgctctattggctgtcgcccacgctgcagatggcggccgttgtcatcttcgtgctcggcgccaactacatgatgctgatgagcgggatgcacgcgtactgccagtcgcgcgtgccccgtgagctgcaagcgcggatgagcagcctgtacagcatggtactgggcggcgcgtacgcgtccggcgtctggggcctgggcgcgctggcggaccggctgggcatccgcttcgtcaccgtgagcgccagtgtgttgttcatcgcgttggtgctgacgctgcgcctgttgcgtccgcagcgcttcgacggcgctgtcgcgtagacgcgtcttccggacccgcgcccgcgactccttcgcgctacaggcgtctctccaccccgaggggccggagcagttccacgcggcgttgctcggcttcctcgggaagtgacgcggcgatgggtggcccacctgtgggcaacttggggatgcctccgggcgtccccatcttcctcgtgagccgggcggccgggcgtgcccccagtcctccgcggggaccttggtgcgccgcgagcgcgctccgacattcagcttcggagcggtacccacttcgacgaggagcgcgccatgccgaacaggaagtacgacccgtacacgggaggcaaggaggcggccaccaagcccccctatgcgccggaccgcgtggagcggggactggaagccgacgacaccctgccgctgtactccgcggactccatccgcgacacccgcgaggagaagttcgccctggacagtgactccgaggtgggcggctacgtccccgacatccgcagccccatcgacgaggcggacgagctggagcgcgagcgccggggccgcgagcgagccgaggagcggcaggtctccgacgaggaagacgaggcgcgcaaccgctgagccgcaggggaggcccggaccttcggacctcgtaccccgtgaaacaccgggccgtggctcgcgagcaaggtctcgccaccacggcccgggaggactgcctgcgtgctacttcgccgcgcgcggcaccggtgcttcatccggctcgatgggcaccagcttgcccaggccgagcggcgtcacctgctcctggatggtcgccgggtcacccacgaggacaatctgcatcgaggccgggtccaggtactgctcggccatgcgctgcacgtncgcggcgctggcgtcgcgc

SEQ ID NO: 991 - DNA, 10717 bp, Myxococcus xanthus
ctctaacggccgtaggctgtggtggtgagggtgccccggcgggcggtgctcacgcgctccacgtcgaggaaggcgccgggggcgggggtgacttcgatgacgttgccgaagccctcctcgcctggccgtccgcagtgtgccagcccgcccaggtcgtccacgctctggaggatgccctcggcgaagaggaagccggtggccaactcgcggtcatgtcctggcgtgcgcatggtggtggccaccgagtctccgctgacgcgaatctccagaggctcctccaccgcgatgtcgtcctcctgggccgggagtagcgtggcgccgttccaccgctggacgaagcggcgcgtgacgccgcgggcatccacggggggcaggggcgcggggcggctcgggcgcaggtgggccaggatgaggtccgccacggcgcgcacgtcgtcggggtgcagcacgcgcaggccgggtgggaagtccgtggggagtgcgggctcggaggagagcaccgcgaggacctccgggcgcgagggcgccagcggcgggcccagaccctcccgccatacctccagcttggggagggggccgtccttccagccttcgacgagcaccagctccacggcgcccgcggagcgctcgagcagcgagggaagcgcgtccgagagggcggtggccgtcgtgagctggacgcccgcgggcgtggtgaagccggtgagcacggcgcccgcgtcctggtagcgagcggtgtcgctgccgggccggtgcagcggatgggcgtcggaggagtgcttcaccacggccacgcgcaggcctcgcgcggcgagctcgggaacgagccgggtgagcagcgtcgtcttgccggcgccggaccagcccaccacgctgagcgcgggcacgcggctcatgccaatgcgcccacgggggtgaaggtgggccggtcgaagagctcgacgtcgacgaggtcgtcttcggcgaagtccgcgcggcccggtgggaggagggcccagccctcgccgtggacgttctggaggatctgcccggcgccctggggacggagcacggcgcgcggcgcgaggccgtcccgggcttccagggtggtggtgatgaggtaggtgaggcccgcctgcttgcggcgtgcttcggagaggtgggcgcggacgcggcggcgcgtctccaacacaccttggtgttttagaaggagcgggcgcgcgaactggtcgaacgccacggtggccgcgccgggattgccgggcagcacgacgacggaggtgtcacccagccgggccacggccacgggcttgccgggcttgagcgcgacgccgtccacgaagaagcgggcgccgagcgcggcgagcacgcgtttcaccaggtccttgtcacccacggaggcgcctccggtggtgatgaggatatccacctgcggggccagtcgcgagagcgcatcgcgcagggcgctctcgtcatcgcgggcgcgggcgagctggcggacatccgcgccggcctcgcgggcgagcgcggccacgaggacgaggttgctctcgtacacctggtggggcagggccggagtgccaggagggacgagctcatcgccggtggcgagcacggcgacgcgcggcgcggggcgcacccagacgtccgtggcgcccatggacgcgagcacgccgagcaccgcggcgcccacgcgctggcccgcgtcgaagaggggtgtgccggtgaggacttcctctccggtgcggcggatgtcgttgccgggcggcacggtgatgaagacgtccacgcgggtgccgtcctcggcggcgcgagtggcctcctgtcggacgacggcgtcggcgccggggggcaggggcgcgccggtgaagacgcgcgcggcttctccgggccggaggggcgtggaggggagggcgccggcgaagatggtgctggtgacgcgcaggcgcgcgggccgatcgcgggaggcgccctgcgtctcctcggcgtgcacggcccagccgtccatggcggagttgtcacagccgggcagcgagcgggaagccgtgacgggagcggcgaggaaccggccctgggcatcgaggagcggcacgcgctcaggcgccgccggggcgatggcgtcgagcgcggcctgccgggcggtgtcgagggacgtgaggggcatggaagcgccgcagcctatgtcgtggagcgcccgctgtgtccacggggggaggggacgcttcgtctgggggcgtgcgtgggcggacagataaagtggccgcggcaggcgcgcgaacggggcatgagcatggagcggatccgcaccgatttcccggaggtgacgctggccatcctcgcgggagggcagggccggcgcctgtctggcgtgcccaaggggctgttggaagtggaggggcgcacggtgctggagcggctcctggcgctggccccgtgcttcgaggacgtcttgctggtggcgaacgtgcccgggccctatgcgcgcttcgggttgcgcacggtggcggacgtggtgccgggcaagggagcgcctggcggtgtccatgcggcgctggtggccgcgcgcacgccctgggtggtggcggtagcgtgcgacatgccgttcatcacgacggaggtcctgcgggtgttgctgggcgcgcgggacgacggcgtggacgcggtgtgcttcgaggcgcggggcaggttggagccgttgctcgcagcgtaccggtcggcgttggcaccggcgtgggagacgacgctggcgacggatccgtcgatgcgggagctgttgtccggagtgcgaacgcggctgttgtccgaggccgtgctgcacgcggtggatccgtcactccggtccctggcgaacgtgaacacccccgaggacctggcgcgctacggtgtggcgctgccgtcgtggcgggggtgaggggagcgtgtctcccgaggaaggcgctcaagaaagggattgggaacgcccaggggtatactgacaggccgtgagacccgccctgcgcgtatggcttctggtgcttgccttgttctggggcggttgcgccaccgcctcgaatgcacctctccaaagcggaggggctgatgcggagaaggagtgtcgctcgcccgatgaagacaggtgcgtcgcactcctgtgccagggggacgcatgtggcttctacctctgtgaggacatgcccggtgcggtgtcgctggcgcgctttcctcctgcgcgtccgcctgctgctgccgccgcgcctggcagagggcctcggaggcattggggaggtgggcaccaccttcctcgaggggcagtcatggtcttccccaactggaatggcgcgcccgagcggatcatccctccgtcacgccagctcacgcccgggcgctgggaaaagcatcacatctttccccaggcagaagacctctcgatgtggttcggaattcgaggcgtcaagatccacgactacaccatgccgattccgcgtgacgtccatcggcgcattcacggtggagacggacgcggtggcgcgtggaaccaagcctggcgcgacttcaaggcggcaaagccgggcgccagtcccacggacatctacaggttcgcgggggaactcatacatcgcttccaactcatgggcggtccgattcagccctactattcgcgcccgggagtgtgaggacggatgagccgtttcttctggatgcacgaggacaaggccgcggcggcaaagtacggaggggagatcaacgcgtggcacaagctgtcgctccccggcgtgagctgcggcacttgcggcgagacatgggcccatacgggacacgagtatccgtgcgtcgacctggctcaactgccggagcgcaacgagttcgcgcgtcccaggcccgagcccttccctgaattcgcgcgtctccgtgagctggtccggcctctggttcctcctggtgccgaactgccgcccggtacgggcttcggtcccttggtcggacgtgccacgggcgtattcggtcccattgcctgggtatgggggcagaagctgctcgtgcagcgcgaagccctgtcgcggttgcattcggagggcgtacaaggactccaggcctgcccgacgcagcttcgtttccggcagaaagacccgccagaactgctggagctacagattgagccccacggcaggctgcatccggactgcatcccgcccgatgagccgccaccgtgcgtgacctgtggccgctttggcctgacgcggccggatgcgcccattctcgacgcggcctccctccccacgggcctggacctgttccgggtcgggaacttctccacgatgattgtcggcacggagcgcttcatggaggcagtgcgccggctggacctggatggcatcaccttccaagcgctgcccgcgcactgacggccggctcgccaagactcgagcctaagcaagcaaccaggcagcaccccctgcgtcaccatgactcatggaccacggcggccgggagtgggaaacaggcgggggagaacctcatgctgaagacccctcttggacgtttccgtgcagtggccctcgcggagggcctgtccgtcatcgcgctcttcttcatcgccatgcccttgaagtacgccgcgggcatgccgcaggccgtgaagttcaccggctgggttcacggcctgctcttcgtgctctacctcttcgcgctcatggaggcggccatcacctaccgctggtccttcgtgcgcgtggtgggcggcgtcttcgcgtcgctgcttcccttcggcaccttcgtcttcgaagcgcgcctgcgtcgcgaagcggccgagccggccgtcgagcccgtgccctgagccacgtcgcgcaccggacgtgacgggtgggacgctccgcaccgaggccgcccggagttcgcgcgggcggccaagctgtgccagcatcccgcgcgttctccgacgggaggtcagcatggagcgcggcaagtgggacacgccagaggatgtggagcgcgagctgagctcgcggctcgcgctcgtggaagcgtccgagggcattcgcggcatgcacttcgcggccgtcctcgacaccgtgcgcttcctcggcggtgaacaggcggtggctcccatccagcagggcggtgactaccccgccgacctggacaccaccgagttctaccccgtcccgcccttcatgcgcgtgttcttctccgcggcccggctgctggcaccgcagctcggcggcgtcgaggaggcgatgcggcagctcggcgtccagggcacgctggccttcatcaactccatgttcggcgcagaggtccggcagcaggtgggcggcgagcccaagcgcctcgtggagatgctccccgaggcctaccgcatggccatcaacttcggagagctgcaggtggcgtggacgggcccgcgctcgggccgcatccacatgcgccgcatcttcacccccgtggcctacaacgagggcatgctcgaaggcgcgctgctggccgtgggtgcccaggacatccaggtgcgcggcggacagacgtccctgctggacagcgagtacacgctgtcctgggactcgtgacctgctgcgtgtcgtggatgtggtaggccgcagtacgtgccgcggtttctcgcctcgcgagaatgggccattgccagtgctggtccgtacacatctgctggacgaatcgtggtgagcccctctgtcacgcggctgatccacgcatgacttcgacgcgactgttcacaaccatgacgaaataaatgatgttccaccgcgcccattggctagaagtgggcgccgagcgcccggacatgtgcaccgggcctacgcaacggagggacgtctcatgaaggcaaacaactggaagaacctggccgcagtggcgggcgtcatggtgtcggtgagcgccggcgctcaggagtcgtcggggagctttggttcggaggggcagttcgtcatcagcacggatgcctccgcgagcctgggttactccacgcagggcagcggcatcggctacatcttcctggagcccggcgcggactacttcctcaagaagaacctgtccgtcggcagcggcctccaggtccgcgcgctcttcggcagcggtgacacgattgccgccttcggcctgaacgcgcgcgtcggttacaacatcccgctctccgaccgcgtctccgtgtggcccaagggccaggtgtcgctgtacatcggcgacgacatcctgcccttcgccaactcggcgctccccgccaacgtcactgtcatcctggaaggctacgcgcccttcctcttccacgtgacgccgcacttcttcgtgggcggtggcccgcgcctggccttcggcctgggcgatgacgtggaggtgaacttcagcgtcgcctccaccatcggcggctacttctagcctccgccccgccgcgtccttcgaggacgtggacgtgcgtgtggtgcatcaggggcctcggacgaggtgggacgctactcccaccgcgtgccggggcccgcttcatttccagccaagggcccgggccgccgccgccgtcagtggctccgctgttgaacggggccgccctctcgcgacaggttcagcgcggtacccaccagcgcgaggtggctgaaggcctgcgggaaattgcccaccatcttgtgggccaccgggtcgtattcctcggacagcaggcccacgtcgttgcacaggcccagcaggcgctcgaacagctcgcgcgcctcgccctcgcggcccatcagcgccagcgcgtccgccagccagaagctgcacgccaggaagacgccttcgcccggagggaggccgtcccgcgtctcgtgcgtgtggtagcggcgcaccagcccgtcctggcacagctcgcggcggacggcctccacggtgccgcgcacgcggacgtcgtcgggtgggaggaagcccaccatgggaatcaacagcaggctggcgtccagggactggctgccaaaggcctgggtgaaggtgttgcggcgcgcgtcgtagccccgcgcgcagatgtccgcgtgcatctgcgcccgcagcgccttccagtgctccacctgcgcgccgcgcatgccgcgcaggttcgcggtcttcaccatccggtccatggccacccaggccatgaccttggagtgggtgaactgctgtcgcccgccgcgcacctcccagatgccctcgtcgggctggtcccagttgcgctccacgaagcgcagcaggtgcacgctcacgtcccaggcctcggcgtccgaacagacgccatgacggagcgcgtggtagaggcagtcggcaatctcgccgaagacgtccaactggagctgacccacggcggcgttgccgatgcgcaccggacgcgagcccgcgaagcccggcagccacggcagctccagctcggtgacgcggcgctctccggctacgccgtagaggatttggagctcgtcgggctctccggccaccgcgcgcagcagccagtcccgccaggcttgggcttcctgggtgtagccggcgtccagcagggtcagcagcgtcagcgtggcatcccgcagccagcagtagcggtagtcccagttgcgcacgccgcccatccgctcgggcagggacgtggtgggcgcggcgaccacgccgccggtaggggagtaggtgagcgccttgagggtgatgagcgagcgcagcacctgcgcgcgccaggggctctcatggatgcagcggagcgcccaggcgcgccacccccgctccgtgtccgcgcgcgtgaggaaggggtccggcggctgccggggcggaggcaggtgcgaaggatgccaggacaggacgaaggccaggcgctggccttccggcacggcgaagtccgcgagcacatggctgtgctccaaacgcagcggcagctccgtggacaggtagagcgcgtccgggccggccttggtgctgacgcctcccggaatcaggcgggcccagggcgtgcggtcgccatagccgaagcagggggcgaactccaggtggagcggcacctgtccggtgcgggcctccacgatgcgaatcaaatgcggcgtgtcctcgcgcagcggcatgaaatcgcacaggcgcacggtgccggcgtcggtgtggaactccgtctccagtaccagcgtgtcgcgcacgtagcggcggtggacgcgccgcacgggcacggtgggggcgatgcgccagaagccatgccgcggctcacccagcagcgccgcgaagcacgcgtccgagtcgaagcgcggccagcacagccagtcgatggtgccgtcattcgccaccagcgcggcgctgtgcgtgtctccaatgagggcatgggcttcgatgggcagcgccatgcgggaaagctagggacgcctcccgcggcgtgtccctccaggagcacccggggcggcgggccgtccacgggccccgcggatggcggaggagggggcagccgcccgctcgcgacgcatcgacgccatgcgacaagacatggggcatgagcagggaatgccgcggcgcgcgattcgctccgggtatggggttgcccggacatgactgtccatgcgggccggccgttctcgattggcgttggtcctccgcgcggggggccacagggggtgcgcggtctggtgtttcatccgcatgtttcacccgcatgcgggcctcgcggcggccccgcacgccaggcggggaggcgcgtactgcttcctacccacgtaccaggttgcgcagaaggaaggccagattggcggggcgctcggccagccggcgcatgaagtacgggtaccagtgccgtccgtacggcacgtagatgcgcaccgggtgaccctccctcacgagtcgctcctgcaagtccctgcggatgccgtacagcatctggaactcgaaggcgccgcgcggcagtccgcgcttcgccgcgtggtccagtgtcgcttcaatcatccgttcatcgtgcgtggcgatgccgtgatacacgccgctgtccagcagcacccgcatggtgcgaacgaagctggcatccacgtcctgcttgtctgggaaggccacgtcgggcttctccagataggcacccttgcagaggcggatgcggatgcgctgtgcgcacagttccttcgcgtcctgctccgtgcgccgcaaggcgctttgcaacacggcgccgacatggggctcgccgaactccgcgcgcagccgtcgcacgatgtccagcgtcacctgcgtcatcgagctgtcctccatgtcgatgcgcacgaaggagtcgcgggccgcggcctcggccaccaccgtgcgcgcgttctccagggccagggcttcatcgaacaacagcccgcactgggtgagcttcagcgacacgttggcccgcacgcccaccgcgtcgatgcgggccagcagccgctggtactggcgcacctcctcccgcgtctcctcgggcgtctggacggcctcgttcaggtggtcgaacgacgccatgagcccgcgcgcggacagcgccttcacggcgtccacggcctcctccagcgtctctccggcgatgaagcgtgaggccagccgccggaaggggcgcaggcgcatggcggcgtcctccagtccagggcggcgggccaggaacagcagggcggaacggggcaggtgggtggcgtcggtgctcatggtgtgggtggcggctcagtccgggggctgccggaggaagtccccggccagcgtgttgaaggcatcggggtggcgcatgtagggcaggtggctggcgccccggatgcgcgccagccgggctccggggatgtgccgggccacgtcgcgggcggcgcggggcggcaccagcaaagtcccggccgccctggatgacgagcgtgggcacctggagttcatggagccggggcatcaggtccgtggccaggatgtcccgcagccggcgcagcagctccaccggggacaagcgccggggctcgcgctggaaggtctcccacgcgctccccggatggcagacaacccgtgagcccgcccgaagcgccgtcatggcgttcgcccgagtcccctccacgccgcccagccatggcaacaccgtgtggatcaacgggatgcggaagaacccccgttccgtcaggcgcaatggatggcggccggtgccctggtggatcagatgaaagaaggcaggtgtctcgtaaccccagacgccgtggttccccgccagcagcatcgggcctttcaatggctggtgctcacagcccagcagccgcgcccggtggtacagggccgacagcgccgcgccctgctcggcgagtcggaatacggcccggcgcaggctggcgagcggggcatccatgatggaaaaacatggggatgcgtggcgtccccagcaggcggcgccctcctcctggccgccgggcagccgggcgcccctgagacggcggcggccctgacagtgggggttcgtaggagtttgagtaatgtcagctcgcaggcatactcaggttgtctgcttcctggtgcatgccgaatgttccggcatgggcagcccgttcgacatcctcatcgaccagcatcgggaactggaagagcgtctcgagcgtctggcatcgggtgtggaacccgatgagctgaggggattgacggcggagctgctggcattgctgaggcttcactcacgactggaggagcgctgcctctacccggtgatggcaggggtggagggccgcgagtcttgtcgtgagcagacggaagaccatctcacgatgcgtgagctgatggctgagctggaagagctgccctcgggccatcccgagtggcaggcgcgtct

SEQ ID NO: 992 - DNA, 9873 bp, Myxococcus xanthus
ctgccctgccgacgcggtatcgtcttccacaacatcagccccgcgcggttctacgaagggctgccgctggcggacgcgctggtggcgggacgggcccagctcgccgcgatggcccccttcgcggatgtggccatcggcgtgtcggacttcaacgccgccgagctgcgcgtcgcgggttaccgcaacgtccacacggtgcccctcttcatcgaaccggagcgattctcccgcgccagcgcggacgcgaagatgctccagcggctcgaaggtccaggccccgtgctgctcggcgtgagccgggtcatgccgcacaagcgcttcgaggacctgctcgcgctccaccgcgaagtcctgcggttgcgcccccaggcccgcctgttgatggtgggcggctacgagccgggcagccggtacttccgcatgctccagcgcgaggcgcgcggcctgcgcggcgtgagcttcctggggcgcctgagccacgcgcagctcgtggccgcgtaccgctccgcttccgtcttcgtctccatgagcgagcatgagggcttcggtgtccccctcatcgaggccatggccgccgaggtgcccgtgctggcctacgcggccgccgcggtgccggagaccctgggcggcgcgggcgtggccttcgaccagaagcgcttcgccttcctcgcggagctggcggtggacctgagcgaggacgtctccctgcgcgggcccgtcatcgctggacaggcgcggcggttggagcacttctccgcgccttccgtgcagaccgccttcacgaaggcactggaaacggtgctcccccgccccacgcccacgaagtcccggaaggttccggagcgtccccgggtggcgatggtggtgcagcgctacggcgaggtgacgggcggcgcggagaagctcgccgcgcaaatggccgagcacctggcgccgcactgggacctcaccttgctgacgacctgcgcgaagaaccacctcgtgtgggacaacgcgtttccgcccggccccgacgtcgtggacggcatcaaggtgttgcgcttcccgtccacgcgggtgcgtaacatccgaggcttcaacggcctgtcgcggcaggtgttcgacaagagcaacgagcggctgcgtgaagagcagtgggtggccgagcagggccccatgtgccccggcctgctgcaccacctggccaccgagcgcgacgcctacgacggctatctcttcttcacctacctctacgcgcccacggtgtggggactgccgctggtggcggaccggtccctgctggtgcccaccacacatgatgaggcccccgtccgcttcggtgtgtatcgggacgtcttcgaacgcccgcgcgccctgctctgcctcacgccggaggagcacacgctcatcgagaagtacttcccgaatcacgcacccacgcgcgtggtgggcgtgggcgtggaccggcctcgggcggatggcgcgcgcttcaaggagaagcacggcatccaccggcactacctgctctacatcggccgtcaggagccgggcaaaggcgtgcctgagctgctcgagtaccaccaggccctgaagaaccggttcgaggacgcgccggacctggtgctcgcgggcgacaccaacatggagctgtccggcgagggcgtgcgctatctgggccgtatcgacgagcaggacaaacacgacgcgctggcgggggcgttggcggtggtggtgccgtcccgctacgagagcctgtcgctgctgacgctggagtccttcgcccagggcacgcccgtgctcgtgaacgggcgctcggacgtgctggtggggcaggtggagcgcagcggcgcgggccgcgcgtacacggacctggagtcgttcatccagggcctgcgcgaggtgggctcggagcgtgagcccatgggcaagcggggcctggcgtacgtgaagaagcagggctggccgcaggtggtggcggcctaccgggaagaaatgcaacgcatcctcgaggagaagcgccgatgaagttactgggacgggacatccccgcgcgggagctgatagctcgcatcgaggagcgcctgcgcacgcgtggcctccccacctccgaggaagtggagctgccgaccgaaggcgtggagccccgggtggagccgctgaccttcaacctgcatgcgctggaggagtacgcggacgccacgcgcgccctccccctgcacacccaccggggtggcgtgggacaagtcgtcctgctggccaagtgggcattccgcaagtcgtgccaggtgttcatcaacgaggcgctcggcaggcagcgcgtgttcaacggacacgtgcgcgactcctacgcgcagctgtccgccgaggtgctccgtctgcgtcgcgaggtggaggcactccgggcgaggccagtccccgcggtttccgatgcagtggtgccgcagcaagagcgcgcacagcgacgcgagcacgaagcggcgccgtccgccgtggcgcaaccgtcgaccgcgccggctccagtcatagacaccgtgctgcccaagccgcgtgacaccaaggcccattcacggccgccggctcggccgaagcagccggtgagcgcggcttccacggaagtggatgcgacctcggcgcctcgtgcgccggccgcgggcgagccagtcacgagcaagaccgcccgtgcgaagaaggccgcgccttctgcgcctgcacagccctcagcggagtcttcgccgcgccggagcgcctccggacagaagaagcgccgcaacaagaagtcccgttgaagaacacccgatgaggggcacggcggccgcccccggacctcctgaacaggccgcgttccaggacttcgggccacgcagccgggtgcgtgcgaggcgggaacaggccgacaccttgcattgacggcccatccgcacctgtgctcaatcgaacacgtgcatgcgcccttcgtcagcgtcgtcatccccgcctacaacgagggacagcggctgcctcgcttcgtcgcggagctcacgcgcgtgttcctcgagcggagcgccccgccggtggagttcgtcgtcgtcgacgatggcagcgcgcccgagcacgccgaactccagcgcgcgagcgtagaggcggcccaggctcgcctcgccaccgagggggcgcggcaccagttcacctacgtggcggcgcctcgcaaccagggtaagggctcggccatccggctcggttggcgtcacgcgtcagcgggcgtcacgtggctggccttcctggacgcggatggagccatcaacgccgaggagttccaccggctggtggcgctgagcgcctcggagatggcgcggaacgtagacctcctggccggctcacgcatcctcatggccggacgccgcgtcgtgcgcaacctccaccgccacctgcagggccgcatcttcgccacgctcacggatgcgaacttcaaactccacttctacgacacacagtgcggggtgaagttcgttcgcgcggacatcctgcggccgctcctggacgtcctccaggagcagcgctggctgctggacgtggagttgctggtgctgctgaagcgccagggcgcgcgcttcctggaggtccccatcgactgggaggacttcggaggttccaaggtcatcccagggctcgacgcggcgcgcatgttctgggggctgctgcagcttcgtcggcgactggagcatgtgtccctgcctacccaccgtgacgcgttgcccgaaggcgagccacacgcccagcggtaggcaggagcgtcactgtgtaggcgtgcagccccgccctgcctgcacggcgacgcgggccctcacctccagtgacaaggccgcttgatttccggacggtacaccgcgaaataggcctcgcttggaagccgtttctccaggttcctcccacactgttcgtgacatgcgcgccttgactgacctgccctccgaccccacctctcctctgaccctgggcctgccgggctttgtcttcgaggacctgtatcgtcccgctggtctgcgccggttggcggagcgcttcgacgcacagctcaccgaggatgagcccgagctcttccaggccttcgacgcgtaccgcaagtctggcggcacgagcgtcagcggcgccgcggagtcggacctgctcgtccgcgtgtcgcgccacgtgtcgcgcttcgtcacgcgcctcttccgagtggagcaggagctggagcgcctgtccggccgcctcaagggcgagctgccgctcttcgacttcaagcgcgagttcatcacccgccgcgtcttcaagaagggcgccgcggaccgcccggcgctggcggagttcccctcgctggacgcgcgcatgcggctgatgctccagctgggcttcccggaggcgctggccaccggggacctggagcggggtctggcggaatccgtcctctcgctgatggacctggagcgcctgttctccaacgcgctgcccgccgagcgtcagggcgaggcggaggccctgcgcgcccgctggtccgcgctgcgcgaggtgctgctgtccacgcccgagggcaaggacgccttcggctccagcctcgtcacgcagggcgatgacgccgcggagatccagtccgtgcgcgcgctgctgtcgctggcggaccgttggacgtacgcgcgggcgctgcatccggagacgaaggacctcttccacgcctggcccacccaccggattcccaagccgctggtgttcgaccagctcgtccagctccagcgtccggacaacgagctgcccgaggccaccgagggcctggagcaccacctccgccaccgcgacggcttcaagctcaccgaccgccggggcacctcgcgcgacgtgatgaacgaggtggactactgcgtgctctgtcacgagcggcagaaggactcgtgcaccaaggggttccccgccaaggacccggtggccgaggggcaccactacaagaagaacccgctgggcatccccctcaacgggtgtccgctcgacgagcgcatctccgaggcgcacctgctcaagcgtgaaggcaactccgtggccgcgctggccatggtgacgctcgacaacccgatgtgcccgggcaccggccaccgcatctgcaatgactgcatgaaggcctgcatcttccagaagcaggagccggtgaacatccccctggcggagacagccacgctcacggacgtgctgaacctgccgtggggcttcgaaatctacggcctgctcacgcggtggaacccgctcaacgtccgccgcccgtacgcgctgccctacgtgggccgcaacgtgctggtggtggggctgggtcccgccggctacacgctgtcgcactacctcctcaacgagggcttcggcgtcaccggcgtggacggcctcaagattgagcccttccccgacgcgctcgtgggccgcaatggccactcactccagcccatccgcgactggtccgcgctcaccagcgagttggacgagcgcatcctggagggctttggcggcgtgtccgagtacggaatcaccgtgcgctgggacaagaacttcctcacgctcatccacctcacgctggcgcgccgggagagcttccgcatccacggcggcgtgcgcttcggtggcaccctcacggtggaggacgcgtgggcgctgggcttcgaccacatcgccatcgccgctggcgcgggccgcccgaccatcatcgggatgaagaacaacctcatccggggcatccgcaaggccagtgacttcctgatggcgctccagctcaccggcgcgttcaagaaggactcgctggcgaacctccaggtgcaactgcccgccatcgtcatcggcggtggcctcaccggcatcgacaccgccaccgagctgatggcgtactacccggtgcaggtggagaaggcgctcgcccgccacgagaagctggtgtcccaggtgggcgaagaggccgtgctggcccgcctcgacgcggaggagcgcgccacctaccagacgttcctggagcatggccgcgccgtgcgcgaggagcgccagaaggcgaaggccctgggccgcgacccggacttcatcaagctggtgcgcgcgtggggcggcgtcagcctcgtctaccgccgcagcctcaccgagtcccccgcctaccgcctcaaccacgaggaagtgacgaaggcgctggaggaaggcatccgcttcatcgagcgcatgagcccggtggaggccctgccggacgcctccggcgcggtgcgcgcgctgcgcttcgagcgcatggtgacggtggacggcaagctcaagggcagcggccagttcttcgagctgcccgcgcgcacggtgtgcgtcgccgccggcacgtcccccaacgtcacgtacgagaaggaatacccgggcaccttccagctcgacgcgcgcggcgagtacttccagagccacgagctggtggacgccgaagacggcttctcgctggcgcccgtgaaggcgaaggaggacccggccgcgaagacggggttcttcacctcgtaccagaaggacggccgtttcatctccttctacggcgacaaccacccgacctacgcgggcaacgtggtgaaggccatggccagcgcgaaggacggccacccgcaggtggcgcggctgtacgccaaggaagtggccgcgctcgacttcaccgacgaggtggcccaggcggcgcgtgacgcgcgccgcgccgcgcacttcgccaggctggacgaggcgttcaccgccaccgtggtggccgtcaaccggctgacgccgaccatcgtcgaggtggtggtgcgcgcgcccttcgcggccagccacttctctcccggccagttctaccggctgcagaacttcgagcggaacgcgcccgtggtggacggcgtgcgcctcaccatggagggcctggccctcaccggtgcctgggtggacaaggagaaggggctgatgggcaccatcgtgctggagatgggctcgtcctcgcgcctgtgcgccgcgctcaagccgggtgagcccgtggtgctcatgggccccaccggcgcgcccacggagattggccacaacgagacggtggtgctcgtgggcggcggtctaggcaacgcggtgctcttctccatcgcccgctcgctcaaggcggccggctgccgcgtcgtgtacttcgccggctaccggcagaagtcggactccttcaagcacgacgaaatcgaggccggcacggaccagattgtgtggtccgtggacactggggacacgattgaggcgcgccggccgcaggacgcggcgttccggggcaacgtggtgcaggcgatggtggcctacgcggagggcaagctgggccccgcccccgtcatctccctggcggacgtggaccgcatcatcgccatcggctcggacggaatgatgcgcgcggtggccgaggcgcggcacggcgtgctccagccgcacctcaagccggggcacgaggccatcggctccatcaactcgccgatgcagtgcatgatgaaggagatctgcgcccagtgcctccagcggcacgtggacccggtgacgggcaaggagacgtgggtgttctcctgctacaaccaggaccagcggctggaccaggtggacttcgtcaacctccggcagcgcctgcgcggcaacaccgtcatggagaaggtcgccgacgtctacctggcgcagctcttcaagcaggccccgcacctcaagcgcgtctgaggcgagaaggcggggcccgtcttcaccggcgtgtgccggtgaagacgcgaatcatctcctggtagttctggatgaggtcttcctcgcgcgtcaggacgacgtcgatgttcgcatcgccgtagtcgcggcgggcatcggccagcgtctggaaggcctccacctgggcgcgcattgacgccacctggggcgccatgccctgttgctgctcgggcggcagcttcgcctggagcgcctccagtttcttcagctcctcttcgtattggagcgtgcgccccaactgccgctgactgacgacggcggtgacgacctccgcgatgccgttgacgtccgcctcggagagctgtgcctcgcggcgcgcctcggcctccgccttggccttggcctccaccaccttcaggccctcgcgcgcggcggccatggcctccggggtgccggcgtccaccaacgcccccaggttctgcaggcccttcatgagcgagccgtacacctccaacatccgccgctgatagcccacgtacgcgtccagcttctccttcgtcaccgtgtaggggcctgcctccaccacaccgtcgggagcgccgggggcctgctcgcccaccaccccggcgggcggcccggaagcgtcctcgggtttcttacaggccgagaaggccacgagcacccacagtccccacagcaccttgcgcacgcgcattcctccagacgggacatgtcagcccctcatgtatgctccggcaacctgggcggtgagaggcgtcccgcctctgtctgtcacggtggggttgttccggccactgaacaatcgccgcattacctttgaccaaccctgccgcgctcgtgtacgaaccgcggttctgtcgaaagcggtggagggaatttgaggcttttcctggttaggcacgcggatgcggacgcggagatccccgagggtctcggtgacgaggcacgcgccctcaccgcgaagtcccgcaccagcactgcccagcatttcgcttcgctgaccgagcgcatcggtcctgtggggcgcatcctgaccagcccgctggttcgcacggtgcagacggcgcagattctctccatctccgccaggttcgagggcccgctgaaggtgcatcgctgcttgctgcccgacatgcccgtgggcgcggtggaaccggtgctcaacgagtacgcggacgagaacctcgtcctcgtgggtcaccagccgtccatgggcgccctggcggcccatctgctcggcatgcagtccttccccaagcccgtcaacccgggcaccgtcatcggcctggagcgcgcggagggggagtcttcaccggcgttcaagttcctgttctacgccgcccctggtcagcaggtgctcgacatcatccagtgaggccattgcggccatgatggacgaagctcgctacaaccagttggtctccgccgcgttcaagcgcatcctcgccgcggcggacaccatcgaccctgacatcctggaagccgacagcaccggcgacatggtgacgctcaccgccgcttcgcgggagaagtgcatcgtcaacacccagcgcgccgtgcggcagatctgggtggcgggccagggtcagggcatccacttcgactacgacgcggccaccggcacctggaaggacgacaagggccggggcctggagttgatgtcgttcgtcgcggacgtcgtccgcggcatcaccggggcggacttcgtctatcccggctgagtcctgccgctcgcggcctccacccagtccccacccgcggcctgagcgcgacgcagggcttctccagcctctttgaggaggctgccgaagctgacctgagacagggcgcccgccacgggtccacggcccgacgggggctcggagacggcgacacccacggaggcgctggcgccctcgtaggccgtcagggacttgatgagctcgcgcaggcgctgccccaccaccagcgcgccggagcgcggcgtgtgcggaaggaagacgacgaagcgactgtccgcgaagggcacggcgacgtcgatgtcgcgcactccggacaccagcagtcccagggcctcggcgagcgcgagcttccgcgcggcaggggccaggggcgcggctttctccgcgaacttgtcgatgtccaccagcaacacggcgatggggtagcggtagcgccggctgcgcttcacctccatcaacatcagccgcttga

SEQ ID NO: 993 - DNA, 12624 bp, Myxococcus xanthus
tcgttcatcaccatcgccgacctcatcgaataccgccgccggaaggaccggctggtgcgccgcgagcccggccagcagaccgtcaacacccgctacggtgagttcaccgccctcacctattcgtggctgcccgacggcgtgaagtccctggtcctggtgaagggcgacccggcgtcgcggcccagcaccctggtgcgcctgcacgcggcctgtgccctgagtgacgtgttcggctccccgtcgtgcaactgcaacgtgctgctggatcaggcgctggcgcgcatcgcccgcgaaagctccggcgtgctggtgtacctgccaggcatgcacggggacgacttgggcatccaccacaagcgcaacaacgacggcagcagcggccccacgcgtggcccgcaggagtcgcgtgacctgggcatgggctgccagattctcacggacctgggcatccacacgctccaggtgatgaccaactcggacgtcacctaccgcgggctcgcgggcttcgggctcaccatcgagaagcgcgtcccgctccagccggactgacgcgcctctcgccgggcggaccgggcccgtggttcagcccaggtccgccagcgcgcccttcaccgcgtccagcgtcgcgggcagctccacgggcgggttggcgaactggctcgtcacctccgccagcgagccgcggtggtagcccaccttgaagtcggcgaacttcaggccgtgcgcggtggacaccaccgccacgcgcgagccccgggcaatcacgccctgcgccaccagcttctccagcgccgccagcgccacgcccgtgtgcggacaggtgaaggttccctcgcggtccgcccgcgcggcggcgttggccagctcggactcgctggcgtcctccaccacgccgtcgaacgccttgagcaccttcaccgcgcgcttgaatgacaccgggttgccaatctggatggccgacgccagggtaggctcggcctgcaggggcaccagctcctggaagccgccccggaacgagcgcaccagcgggttggccttctgggcctgagccacggcgatgcgcggccggcgggtgatgagccccagcgacagcatcagctcgaagcccttgcccaaggcgctggcgttgcccaggttgccgccgggaatcaccacccagtccggcggctcccagcccaggtcctggcagagctccacggcgaccatcttctggccttcgatgcgcagcgagttcatcgagttggccaggtacagccccgtgtccgccgtcaccgcctgcaccagcttcatgcagccgtcgaagtccgtgtccagcgacagcacccgcgccccattggcaatgggctgcacgagctgcgcgagcgacaccttgtcgcgcggcaggaacaccaccgccggaatccccgccgccgcgcagtaggccgagagcgccgcggacgtgtcgcccgtggaggcacacgccaccgcgcgcagcggaacgccccgggcacgcatgtgcttcaccgcggagaccaggaccgtcatcccccagtccttgaagctgcccgtgggcgagacgccgcactccttcaagtccagcgcggccagccccagctccgccgccatgcgcggcaacggcttgagcggcacgcggccctcgccgagcgagacgatgtcctccgccgggagctgcggatacgcccactcccgcttgccccagacgcccgagccatccggcaggcgcgcggagccgaagcgcgtctcgaaacggcgcttccattccgccgcggagaccgtgcgcagggccttcacgtcgtgcgcgacctccagcaggccgccgcagcgcgggcaccggtacaccacgtccatcagcgaggcgcgaaagtcacagccctcactgcacgcgtactccgcgcggaaatccgaagccgactcctcgctcatgcctcctcctgtgcccgcgtgccacactccggacaggccttaccgggccgcacgcgagtatgacacgatgcgcaagagcgccagccatcgtcgtcgccagaaggtctcccaggcgccgctgccacggtgggcttcgcccgaggcaggcgcatgccgcagttgtcgcagagcagcccctcggcctgggtgatgcggcagtaacggcagacgacggcgcccagcggcgcggcggtgcgaacgccatcgtccggggcacgcccggtgtccagctcgggcatgggcgtcaccggaacggcccccatgtccctggcgcgtgtcagttgcaggtcgggaaccacctgcgccggcagatcgggcccggaacggagccgcgtcacgtccaggtcgggcaacacggccgcgaccaccggcgcgcggcctccggcatgcggtgtcacctccagctccggcaaagtcgaaatgggcgcggtctccgccacggccgcggggaaccgcttgccgcagacgttcgcaactccgtcccttcgggctgaaccgtggtcacagagcggacagataatcatgatgtgcgaacgttagcgggccgccgccgacatggcgagcaagcggacagagagcctgcctcccgcctcgctgggtcaggagccacccgagcccaggaggtcacccctgcgagagcggctgccccgtcatgggaacgaagcgaaccgacagcagggactccacctggggcacctctccgggccggagggctcgctggatgcgcaacagttgctgggtgcccccccttggccccaccggaatgatcatgcgcccgcccggcttgagctgtgaaaggagctgaagcggaacgtctggtggcgccgcggcggcgaggatggcgtcgaagggcgcctggtccggccagcccagtgagccgtctccttcccggaacgagacgttttcgaagccctgccgccccaacacctctcgcgccgattgggccagctcggggacgatttccacggagtagacctctctgcacagcagggacagcagcgccgtctggtagcccgagccggtgccgatttcgaggacgcgctcgtccccctggagctggagcgcctccgtcatcagcgccacgacgtagggctggctgatggtctgcccatgcccgatgggcagcggcgagtccgcgctcgcctcttcgcgcaggtcctccggcacgaagtccgcgcggttcagccgagcgatggcctccaggactcgcgcgtccttgatgccgtgccgcgacaggtagtcggcccttccccagtcacccatgcccctagcctaatcatggcaggcgccctaccccacccgtgcgagcgcgagccgcccttcccagcgttcctcgagcgccttcacgaggccctggttctccttcgccttcatgtccgggtccttctccaggatgcgccgggcctcggactgcgccatggagagcaggtcgccatcccgcgccaggttggccaccgcgagctcgggcaggccactctggcgcgtgcccaggaattcacccgggcctcgaatctccaggtccttctccgcgatgacgaagccgtcgctgctctgctccatcaccgtcaggcgctcggcggactcccaggagcgggcgcttccggccaccaggtggcagaaactcgccgccgcgccgcgccccacccggccccggagctggtgaagctgtgacaggccgaagcgctcggcggattccaccaccatcacggaggcgttgggcacgtccacgcccacctccaccaccgtggtgcagacgagcaggtgcaggcgcttctcgcggaagtcctccatgacggagtccttctcctccgccttcatccgtccgtgcagcagccccaccttcgcgtcggggaacaccttccggagcttctccacgccgcgcgtggcgtcctccaggtccagcttctccgactcctccaccagcgggtagacgacgtaggcctggtgccccttggccagttgcgcgcccacggactcatagacgagcgcgcgctgcttgtcgttgaacacccgcgtctgaatgggcgtgcggcccggcggaagctggtcgatgacggacaagtccaggtcgccgtacagcgtcatggccagcgtgcggggaatgggcgtggccgtcatcaccagcacatccggcttgggccccttgctcatcagcgtgtggcgctggagcacgccgaagcggtgctgttcgtcgatgacgaccaggcccaggcggtcgaaagagacgtctgcctgaaggagcgcgtgcgtgcccacggccagatgaacttcgcctcgggccacggcctcgcgcacctggcgcttggccttcgctcgtgcccgccgagctcaccaggcccacgcggtagcccagcggctccatcaccttgcggaagttgcgctcgtgctgctcagcgaggatttccgtgggcgccatgacggccacctggtagccggcctgcagcgcgatgagggcggagaccatggccaccgtcgtcttgacgctgcccacgtctccctggaccagccggttcatgggctccgggcgcgccatgtcctcagagagctcctgcaccacccgcgcctgcgcgccggtgagctggaacggcagcgcgttgcgcgctttcgccagccggggctcggacacgtcgaaggagatgccgacctccgccttcacgccctgccgcttgagcgccatgcccagttggaggaagaacagctcgtcgaaggcgagccgccggtgcgcggggctctggtgcgcatcgagcgcctccaggtccgcgtcccctggcgggaagtggatgaagcgcagcgcgtccggcaggcccatcaggtccaagcggcggcgcaggtcggcgggcagcgggtcatccagttcgtgcgcgtactgctcgcccacgcgggaggtcagctcgcggaacgagcgctgctcgccgcgctcgaagcccggatacacggggacgatgcggttgaagtggaccgacgtcgtggactcgatgtcctccgccggttcgatttccggatggggcatctcccggcccgacatggtggcgcggacctcgccggagaggacgatgcgcttgcccacggtgaaccggctcttcaaccaggggcccgcgttgaagtacgtggcggcgatgctgcccgagcggtcccccacgacggcgcggaacatgcgccggccctgacggcccggcacgaagtcggccaccttgacgatgcccaccgtgacgcctcgctcgccgggctccagttcggcgatggtgcgcaactggcggcggtcctcgtagcagcgcggcagcatgaagaggatgtcgcccatgcggcgcagccccttcttgtcgagcgccgagacgagcctgggtcccagccgcttgcccagcgtcttcagcggcgacgccagcggcccggagcgcggcgcgatggagaggagcttcgcctcggagcgagaggcctccgccgcgaccgcccgcttcttctttcgctgggccttctccttgcgcgtcttcgctccgggaaccgcctctggccccgtgtcgagcgcggcctgacggagccccggcttcgcccgagacgacggcgcgccctgccgcccggtggcgggctgcggcgcggtgacgttcgcctgcggaggctgcgtcgtcggcgccatccgcggtggacgggcaggcaggagctccgagtccattccggcctgacgcccccgcggcgcatcaggactcatgcgcggcatggggccctcaacgccgctcccgcgcgcaggggccgaggctccacgcgaagccggtcctcgaggtgcgtccggccgcgggcccgacgtgggcagtggctccgccgatttccagggcggcacataccccggaggcgtcgtgcctcccgcacccaccggagcgccctgtgtggacctcggccgagccggaaccgcaccctccatcgtcacgccgtgcaactccgcgggcagctccaccccgctgaccttcagcccggccacgactcgccgcagcgcggccttgcggcgctcgggcatggcgtggtccacgtcgggcagcgcggccctcaagtggtccagtgcccgtgcatccacgccactggcccccgccagcgcgcgctccaacaccgggcgcaacgacttcaccgtggccagcatcgcgaagtcgcgctggcacacgtaccggaggggtccaacaaggctggcgagcgggtggttcacgcgggggttccgccgtacatcctacggaacggggatgacgtctcccacaaaacgagaccggggaagcgagccctggcccgctcccccggcaactcactgcgacctccgaggctcagctcccgctcgccggggcctcttcctcgggctcctcgaagcggatctcctggacttccagctcgcgcacgccgccggggctctgcaccgtggcgatgtcgcccacctttttaccgatgagcgcgcgcgccaccggcgaggtgacggcaatccaccgcttcttcaggtctgcctcgatctcccccacgagccggtagctcaccggcttgtcggtttcggtatcgagcaggtccaccgtcgccccgaaaatgaccttgtcgccgccgagcttctttgggtcgatgacctccgcgcgggcaatccagtcgttgagggtcaggatgcgcccctcgatgtgcgactgtttctccttcgccgcgtggtactccgcgttctcacgcaggtcaccatgtgcgcgagcgacctcgatctcgcgcgagatcttcccccgctcgacggactggaggtgcttcagttcctccttcagcttgcgcagtccggacggggtcatcgggatgttgtcgctcccgctgctcatcgacacagctccttccaccactcccaggttcaaataagatggagggccggcgctcctcttccggagcccggcccccgcgaccaaacaaaagcccaatgtaaggaaccactgacaagttggtcaatgaaacccgtacagggaacggggggatgggctgggcgcgcgccctttgacccgctagtctgcccccgtgctgtccgtccaggaattgcgcgggctcggtgccgccctgccccccagtgccttccagcgtcaactggggccttttgcactcatccagcgcccgccttccgaggcctcgaccgccgtgctcgcccccacccgcatggcggcgccctcggaaatcgaacagggcatgctggccttgctgttcgagttcgaacacctgcgcgtggccaccctgccgccgctcaacgccaccgaccggctgcgcattggccgccgcatggactgcgacctggtcgtcgacgacgcgtccgtgtccaagatgcacgcggagctgcggtggaacgaagccgaccagcgctgcaccgtgcaggacctgggctccaccaacggcaccttcctcaacgcccgctccctgggtggccgcgaggccgtgctgcgcgacggcgacatcctcagcgtgggcaacgtgcagttctggtacctgctcacccgtaccctgcatgagcgcctgcgcgcgggcgaagccactggactgggctcgcgcagcggctgaaccttcccgcatgtccacaccgccacgcgacgagcgcgactacttcgagcgcatctacaccgtcaccacgcaagtgccacctgggcaggtggccacatatggggacatcgccgtcatcgtcggtgatggctgcgatgcccgcgtcgtgggacatgcactgggcgcgttgggcgcccgcgcggacagcgtgccctggcaacgcgtcatcaaccgcacgggtggcatcagcacctccggctacggacagcgcgaggccctggaggcggagggcgtcaccttcgacgagcgcgaccacgtccggatggcgtcacaccattggacgggccccagcgagacgtgggcccgcgcacatggattccagccgttgcctccgcgcgaagtgaagactccggacgcgcaattgaaactgttctgaacaggcgctcgccctcccgtctgcttgcgtcgaggcacagacgcgcgaaagttcggattccggccacggggccggcttccaaacatgtcgctcgcgctgctccgctggggagtcttcatcctcctgtgtcttttcgcgccccaagccgtcgccggcgacgcaaagccccggcgaagtgaggcgaagggcagtcggctcgttcgtctcaagaacggccagttgcttcataccgacgccgcggacgcgtaccggcggatgaaggccgaagcgcgttcgaagaacatctacctctgggtccacagcggctaccgctcccccgcgaagcagcgccggctctatgagcgctaccgcaagggcaaggggccccaggcggcacggcccgggcgctccaaccatcagcgaggcctcgcggtggacctggtcatcggcggtgtcaagacaccgacctatgactggctcgtgtcgaatgcatgccgcttcggattcaagcgcacggtgcgctccgagccctggcattgggagtaccgcccacacagcacccgcgagccgaagccggggcgtgactgcgtgggccgccccttgaagcgtcaacggccccaatctccgcccgtggcgagcaccgagaagagctgaggcgcgctagctccaatgcagcgtgtcgtcaatccggcccaagggcatcccgacctcacgggttggtgccttttgtccggggggactgatttttatcagacacctcgattacggtgagcagccatgctcgtcgtcacatcgaacctcgaagccgtcaccgtccacgcggagggggcgctttgtacgcgggtcgccacgattcccacggcgggagggatgttgcccacgcaggtgcgaatcaatggactgcccctgtcgttgcaacccggctcgctccgggcgtccgtggtgcacggcccgtcgggactcgccgtgcgcgaccttcgtcccacctatgacgtccagcttccgccagaagtcgacgtgcccgcggagcaccgcgccttggaggaagccgagcaccgcctctccgacctcacccaacagctcgcgcgcgtgggtcaggaactggatgcgctgtcgaagctgtcccccgggtttccgccccggccgaaggaagcgcaggagccccgggacgcccccgtgtccgcgatgctgtcgctcatgtccttcgtggacaccgagctcgccgcgctccattcgcggaagctggacctggagcggcagcagcgtgacgccgaagccgagctgcgcttgcggcgcaaccgcgtcgccgaagcctcttcgtccgtgcgaggccagcgcgcccgcgtgtaccgcgcggtcgtgctgacgctgtcgggcccccttcccgcggatccgggggcgcggctcgcgctcgaatacgccgtccagggggcgcgctgggtgcccacctacgacttgcgcctgccgcgaacgctggaagagggaacgctgcgcatgcgcgcctccgtgctccagcgcaccggcgaggactggacgggggtgaagctcgccgtctccaccgcggacctcgcccggcatgcggaagtccccgagctgaaggcgctgcgcattggccgccatcaaccggctcccgcgcgttcgggctggagggaggcgccaccggggctcgatgagctgttcgcgggctacgacgccacgcggtcgcccacgccggttcagcctgagctcctagccgaacccgagcccatgcccgccggcctcgagcagccccagaagaacaagcgcagtgccgtgcccatcgcgcccaagcccgacttcgccatgccggaagcggccgcgccaccgcctccgccggcggcggcccctcgaagtgctccgatgcgtcccagtgccgctgcccccgaggacgaggagacgacatcgcgagcgcgagcgcgaggcggtggcttgatgtcgcgcgcgcgccgaccgccacctccggccgaactcgaggaggcgcccgagagttcattcgacgatgacgcagacgggctcagcatggataccgcctcgctgggcggtggtggtggtggcggcgagcgaacacctccgaggcaggagccctccgacgcattgttggactacgaccgcctgaccatgccgcccgcggatgaccagggcgcgcgtggcaggctgcaaccgcgccccgggcacgtcacccaggagctggtggccctggcggaggtccacgcgcagatcgacatcaccgtgcgagtcgccctgagtctgcaggagacctcttccatatgggcggcccccgcgccggcgtggtcccagccgccacgcacgtcctcgcctcacttcgatgcgcgcttcgatgtagagacgcgcgcggacgtgccttcggatggagcgtggcacaccgtgccggtgttgtccgtgccagtggggctgtccgcggaatacgtctgcgtcccctccgtggagtcgcgtgcgttccgcacggtgcgcgtggagaaccggacgccgtatccgctgctggcgggtcccgtggacgtcacgctggagaacgagttcctgatgacgtcccccctgcccaccatggccccgggctcgacgcagcggctggggctcggtgtggaggaatccatcaaggtcgcgcgcaacacgcggttcgacgaggccatgggcggcatgttcggcggctcgacgatgctgacgcaccacgtgtcggtggagctggccaaccggctcagcaatcgcgtcctggtcgaggtgtgcgagcgcgtgcccaccgttcccgtcaatacggagaaggacatcaaggtggaggaattggaagtggccccgctctggcagaagcgcctgcccttgcccggtgaagcgaaggtggagggcgagcgggcgtggcgcgtggtgctccagccaggtgaagcgcagacgctgaaggcgacatggacggtcaagattccgggcaacaagatgctcggcggcggcaaccggaggacatgatgggcacccctttcatcctgcccgtggtcaaggtcaccgtcctcgaggaccgggcgctcgtcgagcggcggggggagattcccctgtccgtgggaacgcagcgactggtcatccagggactgtccccgctcgccgtggaccgctcgctccaggcgaaggtcgcgggtggcaccatctcccaggcacgcatccgccgggcgacgaagccgcaaccacccgaggccgagcgcgaacaccgcacggcgctcggaaagcgcgtcgcggagctggagcaggagctccggcgcgtggtcgcggacgaaacccggctggcggcgcggctgcggctgttggacaccgcgcgcgccgatgtccaccgcgccatctccgagcaggcaggcgccggacagtcgcggccggagacgtggcgggagcagttggagacggtgcgccgcgaaagcaactgtcggcgggactcggcgctccgagaggctgagcgccggacgctccgactgcgggaacagttcgacgaagcacgggcctcgcagacggctgtcgagctcctggagccaacggtcgacacccaggccgagctggaggtgggccaccccacgggcgggcccgccacgctgtccgtcacgtacctggtgccctgcacggcctggcggccgtcctaccgcgcaacgctgtcccgcgaagcctccggtgagtccgtcacactggagtgcgaggccgtcgtctggcagcgcaccggtgaggagtggaaggacgtggagctggcgttctccaccgcgcgccccacgctgggcgccacgccgccgcggctccaggaggaccggctgtggctgcgggacaagacggagcgcgagaagcaggtggtggaggtggccatccgtgaggaggtcatccagaccgcgggcgaggccggcgctgcccgacgggacgatgcgctaccgggcatggacgacggaggtgaaccgctgacggtgacggccccgcatcgggccagcgtgccaccggacggcgagccctaccgcgtgcccctgttccagttcaccgcgcccgctgcctccgagctggtggccatgccggagcagtcccccctggtgcaccgggtggcccggttcgacaacacgggccccacggtgttgctcgcgggccccgtgaagctggtgcgcactcacggctatgtggggcgtgcgcagctgcgtttcaccggcaagggcgagcgcgtgaagctgggcttcggcagcgaggacgcgctgcgcgtggcacgaacggaggacgtgggacgggagaccagccggctcaccggccgcaaggtgacgacgcacaaggtgcgactgttcctctccaacatgggcgcgaagtcggtgccggtggccatcgaggagcggattcccgtctccgaggtggagtcggtggaaatccagttgcagagggagagcacgaagcccgcgcccgcgcgcgtcagcgaggatggcatcgtccgcttcgagctgacggcgtcgccccgctcgcagcaggagctggcgatggactacgtggtgacgagcgcggcgaaggtggccgggctctgagcaggcccgggttccaccgcgaaacagccctggggggccgggacttcctccatggttccggcggaagcattcatccccccgggagtaagccccatgtgcatcactcgcgcggtgtccaccatcgccgtgatgatgtgtgcatgcctgtcctctccagccctggcagcaccttagagc

SEQ ID NO: 994 - DNA, 10092 bp, Myxococcus xanthus
cgggtgctacctaagtacgacgcggccttgacggtgtagccctggaagttgcggcccagccggcgctcggcctgcgcgcgcgccagttcgtcctcgggcaccgcgaagtggtccatgccgatgggccggtagcccgcggacacaaaggccgcgtaggcggagcggaacaactccagcttggcgcgcccgctgggaatggcctccgcgggcatgcgccgttggtgcttcagcacttcgggcatgaacgcgaaggagtagacggccagccggtccggccgcatcgacaacaccgtgtccagcgtgcgggcccacccctcggcgtcctggtgtggcagaccgtagatgaggtcgaagttcacgcccttgaagcccagcagccgcgcgtgctccagcagcgcccgcgtctcctccggggactggatgcggttggtgacctcctgcacgcgcgcgtcgaagtcctgcaggcccatggacacgcggttgaagcccaggctccgaagcagcgtgagctggccgggcgtcgtcacggccgggtggatttcgatggccacctccgcgtccgacgcgatgcggaagcgacgggtgagcgccgtccacagccgttccagctgccgctcatccaggaaggtgggcgtccccccaccccagtgaatctgggacaaggagcgccggcagccgagccgctgcaccaccaggtccagctccatctccagatggtcgatgtactggtccgccgcggcccggtcccggctgatgacgacgttgcagccgcagtaccagcagagactgcggcagaagggcaagtgcacgtagagcgacagcggctcggcgtgctcccgggagcctgcatgctcgagccgctccaccagatgctccggaccgaagtccttccgccactcgggcgccgtggggtagctggtgtagcgagggccggagacgtcgtaccggctcagcagggcttcgggtggcgtggggacttcctggcgggggggctccatctcaccgattcaccattccaagcctcgtgccaggagcatccacgacggggatgtggcgcaagtcgtgcaggtcttgcggccccctccccccacggcgcaacccctgcgccgtggcgcccctgaccgggggaaccttgccctaccctcccgtggcagcaggccccaggaagcgagcctccatgcgcttcacgacaccggaggccgagtccgctatctcgacggtgaagtggaacggaagctccgttctgcttcggtccacggtgctgaacagcggcctaactcatcgacgtagcgtgtgcgaggacgcctcatctggtacggcagctgtggcttggcaccagtgggccatacgttggcattgccttgcacgcccaccaggaagcgcaatcccctggctcgaagcgcctcacgaaaatctcggcaactgccgtagcccgagtcggacaggaccagctcttctttcacgccccagccgaaggtctcattgaaaaccttgagtgcttcctcccattttcgctcgaagcaaacctcccgtgggacgcccgctgcacgcacgcagcgcctgtccgccatccattcctggggaggtacaagcgcattccaatgcagccgctgcccttctcacccgtcacgtgtagactcactgctacttggcaattgtccgtgcggcccaaggtccccgagtactggcgtgcgctccgcacggaatgcatgcctttcttcgggaatcccgtgtcgccgatgaggagggcttccaggcccggcagctctcgctccaacttctgagtgaggtggcagtgcacctcggcatcatcccaggccgcgccggaaacatactgctgcaatcgcaggagcagagcttccgtctggtctggtgcatgggtcagtcgttccgccatgggctcgatgatcttgctctctccgtccaggaggaggcccgtgacgtagccgcccagggcgcgccgtcgttcggtgcgcctagttcctactgccatcgtgtccaggtacccggagagttctcggtcgagcttgtggagttgcgcgggcgtcatgtcccatcaacacggggccgccacgcctgatttatctgaccgagcagtgttagttcacccctggtcttctttgggtgtctttagcaatcgtcacacgtagtcaaataatcaagcaacttccgtatctccaaaggaaccaaccgctctacatcactctgcgcaacgtctccccacccatgagccaccatctgaaccacatctcgacggatacaattttgcagcatcaacggaaggcgactccgaatttcgcttagaacaacctttgcgcgactccgacctctttgccaaacatcgggacgagcaccaacctcgctctttgcctgttcgagagcattcactagcgtactgtcatccctcttcgttcgagccaaggctatcatcaactgcccagtagcctccatcaaaagttgctcatcccgatcggcacaaccgagcgaagcgacaacgatgtcagtcaattcccgactagagacccactgttcgccctttcggtgtccgaaaatcactggcgaaatccagccaagcagacacgaagcgtcgagaaataaagattcgatactatgtcgcgaccaaactacatcaagcaatctaaagccagactcctccctaaagggacccaacgcaggagaacggctatagtctcgatccaacacacgaacaatgtgcactggattacccgagcggccctctaccgaaagcaaggggcgaagtgcctgcataagcacactcgttgcggcagagttccccgcaccaccaagtggaacaaacgtccaggctccaaatcgagccagcaacttaggctgtccccgaaaatagacttctgcacactgcctaaggagttctgcgtcgcttggaccttcgtaaaacaatatttttctcgagcgcagaaactgaatacttgaaaacagactaagatcacaccaacgccccagttcgtcaagaagcacaccttcagaagcaagaatatttgcagatgtcgctttcttatccacaactagaagcgacgtatcggatcggcgtgcgagccgatttattgcctcgactgaatgggtcgcaataaagagttgcgcccccagttcgcgggaaagctcagccaagtacatggcaacaaccccctgaaggcgcggatgaagatgtgcttctggctcatcgaggagcaagaagactggacgccgctcgacgattgattttcggtatcgccagagggcagaaaatattgcaatcagactactgaaacccgctcctgctgaagcgagctcaagctccccttcctgatctcgaaaatacaccttcaggttttcgacccgatcgaaatccgatttcgaagtgaatgaactaatcgttgctcctacggattccctaaggagtcgattcaagcgcgcgaggcccgctctgtcgagacgaacaaccaagtttcggattatctgactctgctgccctcgcatcatcattcgctcaactgcatgagtgcttcgatactcttcattggggcccgcacctggaaagataggtatgaatacggcaacgggctcattctcccggagcaactctagaatgcgacgcgcacgtttgtgcgtaccatattcgagtccctgaacctcggctaaaacctttggactacagactttgacgtcaacattccccgagtcatctacattgagaatgaaatgcccaatcaggctctcctcagagaaatgcagctcaattctaaatgagtcgtctggatcaaaatagagctcacttagctcctccacagaaatccaaagaagagtcttgagccccaagaaaaccagtgggtcgatgcgtatataatcatctttgcattgagattgaaattccctaaactcacgaacgcggccttcctgcagaacccaggaatatgccgcgcacgcaaagcgaatggctgacatgagcgttgtttttccagcattgtttggaccaaccagcacattggtttcttggaagtttgctgtaaatgaatgaaaccccgcgaaatttctggacaatcaccttcgttagcatctaggcaagctcctctatttactactccgggacatcactgaaatactcaatggcattggcgggatagactggattctttctgaacttgggagcggagagcaactgaacgcagtaaaatagggagccatgtcccccttgacggaaagaagataagggcggttgcgttccgacgagcgacgtgtcacgagccattgcagagatagatcttgtggtggcccctaacgcaaggcgcagttgatgtgaacactggggctgatcttcattggggatgagcgagggacttcccaccccctggagttacgtcagtgagaatcacccgcttcggcggctcttccgcacttcgtgtggtgtccctcgagggagtagtcaaacgcggcaagccgccacctgggcgaatccaccctgggaatggaaacgctgtacccacttcttggatgtcgagtggaccgggtgccccacggtagctcagcgggtgtcggccttggtgtaggcatggagggtacgggagcacgatgtccctcctgccagacgccagtaccgcagtgcatggcagctacgtccggcgcccagcggacctgcccgccgtagagcgcgtcgtgcaattcgaacttcgcgtgcgccgcttttgcagccgaaacacggaatgctctcgccgtacgttcgctgagcggccgtcgcgccttctggctgctcgggctcggcggacacggaggccgaccaccgagcagtgcgccgttgcagtcacagtgggagcagaggctaaagccaggctactcaaacccctggccgtgccctccgggttgaactccgcggaggccgcgacgttggcgcgcatccagcgggacaaggacgcgtcgcgtgtcgttacattgactcggcaactctgtgaactcgttcgctcgaggtacgtttcacagagagcaagacgagcgaggacatgtaagcccttcgaagcgtgcctggacaaagctcgcgggtgcggggggcgcgcaaccacgacggctcgcttaccaccgacaggcccgatgtcatgtggggcaccgacgccacctgcacggtgacgacgttggaagggcaggccaccgtcttcatcgccgtcgacgatggcactgccgagtgcgtaggcatccacgccgccaaagtgggaagccgcttcgaggctctcgagcccattcggcggggcatcaaggcgcgcttcggtgcgtacggccagggcgtggcttcggggctagctattcgccacgacaacggcagccagtacacctctgacgtctttcagaacgagttgcgcttcctgggcgccaactccagtccgtccttcattcgcagtcccgagggcaacggctgcgccgagcgtttcatccgccccccaaggagcaactgctctgggtgcgcaccttcgccaccatggaggaactccggctggacctgctggaatgggcccaccggtataacgagcactcgctacttgagcgccacgacttcctttcgccgagtcaggcccagcgggagctgaggctgaagcaagcggcctgattacgaccaacctggtgtctcaacaacccggtgcggtacaagcgccagttgtatggccgcgccaacttcgacctgctgcgtcgtcgcgtgctgctcgctgtttgagcctacagtccgcacgaagtgcgggagagccacggaagcaggtgacgctcatactgtccttggtttccccaatacccggtaagccggtaatctgctgatacctcaatccatcctcatcgaagccccgaactggcttgccccagcctttccggaatgggaagtccaacgctcattccctatgaggttcaggtctatccaatcacggcaactgcgcctcaggttggaggctataaacaggtcccaggaagcgggcctccatgcgcttcacttcaccggaggccgcgtcggccacctcgacggtgaagtggaatggcagctccgttccgctttggtccacggtgatgaacagcggcacccggaagctctccagcgaggcgagtgtcacctgcgcctgtggcaccaccaccttcgcgggcacgggactgtccacgcggatggtgagcaccgtctcggaggggttcttgttcaccaggtgcaactcgaactggttgcgcaccgtgccctgctcgacgacgtagggcatgccctggaagcgcagcaggttcgcctcgaagggcacgcgccgcaccaggctcagcgtgaagcccaccaccgccaccagcatcaacgcgccgtagatgaacaagcggggccggagcacccgccgtggctgcccatccaatccgttgagtgagtcatagcggatgagcccacgcggccggcccagcttgtccatgacgccgtcgcacgcatccacgcactgcgcgcacgcgaggcagtccatctgcaagccattgcggatgtcgatgcccgtggggcacacggccacgcacttgaagcagtccacgcagtcgccgcgcggaggtggggccgggacacccggagcggccttgatgagacggccccggggttctccgcgccgcgtgtcatagccgacgatgagcgagtcccggtcctgcatcgccgactggaggcggccatacgggcacaccaccacgcagagctgctcacggaaccacgcgaagttgaagtacagcgcgcccgttacggccatggcccacgtgaaggccaccggcgacgccaccgggccatcggccaccatcgcgatgagccctcccgccgagacgaagaggctcaacgccgcgtgggagatgagcagcgacaccgcggcgtacgcgccatgtttgagcaccgcccgcgctacgcgcacgggcgtccacggctccttcgcggccttcagccgccgctcccggggcccatcgaagaaccgctcgatgggacgatagagcgcctccaggaacaccgtctggggacacgcccagccgcaccacacgcgtcccagccacgcggtgaagaacagcaggccgaagcccaccgacgtcaacaggaacaggacgcgccagaagtcctgcgcgttgtacgtgccgccgaagaggtagaagcggcgcgccgccacgtccaggtgcaccgccgggtggccccccacctccaccagtggcagggccaggtagatggcgatgaggaccgcgaagcccacccgccgccgagtgatgaaccggccgtgcacgtccgccgggtggagcgccagccgcgaaccatccgcgtggatggacgtgagctggtcgatgcgcgggccatcccgctgcggtgccgcagacatgactgcatcctctccgtgagctacggctgctcgggctcgccctgcggctccttgccgccgggcgcgttggtgcccttgagtgtgagcagataggcggtgacggccttgacgcgctcggcgcccagggtgcgctcccacgcgggcatgcccttggccaccacgccgtccgccacgaccttgtggatggccatgggcccgccaccgtgcatccaatacgcgtccgtcaggttggggccgatggagccctgcccctgcacgccgtgacaggccgcacagttcgcctggaacacctgcttgccgctctccagggaggccgggtccttggccagcgcgagcagcatgccgtcagacgccggcgcgtttccagacgcgcgcttcgccacctccgcggactctgcggcgtactcaccgagctgtccgggccccacctcggcgatgtggtaccagaaccagtaccccgcgctgaagatgatggacgtccagaggatgaacagccaccagttgggcaggtggttgtcgtgctcctcgatgccgtcatagacggagtgcaccagcggcttgtcactgctcatggcggccctccccctgctcgctcagcggcatccgcgcgagcgcgtcgaagtccccgctgcgccgcgccacgaacacccaggcgacgacgccgagaaacaccgcgatgaacaggaccaaggcgaagaggggcagctcggtgagcgacatcccttgatagaattgcttgtacatcagcggccctcctcactggcgatggtggcggcaggcagacggtccggcggcgcgggcgccttctccggcggcgcgggcaggtcctgcggtccacggcccaggcgctggaggtaggagatgatggccaccatctccgaatcccacgccacctggacaccctgcgccgccaggtccgcggtgatgccctccgcctgggtcttctgtcgcgcctcggcgctgtccacgtccgcattgctgtacggcacacccagccgctgcatcagcgcgagcttcttcggcgcgtccttcacgacgatgcgctgctcggccagccacgggtacggcggcatgttggagccggggctcgtcgcccgagggtccatcatgtgcgtgtagtgccagaggttcgggtatttgccgcccagccggtgcaggtccgggcccgtgcgcttgctgccccactggaaggggtagtcgtagatgaactcctccgcgcgggacacgtcgccgtagcgctgcgtctccgccacgaaggggcgaatcatctgcgagtggcaggtgtagcaaccctcgcggacgtagaggtcgcgtccctggagctccagcggcgagtacggctcctgcgcctggccgtgcgctggcaccgcctgcttgagcatgatggtgggcagcagctccgccacaccgccaatcaggatggcgatgagcgtgagcacggtgaaggccagcggcttgccctcgatgagaccgaaccacgacggacggcctgcttcacggtccctgcgggtgacaatccaggcgaactcgcccagcgcgatgatggcgcccatcagcaccaccgcgcggaccggcttcgcccagccgaggaacatcgtcacggtgaggatggcgatggcgaacaccaacggccggcccgtgacgacctgcacccagccgggcgtcggggccttggcggggacgggctcggcgacgggcgtgggcggctccacgacgacggtggtctccccgtccacggccttgccggcgcgggccgtcttccacaagttccacgccatcatgatgaagcccaccaggtacatggacccgccgacgaagcggacgatgtacatgggccggatggccagcagcgtctccacgaagttcgggtagagcagcgtgccgtcagggttcgccgcttgccacatgaggccctgcgtgacgccgctgatccacatcgacaccatgtagaggaggatgcccaccgtcccgagccagaagtgcgcgtccgccgccttgggcgagtgcagcttcgtgccgtacagcctgggcaccagccagtagaacatgccggccgccatgaagccgttccagcccagcgcgccgctgtggacgtggccaacaatccagtccgtgtagtgggccagcgcgctcaccgacttgatggacagcagcggcccttcgaaggtggccatgccgtagaaggtgacgcccgcgatgaggaacttgaggacggggtcctcgcgcagcttgtaccaggcgcccttcagcgtgagcaggccgttgagcatgccgccccacgacggagcccacagcatgacgctgaaaatcatgcccagcgactgcgcccagtccggcagcgccgtgtagagcaggtggtgcggaccggcccagatgtagatgaagaccagggcccagaagtggatgatggacagccggtacgagtacaccggccgctccgccgccttgggcaggaagtaatacatgatgcccaggatgggcgtggtgaggaagaaggcgacggcgttgtggccgtaccaccactgcaccagcgcgtcctggacgcccgcgaagacggagtagctcttcatccccgacagcggcagcgccaggctgttgacgatgtgcagcaccgccaccgtgacgatggtcgcgatgtagaaccagatggcgacgtagaggttcttctcgtggcgcttcgccagcgtccagaagaagttgatggcgaagacgacccagatgacggcgatggccacgtcga

SEQ ID NO: 995 - DNA, 11992 bp, Myxococcus xanthus
gggacttcatgtccttgaggggcacgcggtcctgcgggcgcttggggccggcgaggctgggcaccacggtggacaggtccagctccagcgtgtcgctgaagatggggtcctcggcgtcgtcacgccgccacaggccctgctccttggcgtaggcctcggtgagggccaccaggtcgtcaggacggccggtgaagcgcaggtagttgaggctctcctcgtccaccgggaagaagccgatggtggcgccgtactcgggcgccatgttcgcgatggtggcgcggtccggcagggacaggttcttcaggccgctgccgtagaactccacgaacttgcccaccacgcccttcttgcgaagcatctgcgtgacggtgagcaccaggtccgtggcggtggcgcccgcgggcagcttgccggagagcttgaagcccaccacctgcggaatcagcatcgtaatcggctggcccagcagcgcggcctccgcctcgatgccgcccacgccccagcccaccacgcccaggccgttgatcatcgtggtgtggctgtcggtgcccaccagcgtgtccgggtacacggtgctgccctggcggaacgtcacgtgcgccaggaactccaggttgacctggtggcagatgccgatgtccggggcaaccacgccaaagcccttgaacgcgctctggccccagcggaggaacgcgtaccgctcacggttgcgctcgaactccagctcggcgttgtccttgaacgcggcggacgtcgcgaaggagtcaatctgcaccgagtggtcgatgaccaggtcggccgggttgcgcgggttgatcctgtccgggttgccgcccatggaggccagcgcctcacgcatggccgccaggtccaccaccgcgggtacgcccgtgaagtcctggagcagcacgcgggcggggtggaaggagatttccacgtccggcgtggccttggggtcccacgccagcatcttctccacgtgctcgcgcttcaccacacgaccgtcctcgtggcgcagcaggttctccagcaggaccttcagcgagaacggcaggcggttcaccgccgggtgggttttcgccagcttgcccaggctgaagaggtcataggtggcagagcccaccttgagctgggacttcgtgccgaaactgtcggtcatgtgtgttgccgtccttccttgcgcgggatgcgggaacttctaggccccccgttgacgcgttgcaaagggttcctgcgagcgcattgagggccggacgcttcgagccgcgggtgtgcagccccgctcatcggaaccatgcggcccgctgaggaccggacaggcgtggctcaaatgattttgcgaagcagagacagtgcccgctccagcagcttctgccacaggggccggcggcggaactccgccagcgtcacctcgcggcagtccccgcagtcgccgcggaaggagtcctccagttgctgccccaagcgagggtcggcgaagaccgcgttcacctcgtgattgaaggccaggctgaggcgctccaggttgaatgagccgatggtgccccacaccccgtccaccacggccgtcttggcgtgcagcacgccgcgctgccactcgaagatgcggacgcccgcgcccagcagccgctcgtagaaggcccgggccatgaactccaggatggggtggtcgctgcgagcgttgagcagcagatggacctccaccccgcgccgggccgcctcgcgcagcgccatcaccatgcgccggtccggaatgaaataggcggcggccaccagcacgctgcgccgggcccggcggatggcgtgcaggtaggcccggtggatgcttcgccgactggacaacaccaccagccccaccgcgccgcgccgaggcggagggttgcgcaggcgctccagccgccgggtcagccggtggaagcggccctggaacatcatccgccacgtggcggagaaacaccgctccagttcgtggacggccggcccttcgatgcgcagcacatcgtcccgccacgccgcgcccatctccgcgggcgcccagtgggcggagatgttcaccccaccggtgaaggccacctcgccgtccaccaccaggattttgcggtggtccctccgcagcaggtgccgcagcccgcgtgacaggctgaagggcttgaaggcgcggatgtccacgccccgcgcgcgcagccctgcgaagaagctccggcggctcgtccaggagcccaccgcgtcgtacaacaccttcacgtgcacgccgcgctcggccgcctccgccagcgcctggccaaacagttcgccgacggcgtcggagacgaacatgtacgtctccatacggacataacggcgcgccccgcggatggcctccagcatcgccgggtaggcctccacgccgtcgcgcagcaactggcatgcgttgccctgcaccaccccgtggcggcgcggcaggtagtagcgcgtcaggagccccccggagacgccggggctccacaccggcccatgctccggcacgggcgctgggggcgtgggcgcacgccgcggcgcgcccgtgtccacttcccccgactgctcggtcaacgcctcctggtcacgcatggcctcccaacggtgcggatgcccgcgcgacccggcaacccgagccgcatcgcagcccgtcttccagtgccagccggtgtccggaagccaacgggacaatcccgcgacttcacggacaccggaaagccgtggcgcagcctagaggccgtactccgcgcgcttggcgtccgcgcgggtggcgcacggctggtcgaactccgggaagtactccttcacgtggtccagggtggcggaggcgctcttgtagttgccctggttgtagtagccctccacctccagcagcagcttggagcaggtgcggtccagctcctgctgcgccgccttcatgcgctcctgggcgtcgtagtagaggtcgggcttcggctccgggtgggcctccagcatcagccacgacacgcggaaggacttccaggcctcgtagcggttgcgagcgccgatgtccggcgtctggaagtgcttcaagccccgcttgtggtactcggtggcctcccgcaccagttcctcgggcagcaggtccggcaggagcgcgcgctccacccagatgttccagatgacccacgggtcttcgcccggcggattcttcacgttgtcgaagatgatgcggttgggctcgcccttcttcaggtgctgcgccggaatcatcagttcgatggagcggtcctggctggccagcgtgtcgggcggcaccttgcccacgtccacgccgttgacgctcaccacgacctcgtccttggagatgctctgggcctggtagtgaaggatgaccaccgcgcgcgtggcggcggtgtactcccactcgaagaccttcatgtccgggcgatcccacgtcacgcccggccccaggccgaacgagtcgcggatgggctggccggtcagcatcgagggctcctcgcccaccggctgaccgtcctcgccgctcagcaccagccagtagaggacgccgaacagcgcgagcaccatggccacgccgccaccgatgatgccggtgcgcacgccctggctggcgtccgcccagaagagcttcgcgctggacaccacgccgggggactcacgccggatgcgcgcgcgctccgccgcggacaggccaccaccgcccgaagcggacggcgccggacgggcccgggccggcgggggcgaactggacggccgcttcgcgggcggtgccgctggcgccgagcgctcgatggccgccggccgtgagccgctctgcccctgggacacggggcgcagggcctgcaggttggagcgggtggcaccctcgcggatttcgttcagctcctcctggtcggcaccttccggggccagcgcgacgcccttgttgcgctgccgcttcagggaatccagggagacgatgcgcgtgctgccatcgccttcctgggcgccggcggggagctcttcttcgcccgtggccggctcgtccgtcagcatggcgaagatgaatgtcaccggccccagggtcagcttgtcgccgtcctcaagcacctgcgtcttcaccggactgccgttgatgagcgacccgttggcgctgccctggtcctcgacggcgtaggcatcaccgtcgaggaagatgcggcagtggcgccgggacacacccgggtcgaacagcgcgacgtcgcaatccgtcgaacggccgatgagaacggagtcctggtcgaagacgaactccttaccggcttctctaccctcggagatcgtcagctggaaaggcatggggggttacaatcctacagaggcccgcgccgctcgggcaacggccgcgcgcgcggaggccggttccatgacctgcgcctcgccaccgaaagacaggacccactgggtgagccagcgttcgctgtcccccgccaccagcacctccacgcccccgtcggcaagcgggcgggcgtcctggccgaagcgctccttcacatagggtgcggccacgggggagaagcgcacgcgcaccgaggagtccgtcaggccccgcgccgggttgggcacgtccgcccgggcgtccgcgggcggctggaaggacacgtccgtgacgaggatgtcctccatccggtccaggcggaacaggcgcgcgtcctgccgggtgtggcagtagccctgcagataccactgcccccggtggctgagcagctcgtaggggcgcacggtgcgcggctccggcgaccggccggggctggcatagccgaacgtcacctccaggcgctcgatgatggcccgggtgagcggccccagggcctggggcgcctccgtggacgcatcaatcttccggtacatctcccggtaacgctcgcgggtggcgggcggcagcacgcgctccagcttctggagggcgctctgcaatgcgtcccccgtggccggccgcagcagctccgccgacgcggccagcgccgcggcctcgcccggcgtcaaccggggcggcgcgaagaggcgctggtccaggtccacgtagacgcggtcgttgtccacgtagatgtcgatgtagtcgtccgggttgaagggcggccggcccacgcaggtgagcaggtccagctcctccagcaggtcctcgcggctgatgttgagggcgcgcgcgagcgcgtccaccgtgacgccggggtgcttggagacgtagggaaccaggaacagcaggcggcggagccgctcgtggacgttgctcatgtgctcaccttgtccagcgaatcgtcgtggcacgacacgatgcgcgaggccatctcccgcagacgcgcctgcgcccgctccgggccctccacgcggcagtccggccccagcgccaggcagaagcgcatcaggccgtccacgaacgtgaccggcagccgcgcccgcaccgccccctcctccgccggctccagcgtggcgccgggcaacaggctcgcggcccgcgaggcgagcgtgcccgacaggtggagcaccacctcctcctgctcatggaagcggtgctgccacgggaagtacgccacgtgggcctccagcgagaagtccgccggcacctggaagtccggtgtgcgcgggcgcgccgtgttcaccttgagttcgcgaatccggtggacgtggaaggtccgcaattccttgcgcaggtggcagtaccccaccagcgtccaggcgccgcggcgcagcgccaggccatacgggtccacccgccgctgcgtggtgcccgcctgcttggggctggcatacgtcaggtccacccacttgcgggccgcgcacgcatcccagagctgctccaggcgcgcggagatctccttctcctggccctcatgcacggagcccagctccatgcgcacccggggtgtaggcagggattgaccggcgaagaagccgatcttccgcagcgcgtgcgccaggtcatcccggcccgggaaggcccccgacgccagcgccgcggagccggcggcgtagagcacggccagctcctccttggagaggtccgcctccgggaggtagtaggcgtcccggtcgacgatgtagccgtcccggcgctcgtcatctccttgcacgtacgtcagcggaaagcccagctccaccagctccgccttgtcgcgctcgaacttgcgctcggcggcatcatcggagccgccgtagtcaccagggaagtgctcgcgcagctcggcccaggagatgggctcgcgtgcgtcgagcagaagggccacgaggtcgaggatgcgttcagtgcggtccattggaaaggtcggcgacgatgccgggcggacccgagagggtcaagaagtggacgtgtgggtgggaaacaggtgagagggccgctcgcgtccggcgagatagccggacgcgcctgaacaaacaagcaggtaatcacctgtacgcacggctgtactcattgcggctggcaacgacttgggcggggggctcgcactgcgggcatgatctgggttattgctgctccattccgtggaagtggaagcgacgtggacaggcctgcctgtccggatgccgcacggccgaagcggcgagcggagcctccgaagggactcacgatgagcggcatcaccctcgtccgtaatgtggtggccgggttggcgatgttcgtgggcttcacgagcatggccgcgcctgcgcccgtgcgcgcggagcccctctacttcgccgtcgaggtccgccgtgacgggcggctggtggcccagcccaagctgctgggcgagacgggccgcacccttcgcgccgagcgccgccgtccgggagcgccccttcccgactaccggctggtcctcacgcccaaggccgaaggccagtccttcctcctccagctcgacctgctcctgcccgaggcgaagggccactccgagctggcgctgctccacggccaggagcgcaagctccagcttggccgcgtccccggagagctcgaggtctccctgctgctgatgaaggtggactcgccggagttccgcgcgctcatgcagttgggcgaaagcggcggcaagtcgctgtccacctcgtccatctgagcaacgccctgcccggctacagcacggccaggtcgtcgcggtgcacggcctcgtcgaggtagcggtagcccagcaccgcttcgatgtccgccgtgcgatgtccggcgatgcgtcgcagctcgttggcgtcgtaggccgccagcccccgcgcgaacacggccccctccgcgtccaccaggtccaccgggtctccgcgcccgaagtccccctccacgccgcgaacgccgctgggcagcaggctgcgcttgccggtgacaatggcctcgcgcgcgccggcatccaccgtgagcgtcccgcgtgcgcgcagggcatgggcaatccacgcggcgcgggcactgcggcggctgccggtgggttcgaagtgggtccccacgtccgcgccttccaggacggcgcgcaggcggccgggcacggcgccggacgtaatcacgcagtgaatgccggaatcggacgcgcgcgcggccgcccgcaccttggtgctcatcccgcccgtccccaccccgctgctcgtaccggtggcgagcgccaggacctcgggcgtcacctgcatcaccgtggccagcagctccgcgcctgcgtcgcgccgggggtctccggtgtagaggccctccacatccgacagcaggacgagcgcgtcggcatccaccacgccggccaccagccccgccagcgtgtcgttgtcaccgaacttcagctcgtccacggagacggtgtcgttctcgttgatgacggggacgacgcccgccgtcagcaaccgctccagggtgtgcttcacgttgaggtagcggcggcgctcctgcacgtcctcgtgggtgagcagcacctgggccaccgccttcccatgcgcggcgaaggcctcttcgtaggcctgcaccagccggctctgccccaccgccgcgcacgcctgcttgcccgggatgtcgcgagggcgcgagggcaggcccagccgctcgacccccagggcaatggccccgctggacaccaccaccagctcgcggccctgcgcggcccacaacaaatcctggcccagcgcatcgaagtgctgacggttgaaacgtccggtggcgttcgtcagcgcgttggtgccgattttcaccaccacccgccgggcggagcgtagggcggtgcgtcccgtggaaatcgaactcacagggcgtcagcgtaggtcagaaatggaagacgcgcgcgtccggcgtgttttccccacagcggcagtcataaagtcgtacgaaaaaggtgggggccccaatgcctccgccaggagagcacggtttgaaggaaatctacggcaacaccctgggcctcaagtcgagcgaacagcaccggttgcgcaacaccttccgccggcgcgtcccaccgcacgaaatcgtgtcgcccgagcttgcccggcatctcaccgagctgtcgcgtgagctgaaccggcaggtgggtgtgctcgtcaaccggaagggagaaatcgagcacgtcatcgtgggcaacgctcacaagctcgagctcccggacatcggccgcgcccgcgcgggccaggtgcgtctgcgtggcctccgcctggtccacacccacttgaagggcgagccgctcaccaaggacgacctcacggacctcgcgctgctgcgcctggactgcgtggcggccgttggcgtgggccacgaaggcctgcccggcgtcctgcactacgcctacctcatcccggagaacggctccggcgacttctggcacgtcgagacgctgccctccgtccacgtggcgcaatcggacctcatggacacgctgggcgcgctggaggaggagttcaaccgcaaggcggcgtcgcgcaaggtgggcggccgtgagaaggccatcctcgtggcggtgtgcctggacggcaaccgcgccctggccgagtccagcctggcggagctgaaggagctggcgcgcaccgcgggcgtggaggtcatcgactccgtgctccaggtgaagcgcgaggcggacccgcgctacctcatcggccgcggcaagctggaggagctcaacctgcgctccatgcagaccatggtggacctgctcatcttcgacaaggacctcaccccgtcccagggccgccacatcggcgaggccaccagcctcaagatcctggaccgctcacagctcatcctcgacatcttcgcgcagcgcgcgcagagcgccgagggcaagctccaggtggagctggcacaactgaagtaccggctgccacggctggtgcagagcgacgattcgctcagccggctcatgggcggcattggcggacgaggcccaggcgagacgaagctggagatcgaccgccgccgcgtgcgcgagcgaatcacccacctggagaagcgcatcgacgcgattggccgggagcgcagcgtgcgccgggcccagcgcaaccggcgcgaactgcccgtcatctccattgtcggctacaccaacgccggcaagtccacgctcctcaacgcgattacgaacgcagaggtgctggcggagaacaagctgttcgccacgctggaccccaccagccggcggctgcgcttcccgcaggagcgggaggtcatcatcaccgacacggtgggcttcatccgggacctgcccaaggacctggtcgccgccttccgcgccacgctggaggagctgtacgacgccagcctgctgctccacgtcgtggacgcggcggaccccgcccgcgacgagcaggtggaggcggtggagaacatcctcgagtcgctcgacttgatggagaagccgcgcctcatggtgtggaacaaggcggacctgcttccgccggacgaagtggcggcgctgctgcgcacgcggggcggcgtggccatcagcgccgcgacccgcgagggcctggcgacgctgctggccaaggcggacaccacgctgttcgccgaaggcgccaccgaggccatcggcgccatctgagcccgcggttgccgcgcaggcacggctccccgtagagtcggggggccgtgtcgactccatcgctcacacccctgctgctggcccaggctgactacgcgaagcctgtgtcctctctgtctccgaagtacttcgagctgctggagcagaacagccacatcatctaccccgtcctggcgattctgacgctggtcatcatcgccgcgggcgtcctccaggcgtggcgcacgcaggacctggacggcctccagaagaacgagttcaagcgcgccatcgtcaacgagctgcgccgcaacatcagcggcatgcccggtgacttgctggcgaagtccgtggggctggaccggctcaagacgaaccgcctgctggagcagatgcagcaggagggcctggtggtgagccacaccaactcccagcggctcaccgtgtggcgcgtccgcggcgccacgccggacgccgcgccgcgccgctactgaaggccgctcagacgcccgccagctccgacttcggatggcgcgtcatcaggtccaccaccgccgtgcgcgcgctcttgccctcgtgggcaatcaggtacacctggtggcagatgggcagctccacgcccgtcttgagctccagttcgtgcgcactgcgggccgtcttcacaccttcggccacttccttcatgtccgcgaggatgtccggcagcttgcggcccttgcccagctccatccccacgtgccggttgcggctcagctcgccggtgcacgtcagcaccaggtcgcccatgccggacagaccggagagcgtcagcgggttggcgcccttgcgcaccgccaggcgcgtaatctccgccaggccgcgggtgatgatggccgcgcgcgcgttgtggcccatgcctaggccgtccgccatgccagcggcaatcgcgatgacgttcttcagcgcgccgccgtactgcacgcccaccacgtccgtggaggtgtagctgcggaacgtctccgtctgcagcgccttctggcagcgcagcgccaccttgtcccagtgggaggcgatggtcaccaccgtgggcatgcgccgcgccagctccttggcgaagctggggccggacagcaccgcgaggtacgggtggaactcctccggcaggcagtcctccaggagctccgtcatcgtcagcagcgtcccgttctcgatgcccttcgacaccgtaacgatggggacatggcgcggcaggtacgcctgggccttcgccaccacctcgcgcgtggcgtggctgggcgtggccagcaccaccaactccgagcccacgagcgcctcctggaggtcattcgtggcgcgcacgcgctccgagatggggatgcccttcaggtaggtggggttttcgtgctgggtgttgatggcctccaccacggaggactcacgaccccacagacgaacctcctcgcaattgaccgcgagcacgttcgccagggcggtaccgaaggagccggagccgatgacactgccacgcatggaagacctcgctagaaaccagtcacgacgccaaaggtgatgacgggcatgaaatccgtctcgtcaggccgggtccggatgtccccgccaatcgtcagagcgtaggacgttttctcactcacggggatttccgcgcccagccgcaccggaaaggcgccggacagctctacgtcagggggcaggccgcccagcggcaccccttgaatgggctcggtgtccagcgccatcaggtagcggacgtccaggaacagtcgcggcgagcgggcgcccgggagttggagattgccgacgatgccgggcagcacgttccagttgcgacgtccgctgtagtagcgcgcgccccggtcctccacgctcgcgggccgcaggaagaaggcgtggctgccctccaccgccacgcccacgctccaccggggcccgccgtcgagcaccatccaccgcgcgcccacgcgcagctcgctcatcaacccgtaagcgctgtccacgccggccagcacgtccacgcggcgaaggacgccccccgcgactcgcgcgggccccat

SEQ ID NO: 996 - DNA, 9839 bp, Myxococcus xanthus
gctctacggtctctgtatgcgtcacgcggcatccacgccgcacatgctgaaccacaagccgggcgccgagggcatcgacccggccgtgttctccggcgaggagaatgtcatcgtcgacttccgctacagccaggacgcgcggctgacctggtggttcgaccaccacgcctccgccttccagcagccgggagacgaggcgcacttccgcgcggacaccagcgggcgcaaattccacgacgcgcaccgcaagagttgcacgaagtacctggcggacgtggcccgggagcgcttcggctgggatgcgtcgcccctggcggagctcatccactgggcggaaatcatcgacggggcccagttcccctcgccgcagatggcggtggcgctggaggagcccgcgctgcgcatcatgacggtgctggaggccaacaaggaccccagcctcatcccggaagtcatccgccgcatgcagtccgagtcgctggcggacatcgccacctcgccgctcatcgccgcgccgttggcgccgctgctggcgcgccaccagtcgaacatcgagctggtgcgtgcccgggcgcgctacgagcgcggcgtcgtcttcttcgacctggtggacgagggcgtggacagcctcaacaagttcatcgcctatgccctctacccggacgcgcgctacacgctgtgggtggggaagggcgcctcgcgggccaaggtgtccatcggctccaacccgtggaagccggagctgcggcggcacgacctgtccgccatcgccggacgctacggcggcggcgggcacccggtggtggccgcggtgagcttcaaggcggaccaggccgacaaggcgcgcgccgcctacgcggagattctggcggagctgtcctccgacgcgtgacggcgcgggcgtcagcggcgctcagaagaaccggaagcccgcctcccgcagcagtcgcaccaccgtcaccatgggcaggccctgaacgttggagcggtcgccgtcgagccgctccaacagggcctgtccggcgtcctccacgcggtagctgccgcagcagccctcccattcgttcaggtcgaggtagcgctccagctcctcctccttcacccggtagaaggtcagccgggtcgtctccactgcatcgagcaccttgcctccggggcccaccaggcacaccccggtgtggatggcgtgggtgtggcccaccagcttgcgcagttgctcgcgcgccgcgttccggtcgacgggcttggagaggacttcgcccgccacctcgacgagctggtccgcgcccagcacccaggcctccgggtggcgctgatgcaccgcgcgggccttgcgtgacgcgagctcccgcacggcctccgtcaccgacaggtgtggggcgacgacctcgtccacgccgggggcctcggcgcggtagggaagcctcagtccatccatcagggcccgccgggcgctcgacgtggaggccagaatcaattcgctcatgggacgggcaacctagtgcagggcggggcgggtgggtgtccagtcgcgccagcaagcggccgtgcacgtctcggcttcccggccacggggtgatgccgtaccctggcggcccatgtcgcggcgcggtctgctcgccttctgtctcctcattgctgcctgcaagcgcggccccctggcctctgaggcgccggacgcgtcatgtccggccgtgcccgccctcagcgcgcctggcgccggggcgcccaccgccagcgtgcgttccgcaccgcccccggaggacgccactcaccggatgcagccgctggccgtgtgccgctcggacggcgcggccccgttggatgcgtcgcgtcgctacttcgaggaaggccgcttcgaggatgcactgtcctgcgccgcccaggccgccgcgctggagccggacctggccgccgcccacgcggaacgcggcgtggcgctggccgccctgggccgcgagacagaggcgcagctcgcctacgcgcgggcgctcgccatcgacccgggggacccgtccgcccttctgggctcggcgcacctgtacgccgtgcaactgtcctccacccgggagcggggacgaattgggcgccctctacgccgagcgcggcttgtcccagcccaacacgcccccggagctgattccgcacctcgcgctggtggccgccatggccttcaatgatttgggacaggcggagtcctcgctggcgcactccgccatcgtcctcgcgcgcaatcccggaagccgcgaggccctctacgagcgcgccctggccctcttcgagctgtgccgcttccgggaggcccgcaccgccttcaccagtctcgtggacgacccggagcgggccgcgcacgcccatcatcacctggggctcctgttggagcgcgagggcaagtggaagcaggcgcagggccacttcgacaaggcgcgcacgctggcgccggacgactttcccgagccgccgctgcccgcggaggaggacttccgcgccgaggtggtgagggccgtcgccgagctgcccaaggacatgcgcggggacttggacggcgtgcccgtcactgcggaggagctgcccgcggacgcggacctgctggccaaccagccgccgctgtcgcccacgattctggggctctaccggggcccgccgctggccgagccctgtgacggctccgaggtgccgtgccgctccgtggtgctctaccgccgcaacctggcgcgcgccgcccggacgcccgaggaacttcgcgagcagatccgcgtgacgttgctgcacgaaatcgggcaccttcgcggcgaggacgacgaagaactggccgctcgcggcctggagtgagcctgatgcccccccatgcagccctgcccgtcgcgcgcgtcacccccaagggggcgcgctcgctgcggcacttcaatccctgggtgtaccgcaccgaaatcgccgccccgcccgacgtgaagggcgccggcgccgtggtgctggtggtggactcccagggcaatcccattggccaggcgctctatgcccgccgctcgcccctggcgctgcgcctgctgacgcgcaaggggcccgccgaggagccggtggacgacgccttcttccgccgccgcctggaggccgccctggcgcgccgggcgtacctgtccggccgtgacgggctgcggctggtgcacggcgaggcggaccagctcccgggcctcttcgtggaccgctacggaaagggcctcacgctccagacgctctccgagggcatggacgcgcgcaaggagacgctggcgaagatgctggtggagctcaccggcgccacccacgtcatgtgccgggacgacgcctccggccgtgacttcgaaggcctgccccgcgaggcgcgcctgctgcacggtgagggcgccgcgcgcttcacctaccacgagggggagaaccgcttcgaggtcgacctccagggcgacatgaagacgggcgccttcctggaccaggtggacaaccacctgcgggccggggagctggcgcgcggcgacgcgctggacctcttcagctaccacggcggcttcgcgctctcgctgtcacgcacctgcacgtccgtgctggcggtggagcaggacgagaaggccgccgcgcgcgccaaggccaacgccgaggccaacggccgcgccaacgtcaccgtggagaacgccaacgccttcgatgtgctgcgccgcttcgacaccagcgggcgccgcttcgacaccgtggtgttggacccgcccggactggccaagcgccgcgagggcctggccaccgcgctgcgcgcctaccacgagctgaacctgcgcgccttccgctgcctcaagccggacgggttgctcgtcacctgctcctgctccggcaagctggaccgcgccgccttcgaggagatggtgctggcggccgccgcggatgcgaagcggccggtgcagattctggagcggcggggcgcggggttggaccacccggtgctggccgggctgccggagacggagtacctgaaggccctctacgtgcgcgccctctagcgaggggagggggctggggcctatggaatccccagctccttgcgcagccggcccacgattttgaagtactccgttcgtgggaaggggacgttgaggatgtggaagtccttcttcgccaggcccacgcagccgaagcagtagttgcagtcctgcaggttgcggcacagcaccaggtacgcgctggtggagcagttctcgctctggacgcagtacgcgcaggcgttgcagctcttgcagtccacgcagtgcgagcagttgttgcacagctcgcaccgggtgcagtgcgtgcacgagaagcaactgtcgcagtccttgcagaacatgcagttggcgcagcgctgacagccctcgcacgcgtaggagccggggttgcccgggtcggacgcgaagctcttggccagcttctggaactgctccaggaactcccgcttgcccagagaggacaccagctcccgcgccgccttctcctgcgcgaccaggtccgccttatcgggccgcgttcctttgtccttcaccacctgggacactccttcatcagttcggaccgggcctcaggcgagccagtcccgcaaggtcgatgccgcgcgccacccggcgcacctccaccgtacccggaaatccccggctggtgacggcaaccacgtagcgcccccccacaaggaggttcgcttcggccacagactcctccgcgtcgtaccgcacgaagcccacggcgtcgtccaggtggatgggggcggacgggtcactggccgccttgccccgggagcggtcggcggcctcctggatggccttgccaatgcgctcgcccatggtggtgtccacgatgcgcaccttcacctcgcgtccctcaccccgggtgtagagccgctcggcctcggagacggacacctcgccgtacttcccggtggagccctgggtgtgtgccacggtgaagccgtccagccgttctggaaggaagggcgccagttgcttgaagtacacgcagggcgcgctctccgccgacaccacgggtgccacctccggggacgagccggactcgccaatgcatcccgtgcccaggacgagtgcgagaagagcgccagagcgcctggggaaaaaagagtcgcgcacgaacgaatcaaagggtatccccgccccgcgcgcaatggacctctcgaagctcaatcctccgcagcgcgaggccgtggtgaccctggagggaccgctcctcgtgctggcaggcgcaggcagcggcaagactcgcgtcatcacccaccgcatcgtccacctgctcaacgagcggccgggcctcatcatggcccgcaacatcctggcggtgaccttcaccaacaaggccgccacggagatgaaggagcgcctggtccacatggcgggacctcgggcgcagggcgtgctggtgtgcaccttccacgcctttggcgcggagatgctccgcgaggacatccaccggctggggtggcccaagaagttcgccatcgccgacatgggcgaccagctggccaacatccggcgcgcgatgcgcgagcacaaaatcgacgaccgctcgttcgacgcgcgcaaggtgctcaacctcatctccaaggcgaagaactccggcaaggcgccggagcccaagccggaggggattggggatgattacgacctcatcacccacatggtgtacccggactatcagctgtcgctgaaggcgcaggggtcggtggacttcgacgacctgctgctgctgcccgcgcgcctcctgcgcgagcacccggacctctacgagaagtacaccaagcgcttccgctacctgctggtggacgagttccaggacaccaacaccgcgcagttggaactgctgaagctgctggcgggccgctcccgcaacgtgtgcgcggtgggtgacgacgaccagtgcatctattcgtggcggggcgcggaggtgcgcaacatcctcgacttcgaccgcctcttcccgggagggaaggaggtccggttggagcagaactaccgctccgtccagacggtcctggacgcggccaacgccgtcatcgccaagaaccccgagcgcaaggccaagcagatgtggaccgaccgcacggggggaacgaaggtgaaggtggtgacgtgtcccaatgacgaagaggaggcccgcttcgtcgcgcacgaaatccagaagcacatggccctgggcatctccgcggacgacatcgccgtgctctaccggaccaacggccagtcccgccccatcgaggagacgctgcgggagaagaacatcggctacgaggtggtgggcggcagcgagttcttcgaccggcgcgaggtgaaggacgtcatcgcgtacttcaaggtcatcgtgaacaagctggacgaaatctcgctccttcgcatcgtcaacgtgccctcgcgcggcattggcgacgtgacgatggagcgcctgaacgtccacgcgcggggcgagggcgtcacgctgtggacggtgatgaagaaggccaccgactacgaggacctgccgcccggggccggggcccgggtgatggacttcgtggacctggtggagcgctaccgcgccgcgtacgagcacggccagttggccaacgtgacgcgcaagctgctggaggagattggctttcgcgaggccacccgcgcccacgccaccagcgccaccgccgcggacaagaagctcaagggcgtggacggcgtgctcaactcgctggagaacttcgaaaagcgcgagggccccaaggcgagcctgccgacgtacctcaaccgcctgagcctggacacccggcaggaggaagaggaggtgccgggcgccaaccgccgcgtcaccttgatgacggtgcacgcctccaagggcctggaataccggctcgtcttcttcatcggtatggaggaggacctgatgccccacggaggcatgcagggcgaggcgcagaacctcgaggaggagcggcgcctctgctacgtgggcatcacccgcgccaaggaggtcctctacctcacccgcgcggccacccgcgtgaagcgcggcaaggaggtgccccgcacgccctcgcgcttcctggaggacctgccgccggaggtgattgaggtggtggaactggacgcgccgcgtcaggggcctcccaccacggaggagaagaacttcttcgccaacttgaaggagcgcttcaagaaacccgcgattccgggaacgcctccgggtggcaccgggccgtctgggggagcagccaggtaggtgtccgcctcctgatgggggcgtcctggcgggggtgatcggggaatccggacgtctggtgcggtgtgaccttgacttgatccgccacacccactaggacggtcggcctttccgggcctccgtgaagttttcacggtcgacccgcggttgattaagcacgagcagcggtccctggaatgcacacggcggccgcgagaagtctggagtgcacgaaatgtcgcagaagacctacagcgcgaaggctggggacatcaagcgccagtggcacgtcgttgacgtgtccgacaaggtgctgggccgcgcggcgagccagattgccaccctgctgaagggcaagcacaaggccatctacacgccgtccattgacacgggcgaccacgtggtcgtcatcaacgccgaaaaggtgaaggtgacgggcacgaaggagcaggacaagatgtactaccggcacccgaacgcgggtttcccgggcgccctgaagatcaccaacctggagaagctccgccagcgtcaccctgaggacatcatcatcaacgccgtgcggcgcatgcttccgcgcaacgcgctcggccgccagatgatgacgaagctgaaggtctacgcaggtgacacgcacccgcacgcggcccagaagccggccgcgttcgaggtcgaggcgtaagggagataacgtccatgcccatcaacaagagctcggtttgtgcgccaccgaccgctgcaaggaggccaccgcccgcgtctgtattcgtcctggcagtggccttgtcactatctacggctgcgagctgaacgagtacttcgcccgtgagacgtccaagatgatcctcagccagcccctcgagatcctcgagcagaagggcaaggttgacgtgacggtcaacgtcaagggtggcggtctctccggccaggccggcgccatccgtcacggcatcgcccgtgcgctgtgctccttcaacccggagttccgtccggcgctgaagaaggccggcttcctcacccgcgatgctcgcgcggtcgagcgtaagaagtacggccagccgggcgcgcgtcgccggttccagttctccaagcgctaagccactcgctcagcagctgggttgtcctcacacggcgggggtcctcatccgagggcctccgccgatgtgttttcggggtccatcacgccccatcgcatgcgcgcgcgagcgtctggtaggatttgcgccgctcatggaactcaacgagatcctccagatcgccctgcgtggcggtgcctccgacattcatctcaaggcaggcctgccgcccatgttccgcgtggacggttcgctggttccgctgaaggacggccgccgcctccctcccgaggaggtggcgcgcatggccttcggcatcatgaacgagttccagaaggagaagttcaaggggagcaacgaggtggacctggcctacggcgtgccggggctcgggcgcttccgcgtgaacgtcttccagcagcgtggcaccgtgggcgccgtgctgcgtgtcatccccttcaaggtgatgaccatccaggacctgttgctgccccagattctcgccaagatttgcggtgaggagcgcggcctggtcctggtgacgggcaccacgggctccggcaagtccaccacgctggcggcgatgatcgactacatcaacgccaacgagaccagccacatcatgacgattgaggaccccatcgagttcctcattcgcgacaagcgctccatcgtgaaccagcgcgaggtgggtgtggacacgatgaccttcgcgcaggcgctcaagagcgcgctgcggcaggacccggacgtcatcctcgtgggcgaaatgcgtgaccacgaaaccatcgaaacggcgcttcacgccgcggagacgggccacctggtgatgtccacgctgcacacgctggacgcgacggagaccatcaaccgcatcgtctccgccttcccgccgcaccagcagaagcaggtgcgcctccagttggccagtgtgctcaaggccgtggtgtcccagcgtctggtgccgcgcgcggacggcaagggtcgcgtggccgccgtggaagtgctgcgcgtcacggcgcgtgtccgcgagatgattgaagacaaggaccgcacgaaggagatccacgacgccattgcccagggcacggacacgtacgggatgcagaccttcgaccagtcgctgatgagcctggtgcggcaggggctcgtcacctacgaggaggcccatcggcaggccaccaacccggacgacttcgcgctgcgcttctccggcatcagcggcacgtccgactccaagtgggacaacttcgattcgaagcccggcgagtcgcggcccattcctggctcgtccgccttcgcgcagaagggggcgcccacggctgtcgcggcgccgcaggccgcgcctgctccggcgcccatggcgcagcccatgcgaccggcggctccagcagcccagcagatgcgcccgggggggccgccgcaggccatgcgtccgggggctccggccggcgcgccggtggggcgtcccatggggtttaccgccgtgcggcccgcaggcgcccggtccgggccccgcagcggcagggggggaccacg

SEQ ID NO: 997 - DNA, 10486 bp, Myxococcus xanthus
ggcctgcgccgcatctccgccggcaaggcgaagagcggtgagaagggctacctggtcgacgcggaccgccgcgcggccatcgagcaggccatcagcctggcgtccgcggacgacgtcgtcctcatcgcgggcaagggccacgagacgtaccagcaggtcggcgaggagaagctcgtgttcgacgaccggcaggtggccgcgaaggcgctggccaaccgcatcgctggctgagcccgagcctcccaagccccgtcgacccgcccgcccatctctcacaccatggcagcttccttcagcgacgaagaggtggtgcaggcgaccggggcgacccggcgtggcggcccggccccggccgcctacgctaccgtctgtaccgacacgcgggcactcacccccgggtgcctcttcgtggccctggtgggtgagcgcttcgacgcccacgctttcgtggacgccgcggcgaagggcggggcggctggcgcggtggtggcacgcgggcgcccgttgcccgcgctgcccgacgggctgacgctctatgaagtggatgacaccctgcgggccctgggcgcgctgggacggcaccaccgtcagcgcttccggattccggtgtgcgcggtgggtggctccaacgggaagacgaccaccaaggagatggtgggcgccatcctggccacgcgcgggccggcgctgaagaccgagggcaacctcaataacgagattggcgtcccgctgacgctcttccggctggagccgcgccacgtcgcggcggtcatcgaagtggggatgaaccagccgggggaaatcgagcggctggcgcgcgtcgtccagccggacgcgggcgtcatcacggtggtccagcccgagcacctggaagggctgggcagcatcgagggcgtggcggcggcggagggcgagctgttccaggagatggggcacggcaccaccatcgtggtgaacgtggacgacgcgctcatccccgcgcaggcggagcgcagcggagcgcagcggctgacgttcggccgggcggagcacgcggacgtgcggctcgcggacgtgaagacgctgggccgcgagggcatggtggccacggtgcggcacctgggccgcgagtggccggtgcggctgcacttcgtggggccacacaacgcgcagaacgcgacagcggccttcgcggtggcgctggcgctgggctacaccccgcaggagtgcgtgcgcggcctgcagtcggcgcggccgtactcgcggcgcctcaacgtggtggacgggcagcacggcgtgacggtcatcgacgactgctacaacgccaacccggcctccatggacgccgcgctggagacgctgggcacgctggtgcccgcgagcggccgggccgtggtggtgctgggggacatgctggagctggggccgggcgagctcgaggagcacgcgcgcctgggcggccagattccctcgcacgcggcgctggcggcatttttcggtccccgctccttgaaggggtgggaggccgcttccatgggtgaatccgccgcccacttcaccgacgtggagccgctgatggcgtggttggcgccgcggcttcgcgaaggtgacgtggtgctggtgaagggcagccgcggcatgcggctggagcgggtggtggccgccctgacgggcacggccgcccccggaggaaaccactagtgctgtacctcctctacgaggtcatccagaactccgaggcggggcgcgttctcaacttcctgcgctaccccaccttccgcatcatcgccgcgggcgtcttcgcgctcctcctgggcatgctcatcgggcccaagctcatcgctcggctgcggctgaagcagcacgggcagagcaacgtgcgcgaggacacgccggactcgcaccagaagaagaagggcacgcccaccatgggcggcgcgctcatcctgctgtgcatcgcggcgggcacgctgctgttcgcggacctgaagagccgcgccgtctgggtgatgctgctgctgacgctgggctacggcttcatcggcttcctggatgactggctcaagctgtccaagcgcaactccaagggcctggccgggcgcaagaagatggtgttgcagaccttcttcttcctcgtcgccgtgttcggcctgctgacgacgtggacgctgccggacggctccttcggccccacgctgctcatcaataccaagctgacgctgcccttcatccccacgcgctggttcaacccggacctgggctggttctacgtcttcttcgcgtggattgttgtcgtgggcacgtccaacgcggtgaacctcacggacggcctggatggtctggccatcgtccccaccatcgtgtccgccatcaccttcgcggtgctctgctacgtggcgggcaccacgctgagcatcgcggactacgaggtggtgggcggcgcgtcgaagctggtggccacgccgctgtaccagtacctgggcatcctccaggtgccgggcggcgcggagctggcggtgttctgcgcggccatcgtcggtgcgggcatctcgttcctgtggttcaacacctacccggcctccgtcttcatgggcgacatcggctcgctggccctgggcggcgcgctgggcgggctggcgatgctgtccaagaacgaggtggtgtccgccatcatccacggcatcttcttcgccgaaatcctgagcgtgatgattcaggtcacgtccttcaagatgacgggcaagcgcgtcttcaagatggcgccggtgcaccatcacttcgagctcaaagggatggccgagccgaagatcatcgtccgtttctggatcgtctccatcctctgtggtggcgtggcgctcctgtccctgaagctccgctgaagccggaggtggcacggccatgacgttggcgctgtccggtcagaaggtgctggtgttcgggctcgcgaagagcggcgtggccgcgctgcgcctgctgcgtcagcagggcgcggacgtcacggcgctggacgcacgtggcgaggacgcgctgggcgcggtggcccacgaggtgaaggcgctgggcgccacgcgggtgtccgggcccacgcctccggggctgctcgcgtcgcaggacctggtggtggtgagcccgggcgtgccgctggcgctgccggaaatccaggccgcgcgcgcggcgggcgtggcggtgtggggcgaagtcgaactggcgggccgcatgctgtccggcgtgccgctgttcggcatcaccggcaccaacggcaagagcaccaccacggcgctcaccggcacgctcttcgccagcggcgacaagcgcaccttcgtgggcggaaacctgggccggcccttcagcgaggcggccatgtccccgggggactgggacgcgctggtggtggagctgtccagctaccaactggagggcatccgcacgctgcgccctcgcggcgcggccatcctcaacctgacgccagaccacatcgaccgctatcccagccacgcggcatacggcgaggcgaaggcgcgcatcttccagaaccagcaggccggtgacttcgtggtggtgaacgcggacgacgcggacgtgctgggcctggcgcgtgccgcgaaggcgccggtgtacggcttcagcctcacgggcaagccggtggcggacgctccggcgctggcgggcctggcggtggtggagccgggcggcttccggctggccttcctgggcgagcactacacgctgacgaaccgcgcgctgcgcggcgcccacaacgcgcagaacgcgatggcggcggcgctgctggctcgcctgggcggcgtggcctccggcgcggtgcaggcggggctggacggctacccgggcctgccgcaccggctggagagcgtgcgcgtgctggatggcgtcgagtgggtgaatgactcgaaggccaccaacgtggattcggtgctggtggcgttgcgcgccttctcccaaggcgtgtggctgattgccggaggcaagggcaagggcgcgccgtacgcgcccatggtggaggcggggcagggcaaggtgaagggcgtgctcaccatcggcgacgacgcggacacgctggcccgggcctatgccggcgcggcgcaggtccacgcgtgcggcaccctggcccatgcggtggcgcgggcgcgggagttggcggagcggggtgacacggtgctgctgtcgcccgcgtgcgcgtccttcgatcagttcaagaacttcgaggaccggggcgattcgttcaagcgcctggtggaggcgctgtgactgcatgaagaacccttctcctccgtcctccgccctcgtgcgcttcgacccggtgctgctttgcgcggtgctcgggctcgtgagtttcgggctggtgatggtgtactcggccagcgcggtgctggcgcaggacaagctgggcgacagcctctacttcctcaagcgccagctcgtcgccgcgggcctggggctgggtgccatggccgtggccatgaaggtcggctggcgccggctggcgcgctgggcctatccgctgctgctggcggccatcgtcctgttggtgctggtgaacatccccggcatcggcagcacggcgggtggcgcgcggcggtggattcgcctgccgggctttggcctgcagccggcggaggtggcgaagttcgcctgggtcgtctacctgtcctactcgctggcgaagaagcgggagaaggtggcgaagttctccgtgggcttcgttccgcacctcgcgctgtgcggcatcctggtgttgctttgtatgatgcagcccgacttcggcagcagcgtgctgctggtgttcatgctcttcgtgctgctgttcgcggccggcgcgaagctgagctacctggtcggcatggtgctgctggcgttgcccctggcctacgtggccattgcctccagtccgtaccgcatgaagcgcatcctggccttcatggacccgtgggcgcaccggcatgacgtgggctaccaggtggccgagtcgctgatgtccatcggttcgggtggcgtggtgggcctgggcctgggcgacggacggcagaagctcttcttcctgccggaagcccacactgacttcatcttctccatcatcgccgaggagacgggcctcattggcgtgggcctgctggtggtgctgtacggcgtcgtgctgtggcgcggcgtccgggccagcctggcggcgggggagacgttcggaacgtacctggggctgggcatcagctccatcatcgcgttccaggccgcggtcaacatgtgcgtggccatggggttgctgccgacgaagggcctgacgctgcccttcgtgtcgtacggaggttcgtcgctggtggtgttgatgggtgcggctggagtgctgttgtcgttgagcgcgaacacccagggggtcgcgaggcccagccgggtgggaaccgacatgcgggaggtggcggcatgatgaaggtgctcatcgcgggtgggggcacgggcggacatctctttccgggcatcgccctggcggaagaggtggtgacacggcatcaccgcaacgaggttgtcttcgtgggcaccgagcgcggcatcgagtcgcgcgtggtgccgaaggaaggttatccgctggagctggtgaaggtgcagggcctcaagggcaagggcttcttgtccctgctcaaggcgctcttcgcgctgccgctggccttcatcgagtcctttcgcatcctcgcccggcagaagccggatgtggtggtgggcgtgggtggctacgccagcgggccggtggtgatggccgcgtggctgatgggcatccccaccgccatccaggagcagaacgcgctgcccggcttcaccaacaaggtgctgggccgcatcgtgcgcgtggtgttcatcgccttcgaggaagcgcgcgccttcttcccggagaagaaggtccagctcatcggcaaccccatccgccgcaagctgatggacaactacctgcgcagccacgtcgcgcacgagcgcttctccgtgctcgttttcggcggcagcctgggtgcgcggggcatcaaccagcggatgacggaagcgctggattcgctgggcgacctgaaggacagcctgcacttcgtccaccagacggggaagaacgacctggagtcggtgcgcaagggctacgcggacaagggcttccaggcggaggtggtcgagttcatcgacgacatgtccagcgcctatgcccgcgcggacctcgtcgtctgtcgcgccggcgcgacgaccctcgcggagctgaccgtctgtaagaaggccagcatcctgattcccttcccgcacgccacggacgaccaccaggccgtcaacgcgcgggcgttggtggatgctggcgcggcgcttatgtttcgcgagtcggagctcaccggggaaaagctggcgcagacggtgcgtgagctgaagagccacccgttgcgcctcaagagcatggagaagaaggcgggcctgttgggccgtcccgaggccgccaaggaactggcggacgtgtgcgtggacctgatggtccagacgtggggccccaacggccgcgagcgtacccccatcgaagccgagaagaaggcccccaggagcaattcgtgacacgtaacaagccccccagcctcttcaagacgcgccatgcggcgcaggtccacttcgtggggctcggtggtatcggcatgagcggcatcgccgaggtgctgctgaacctgggctaccgggtgtccggctcagacttgcgcgagagcgacatcacccggcgcctggtgcgcatgggcgcgaccttcttcgaaggccaccgcgcgcagaacctgattcaggcggacgtggtggtgatttcctccgcggtgcgcaaggacaacccggaggtggtcgccgcccggcagcggaagattcccgtcatcccccgcgcggagatgctcgcggagttgatgcgcctgaagtacgcggtcgccgtggccggcagtcacgggaagacgacgacgacgtccatggtggccaccgtgctgagcgcggcggggctggacccgacggcggtggtgggcggcaaggtgaacgtgctcgactccaacgccaagctgggcaagagcgagctgatggtggtggaggccgacgagagcgacggcagcttcctccacctgcatccgtccattgccatcgtcaccaacatcgacccggagcacatggaccactacggcgacctggacacgctccagtccgccttcgtggagttctgcaaccgggtgccgttctacggcctcaacgtgctgtgcctggacaaccccaacgtccaggcgctgctgccgcgcatcgagaagcgcttcgtcacctacggcagctcgcacatggcggactaccggctggagaacatccaactggacggcttcaccacgcgcttcaacgcctatcgccgggaggagtcgctgggcgagttccgcgtgcggatggtgggcgcgcacaacgccttcaacgcgctggccgtcatcgccgtggcggaggagatggacatcccgctggagacggtccgcgagtcgctggccgagttcggcggcgtgcagcggcgcttcaccgtgcgcggcgaagcccagggcatcaccgtggtggacgactacgggcaccaccccacggaagtgctggccacgctggccggcgcgcggcgggccttcggacgccgggtggtggtggccttccagccgcaccgctacacgcgcacgcatgacctgatgaaggagttcaccacctccttcaatgattcggacgtgctcttcgtcaccagcgtctacgcggcgggtgaggagcgcatccatggcgccacgggagacgcactggcggacgccgtccgcgcccacggccaccgcgacgtcacgttcgtggagaagcgcaccgacctaccggcggcgctgctgccgcgtctgcgcgagggtgacctggtgctgacgctgggagcgggtgacatcacccacgtggggccggagttgctcgagctgcttcgcaccacccccctggcgaaggactagcgccatggtggaagcaggcgtgaagacggcgctggcggctcgcgtggagtcgctgggcggctgcgaggtgaaggcgggcgaaccgctggcgcctctcaccagcgtccgggccggcggcgccgcggaagccctggtgcgcccgcgttcgccagacgccctggtggcgctgctgaagctggcgcgtgaagagggtgtccccgtttcgattctgggcggcggcgccaacacgctggtgggcgacggcggggtgcccggcctgacgctgaagctgccaggagacctctttccggaggtggccgacgtgggccccgaggaagggcggctcaccctgggggcgggggcggccatcgtccgcctcatcaatgtcatgcgggcccacgcgctggtgggcgcggagttcctggccggcatccccggcacgctgggcggcgcggtgtcgatgaacgccggcaccaagaacggcgaagcctttcgcgtcatcgaggcggtggaagtggccacggcggacggggtggggtggctgacgaaggcacaggtgccgtattcctaccgtcactccgaattgccgccgggcggcgtcgtcacccgggtgcgtttcgcgctgcgcaagggggacgtggtggcctccaaggccgtcatggacgctgacctgggttaccggaaacggacacagccgctcagtcagcccaacttcggcagcgtcttcaccaacccgccgggcgaccatgccggacggctcattgaactggcgggcctgaaagggtactcgctggggcgcgcgcaggtgtccaccctgcacgccaactggattgtgaacctgggcggtgccaccgcccgcgacgtgctgggactcgtcaccctcatgcagcagcgggtgctcgagcagtccggcgttgacatgaaacccgaagtcaagcgcctgggagacttcctgtgactccgaaccgcggtgccttcacgaaggacgagctcaagcagaagcgtgtcggtgtactgttgggcggaatgtccgcggagcgcgacgtgtccctgcgcaccggtgaggccgtctccggggcgctgcgcgggctgggctacgacgtggtggagattgacgtgggccgggatttgcccgcgcgtctggcggcggagaaggtggacgtggcgtggctggccgtccacgggcgttatggcgaggacggctgtctccagggactgctggagtcgctcttcattccttataccggcagcggcgtgctggcctccgcgctgggcatggacaaggtgtacgccaagcaggtctacgtggcccacggcatccccacgcccgcgtaccgttcctttaaggacgccgcgtcggcgctggcggcggcggacagcctgcccttcccgtttccagtggtggtgaagcccagccgcgaaggcagcagcgtgggcgtgcacatctgcaagacgcgggacgcctacgaggccgcggtgacggacgcggcgaagtacgcgggcaccctgctggtggagcagttcgtcaagggacgcgaagtgcagggtggcgtgctggacgatgaggccctgggcgtcatcgaggtacgcgccgcgcgcgagttctacgactatgacgcgaagtacaaggcgggcaccggcacgcagtacctcttccccgcgccccttcctccggatcagtatgcgcgggtgaacgaggtgtgcctggccgcgcaccaggccctggggtgtagcgggggctcgcggtcggacgtcatcgtcaccgacggaggcgatgtgttcctgctggaaaccaacacgctgccgggcatgacggcctcgagcctcttgcccaagattgccgcggggcgcggtatcgactttcccgccctgtgtgagcgcctgctgctgggcgcgtgtctcaaggcctgagcatctggtatggggccggcgcaacttggcgtcggtctccttcgaaaatttccgaagcgcctgtgtggcggcttgcgctacagcgacgtgcctgtagccaaaaactggcgtggctcccgaaccgggcacagcatgcgtcaacccttttctccccatggccttcggtaaatccaagaaccgccgccgtcaggacgccgcccagcagaaagaggcggtccggggcgcggtgcgctcgcacgggccgggcgtgctcaaggtgctggggctgaccctgggcaccgggctgctggtgtggggtggggtggcgctgcgggagtgggcgctgacgtcgccgcgcttcgaactggaggcggtgtccttctccggcctccagcgcgcctcccgggtggagctgctgcggctggcggcgctgacgaaggggcagaacctgtggacgctggacgtggacgcgctggagcgcgccatgcaccagcacccctggctgcgcacggtggaggtgacgcgtcgcttccccaaccgcgtgtcggtggaggtgacggagcacgtgccggtggcgatggcggtgctgggggagctgtacgtcctggacgaggaaggcgagcccttcaagcgggtga

SEQ ID NO: 998 - DNA, 9905 bp, Myxococcus xanthus
ctggatgccgcgcaccgggaaagagggtggcatcagccaggtgagcatcgccaggcgctggcggcgggcatcacgttccgtccggcgtctgacacgatacgcgacacggtggcctggttcaagacgctgcctcccgagcgtcaagcgaagccgcgctccggcctgtccgccgagcgcgagaaggaagtgctggccgcttggcaccaggagcgcggcaccgccaacgcgggctgagtgggccttcgcgcgcggggacgggcggatgggggcaggtgaagcgcctcctcgcactgcccgtccttgcgtccggggatgcgggtttggcaggaagggtggggtagcgcggcttgctgcctgggggaacgaccatcatgacgcccgacctgctgaaggacgccgtatcacccatcctccgtgcgcgcggcacgtccgtgctgctggccgcgctgctggctgcgtgcggcggcaaggacgtgcggccggaggcgccgcccgcgggtgactgtgcgccgctccggctggagcgggatgtgaatctggaaggcttccgcaccgaccgcttcgagtggcgcgacgcggactgcaagccccgctcggcgtcgctggtgcgcaatgacgccacggaccccaaggggtggacgggcggctacctgcgccgctacacctacgaggtcgcgggcgcgacgcgcgtctgtgatggctcggacggcatggtgccgggctggggcatcgtcacgagccacctgcgcgtcagcccgccgtggggcaactggacggagggcatccggggcacgtggcgcacgctcttcgagggccgccaccacgcgctgcatgagttccgctggcccatggagcttggtggccacgtcgtcgacgtgacggtgcattacctcttcgctaccgggcggagccatccgctctatgccatcacccatgatgcgtccggtgcgccgcccgacgtcatcaacgcggacgtgcgctcgccctacggcgacatcatcttcgatggggatggcaacgcggacatctccggcgtgggctggggagaccgctaccgcttcgtgacgctcggtgccgggccgctgacgcgggcgagcggttgggactaccgcgagcccaacgtggtgccctacacccgcatgtggattgcgtcgcccgacgcggagatgggcgtggtgcagacgcagacgtgggtgcagaagcccgcgggcggctactggcaatacccgtcctgggggcaggtggacgaggacggccccatgcccgaggactggaactggacctaccagctcaaccagtacgagctgcccgagcaggggcccacgcgctcgcaccggatggcgtgggggagcaacttcggcgcggtgggcttccgcgagtacccgcgctacagcgacgacgccatgctgtccggctacccgtaccagagctactccgtcttcatggtgctgggcacgcacacctcggacccggtgctgcggctggcggcggacgtggaggcctggcagggcgtgcggctgacggccaccgagggccgcgtcctggaccggggccccggtggggtggggcgggatgactccgtggcgcgggatgtgcccggctacaacccggtgtacgccacctgggaggcggaggtcggcgccaacaaccgcgcctcgctgcgcttcgagacgaacggccgcgccctggtgaatcccgtgctggtgctgcgcggttacaccgcgtccacaccgcccacccgcgtcaccctggatggccaggcgctctccgcggacgtggactacttcgcctccgtggacgacgccggcaacgcgctgtggctcacccttcaccggaccgtgacgggctcggcggcgctgctcgtggagtgagtacacgggccgggtgccccgcaaagcaacgagggatgccccgatggactcggagcatccctcggatttcgacccatctatcgggttcgccctccccctctggcgagcgtgaccccgggtcccccttccacagacgttgccgcccccgcggcgccgtcttcctacccgcccttggtgtgtgtccggagggccttggacccctccagcgaaactgcgtgtgacaccttccccctacaccgcttacggccccttcaggtgcgcgtgcccggtgcccccagcaccgtcactcgggggagccgaggcccccccttcacctgtcctgctgcgtcccagggcaccgcgggccgtgagagtgcccgcagccgtgcctgtgtctgagcgcgtccgaacgtctgcgggcgcatggacgccacccgcgttacgtccctcgactggatttggatggctgccgtcacggcagaattcgccaggaccgccagctgtgcccgcttcgcccccgcgaaggtggccagctccggaatgacgatgccctccaatgcccccccagtggcctcgagccactccccccgggaaaagcgcctcggccgttgagccgtggccctgcttcccttgtcgccgtgcgacactgcaccgagcctcgtgtttcccccagatgccccccggcccggtccatacgcgacgtgcgacatgcgtcttccccccgttcggtccgccgaagtgactggcgacaagggcatactggctcagacccaggatggagttttccgcctccgcgccaattgcttgcgtgagcgcgccagcgtgtctggcgtgtttcagtgggtgttggcggggtgggttttccgcatcttctcagagacctggaaggtggcgggtgggacgtggggcgagcaggcaccacgggtagggcgaggcgggactcggagatgtcagcctgacacgataggggagtggctcacactgcgtctccaggctccctccctggtgggtggtgtggtgggcgggaggggacagggcacatgaggtgggaagagatgggcgagacgccccgggaggacaggcgcggaggcagggacggcggtgcgaaggcgtcctccggtcgctcctccctgctggccgtgctggcggagaagccctcggtggcgcgcgacatcgcgcgggtgctgggggcgaacgagcgcggtgagggctggctgcgcggcaatggctacgtggtgacgtgggccatcgggcacctggtgggcctggcgcagccccatgagattcgcgcggactggaagaagtggagccgcgcgctgctgcccatgctcccggcggactggccgctggtcgtctccaaggagacgcgcagccagttcgaggtggtgaagcaggtgctcaacgcgccggaggtgtcctcggtggtgtgcgcaacggacgcggggcgcgagggcgagcttatcttccggtacatctacgacgcggcgaagtgccgcaagccggtacagcggctgtgggtgtcgtcgctgacggagcgggccatccaggacggcttccgccggctcgcggacggccgtgaatacgaagcgctggccgccgcggccatggggcgcagccgggcggactggctggtggggatgaacctgtcgcgcctgtacacgctggcgcacgggggccatggagagatgctgagcgtgggccgggtgcagacgcccacgctggccatggtggtggagcgcgagttggccatccgcgacttcgtgccgcgtgactacctggagctcgtggccaccttcgcgcccagggcgaagggggttccgccggacgcgctgtacaagggcacgtggttccgctcggggccggatggcaagcccgtggcgcccccgggcttcgagggcgtgcgcgaggcgcggcggctggatgcgaacggcgtggaggcgcaggccatcatcgaccgggtgcgcgccgggcgggccatcatcgaatcgctggagtcggaggagaagaggatggcgcctccgctcctctacgacttgacggagttgcagcggcacgccaaccggctccatggcttcagcgcgcagcgcacgctggaggtggcgcaggcgctctacgagaagcacaagctgttgagctatccgcgcaccgccagccggcacctgtcacgcaccgtggcggacacgctgccggaggtggtgaacgccattcgcgggccctacgaggaggacctggccgtcggtacgggggctcgggcgctgggcaagcgctatgtggatgacgcgaaggtgacggaccaccacgccatcatccccacgcccacggcgccgggcggggtgcggctgtctccggacgagcagcgcgtctatgacctggtgtgccggcgtctgctccaggcgtggcacgaggaccacgtctggcgggtcaccacggtcatcaccgcggtgacgtcggcaggggcgccgcccgtggtggaccgcttccagagcacgggcacccaggtggagcaggtgggctggaaggtgctggacattggcggcggacagaaggcgccgcggctgaagtcggaggggcgcaagggcgaggacgcggagcgggagccggaggacgagccccagacgctgccgtcggggttggcgcgcgcgcagccgcagtccgtggaggacgtggaggcggtgaagaagcgcacgcgtccgcctccccgcttcacggatgcgacgctgctgacggccatggagtcggcggggcgggcgttggatgagaaggagctcgcggacgcgatgcgcgagacgggcctggggactcccgccacccgcgcggccatcatcgaggtgctgctggaccgcgagtacctgcgccgccggggcaaggtgatggaggccacggagaagggcatccatctcatccaggtggtgcacccggatgtgaagacgccggccatgacgggccagtgggaggcgtggctccagcgcatcgagcgcggcgaaggccagctcgatgagttcatccgtggcatcgaggcgtatgtcatcgaggtggtgggccatggcgccaccgcgccgcaacggcctccgcgcaacgaggtgttgggggctccacctggagcaggttgggggcagggcggcgcggcgcaggtggcgagcgagggcgcggccgcggcgcacggcgctggcgcgggagcgcgtggccctggcgggcagggggcgttcgcggagtcctctgctgagcgtttcggggatgcttcggcggggggggcggggcgtggccggcagggggcgttcacggaggcttctgccgagcgcttcgcggatgccgcgccgggtgtgcagggacagggacgcccgggcgcgctctcggaggcttcggagccgctcttcgggacgcggcggagcaggacctcgggctccgtgggtcgctcggagcctcatggcgagccgctgtcctccaccatgtcaccgggcggaggcgcggcctcgcgtcttcctcgggcggacggcacaggctggaacgccggggcctgggagaacacgggcgctgctcgcgctccagtgaaccgtgcgaggaccccggcgtcagccgcgtccaccgggcagcggccggagcgcgtgcggcgcgcaccgacggcgcccgaggcgctgcgtccgctgctgaaggaggcgttcggcttctcggacttccggccgtatcaggaggccgtgtgccgcgcggccacggcgggagaggacctgctgctcgtgatgcccacgggcgcgggcaagtcgctctgctatcagttgccgggtctggcgcgcgcaggcaccacgctggtggtgagtccgctcatcgcgctgatggaggaccaggtggcgcggctccagtcgctcggcttcgcggcggaccgcatccactccggaagagaccgggccatgtcgcggcaggtgtgcgcggactacctggaggaccggctcgacttcctgttcatcgcgcccgagcggctcggcgttccgggcttcgtggagttcctggcgcgccgcacgcccgcgctcatcgcggtggacgaggcccactgcatctcccagtggggacacgacttccgcccggactatcgactcctgggcgcgcgtttgcccctgctgcgccccgcgcccgtggtggcgctcaccgccaccgccacgccggacgtgcagcgggacatcgttcagcagctcggcctgcaaggccccgggggcaaggcgcgcaccttcattcacggcttccgccgcaccaacatcgccatcgaggtgcgggagctgaaccccggcgcgcgcggcgacgccatccagggattgctcgaggacgaggagaaccggcccgcgattgtctacgcggccacgcgcaagcacgccgagcagctcgcggaccagctcgcgggcgagttccccgcggccgcctatcacgcggggctccagccttcggagcgagatcgggtgcaggccgagttcctccggggctcgctggaggtcatcgtggccaccacggcgttcggcatgggcatcgacaaggcggacgtgcgcaccgtcatccacgcggcgctccccgccagcctggagggctactaccaggagctgggccgcgcgggccgcgatgggaagccgtcgcgcgcggtgctgctgcattcgtacatcgaccggcgcacgcacgagttcttccaccggcgcgactacccggaggcgtacgtgctggagcggctgttcaagtccacggcgccgcagctcgagcccaaggccgtgctccagggccgcgtgcgaggagaccccgaggtcttcgacaaggcactggagcagctctggattcacggcggcgtcgtcatgacgcctgacgagacggtgatgcgcgggaagccgggctggtccgcgtcgtactcggcccagcgcgatcgcaaactgctgcacctggagcagatggggcgctacgcggaggcccatggctgccgcatgaagcagctcgtggggcacttcggtgacacccaggattcgggtgagccgtgcggcctgtgtgatgtctgcgcgccggaggactgcgccacgctgcgcttcgccgagccgacctccgcggagcggcactggctggagcgcatcctggagtcgctccaggagcgggacggacaggccaccggaaggctccaccgcgagttgtttggagagtccctgccacggcgcgacttcgagcgactggtgggcggactggttcgcgccgggctgacgcgcttggaggtggactcgttcgacaaggacgggcaggtcatttcgttccagcgtctcgccctgacggacgagggccggcgcacgcgcgcggtggacccccagcgagtggtcctgccgttgcccctggagaaggccgcgaagcgcaagcggggcaagggcgcggagaagggcaccgcgaagcgggccacggccaagaaacgcacggtccgcgccaaggccggggccgcgacgcggcgcacggcatccgaatccgatgaggaagactcgccgacgcactggcgcgcgaacgctccctcgaagagcaccgccggggcgccacgtgcgtcccggagcacgggggctccgagtggctccgcgtcaggccgccgcgccgcggccgagccttctccgaagatggtggaggccttgaaggcctggcggctcgcggaggcgcgcaagcggcgggtgcctgccttccgcatcctcacggaccgggtgctggaggccatcgcgtcggcctgtccggagaatggctcggagttgatggccatccacggggtggggccctccctcacggagcgctacggcgcgcagattctttccctcgtggcgcgcaggagctgagcccggacgcctcgcggaaggaggcgtccttcccacgaagggaagggcgcttccctccgcgcgccacggcgattccagcgcaagtccgggtgcggggcgcaaggggccgcgtctccacgcccgcaggaacgggcagcgtgcgtccaggcaacgaatcatcttcaccgtgctgccgggcagtgcaggcggcgtccgcccatcgtcacgttggaccggccaaaccagcggacttgtgcgcggacgcagggcgaaggggggcacgcgatggaactgggcttcgagacgattggaaacgccacgctcatctgccacgaccacggtccggtgttggtgaccgacccgtggacggacggcagcgcatacttcgggagttggacgctgtcgcatgagattccggcggcgcagcgcgaggccatccaggcttgtgcctacgtgtggctgtctcatggccacccggaccacctgagcatggaatcgctgggcgcgctgcgctcgtgcacgctgctggtgcccaaccacttcggccaccgcatgcgcgatgacttgcgcgggcagggcttcaaggtgcacgtgctggcggaccgggtgtggacgcagttgtcaccgcgcatccgcgtcatgtgcttgccggacgtgaaccaggacgccgtcctgctggtggacatggacgggcggctgctggtcaacctcaatgacgcgggggaccgcggggccggccacttcgtgcgcaaggtggtcagcgggtatcaggagtcgtatctcctggccctgtccgggtacggcgacgcggacatgatcaacttcttcaccgaggacgggcagcgcatcgcgccccatgccgcggcgaagacgcccgtgggccggaccattgcccggcaggcggagttttacggggtgcgctacttcatccccttcagctccatgcacaagtaccagcgggccgacagcgtctgggcttccgagtacaccacccggctggaggactacggccggggcttcgagtcgcgcacctgttcgctgctgcccgcgttcatccgccacgacttcattcgcggtcagacggagcgaatccagccccgggagcgcgtcctgcgcccggtggaccccaaggccttcggtgacgactggagcgattcactggacacggatgaggtgacggcgctcacgacctacttcctcggcgtggagcacctggggcgcacgctcgacttcctgcgcttccgcgtgggaggccgggagcacgtcatcgaattccagaagcgccgcttccgccggggcatcaccttcgaggtgccacgtggctcgttgatgtcggccgtgcgctaccaggtcttcgacgacctgctcatcggcaacttcatgaagacgacgctgcacggcgacttcggcgcggggcggctctacccggacttcagtccctatgtggccaagtacgcggacaacgggcaggcgcgcacgcgcaacgagctgcggacctatttcgcggactaccgcaagcgcgacccgctgggcttcctgcgtgccaaggtggagacgcattgtgtgcggcccctgcagacgcagtccgcggagctgctgcgcatgctgctgccccaggactcgcggggctaccgtgccgccaaggagaccttctggcgggtccggcgcgctctgctctagaggtacggcgacagcagccgcgccagcccatcccgcaggcggatgggcagggcgcgcgcgtccacctgctccaaccgtgaggcccggcgttgcgcagccgcgcggccaccacgccctccaactgcatggccagcgcggtgtcgtagcactccacgttgaactcgaagttgagccgcagcgagcgcgggtcccagttggccgagccgatgagcgaccacacgccgtccaccaccatcagcttcgtgtggtcgaagggcggggcggtgaggaagatgcggcagcccggccgcagcacctgccacaactgcgcccaggcggcccactgcaccagcggaagattgcccttctcgggaaggaggatgtccacctggacgccgcgcagcgccgccacgctcagcgcggtgatgagcgccgtgtccgggaggaagtagggcgtgacgatgcgcaccgacgttcgcgccgtggccagggcccccagcagcaccgtgcgcagcgtctcgaagtcctcgtccgggccgtccgcgatgcctcgcgcgagcacggtgcccacttcggtgagcggcggggaccctta

SEQ ID NO: 999 - DNA, 9996 bp, Myxococcus xanthus
ctctaaagccctgcatgcccgggacgaacgcttcgcgcgcgaggccgagctgctgtcccgcatccaccaccccgccgttccccggttgcgagcgagcgggcgttggcaacccgccaagggaccgccccacccctacctcgcgatggactgggtggagggcacaccactctacgattgggccagcgagcaccgtcccacgtcgcggcaggtgatggccctgctcgcgaggctggcgcgggcgctcgaagccacccacgcggccggggggctgcaccgggacgtcaaaggacacaacgtattggtacgcgaggccgacgggcaggcgttcctcatggacttcggttccagtcactacgtgggtgccgcgacgcagacgagctcgccgtttccaccagggacgccggcctatcgttcccctgaagcatggcgcttcgcggcgggtaactccgcgcctccgtatgcgccgggacaggcggatgacgtcttcgccctgggcgtcaccgcgttccggatgatcacggggcggtatccaccgtcgacgcatcctgacgtggcggagtccaggttctggcacaccgagcgagcccaggccccatccccgcgagacacgaatgggcactgctgcccggagttgagcgcgttggtgtcgcagatgctcgccccaagcctccatgcgcgaggcagcgcacgcgagctggcggaggctctggattccgcggtggcacgggcgggctcggagtcgaatgtgccactcatggtgggaggtgcccttcactcccgagcatcggcgcagtggaaggaacgttccgtccgccatcgggcccaacgaccccggtggccatgggtggccatcatcggacttggaggccccctggtactgagtctcggctggcggcctcgcgcgggagccgcagtcgaagtcgctcccatgccgactgcgatgtccgtggaggcaactgacggcggcacggtggcggtgggagacagtgtgttcgcggctccggcatctcccatccaggcccccgttgcatggtcgaccatcgccctggagatgccaccccgcccctttccggggcagacccggccagacgcatcaggacggtgcccacgcaagctccaagtccccatcaacggtggctgctgggtgaagctggccgtcgataacctgaaggactgtgacgaggatgggtatgtccacaagggcgcctgctatggccccgcctttccccctacgcggcccgccacgtcgagccccgcccactgtcctacgcgtcactgaagcgcagctcctgtcgcccgcctgcccgcaccccgcgtcgcttcggcaaggcgcaccgctgcggcatatcctgctgtcgatgaagcccacctacacagtcgccgccgtgcggaaccaggacgagttggagcacatcctggcgctgcaacagaagaacctgaagcaggcgctgtccgcggacgagatgcgctcacagggcttcgtcacggttcagcacgacctgccggcactggagcagatgcacgccatggcgcccagcatcgtcgcccgccacgatggagtgctggtggcctacgccctgacgatgccgcgcgaggcccgcgcgctggcccccgtcctggagcccatgttcgcgctcctcgattcgcttgagttccgaagcaagtcgctgcgcgactaccgcttctacgtgatggggcagatctgcatcgacaaggcgcaccggggacagggcttgttcgaccggctctaccaccagcaccgggaccacttccgagatcagttcgacctcatcgtcaccgagatttccgtgcggaacctccgctccctgcgcgcgcacgagcgggtcggcttcgagacgatccacacctaccgggacgcgacggacgaatgggccgtggtcgcctgggactgggcgccgccgcgccccccggacgtcacgcccgaggggaacacgcgctgagcgttgagccagcccctcctcaagggaactgacgttgcacacgcgcactgagcccgatgagggccgcacggtcctgcgcgctgaacatggccccaaaggcccgagcctcggcggaaggatcgcgctggaagaactccgtctcgcgccgagcgaactccgcgatgttggcctcggtcgcgggctggctgagcaactctcgctgctgcgcgtagaagtcccccacctggcctgtgccgaactcgcgagcgtaggcctccgcggcgggccccagtcgcgtcagcggcctcgtcacgccagaggcttgaagcgcggggcccacgaagggcacggcgtgaaccacggcgcccggcaaggcccccacggcatgcccgggccgtgcccagcatccccacagcccccgacagcaagggccggatgggccgccccgactgaacccggggggactctgccgcgtgacctccagggcccgctggcgctgtccgccggatggagcggcaccttgaccggagagattcaccagaggggctgaacgcggtggctcgaagcggtccctggatggcggcggctgccgagcagcactctcaggcgccgatggcggcgtggccaccgaatcccgaacgcgagacgcggatggcgccacggcggggcgaggcgcgactccaggacgaatcggactggtgttccccatgccggagagcatatcacgggctattcacgaaaaacatgcctcgcacccatcccattccttcgcccctcggcagcacacgcaatgactcatccgctgtagcccaaagcgacgtgtcacgttgaaaacagacgccaaacacgtccaatccctcatcagccatccacgccttgggaggccgaaaaaccacggcatcgggcaagggacgcccagggtcgtttcagagggagacatgcaccctatcgcgacgggaagagggccctttccacacttggagtgcacagtcctgggaacaaatttgtgacacggcacaaacatgaatccggattgccaggaacattcaagtttgatgtattaaaggcgtctcacttcattgtcccccctagcaggagttcccccgatgcgtcgttatgttggatctgccttcctcgccgccggtctgctcgttggctgtggtccgagcgaaaccgaaacgtccacgcagcagccccaggagcagcagcaggggctgctgacggaggctgacgtggacgttgccaccgagtgccagggcattctccagttcgtcaatgaagcgacgttcaacacgctggacgcctatctgcccagcaacgtcgtccacaacctggtcaaccggcgcgcggtttcgcagttcgtctccctggcggacatctcctccgtggcgctggtcggtccggcgcgtctgcagcagatcgagcagggcgcccggagccaggactacatcgacgcggactgctacggcatcgcggatgggctggccctgtcgcaggatgacgcggtcgccatcgtgtcgctggtcaacagcatcagctccaccgaactgcacgacatcctcccctacgcctggaacggcgcgctgaacctgcgcaaccagcgcccgttcacgaacgcggacgccatcgcgaacacgacgggcatcgccgacgtgagcttccgcaacctccgcaacgcggccacgctgagccgtccgttcgaggcgctcatcaacgcggtgaacaacgtgccgcggccgcacggtggtgtgttcatggcacgccacttcgactggtgggagaacatgaacggccggttctacaacttccagatcactgagtgcttcggcgaaaggacggagcgggtgtccgaaccgcataaccaccgcgggacgaatgctgacgccgccgaggttcgcgcccatgtcgaggcgttcgtcaacgctgccgcgagattcggaacgttggacccggaagtgaaggccgccggtctggccaacctgaacaccctgattgagggccgctcgttcttcggctgctcctacggctacgcccgtgacccctggagcggccacggcgcgacgttcttcgtcgacaccgagtccggattcagcgtgtacacggacagctactgggcggagtgattcaccggcgctccggacggggctgaacggcccgtccggggcgcagcaggcttgaagcaaactgaggactcccaccgaacccctcaagcgagtggaactgcgctccgtgatggattcgattcgggacttctcaccgtccaatcaggcgaagcgcgagtccagcttcgtgagctggctcgtgaagccttcctgctgcatcttcgtgaactcctcgctgtgcatcgcgtccagcatcaccaccatccgaacgccgtcgccgctagggaggaagtccacggcgatcttgctctcgtagggagcgacaccggggaggaagtcgatgacgttcgtgaggacgagtcgcgaatgtggcgccacctcggtgaagcgggaacgggtcgcgtgagaggtcggctggcccatctgcttcatcgcggcgatcatctccggtgagtcggcaatcatgtcgtaccgaagggcgccgcctacgcgtgcatcgagttcgtgcaccgcggcacggaagccctgtggtccccaccacgactcgaagccctctttcgtggtccagagcgcccagatgtcctcgattcctgcccggtaggtgcgctcgatgacgaccttcgccttctcgttgctcatttccgctgccccttctcttcgactcggcgagtctgttgttgttgctgcttcttctccagtgcggctccgaagcgatcgaggcgcgcctcccatagctgccggtacccggtgagccacccatcgagttcctgaaacggctccggcttcaaggcgtagaggcgacgctgcccatccggccgcatcgagacgaagcccgactccgacaggatgcgcagatgccgcgagacacctgactgatggattccggccttctcgacgacgtcactgacctgctgctcaccgtaccgaagggtctcgacgatgcggcggcgcgtcgggtcggcgagcacctggaagacgtcaagttgcatgaacatgcatatacacatccatgcatatattcgtcaaggccggcgcccaacgcaagcgcacgggccaggcgaggcgccgtcgtgtcggcacctggagccctctggcggggccctgctcggaagaactccgtggcgacagcctcgattcgagctgcctgctcccttactcagcgggccgtcgaagccggctccggaggcggtatcatggcgtgtgctcgctgagggccgctcaccaggatcttaccaccacgacttcgaagtggaccgcgatgcactacttgagcctcacggctgaattcaaagcatcccacgcagtcaccttcccggacggccagcgcgagcccctgcacacgcacgactggtgggtccgcgtctgggtgaaggcgcgagcgctgaatcattgggacgtcatcatcgacttcaaggatctccaggacatcatcgttcgggtgtgccgggagctgcatgacacgaacatcaacgagcacccctacttcaagacggtgaactgcacggccgagcgcgtcaccgagtacgtcttcaagcaggtggagtcgggcctgcccgagggcgtcacgctcgaccgggtgcacctgcgtcggacgggcggcgagcttccagaggccgagtacgcgcatgcgagggactgaccgttgaggattgctcctgactccgcgctcgcctcccgagggctggacggttagaaacactccttccatggcgcctcctggcctccatcccctctctcccctgccccccatttccggaagtgggggcgttcgcgtgaaggtcgagggcctgagccgcaccttcccaggcaacatcgccgtgctgtcggggctggacctggacgtggcgcccggttcgttcgtggcgctgctcggtccctccgggtgcggcaagtccacgctgctgcgactggtggccggactggaccgcgccgaggccgggcacatctccttcaccccgacgctggagcgaacccagggcgagcgcgcccccatcgcctacgtcttccaggacgcgcacctgctgccctggcgctcggtgctggacaacgcggcgcttccgctggagctgaccggtgtgtcgaaaccggagcggcaggccgccgcgcgcgccgtgctcgagcaggtggggctcggtgatgccaccgaccgctttccggcggagctgtctggcggcatgcgcatgcgcgtgtccctggcacgcgcgctcgtcacccacccccggctgctgctgctggacgagcccttcgccgccctggacgagctgacgcgcggccggctggatgatcaactccgcgcgctgtggcgcaagctggggatgaccgtgctcttcgtcacccactccattccgaaagccgcctacctggccgagcgagccgtggtcctgtcgcgacgtcccgcgcgcgtggtgctggatcggacgctggagctgccaggtgagcgcagcgcgtccctgcgcacagaggcgtccttcgcccgcgaggcccgcctgctcaacgaggccctggaacaaggagagcgctggtgaaccgctcagcccttcgcgctgcggtccctccgctggtggcgctcgtcgtcctgctgaccctatgggaaggcacggtgcgcctgctggaggttccgcgctggctggtgcctccgccctcggccattggtgccgcgggagcccaggaggcctcctcgctcctcggcgcggcggtcaccacgggccgctccgccctggtcggcttcgggttgagcgcggtcctgggggtgctcgtggccgtcctcctggcctcctcgcggatggtggagcgcgccctctacccctacacgctcttcctgcagacagtgcccatcgtggccatcgccccgctgctggtgctgtggttcggcccgggccctcgcgccgtcgcggtgtcgtccttcatcgtctcgctcttcccggtcatcgccaacacgctcaccgggctgcgctcggtggagccctcgctccgggacatgttccgcctctatggcgcgcggcggctcgccacgctgtggaagctggagctgcccgcggcgatgccacacctgttcacggggctgcgcatcgcctcgggcctggccgtcatcggcgccatcgtcggcgagttcgtcgccggcttctccgagggcaccgcggggctgggaatcctcgtcctggccgcgtaccgtcaactgcgcacggatctactgttcgccgcggtgctggcggcctcggggctgggcttggtgttgttcggtgtcgtgagcctcaccggcgcccggctgctgcggcgctggcacccgtcggcgcagggaacatgaatcgcctggaaaggagctggacgtgagcggacgcctcttgaaactgttgggctgcgcggtgcttctcgtggccgcgggggcctgctcgcgccagaaggaggagcccaagcagggctcccaggccgcaacgggggccagcaccgccccgccgaaggcggacgccccggccaaggtgcggctcgcgctcaactgggtgccggagcccgaattcggcggcttctatgcggcgcgggagtcgggggccttctcccgccatgggctcgaggcggagatcctcggcggcggagccggcgcccccgtgccgcagatggtggccaccggcaaggtggagttcggcatcagcggcgccgacgagctcctcgtcgcgcgggcccgaggcctggacgtgattccgctgttcgcggtgtatcagacgtctccgcacgccatcatggcccacgcatctcggggggcgaagaacatcgcggacgtgctgtcctcgggcacagtggcgctggagccgggcctctcctacgtggccttcctcaagaagaagtacagcttcgacaaggtgaaggtggtgccctacgacgggggcgtcgcgcgcttcctggcggacaaggacttcgcccagcagtgcttcgtcaccgccgagcccatcgccgcgaagcggcagggcgccacgccaacggtgttcctggtggccgaggagggcttcaacccgtacctcgccgtggtcatcacgcggcgccagtactggaaggaacagcccgagcgggtgaagtccttcgtggcggcggtgcgcgaggggtggcggacctacctggacaacccggggcccaccaacgcggtgatgggaaagctgaatacgacgatggacgcggagacgttcgcggagggggccgagacacagaagccgctcatcgagacggaggagacgcgagcccgaggactgggcacgatgaaccgccagcggtgggagcaattggcccagcagctcgtggagctggacctcatcgagaaggcgcccgccgcggacgagttcctgctgccggagttcaccggctcacgcgattaaagcggcacggagccgtatcagccaagagccgctcacctcgctcgaatatcctccagcccggtgacccgggatgcgtaaccgtccggccaacgacgtgccgtgagggtttgccggggtggcggtagcggcggacgctttcgggcatgtcgaagcaggtggagaagcaggagtgggtccgcgtcgcggaagcgttcgaggccagtgggcagacgcagaaggagttctccgctcagcgaggcgtgcggctgagcacattgcagtcgtgggtgtaccggcgcgacgccagcgtggcagccaggcagcaccggtgcgcctgctaccggtggaggtggctggcatgtcgcggccgagcacggtgctgctcgaggtggtaacggcgagcggagctcgcgtgagattctccgtgggcaccgacgtcgagtacgtggcccggctcgtcgcggagctggggcggtaaggcggtgtttgccctcccagcttcggtgcgggtggtgctggccacagggcctgtggacatgcgcaagtccatcgacggcctcatgtcgctggtgcgcaccgccgctcaccgcgagctgcgtcaactgcacagcgcccccgtcctcacgcaactgcacgtctggctcgaaacgcaggcgccgcgccacctgcccaagagtccgctgggccaagccatttcctacgcgctgaagcagtgggaggccctcacgcgcttcatcgagaatgagcgccttcctctcgacaacaaccgcgcggaagcggcgctgcggaaggcggctctgagccgtaagaactttctcttcgtcggccacgaggccgccggggaaaacctcgagggcctctacgccctggttgccacctgcgcggccaacggcgtcaaccccgagacgtacctaaccgacgtcctgctgcgcgcgcagacgcatcccaactcccgcatcggcgagctgctaccccacgagtggaaatgtcgacgcgtcgccgagccgcctgactcagtcctccagcccagtccctgaacagctcgctcttcgtggcgctcgccgaacacagtcctcgtccgcaatcaaacctcccggaacgacgcccaccggacggttacagtgagtccgctgcggccgagggtgaggatctccggacggccacccttgttggggagcgggcattggtccatgactccacaccccatccctcccccggtgagggcaaagcgctccccgctggcaagtcccacgaggaccaccggggggcgtggcgccatcgtcctggtacgccttctcgcacagcgtggacgcggtggcgaaaggggcggcgcgagccgagcacctgctggcgctggccacgacggcggccctgctggcagtgggggccgtgcgccggctgcgcacgcggcgccaggcccagcgcccgcggtgacgcgcggaaacccaatacgccccaaaacagaaaacccccggtgtccacgagggacaccgggggtttctcaaaaagaatccggcagcgacctactcttccgcgcggtttcccgcgaagtaccatcggctcttgagggcttaacttccgtgttcgggatgggaacgggtgggaccccttcga

SEQ ID NO: 1000 - DNA, 12898 bp, Myxococcus xanthus
acgccacactctgggacgagccgaccaccggtatcggcctgtacacccgttgcctggcctccgccctcgaggcgctcggcgtccagctcacccgcgtaggggctcagtcatccggcgaggcccctcgcgcgaaggcagggcgcaccgcctggacgctgggcggcttgccgcgcgtgctccagcgctcggatgcgctgctgtaccacgcacacggtaacttcaacctgcccctcatccgcgctcccggcatgaagtacgtgctgacggtgcacgatttgattccgctgctgatgccggagacggtgtcggccgcgttccgctggcagttccggctgtggatgtcgcgcagcctgatggtggcggaccaggtggtgtgcgtgagcgagcgcacgcggcaggacctgctggcccgctatccggaagcggagtcgcgcacggtggtggtgcccaatggcgtggaccacgtccatgcgccagtcctggacgacaccagcaaggacttcctgcgcgcgctctcactgccgaaggagtacgtgctctacgcgggctcgctcgacgtgcggaagaacgtggacctggtgctggatgcgctggagcggctgcgactgcggggccggcctgcctcgttggtgctggcgggacagagctggttcggcgcggggcgcgtgaaggcgcgcatctcccggctgcgctcggaggggttcgaggtgcgctcgctcggctatcagtccgacgccgtgttctacgagctgatgcgccgcgcggccgtgttcgtgttcccctctcgctatgaggggttcgggctgccaccgctggaggcgatgcggctggggacgcccaccatcgtctccaccgcgggctcgctgccggaggtctgtggcgacgccgcgctgagcgtggggcccgacgacgcgaacgggctcgcgagggcgttggaccggctgcttcactcgccggaggaacggcgggcgctcggggagcgtggaaaggcgcaggccgcgaagttcacctggaagcggaccgccgagggtaccttggcggcgtacgaggccgcgctgcggcgataaggagacgtatgcgaaagctcgtctggagtggggtgatgctgtgcggactgctcgcgggctgtgcgagccggcaggagacaggcgctgctccggcggagccgccacccgccgaggccgaagccagcgcagaagcgacggcgccggtccctgaagacacgcaggccaccgagacttcgcccgccgaggaaggtgaggcgaaaacggtcgtccagcccctggtggtgacgcccaatcccgagccgaaggaccccatcaatgtccgaagcgccaaggtggacggtggcatcctgacgctggccgtgatgcatggcggaggttgcgccgagcacacgtactcgctggcctgggatgggaacctccagcagggcgcggatggcacgcccgtggcgaacctggtgctggtgcacaatgggaacaacgaccggtgcaaggcgctcctgcgggccactcctcgcttcgacgtgtcctcggtttcgcagctcttcggggcgcagttcgggaagacctcgggcacggtgaacctggtcctgtcggaccaggctcacgtgcgctacgacttctgagccctacgactcagcggaggacgcctcggtgacgccctccgccagcaggtcctcgcgcagcttcgtgaggaccttgcccagcaggttcagtcctcgccacttcgcggggtgaaggatgcgcgggtcctcctcatccaaccccacaccccagatgcgatccacggggctggcttccaccaactccgttcccgcggtggccaggagtgccttcaacaactccgggctctgggtgaacttcgcgcgattgccctcgtagacgatgcgctcacgcgccttctcccagcgcgtgttgtcgaaatcgcggaccttgcggcccagggccttgtgcgtcttgggcgacttcgatgacaggatgctcgccagcgcctcgttgtcaccgaagagccgcgccttgcctgccatcatgtactgctccgcgcacacgtagcgcacgccgtccacggtgaagtcggaagggtgccactgggagaagggggagtgcgcctgccagaacaaggtgaaccgctgttgttctgcttcgctcatgggcgacctcggaaatggtgttgattgtacacgaacgttggcggcccagcggcctgacaaacgtcgctacactgcccaccttcatgacgctctccgacgccctgctcctgctggaacgctgcttcaccgggcttgcggaaggcgccccccggctccgcgagcaggaagatgcccgcttcgccctccgccccagcaccgtgtggctggagtaccgctggtatgtccaggagcgggggatggcggaggtcttcctcaagtggccccgtacctccaccgggcagagcgccgcggccgaggccacggtgctgcgcgtccatctgctcggcgtgtcacccacgctttcccaacgtgcggggcaactgctcgtggggggcacgccgtcgagagatcgcatcatggacctcttcggtgatgacggcgtgcgccgggagtgcgtctgcctgggccggacgaacgtcaccgtcgagcactgggagccgcagcccggcccgcgcccgttgctggatgatgcgcgcttcacctcgctggccgaggtgctggaggcgccggactccacgcccgaggtgcgtcacgaggcggtgcagcggctggccgacgagcgaagccctcgcgtcgtggcggtgctgctcgcgctggtggcgcgcaagcactcgctgatggcgctgcgggtgttgtcggagtggggcgtcgtgggggcgcgcgaggcgcttcagcgggacctggcccaggtacggccggacaatccggcggacctgtggacccttacggcgttggagcggcggcttcaggcctgggcggcgcttcagtgaacagggacgcctgacgcatcacctcgtcatgaggccattcacttcggaatcgcgggcccgcgacgccagtcccatcgaagctggcgaggcatcggtcgcccagccgggcctccgacgcgcgcgcatccttggggacacgcgcgcgccttcgcttgctcacgccgcgccgggcacgcgggggccgagcacatcgcgcagcgcgtccgccacggtcagcttcgggacccaacccagcgccttcagcttgtcgggagcgccgacgaggctggggatgtcggagggccgcaggcgcgcggggtccagctcgatgcgcgcgctgacacccgccagcgacagcatctcctccagcaggctgcggatggtgcggccctcaccgctgccgatgttgtacgcctgccccggctcacccttgtcgagcagcagccggtaggcctccaccacgtcgcggacgtgggagaagtcgcgcaccgcatccaggttgcccgtgcgcagcaccgggtccaccgtgcccagcccgatggcgcgaatctgcgccgcgaacgagggcaccacgaaggtggggtcctgccccgcgcccaggtggttgaagggccgcgccatgacgacctccagcccgtagctgcggtggaactgcaccgcggccagctctgctgcggacttggaggcagcgtaggggctcaggggcaccgcgggggtgtcctcggtggcgcgcgtgccttcgggcaccgggccgtacacctcgccggagcccaccagcaccacgcgcgccttcgggacgctctcgcgcaccgcggtgagcaggtgcaccacgcccatggtgttcaccgcgaacacccgggacgggttgtggtggctcttcgcgaccgagctgaagcccgccagatgaatgatgccctcgggcttcacctcggctaccgccgccttcaccgaggcttcattggccacgtcgaagtgcagggcgttgctgttgatgccctcaccgcgcggcccgtgggcctccactacctcgtcgccggcggcgcgcagcagggcgcacaagtgccggccgacgaagccatccgcgcctgttaccagaatgcgcatctaccgctgccccgccttcacgcgctccaggtccgcgtccaccatcatctccaccagctccttgaagcggaccttgggctcccagcccagcttcgtcttcgccttggccgggtcaccgatgagcaggtccacctcggcggggcgcacgaaggccgggtcgatgaagacgtgcttctcccagtccaggcccacgcgcgcgaaggcaatctccaccagctcgcgcacggtgtgcgtctcgttggtggccaccacgtagtcctcggcctgcggctgctggagcatccgccacatggcgtccacgtagtcgcccgcgaagccccagtcacgcttggcgtccaggttgcccatgggcagcttctcctggaggcccagcttgatgcgcgccacgttgtaggtgaccttgcgcgtgacgaactccaggccccggcgcggcgactcgtggttgaagaggatgccgctcaccgcgaacaggttgaaggactcgcggtagttcaccgtgatgtggtggccgtaggccttggccacaccgtacgggctgcgcggatagaagggcgtgtcctccgtctgcggaacttccagcaccttgccgaacatctcgctggacgacgcctggtagaagcgcgcctccgggcgggtgtggcggatggcctccagcatcttcgtcacgcccagcgcggtgaactcacccgtgagcaccggctggttccaactggtggggacgaaggactgcgccgccaagttgtagacctcgtcgggcttcgtcaggttgagcaacgccgcgagcgagaactggtccagcaagtcgccctggtgaagctgaatcttcccgtgcaggtgctggatgcgctcgaacttctcctccgacgagcggcgcaccatgccgtgcacctcgtagcccttcgaaaggagcagctccgcgagatagctgccgtcctgccccgtgatgcccgtaatgagtgcgcgcttggtcgccatgttcttttctgtgttggctggaagacgcactttctagccgacgctgtcactcatcgccaaccgttcccggccgcttcctacttgaaagcctgacgcctcgtgccaagttagggcgctctcatcgctcaatctggaggcggtcatgcgcaacccaacccccctggccctggcggcgctgctcctgggcactccggtgtccgcgcaggtctccgtgtcgccgacggcgcagtccgagcccgccccgtccatcaccggcggggtgctccaggacgtggccctctgggtgagtcccggcgcccccagcagcagcctgttcctcaccgcctacaacagccccaacgcgggcctcgtcaccttcggcctggggggcgagcaactggatgcggagctcacggatggccccatgtcggccgtggccgtgcgggacggcttcccgctgtccggggtgcagcagaccctggtggtggcggccagcatcaacttcaacgggctggcggcctacacggcggaccccgaccgcgcggagcgggtggagcggattggcgccgcgggcttcctgacggggacgcagttctccgccgtggcgctctatcaaaacgaggactcgggccggttctatgtgttcgcgggcacgtccacgggcgtgctccggcagtacgaactggccggggacacggggagcgtgacggccaccctggttcgcacgctcgccacgacggggcccatcgcgggtctggccgtggacgaggcgtcggactccctgttcgtcacccagcaggggcagggcctgtggcgctatccggcggcagcggacgcgggcgccaccggacagcagctctccatccagggctcgggcgggctctccgccaatgtgggccgggtcgcgctgtaccgcgcgcgcaatggcgaagggtacatcctggtcgcggacacgggcgcggatgcgttcgccgtctatgagcggcgcgcgaggaccctcgtgggctcgttccggctggcggacgaggatgggggcgtcatccgggcgaatgacccagtggccctcgccgtcaccgcgtcgtcgctgggtacgacgtatcccgacgggctcttcgtgggcagtgacgcgttctcgaacccgcagcgcttcctgtacgcgcgctggccggcggtcgccgaggccttcgaccccgcgctgcgaatcgacacgcggttcgattcggacggggggacggacgggggcacggacggtggcccgggggacggaggtggctccggtggtccggggcccgcgccaggtccgggcaatcgtcccgacgagtcgggctgctcgtgtgcttcggcctccgtgccggccaccgctgcgttcgcgttgctcgctttggtgcgggtggggcgtcgccgtcgcgactgaagcgcgttgccagcgggcgcgcgccgcgctgaagtgcgcgccctcatgcgtttctttcgactcatcgccctcgcgttggcgtgcggggccacctccgcgtgctccggcttctggacccgcggcgcgccgccggagcccatccacatcaccctggtgggcatcaacgacttccacggacaggtggagcctcatcgcacgccactgaaggacggccaggtggtggaggagggcggcgccgccacgctcgcggcctacgtggcgcggctgcgcgcggccaacccggggggcgtggttctgctggacgcgggcgacatgttccagggcacgttgccttccaacctcacggaaggggccgtcgtcatcgacgtgtacaaccacctgggagtggacgcggccgccattggcaaccacgagttcgactatggccctgtggggccgggttccatggcgcagcggcccggggatgatgcgctgggtgcgctcaaggcgcgcatcggccaggcgcgattccccatgttgtcggcgaacctccgcgacgcttccaccggcgcgcgccccgcctggacgggcaatgacggcacgtacctgatgaaggtcaagggcgtgaaggtgggcatcatcgggctctccacggaggacacccccaaggtcaccaatcccgccaacgtgtcgtccctgcgcttcctgcccctggcgcccgccgcgctggaagcgtcccgttccctgcgcgcgcgcggcgcggaggtggtggtggtggtggcgcatgcgggaggcaagtgcgcggacttgagcaacccccgcgacacgtcgagctgcgacgagggcgacgcggagattctgtcgatgctgaagcgcctgccgccaggcacggtcgacgccatcgtggcgggacacacccaccagacgatgggccacttcttcgcccaggtgcccatcatcgagacgacggggctggcgcgctccctgggcgtggtggagctgttcgtggacccggacagtcgccgcatcctgcccgaacgctcccgcatccaggccgccattcccctctgtgcgaaggtggacgccacccagggaacgtgtgacggccgccgcctgcggaacgagccccaggtgcgcctggagcccgcgtcgttcatggcggagccggtggtgcccgacgcgcaggtggcgccgctgctggcgccagcgctggagctggcacgggaggcgcagaatcgccagttggggctcgtggcggccacgcccctggcccgcggctacacggaggagggcgtgctgggcaatctggtggcggacgtgctgcgtgcgtcggccaatgcggacgtggggctgatgaacccgggcggcgtccgggccgacctggccgcggggccgctcaccttcggtcaggtgttcgaggtgctgcccttcgacaacacggtggccgtggccaccctgacgggccccgagctgtcgcggttgctgcacctggcctatggcaacgacatgggctccgtcttcgccgtctccggcctcgaggtgacgctggagcgctgcccggggcctgggcggctctcgggagtggccctcgccggcggtcagccgctcgtggtggactcccgcaagatgtaccgggtggccctcccggactttctggcgcgaggcggtgacgggcttgagcccctcttgagcaccgtgccaccggagcgcatcgagatgacccccgtcgacgggctcgacctgcgcgaagcgctcgtcgcctacgggaaagcccggggcggcacgctggaggcccccgacttgggacgtgtccgctacacgggtgtagcagggtgtcagcaagaggcgcgctgagagcgtcccggctgaaaattcggacgacggttgatccgctgggggtgaacgaaaggactcaccccaggggaaggacacagaaatcgcgccgggggccgatttttcggcctgggatcagtttccaacgggaagcggaggtcctactctagtccctgcgagtgtccactccgaggtggcccagggcctgcgtgggtggactcccgtgagctggaggaaccgacatgctctacaaagtgaccccgatgatggcgccgcctgcgcctgagaaggcgaagcagcgtgaaccggggcagggccagccgcgcaagcgtcgcaagtccgccgtctacgacgcggatggccaagaggtgctcatctcgctgatgtgcatcaagtgcaagacgctgaagccgctggcgcagttcggcctgcggaagatggcggatggcgccatccggaatcagccttggtgccgcacgtgtcgctcgggcgcgggcagcaagaagcccaaggcgggcaaggacgccgctgccgtcgcgccggtggaagaggcggccccggtgctccaggtcgtgccggccgccgcgagccccgaagcgggtgaatcccccgccgtgcctgtcgccgccgcgcagggctgagccgccgtcgccgtcccagctcccggggggctggaccttccaggtccaactcccgcgggagcattccttccagtcctacgacagccgcagaccggcggggagcgtatccccgagcgcgcgagcctcgtctgcggcttccagcgccacgacttcgcgcaccattcgcacccaggtctcggaggccttcgccgccagcagggcctgggccgtgcgctcgcgcaggtccgggtccagatcgcgagtgcggtctcccgtgagccgcgcgagctgcgccgccgcgaaggacgcgccgtcaatcttccgcaggtccaactccagcagcagcgtgagccaggcctcggccgtgtccacgtccaccaccttgtggctgctgccgtataggggcacgcgcgcgcccagccgccccagggaccaggcccacggtccgccggacttcgcctcggccttcagcctcgcggcaatccaccggcccagctccgccttgtcacccggttgcaggtgctccagcgaggccgccgtgcggaccatctcctccaggccctcgggctggatgcccttgagcttccccggcggcggcgcgtccggtggcaccttccgcgccaggtggggctggaggtacgcgtacagcttctgctgccgcgcctcgtccagtccgcccgcgatgcggcgccacatcacccagaactccgtccataccgccttgtccgtgtggtgctgcaccagcgcgtcgaacaggccgaaggtctgctccgcgcgccagccgtccagcgggtagccgaagcccggccgtaggctgaagccggtgaggctgtagaagacacgctcgtggtcctccgagcgccggcgcttgctcgcgcccgcgaagagggtgctccacatctcccgcagcaccgggacgcgccacgtctcacgcgagcccagggccttctccagcgtgcgcccgagctgcttcacgtccttggggccaatgggcagcggcttgttgccgtagacgcgctcgatgttgtccttcgcctcgacgaagcgcgcgggcatggactcggtgaccgtcagctcgtgcgagccgccggtgccgcgcagctcgaactccaggcgccaccgctcgtccgcgacgttggacacgcagtacagctccagggtgccaatctccgtcagcgccgcctggaggtgcacgggcacctccgccaccttgttggaggcgcccttgagcagcgtgtggatgggcggcagcggcttgaggtcctccgccagcggcaccaaatcgccgggcttgtcgatgcggtcgctggtggtggagtagagctggaactgcaccggccggcccagggtgagcgagaagggtcgctcgcccaggtcgaccttctggccttcctcgaagccgcgggggatgaggcacagcgcgggttgctcggcgctgtccgccgcgcgctgcatgcccacgtagtaggcacgcgcggcgccgccccaatgcgcagcccgtgaccgggccgcaccagcccgtagtactgggcgccccgggccaccgcgagctccagggactcgtcccgcagcaggggaatgcacggcgcgttcggccaccatgcggagaggacctccaccagccgctcggaaatctggggcgagttgaacacgcccccgttgagcaggatggcgtccgaccggggcagggcgccctccgctggcgccgtctcgcccagcgccgctaagcccgccaccgcgtgctgcgcgaggaaggccgccatgtgccgcgtcaccgccgcgtcctgcacgtagggcaggcccagctcctgaagcgccattcgcgcggcgcggcgtggcctgtcagcgggggtggtgagggggaagaagccgtccagcaccagcgcctgcgcctcgtcgcgcgtcagctccgtggacaacgtgccgcccagcagcttgctgccgccactcaccagcgacacgccgtgcttctccggcggggcgagaccgagcagcgcctccttcgcggtgcgcgcggcctggatggcctgcgtccactgcgtggcggacaggcggcggccgtccgtgaagagcttctcctccacccggcgcgcgagcgcggcgtccatgttgtcgccgcccagcatcaggtggtcgcccacggccagtcgccgcagcatggggccttcgggcgacaggcccgcatgcaccagcgtgaagtccgtggtgccgccgcccacgtccaccaccagcaccagccggacgttggagagcgtctgctccaggtccgcccggtggcgcgcggtgtagtcgtagaaggccgcttggggctcctccaggagggtgaacttctccaggccggccttgcgcgccgcgctcaccgtgagggcgcgggccgcttcgtcgaaggaggcggggacggtaatcaccacctcctgcttcgacaggggcgcgtccgggtgcgcgtaatcccatgcgcgagccatgtgcgtcagcagcagggcgctggcgtccaccggggacagcttctggacgtccgcgggcgcaccccaggggaggatgggtgcggagcggtccacgcccgggtggcacagccagctcttggcgctggctaccagccgccccggcacgcgcgcgccctgccagcgggccagctcacccaccacccacgggccgccgtcatccccccagggcagcgtgagcgaaccctccgccagctcgtggccggcgggcacgtacacggtggagggcaacagggcccgcggggccacctcgccctgacggacgagctgcggaagggcgaagtcctccacgggggcacccgcgccccgcgaggggtccacggatgccacggcgcaatgggtggtgcccaggtcgatgccaacgattcgcatacgcctccgattgacggatggctttctactccttcatgcggacgttgagttccagcttccagcgcccggggccatccttctccaggcaccggagctccagcgtccccacctccgtcaccgccgcctggaggttgacgggcgtcaggtcgctgaagacggagggctgaccgggcatggtcgtctcgatgggagccagctcctccagcccgccgctggccagctcggtgtcgacgtcctccagcatgacgcccaccttgtcgtcgcgccgcagggaagaggagaagaagcggaagcgggtgggctcaccggtgacgagcccgaactcctggggcgggacgtccgcctgcgtgccttcctccatgccgaagggggccacgcagagcgccttcacgggcggctccatgccgggcaccgcgggcatcgccgtctccacgcccacgtagtaggcgcgggccgtgccgccgcggatgcgcaggccgtggccctggcgcacccaaccataataggcggcgccgcgcgccaccgcgaggtccaggtccgcgccctccagcgcctcggcgggcgctccgccatccgccgtgagccagccgttgatcacctccatgacgcgcgccttcagcgggccggccttgaagacgccgccgttgaagagcaccgccgtggggtggaggaaggccttgccgctgacgtccaccggcgcgtccgggctggacgcgagcgcctgcgcctgccgggtgaggaaggcggccaggtgacgggataccccggcgtcctgggcgtagggcagcgccatctgcgccaggccggtgcggcgcgcggtgcgcggcagctcggtgacgggcgtcacggggaagaagccgtcggtgaggacgcggtccagctcctcgcgcgtcagctccgtgcgcagcgtgccgccgatgagcgacgacccccggccggggatggagatgggtgcgcgctccatggacgggtcggcgtagagcgcctccttcgcctggcggcagccatgggtgagggcgttgaattgccaggcgtccagcttcttgccctcggccgccatgcgctggttcagcgtgtgcgccagcgccaggtccatgttgtcgccgcccagcaggatgtggtcgcccacggccacgcggagcagctccaggtcaccggcgtttgcccgcacggtgatg

SEQ ID NO: 1001 - DNA, 8310 bp, Myxococcus xanthus
cggtgggcatgggcctgcggctggagcacatggacccgggtgctcacccagcagttcgtccgcttcgtgccccggggtctcggttttccggctccaggttcgccgcgcgcctcaggtttctgagaggcgaggacgcccgcagcgggtggcggggcctgggtttcccagggggccagtgccctggcacgccggtggcagatgtcccggccgccgctggcgtggcaccggggaggccggggggccgtcagtggggccgaagtgcaacgggagggtcgaatgcggcagtggaaacgctggagttgggccggagtggtggctgtcgtcgcggtgggatgtgacgaaggcaacaagccgttgtccccggtcgacaacgagcccgtgcagcaggaggcccggctggagagcttccctggctgtgaggccctggagcagcacatcgaggacacggcgacgaagcagatgcgcgcggcgctggagagctacaagcagtacgcctacggaggcggccatggggatgggggcgcggcgccgcccatgacgggcgcgccgcaggaggactcctccggaggcggcggcaggcccaacgactacacgggcacgaacaaccaggtcgccggcgtgcacgaggccgacttcgtgcagaacgacggcacgcgcatcttcgtgctgtcgggcccccggctctacatccaccgttcgtggcccgcggagcagctcacgcggacggccgtgctggaggtggagggttggccgcgcgagatgctgctcgacgccgagcgcaaccggctggtcatcacctcggaagtagccgaggaccgccccgggacggtggcggggggccgcggcacggacgacatgccagtcgtcgactgcgccggcttcggttgtggccatgcgtacagcaacaccgtgaaggtgacggtggtggacgtggcggacctggaggcgcctcgggtgctggagcaggtctacctgcccggcggctacatcagcgcccggcgcgtggacagcgcggtgcggctggtgttctcggacgggttccgctggccggcggatgtgcgcttctatcccgagtactcgccggggttcttcggtgaccggtcccggctggtcgcgtccatcgacgcgctcatcaagcagaacgagcagcgcatccgcgcgcagtcgctggaggattggctgccgaagggccggcgcgtggcggcggacggcgaggtgaagccgctcgcgtatgactgcacgtcgttctaccgcgccaacgggcccaccgggctgggcctggtgtcggtgctgtcgctgaacctggacgcggaggattcgtcgcccagccagaccagcgtggtgggcacgcccggcgaggtgtacgcgtcccatgaggcgctctacgtggcgtctcgccactggtggtggtggccggagcccggccagacgacgcacacgtacctccacaagttcgacatccgcgacccggaccaggccacctacgtgggcagcggcacggtggagggatacatcgtcaaccagttcgccatggacgagcgcgagggcgtgctgcgggtggccaccaccgtggagctcccaccggagaacccggggaccgggaacggcggggacaccgtgtggacgcctccggagacggtcaaccgcgtggtgacgctgcatacgagggacgggcacctgaaggagctgggccgcagcgaggacctggcccggggtgagcgcatcttcagcgcgcgcttcatgggcacgcgaggctacgtcgtcaccttccggcaggtggacccgctcttcaccttcgacctgagcgacccggcgaacccgcgcaaggtgggcgagctgaagattccgggcttctccacgtacatccacccgctgggtgacacgcacctgctcaccttcggcgagcaccgcaacgaggacggcacctggcaggaccgcgccctcaagctgtcgctcttcgacgtgagtgacctggcgcagccccgggagaccttcacgcaccagctgggctcgatgggcagccacagcgaggcgctctacgagcacaaggccttcacctacttccccgccaagggattgctggccctgcccttcacggactgggactacaacgcctacgactactggtccggcttccgcagcgagctgcgcgtcttccgcgtggacacggccacgggcttctcgccagtgggcaccgtctccatgcgggacatgtaccagtcgttcaacttccggaactggagctggtactggcagccgacggtgcgccgcagcatcatggcggacgactacgtctacaccatctccgacgcggggctgcgcgtgtcccacgtggacagccttcagacaccgctggtcaccgcgcccttccatccgcccatgctgccgtagcgcgggcttgccccctgggacgccgggtgtcccagggggacgtatcacgggtgtgtgacctggccttcctgtcaggcgaggggggcgtggcacgtcggacgtgggcagcgcattccctgccggaaggcgctataggcgcactccccatgtccaccgccgtgttgccaacgtcctccgtgaattctccccgcaccgagctccgggcgctggcccggcttgcggttcccatcgccatcgcccagggcgggcaggcgctcatggggttggtggatacgctggtggtgggccgcgcggggacatccgcgctggcggcggtgggcctgggcaacggcctctacttcgcggtcagctccttcggcatgggcttgatgatggggttcgaccccatgatttcccaggccattggcgcacggcagttcacccgggcgcgggcgctgttgtggcagggcgcgtggatggcgttctgcgcgggggtgatgctggccacgctgatggcgctggcgccgcggctgctgccgctggcgggcatcagtgagacggaggccgcgggagccagccagtacctgatgtggcgcgcacccggcatgccgatgatgctgatgttcctcaccatgcgctcctatctccaggccaccgccttcacgcggccgctggtgatcgcgacggtggtggccaacatcttcaacctgctgggcaacctggtgctcgtcttcggtggcgccaatctgccggcctggttcggcccgctgcggtcggtgccggcgctgggtgtggcgggctccgcgatggcgacgtcggcgagcatcggcatcgagctcctcatcgcggtgctgttcattcgcagccggaaggtggaaggggcgcgtgccagtcgtctgccggtgtgggcggacctctcgcgcgccatccggctgggcctccccattggtctgcacatctgcgcggaggtcggcgtgttcgcgctggcgggcgtgctggcggcggggctggggccggcgagcgtgggcgcgcaccagattgccatctccttcgcgagcgtctccttcaccgtggccatgggcattggcaacgcgggcagcgtgcgggtgggctgggcggtgggcgcgcacaacacgccgcaggcgcggctcagcggcttcatggccctggcgggcggcgcgggcttcatggcgctgagcggcctggtgttcgcgctgttccctcacacgctggcgaagctggcgggggcgcccgcggacgtgctgccgctcctgattccgctgctgatggtgagcgccatcttccaggtgttcgacggggcgcagggcgtgggcgcgggcgtgctgcgcggcgcgggcgacacgcgcttcaccttcctggcgaacatggtggggcactacgccattggtctgccggtgacgctgctgctggccttcaagctgggcctgggcgtggtgggcatctggtggggcctgtgcgcgggcctcatcagcgtggcggtggcgctggtgtggcgcttcaaccggatgagcgcgggcacgctgcgtccggtcgaagcgtagcggcgcgcggcggctaccagggcaggtactgctgaatcatctgccgccacacgggccagtcgtgcgtgccgccctgccacacggccaggtggttgccgatgtccttcttccaaagcaggttggagaggtgctcgttggaggggcggcagaagtcgtgctcccccaccgccagcaccatctccacacgctggagggcggagagctgcgcggggtccgtgaggttcggcagccactctgtgcacgaatggaagtagacgtccgcgtcgtggtgtccgtcgaggaactcgttcgtctcgaacttgccgcccatggacagcaggcgccggaagacgtgcgggtgccgcaggccgacgttgtacgcgtggaagccgccgaagctgcacccggccagggtgaggcgcccgccggtgctgcggctcttgagcaggggcaccacctcgtggaggaggtactcctcccactgctggtggcgccggacgcggtccgccgggtggatggcggtgttgaaccaggactcctcgtccactgagtccgggcacaccacgatgtaccggccggactggacgcggtcggcgatggcgccgatgaggccgaagtcctcggcctggaagaagcggcccttgctggtcggcagcaggagcaccggctcgcccgagtggccgaagatgagcagctccatgtcgcggtgcagtcgctcgctgtaccagcggtggtattcgcggttcatggcgcgcaatttaatcgcaatgcgtcaaaggccgcgactggagtgcgatggccgcccgccggactgccgggagtgaacacctgggcggatgtctgactttgccgagtcggcggttacccgcctgggtatccgttgtggctcccactgacggtgtcgagctttgaacgcgaggcgtccaggccaatggtgcgcgtgcattgccagggcaaggtgacggcgcagcggcgctgagcgcttcatcgtttggcacgtcgtggtggattcagccgtctggcacccatgggttgctgcctgtgtggccagaagcctgcccgcattcctcgtgcttgggcataccaccccagggggagcgcgcgttccgggctttcgtaggacaagtcatcttgtgccggtcaccagacggaaacgagaatgcatgcgcacgtgctcgcttgtgcggccagacacgtgggcggtggggggagtgccatgaagaaggacctcgggcttccggagcagcccgccgtgccacgcgtggtcacggcggagccattggctcacgttgcagaagacggccgggctcatctgctgcgcgagcacttggaggccgtggggcagtgggccgcgatgctggcgccgcgagaggatttgcgtgcgccggccctggtcaccgggcgctggcatgacctgggcaagtacacccgggacttccagatacgcatccgcaaggagaacggcttcgaggctcacttggagaaagagggggcgctggagcgagaccactcgacggccggtgcgctctggtcgctgagccgggaccggcatctgatgccgctggcattcgcgatagccgggcaccactcaggcttgcccgacgcgtcgaacctccggaaccgcgtggggcgcacggagaagcaggcgttgctctccgatgcgcgggctcgttgtgacgcacccgctttgctggacggaccgttgggcttctctccggaggcgctcgacaagctcgaaccacggcaagtggagctctggacgcggatgctcttctccgtcctctgtgacgcggacttcctggacaccgaagccttcttcgatgcgaacaggagcgcggcccgcgaggtgccggtgtcgttgtcgcagctcgccgagcgtctccgcggcttcctgcgggagaagcagcgtagggccccggacacggaggtgaaccgggtgcgccgcgaggtgctcaccgccgccgtggaggccgcggtgcagcgccccggtgtcttcagcctcacggtacccacggggggagggaagacgctgacgtccatggccttcgcgctcgaacatgcgcggacgcaggggcttcagcgcgtcatcgtcgccatcccctacacctccatcatcgagcagagcgcggaggcgtaccgccaggccttccaggggctggagcacgccgtcatcgagcaccactccgctgtcgacccggaccgggagacgccgctcaaccgcgtggccagtgagaactgggacgcgcccatcatcgttaccaccacggtgcagcttctggagagcctcttcgcccgccgcccgtcggcgtgccgcaagctgcaccgcgtggcccggagcgtcatcgtgctcgacgaggcacagacgctgcccgcctcgctcctggagcccatcctggatggcttgggcgcgttggtgagggactacggctgctccgtggtcatctgtaccgccacgcagccggcgctgggacgccgcccggacttccaggagggcctgccggaggtgcgtgaaatcgtcccggcctcggtgcgcgccttcgagcggctacgccgtgtgcgcgtgcgctggccctcgtcagggcggaagctcccctatgccgagctggccgacgccgtggcggccgagcgggacgtgctcgcggtggtccacttgcgggccgacgcgcggcggctctgcgaactcgtggatgaacggctggggcatgaagagacgctgcacctgtccgcgttgatgtgcccggagcatcgctcccaggtgctcgcggacatcaaggcccgaaaacgaagaagggagcctgtgcggttggtggccacccaactcgtcgaggcgggcgtggacctggacttcggcgtcgtctaccgaggactgggaggcctggacgcgctggctcaggccgctggccggtgcaaccgggaggggctgatggagggcctgggcgagctgcgcgtctatgagcctgagacgcagccacccaggggcgttcctcgcgccgcccaggacgtcacacgcggcctgctggagcagtcaccggacctggacttgttcgcgcccgagagcttccagcgctacttcgccaggctctacgccacgcgccaccgggatgagaagggtattcaggcgctgcgcgcgaagttccagttcgaagaggtgtccaaggcgttcaagctcgtcgaggacgactggagcgcttcggtggtggtgccctacgtgggccatgcgccgctggtgaatgcgctgcgtgagcgaggcccttcgcgagagcggctgcgcgcgctgcaacgcttcacggtgacggtgccccgcaagctccgggacgactggctggcgcgcgagctggcgcggctcgctgccgagacggtggcgtacctggggccggagcacacgtccgcgtaccacaagcgcttcggcctgcttccggaccacgtcggcatcttcgacccgtccttcctcattcccgcttgagacccgcttcaagaggtgtggatgacatcaacgccaggcagaagttttcgcgtgagggcgcggggacccgtggcctgtttcacgcggcccgagatgaaggccgagcgcgtcagctacgaggtgatgacgccctcagcggcacgtggggtgctggaggccatcctgtggaagccggccattcgttggcacgtccacgaaatcgccgtgctcgcgccggtgcggtggaccagcttccgccgtaacgaggtcaacagccgggccactgtggggaagttcgactacgcggcggacgaggaccgggcccagcgcaacacggtggcgctgcgagacgtggactacgtcatcaccgcgtccttcgccctggtgccgggcaaggcggggcccgatgacaacgtgcgcaagttcgaggacatgttcgagcggcgtctggagcgaggccagttcttccatgcgccctacctgggatgccgtgagttcgcggcgcgcgtcgagcccgcggaggacgtcctgttgccgcatgagtcaggccaggggcggaggccgctgggcctcatgttctacgacttcgtcttcgacattcctggagagccggtgcgccctgagttcttccaggcgttcctggaggacggcgtgctgcgtgtgccgcctcgggcgcaggtgctggggggaggcgttccatgatgctgacggcgctgaatgacttcgcgcgcgagcgagggctcacggatgaccctctgtacgaggtcaagcccgtggacttcttcattcgcatcagcgcgaaggggaagttcatcaagctggagtccctggcgagggaagacgggagaggcaatgcgatgccaatccccaggttgccgcagcgctcggtgaacatcgcggcgggcttcttcgcggacaactcgaagtacgtcctcgcctacgagactttagagcacg

SEQ ID NO: 1002 - DNA, 9567 bp, Myxococcus xanthus
cgctctacagcggaggcggcatgcgattggtgaggacgtggagcacggggctcgccgttctgctcctcgcgggctgccgctcgcagggagacccggggccgcagggaggccaagcggccacgaaccagcccatgccggtggaggtggagcgcctggcccccgccgaggtgcgcgagtccaacgagtacctgggcgcgctcatctcccgcagcagcatcaccgtctatccgcaggtcgctggctacgtgaagtcgattccgctcaagccgggagcacgcgtcgaacagggggaagtgctgctcgtggtggacccccggcgagaaagcgcgggcctgcgcgccacccaggcgcagcaagccgccgccatggcgcagcgagagtacgcccaacagacgcgcaagcgcagtgcgcaactgctgaaggagggactccagagccgccaggaccatgaccaggcggtggcgcaggcagtgcaagccgaggccagcgcgcgtgccatcgaagcccaggtgcaggcccaggaggtccagctcggattctacgaagtgagcgcgcccttcgccggcatcgtgggcgactacccggtgaacgtgggcgacttcgtgacgcagcagacggccctcaccacactggaccagagcaacacgctggagctgtccgtccagattcccgtcgagcgggcaggcaccgtccgggtgggcaccacgcccgtggaggtgttggacccggagggccggctcgtggtgtccgcgccggtgttcttcgtggcgcccacgcccaacgccaccacgcagttggtggagatacgcggcgccttcgagaacaccgtgggcctgcgcgcgggacagttcgtacgcgcccgggtcgtctatgccacgcgggaagccttgcgcgtcccgacctccgccgtcacccgcatcagcagccagtccttcgtcttcgtggttcgggactcggacgctggcaccgtggcgcagcgggcgccggtgagcctgggactcgtctccggcaatgactacgaggtgacgggcggactggacgcgggcacgcccgtggtgctcagcggcatccagatgctccgcgatggccagcccatccaacccaaggccccctcgcgcaagccacctcctggcgtaggcggcagcgggaccgacggcggcaccccgccggaacagtgaggggccgccatgttcaccgacttcttcatccgccgtcccgtcttcgccagcgtggtgtccatcatcatcaccctggtgggggccatctccatccccatcctgcccatcgagcaataccctgacctgtcgctgcccgtggtgcaggtgacggcgacgtacatcggcgcctccgcggagaccgtggagagcgccgtcaccaccgtgctggagcggcagctcaacggcgtggagggcatgcgttacatctcctccaccagcagcaacacgggcgtgagcaccatcaccgtcaccttcgacccgggacgggacttggacatcgccgcggtggacgtccagaaccgcgtggccaccgcgtccgcgcagctcccggccgccgtcaacgcgctgggcgtcaccatcaccaaggcccagacgcagctgctcatggccttcggcctgttcgacgaggagaaccgttacgagacgggcttcctcagcaactacgcggatgtcttcatccgggacgcgctgctgcgcgtgacgggcgtgggcgacgtgcggatattcggcgagcggcgcttcgccatgcggctgtggctggacccctctgagctggcacggcgtgggctcgccgccacggacgtggtgaacgccctgcgcgcgcagaacgttcaaatcggcgcgggacaggtaggacagccgccagcgccgccgggccagacgtaccagttcacggtgcgcgtgctggggcagctcacgtccgcggaggagttcggcaacatcgtggtgcagcaggggccggacggctcgctggtgcggctgaaggacgtgggccgcgcggagctgggcgcggagaactacggacagctcttgcgcttcaacggccgcgaggccgtgggcctgggcatcttccaactccccggctccaacgcgctggacgtgcgcgacggcatcgtcgccgagctgaagcggctgaagggcaacttcccgccgggcatgcgctaccagcgcgccttcgacaccacggcggcggtgcaggcatccatcgaggaggtgctggtgacgctgggtgaggccatcttcctggtggtgctggtcatcttcatcttcctgcacggctggcgcagcgtgctggtggtggccaccacgctacccgtgtcgctggtgggtaccttcctcttcgtcaacgcgttcggcttctccatcaacacgctgacgctcttcggcctcacgctggccacgggcctggtggtggatgacgccatcatcgtcatcgagaacgtcgagcgcaccatggagcaggacgacgtgggccctcgcgaggccacccaccggggaatgaagcaggtcgccggcgcgctggtggccattgccctggtgctgtccgcggtgttcgtgccggtgtccttcttccccggcaccaccggcatcatctaccggcagttcgccctcaccctggccttctccatcagcctgtccgcgctggtggcgctcaccctgtcccccgcgctgtgcgccatcctgctgcggccccacgaaggccagaagtggaaggtcttccgcatgttcgaccgggggctcgacgcgttccgagacgcctacggccggatgttggcgaagctcatcggaccgctgcgctggccggtggtcatcgccttcgtcgtgtgtctggccggcaccatcctggtgtaccgcctcacgcccacgggcttcatcccgggcgaggaccagggctacctcatcatcgccgtgcagggaccggagggcacgtcgctggactacacgcgcaatgtgctgctccaggcggaggacgtgctgcgccagcagccggaggtcgcggacatcttcaccgtgggcggcttctcgctgctgggcacgggcgtcaactacggcaccctcttcgtcaacctgcacccgtgggacgagcgcaagcggccggaccagagcgtggcgggactggtggagcgcctgcgacacccgctgatggccattggcggcgcgcgcgtgttgcccttcgagccccccgccatccgcggcgtgggcagcgtgggcggcttcgagttcgtgctggaggaccagcaaggcggtcgaacgctcgctcagctcgcgcagacgacggacatgctggtgggcgcggccagccaggacccgggcctccgcggcgtcttctcttcctacaccgccaacacgccactcctggacgtgcaggtggaccgggagaaggccctggcaatgggcgtcccgctggatggcgtcttctccacgctgcaagtctacctgggcagccagtacgtgaatgacttcaccttcgccagccgcgtgtaccgcgtgtacgtgcaggccgccgtcccgttccgcaacgagccgcgcgacatcgacgcgctctacgtccgctccgcgaagggagagatggtgccgctggagtcactggtgcaggtgcggcccatcaccagcgcgcagaacatccagcactacaacctgtaccgctcggcgaccatcaacgggcaggccgcgccgggctccagctccgggcaggccctggacacgatggaggcggtggcgcgcaagacgttgcccgtgggctacaccttcgaatggacgggtttgtcccaggagcagaaggaggcgggccgcagcgtgctgctcatcttcgggctgggcgtcgtcttcgtcttcctggtgctgtccgcgcagtacgagagcttcgccctgcccctggtcatcctcctgggcgtccccgtggccatgctgggcgcgctggggctgcagaatttgcgcggcctccagaacgacgtgttctgccaggtcgggctcgtcatgctggtgggtctggccagcaagaacgccatcctcatcgtcgagttcgccgagcagctccgccacgaaggccggagcgtcgaggacgccgccatccacgccgcccagacgcgcctgcggcccatcctgatgacgtccttcgcgttcctcatgggcgtggtgccgctgatgctggcctcgggggcgggggcctccgcgcgcaagtccctgggcaccaccgtgttcggcggcatgctgctgtccaccttcgtgaacctcatcttcatccccgtgctgtacgtggtgctggaggccgccaggctccgcgtccgcccaccgaagccccacgcaccctgagtgctggcctgggacctgggggccccctggatgccccgccggaggggcttcgttatcctgcgggttgccatgtctcacttcccgtcacgcgatgaccggcggcgccagcggctctatgcgctcaaacgtgcgcccgggctccggcaccatggcaacaccgcgctgctccaactgctgggcaagggccaggacgtgtcctgggctcgcggcgaggtgctgtgccgggaaggcgagccccccgagggcttctccctcctcctggagggcgagttggaggtcatgcgcggtgacgtgctcctgatgacgctccagcccggcacgcccctgggactggaggcgctgtcgagcggtagcaacgccttcaccatcctggcggcgacggactccgagggcctcttctttccgaaggacgctgtcgcgagcctgctgcacgcgcccaccggtatgcaggagcagccccgtccgccagcggaggtcatcgccttcgagagcgacgtgcgcggcgcgcccctgtcctccctcatcgagctggtggcgaaggtcatccaccgtgactttggcgaccgcgtgctgctgctccggagcgcacccggcgggcatgacgcgcccgtcacgaagggggcggatggcgtcctgcgcgccacgctgcctccagcggaagctggcggtcccggtctgctgaccccatcggtgctccaacggctcacggccgagcacggcctccactacgtcctgctcgacggctgccgcgtggcggacatcgggatgccggggaagacggcgcggctggtgacgacattggacgcgcggaaggcgtcggcccctcgcgtgcttcccaccgtggtggtggagcctggccgtgcgtcacgcgcatcggagttgagtggcaagtccctgcatccccagtggcttccgccctgccccttgcggttgagcctggacaggatggcgcgggtgctcgtggatgaccgtccgctggacgccacggtgctgagccccgccgagcgggacgcactctcccgctgggcccgagccctcacccaccgtcgcgtgggcctggcgctcagtggcggtggcgtgtggggcttctaccatgtccacatcctgcgctggctggtgagccagggcgtgcccatcgacatcgtcagcggcgccagcatgggctcgctggtgggcgcgtacttctgcggcagcgcgctggatgggcacgacggtctggaaggactgcgacggctggaggagcgggccatgagccggcagctcaccctggccgccacggccgccatcgtgaccacgtattcgctggaacgcttcgtggagcaggacctgggccggctctgcctggaggaactggccatccgcttcctgcctgtcacgacggacctgaccagcggagactgcgtggcgctggagcaggggccggtggccctggcggtgcgcgccagcggctcggcgccgggtatctggggccccacggtggtgcctcccgcgcggtacgtggacggcgccttcaccagcatggtgcccgcgcacgtgctgttgaacgcgggcgcggacgtcatcttctccagcaacatcttccccttcggcgtccggcatgcgtccccgcggcggcagtccggcctggggcgcttcctggcgggactcaatccggtggcccgcgcgctggacctggctgccagtggcgtgctgctattgcaccgcagtggtgacgtggagagcctgctcgcggacgtccgctacgacatccaatccgcggaggcaccgctgctgaccgccatggagttcaccaaggcccgggacatcctcggacgggcggcggcggatgcgtcgctcgcgaagcggctggaggagatgaagcagcactggctccaggtcaaagcccggggtgtccgtgcccacgcgcatccaggaggacagcaagccgcatgattcccgttcgcatcctgggcacagccagtgtccttcccggccccgccgtgacgaccgcggagctgtgcgcgcgcgtgggacgaaacgccgcggaggtggcacggaagacaggcatcctcacccgccacttcgcaccaccggggacgaaggccgcggacgtggcggcgcaggcgctgcggggcgcgctggacgcggcgggactggaggcccgagccctgcgccgaatcctctgcgtcacctccatgggcggcgacgtcaccacgcccgccaccgccaaccgcgtggcagcggcgctgggcctgtcgggaagttgcgacgcgatggacctgagcaacgcctgcatgggcttcctgagcgccttcgacctggcggcgcgctcggtggccacggggctggggccggtgggcatcgtgtccgtggagctgctgtcgcgcaccaccacgcccgaggagccccgcccctacctggtgctgggcgacgccgccgccgccgccgtgatgggcgcgggccgttcgggagaaggcgtcctgggcgtggccctgggcaatgacggcacgctgcccacggacgtcgtgctggagaacccgacggccaccggcaagctggagcggatgcgcttcctgacgcccagccaggagatgacccgcgtcgcgctggacgcgctggtacgggcggcgcgcgcggcgttggacgaggccggcgtgacccttcacgacgtcgagtgggtgctcacgcaccagccgaacggcagcatgttggaggccatcctccaggcgctggaggtgtcaccggaacggagcgtgcgcgtggtggacacggtgggcagcgtgggctcggcctcgctgggcaccagcctggaccggctgctgcgcacgcgtccagtgaagccagggcaccgcatcctcctggtgggcgtgggcgcgggcgtggcccacggcgcggtgctgtaccaggtgggcggatgaaacaggcaggcggctggcccctgagggcctggctgacagcgttccggctgctgcgccggtatcaccgctacgaggtggtgaacctggagccgctgctccgccccggcgcgaagctcatcgtcggttaccacgggcgccccctggccgtggacctgtgcatgctgacggtgacgctccacgaacgcctgggctatctgccgcacggcgtggcgcacggcgcgttcgattcgattccgggcatgcgcgcggtggcggacgggctgggcttcgtcacgggggatgacccgcggctggccgaggcggtggcgcgcggcgaacacgtgttgttgcagccaggaggcacgcgtgagggctgccgtgacttccgccaccgctaccgcgtcgactggggcgagcgcatgggctacctgcgcctggcagtgcgctaccggctgccgattgtccccgtgggcggctgcggcatggacgacgcgtacgtgggcctcaacgacgggtacgcgctgggccggcgggtgggcatgcccgcgcggctgccgctgtggctgggcgtgggtgccacgggcctgtggcccttgtcgcttcccttccccgtgaagatgacgcagtgggtgggcgagccgctgacgcgccacctggagccaggcttcgacgcgggcaaccgggacgcgatgcgcgcggtgcatcaggaagtggcggacgcggtgcagcggctgctcgacaaggctcgcgacgtggacaagggcagcagacggaaggcagtgcaatgagggaaggtgagggttccgaggcgcgggagtgggcgctcatcctgggagcttcgtctggcacgggcgcggccatcgcggaggcggtgactcgaaagcccgggttgaatgtctttggtgtccaccggggccggtacgcggaaggtgccgtgcagttggagcagcggattcgggacgccggtggacgcggtgtgctgtggcaggcggatgcgtcttcaccggaggccgcggaggcgggcgtggcggcgctgcgggaggtcgccgggcctcggagcgtgaagctcttcgtgcattcgattgcgggtgcctcggtggggcgattcctgtccgagggcgaggaccggctgcacgcgcggcgcatccgccggaccttcgacacgatggcgcactcgttcgtcttctgggtgcaggccctggtgaatgaagacatgttggcgccggaggcccggcttctcggtctgcagaatccgctggatgagacgcacctggggaacacagggctcatcagcgcgtcgaaggcggcgctggagatgtacgtgcgctacctggccatggagctgggaccgcgaggacaccgcgtcaacctgctgaagttcggcacggtgatgacgcccgcgctaaagcacgtgtactcgcccggggccctggcccgcctggaggcggcccacgcgaggatgaatcccgcgggacgcatgggcaccgtggaggacgtggcccgcttcgtcacggtgctcgccggtgaggaggcgggctggttcaacggagccaccatcgacttcaccggtgggatgacgctgcggctgttggacctggtgctgaatccgtgaacgtgacctgtcagcgcaagcgctatgtcgtgcgctcgctcagaacgggcgtttcttcgcagcgggggctttctcgattccgcgtgccagtagctcctgctcgaatcgtggctcccatccgggttggtggtaaagccgcgcctccgcgagcgagcgaaccttgaggtcgtcagcgcactcgacgttctcttgcctcagtactttgtcgatatcgcggttgcggtagacataggtcgcgttccccgtcttggagaactcaaccaccgagtactcatcgaagcgcagacaaaatgcgctcacatcgtacctggaaaagcgcttcgctctcctgaaagcagcctgctgctcagagggaagcgttcgcacctcccggagcaaagcatcgtaggcatccggagccagccaacaggtcgtcgacctaatggagcccaggtagcgcagccagaagacatggcggtcccgctcgtgcatggccttctcaaagaagaactcaaggtcctgctggatgagcgccgacaggaacgcctcgaaagcctgttttgagcgaccgcgaaccgcgctccacgcctcagtcaagatggagatccgagggtccccgaagacgctgtccttcgcgatgaggcgctcctcgacgcgggactgcgcatccttgtggacccgcccgtgcgcgcgacactccagtatcgccgcgatgacggcgacacgcgcctccagcggagcaccgatgacgctccggtcagcgctcgcgctcggaagccacgcccgtcct

SEQ ID NO: 1003 - DNA, 13434 bp, Myxococcus xanthus
tgcggacctgtctcctccttccccttctcttcatatccggctgcgcgctggagcccggtgagagcttcgcggtgctggagcccgccgtccgcgcggactacacgccggtagccgggcgcgacgagggcaacggcttccagcgtctcgcctccgacttcgagcttcgcctggacggcgccgcgctgggcgtggaccacatcgacctggtgggcggcggtggcacccgcggccccaccaccttcgacccggccaacccgccgcccggctacaccaactgccacaacggccactgccaccacgacgatggcgcgctggtggactacgaggacatccaggcggagctggatggcggtggtggcggcgcggaggccacggtggccagcctgcacgtggacgcggacctggacctgctggcggaccagacgctgtcgcccgactgcgagccgtcctgcgagctgggccgcacccacgtcagccgctaccagtgggacgtgtcatcggtaatgctggaaggcgcggtacgcgacagccgcgccacgccgcgcttcaacgatgagcgccgcttccggctcgcgttggcggcggcggaggaggccacgccgctgatggtgctgcgcggcacggtggacatccccgcggaccgcgagaacaagccgcgcgtgaagctcgccctgcgcctggcgctgacgcccacactgttcgactcgctggattgggcggccaccacgccgggtcccgacggcgtggtggacctgaacgcacccgagaacgccgccatccggaccgcgatggtggaagcactggccaccttggagccacaggcggaggtccggcgtgaagaccgttgagcccacgaacggcgcgcacgcggtgcccgccaccttcgcgccgggtgacgcgttgctcacctgcgagaagctcgtcatcggttacgacagcaaggccatcctgccgcccatcgacctgaccattcgccgcggccagttcgtggcggtggtgggccgcaacggctccggcaagagcacctggttccggacgctgctgggcatgcagccgccggtgtcgggcaccatctcccgcgcctccgcgcaggtgcgcagtgcctatgtgccgcagacgtccgccatcgactcgctgctgccactgcgcgcgggcgagctgacggcgtggggacgcctgcgcggctggagcttcctgtggcccttcgcccggaaggcggaccgacaggccgtgcagagcgcgctggagacggccggcgcgaaggccttcgcatcgaggccctaccgcgagctgtccgagggccagaagcagcgcacgctgctggcgcggctggtggccaccgaggcggacctggtgctcctggacgagcccaccgccgccatggacgccgtcgccgagcacgagacgatgcagcgactgtgcacgctgtcgcgtgagcggggcctgggcgtggtggtggtgtgccacgacctggaggtcgccgccgagcacgcggacgtgctcgtcttcgtggaccgcgagacgtccgccttcgtcgtgggcgatgcccgcaccgtcttttgtcaccccgccttccgccgccagtacggcgacgagtactgccaacgcgcgcccctgggacctcaccgtggaaacgacgctcgctgaaccatccaagtgggagcagttccacctggcgttcgatttgttcagggacccgctgctgtgcgcgctcatcgcgggcggcgtactgggcttcctgagcgtgtacgtggtgctgcggcgcatggtgttcgtcagcgccgcggtggcccaatccgcgggcctgggcgtggcgctggccttctacgcggccatccacctgggcacgcacgtggagcccgtgctgggcgccaccaccctggcgctgttggccaccatgttgctgatgacggagccggcgaagctgcgcctcacgcgggagagcctgctgggtctggcctatgcgctggcgggcggcgccgcggtgctcgtgggagaccgcatcgcgcaggaggcgcacgacatccagagcatcctcttcggcacggcggtgctggtgacgcccgagcagctctacacggtggccatcgctggcggggccatcatgttcatccacctgtggtggtaccggggcatcaccttcgccagcttcgaccggacgggagcgctggtgcaggggctgccggtgcgcctcctggacggcgtgctgatggtcagcatcggcgtcatggtgggcgtgtgcgcccgggcgctgggcgcgctgccggtgttcgccttctccacgctgtccgccatcgccgcgctgatgttggagctgcggctgccgtggaccttcttcgtcgccacgctcttcggcgccatcgcgggcgtgggcggctatctcttcgcgttcttctacgacttccccgtgggcggctcgcagacggtgttcgccgcggccatggtggccgtggcgaccgtcctgcgaatgctcgtccacgcggtacagaaggcgcgctgagggtcagcggaccgccgcggagacctgcttgaactcgggcgtgccggcgcgcccgagcaggtcgaacagcgcggcctccaccgtgacgacgtgcgcgcccgcgtcacggcacaactggaggcccacctgccggtcctcctgcgcgcgcgacagcacggcgtccgtaagcaggaacggggacagaccgcgttcggccaggtcgcgcaccgtctggaagacgcagatgtgcgtctccatgcccgccaccagcacctgcgtgcgcccgccgagcgcggccagcacgtctggcacggcggcgctgaactccagcttctccaccgccttgacgtccttcagcacccgcatccgcagcagcgaatgcgtgggccccaggccctgggggtactgctcggtgaggaggatggggagccccagcgcgcgagcgccctcgatggcggcggtggtgcggctgagcatccggtccagcgcgtcccggtccatggcggcgcacagtcgctcctggatgtccacgacgagcaacgcggcctggtcctgcttgaggcggaaggtgggcatgccccctcctcgcgcgaacggtgagggcccgtcaagcggcgggagccgccagcgcgactggtggacgcccgcacggcgaggacttccagcgggtgacagtcaacccgcgacgcgcgggcaatgagccgcgtgggccgggctcatgattgatgggaattgccggcaggtggcagcccccgtgccattcgggcaccgctcagcaggacaccgtcccatgcgcagcgagggccggggccccggtctctcgtagggcaaggagctccggcgggcgcacgagccgcagcaggcgcccccgcccggcgatgaaggcccgagcgcggcgaagctccggctgatgcgggtccgcgtcacgccagcagtcgaggaacgcggcgaagtcctccaccgcgctgctccaagcgccgagcgccacctgggactccgcggacagcagtcgcaagtgcccgcacccaggccgctccgccaccagcgtcttcgccagccccaccgccttgtcctcgcgttccgtgcgcagacgcagccggaccagtgcctcgcgcgcgggccgggagaaggccgccggccctgcggcccgaagccgccgctccagccgccacgcacgcgtcagcgtggcctcggcgcggcccacctcgcccctgcgaacctccagcgcgccacgcagctcatgagcggccacctccaccacccgcgccacatctcgtggacacagggccaggtcctccgagcggcgagcctccgccaggagcgcatgctgcgcatccagtgagttacatacccgctccacctcgcccagccgcgcggcctcgagcaggctgagtcctctcgtgtactggcgcatcccgtcccgcagcgcccgctccgcagggctggccgtatcagacagctccatgggcacgtccgccgccgcacgccagaagccgaagcgcaggtgcgcggacaccatcgtggctgcggcgaacagcagcgcctggtcgtcacctccagcaccttccacccgctgccgcaggcgacgggcccacgcctgggactcgccgtactggcccgcttcggcgcagccctgactgagcagccgcatggccgcctcggcactcggcgcgtcggcggtgtgcagtccttcctcggccaggtacgcatcgtccgcggccaccgtggcctccagcacgcgccgggcctccgccaccagcccaacccgctgaagcaggcgccccgcggagagcagcgcggggccggcacgaggcgccagcgccaccaggcggtgagcactgtcacgggcagcctcgggccggccgctgttcagcatggcctgcacccatgcatggtggacgcccgcgtggtccgggtgtgagcgcagcagctcgcgcagcagggcctgtgcatacggctgcccctgtccgggccggccatccggctcgtagccgtccaggaggaatcccgcgagcagcagccgcgcgtcgccgtcctcgggatagcggtcgatgaggcactccatgtcacgcacgaaggcgttgcgcccattggccggccccttctccgccagcagactgcccgcgacgatgtagcgctgctcgcggtccgtggtgccctcgctcagggccagcgcgcggctcatggcctccgcgcgggcggtggcgaagcgggcaccggagcctcgcgtgagggcgagcccccaccaggccatggccagcgatgaatcctcgcgcgtggcctgcgcgaaggcgcggcgggcttcaccgccccaccccaggtgcaacagccgcaggccctggtcgaaccaggcctgggcctggggcctggtggtggtgacgcccaggtgcgcgtgccccaggccctcgcgcaggagcggcgtggggagcgcgtcatccgcgacatcctcccacggcgcgcgggcatggacggaaggttcatcggctcggagcagtcgcgccaacatgatggcctcctcaggccccggcgaccggggcggtgcagacgttgaatccagaatccagggaacgaaggcgggaagcgaagcgccgccacgccgaggccagtccgtccgcctcgacgggagccgctttgcggcgtgccccgaaacactcacggcgccaggacggccccatctcggaggaaatccagtcctcgtgctcggccagccagcccgccagcgaggcgagccccgcgcgcagcgcccgccgctcgtgtcccgtggtcggcaagcgcgccgggcccagctcctccgcgcgaaacggcagatggcccggcaccccctccagcaggacgggcgcgaagcccgcccgagggacgaagatggcttcgccgcactcacacagcgcgccgaagccccacagcgtcaggcgcccaccatccggaaggcccaccgtgtaggggctctgtccctccgcgccttcggggcgcgcgtggcgcacgagccctcgtcgaacgaggaggttcccctccgggcagaggacatcccgcccgaggcaccacatggagacgtcgaacagccggtctccatcgcgtcgaagctcacagggaagcacggtggacatggcatggccggacatgggcgctatctcctctcagctcgcggacttcttcgccgtggcgccgcggcgcacggggctggcgccgaagagcgcgggcgcgtccactgggcttccgccctgcttgcccagcaccgcgttgacggcgcgcaccaactttccgcgcacgctggccgtcagtggcaggtctcccagcgcggcctgaagctgctgggcgctgatgccccggccgctcttcggcttgccgatggacagcgactcgtagctcttgccctgcgtgtccttgtcacggcgacgggcgctccgcttcttcaagagggttcgaccctcggagccgtaggactcgagctggcgcgacaggcggaggagcttctcggtggggatgttcttgtccgtcaggaactgctggaaggaacccatggtcttctctcttcggggaacgaggggccggcactggagcaccggcccccgggtgaacgggccaggggcccgggaacagcgtcagtgctcgtggccgtggtcgccgtgcgactcctcgatgagcacgccgaaagtcgccacggacgtggggccgaaggtcaggtagtgcgtgcccaccgtgagaggcacgacgtggcggcccttgatgtcggtgcagcccttggagctgctggtgctctcctcgatttccaccgcctcaccgctggaggtggtgacggaaaggggcacgtccgcgttggtgtagatgacgtagtcggcggcctcgctcgcggcgaaggccaccatgccctgattcccttccgagccgctcatcagggtgatgtcgtagcggcggtggtccgcgcgaatctcggggggcgggttgttggtccccatgttggagatgacggcggtggcgggcccctcctggaggtgctcgcacgcctcggcgtcgacgccctcttcttcgggatggtcgtcgccgcagccggcggagacgagcgcggtggacagcaggaacgcggcaaggagcttcttcgtcatggtgcgactccacgggattggactgcgggtgtgccacgcccgcgcgccagcaacggacaccgccaggacatggaggggccgccacgggtgcgtgggaatggaaggggcgtgcacggagcacgaaacacgggcgccgtgagacagctcagccggcgtgggcacaaagccgcaatgactcacagcccgcgcggagcggacggagtctgtctggctttagcggacgggcaacctcacacggcgcgacaggccgtctgagcgagcaaactcccgggcctcacgcgcgcggcggagaggccttgggagccaggtgaagacgggcgacgggctccgcatggaagcggaacaccgccagcgcgggctcggagcgagcgggcgcgaccaggaggaacggagtgtcctgctgcggaggcggagcctcccgccggaagaaggcgtggacacagtgggcatcagagccgtgggagtccgcctccgtactcttggaggcgagccgcacatcgtcgaaggacgcctcagcgtgaccggcgccatgggagtcaccggcctccacgtgcatcacctcaccatgctccaggcacgtggcgtgctggaccagggcgaagtgcatcacgctccccatgtacgccagcacgcacacgagcgcgaacggcagcgccagaaggcgcgaccggacggaactcacgggctggtgaaaggaggagcgactcacgtcagggcattcccggtcgaacggcgtctacggttgtaagccagacagaccgttcgcgcaagtcagactgtctcacgcaacattcgccaggaaacagcactcccggcgaacgatcaacagcaacgcagagacaatagtaacaataacccctttccagcgccgctgcccgggtgggccccggagcggccggtcccaggcccggcgggtggcaagaggccaccgagggagtgtcctgctccgacgaaaggcaccgggcccgtggaccggtggaccgtccaggcgtagggtgcgcgccgcccggaagacgcccgggcgcaccatcgaggtcacgacttcgtgcaagagttcatcgacgcgctccggagccaggcacgccacattgcgcccgacctggcgcgaatcgcctaccagcggggcctcgccgtcacgcgaccggaagggaccacccaccccatccccattaccgccacgcccgtggtgctggacgccgcggagattcgccgccgctcggagctgtccgcccgcctgtcctccgccacggtgaagatggcgcaggcgcagctccagggcgcggacgcggagtccctgctgggcgccctctcccctctcgagcgcgtgctcgccgagcgcacctggcgccagtccacccggctggccaccacgcgcgtggactacttcgtcgcaggcggcacgccgtgggcgttggaggtcaacgccaccatccccgccatgcaggggtactccgacatcgcggcccgcaccttcatcgaggtggtgggccgctacttccgctatccggagaagtccctgcacgccctgctgtcgctcaacggcagcaacgcgctggcgttgtaccgggcgctgctggacggatacgcggccgagcgcaacggcaggatgccggacacggtggccctgctgtgccgccgcaacgacgcccaaatcacggagctgcgctggctgtgcgagcgcttccgcgagttcggcgcggacgcggacctggtccatccggacgaggtgtccggtgacgacgccttcgtggcccacggcaagaagtacgacctggtgtaccggcacctcttcgtccggcgcctggaggagtccccctccccctgggtcgaggacttcctgggcaccgtgcccggcaagaaggcggtgttcctcaatccccccgcctcgcaggtggaggtgaagctgaccttcgcccgcctgtcgcaggccctggccgagcccgcactggccgaagccgcgcgactcaccggcgacgagttggaggcggtgcgcgcgtccgtgccgtggacgcgaacgttccagcccggcccgacgcagggccccgacggtgaacgcgtggaggacctggtggccctggtcgccgcgacgccggcgcgcttcgtgctgaagcgggcctgggactatggcggccgagccgtcttcctgggccgctccgcgggcaccgtcccctacacggagcgggtgcaggtggcctatggcgcgccgatgacgtgggcggagctgtgcgcgcgcacggcggcggacacggccggcggaggcttcgtggtgcaggaagtagtggactcgccgcccgaggagcacctgctctgcgagcccaacggcaccgtgctgcccacgtccttcttcgtggactactccgcctatgcctccgtgggcctggcgcggcagcccgcgtggggcggtgtgtgccgcgggtccatgtcggaaatcgtcaacatcgtcggcggtggcggcgtgttgccgctcatcacctctgaagtcgcctccaagctcctgatggcgtggaaggccttctaggccgttgacccgatttcgggggccgcgccctccctcctcgcaccacaggaggaagggatgacctcagcagtgcagcggtgtctcggcgcgtcgctcgccgtcgtgtccatgttgtgcgccagcgtggccctggcgcacggctccatggaagtacctctcagccgcgtctacagttgcttcaaggaagggccagagacgccgaagtccgacgcgtgcaaggcgctcatccaggctggtggcacgcaagcgctctacgactggaatggcgtgcggcagggcaacgccaacgacaggcaccgcgacatcattccagacggaaagctctgcagcgccgcgaatgaaagtcaccggggcctggacctcgcacgcacggactggccctccacgctcatcacgccggacacccagggtcgcttcgagttcgacttccacgcgaccgccgtgcacgccaccggctacttccgcctatacgtcacgcgtgagggctacaacccggcgctcccgctcaagtggtcggacctggaagcaaatcccttctgctccatcacccacgtctccgcccagaacaaccgctaccggggctcaactgccccttcccctcaagggaagacggggcgcgcatgtcatctacggcatctggcagcgctcggacagcccggaggccttctacgcctgcaccgacgtgaagttcagcaacaccccgccgccgccctcgtcgtggaaggagctgggccaggtacaggcgcgtgaagacctgcccgcggggagctcggtgacgctgcgcgttttcgacgcgcagggcgctgacaccgaatcccatgtgcatcccctgaccacggccacgccggcggcccagtggattcatgcgctggcacagcgggtgaacggcgcgtccagccgcgtacaggtgggcgtgctcgacgcagcgggccgcgtgaatcccgtgcaggacgcgctgggcaaccgcgtctacgcgcgagagacgggctacaccttccaggtcgacatcatgaagccgccgcccggtggcggtggcgagcctgtctacccgtctgggattgaggactatgcagagggcaccgttgtgcggggcaccgacggactgcgctatcgctgcaagcccttcccctactctggctggtgcaagggctccgcgctgcattacgcgccgggcacgggcttgaactggcaggacgcgtgggagcgcattccctgaagcccaccgggtgacgcgacacatccagtttcggagtgaaggcaccgggatgtcacaacgcctgacgcaacatgttcgcgtcatggccgacaatcccggtgcctccgacattcatgtcgttcccgagaaaggtgtgtgtatgtccccccgaatcgaccggcgcgctccctcgaagctcggctcgaatctccagaaggacgcggagccgacccaggcccgtacgcccacggcgacgacgtcctcagtcaaataccagacgcagcgcaacgcggatgccttccaaggtgctgctccgcgtgggcgcgcgcaggttgccttcggaaacaccgtggcggccctcaacacgaacgcggtagtggccccggcgctgacgcccgagcagcaggcatctgcggagcaggcgcaggtggacgccaccaaccggcaggacccgtcgtatctcacgaactggctgaaggaccatcccgacccggcgcagcaagcgggcttcatggatcgcttcttccaatacgggaccgatgcgggacaactgctcgacaaggccagcgaagaggatttgccggtgctctccgccgccctcgacgcggcctaccggtcgggcgccgtcacgctcgacgaactgacggcggccgtcggttcccatggcgcgggctcctggggcggtgagacgcacgagacgctggcgaaaatcatcgccggcacgggcaacccggagctcatcaccgcctacgcgcagcgcgagctggaaatcatgacggccagcaacccggccgacccggcgcgcgccgtggccatcgccacggcgctggcgggcctgccgccggacaagctccaggagttcctgaagaacaacccggacgccctgggccacgtcctcaagaacatcaacgaccccatcatcggcggcggcacggaggcgcttggaaagctgctggacgcggccagcgcaatccagcccgccacgccggagtccatcaagctgttcatggacagcatcgggcacctgggagacaaccccgaatcccgcgcggcggcggcgcgcttcttcacgcagcacgcgaacgcgattctcgccgcggcgagcgacgcctcgggctccattggaagcgcgggcgcgggcaagctgtccgagttcttcacccggacgctcttcaccgagccttccttcgagggacaggaggcgttccactcgttcatcacctcgaagctgggtgacatgcaggcgcagttggaggcggaggcgcacgccaatccgccgtcgcaggatgcgcagcgcctggcacggtccatgggcagcctcgttggcgccatcgagggaggcttcctcctctccgtcgaggagctgaacaagcgcaacgaggccgccgagggaatggcggggctgatcttcaagctcaaggatttgctccccacctcgagcatcccggggctgggccagttgcagaacctcaccatcgaccagatccagaactgggtgacggaggcgctcaagaagaagccagatgatccgcaggatgccattccgttccaccagctcttcggggaggccatctccaaccctgccctccgcagcgtgtacgactccgcccggctgacgtcgctggagaatcgcgagctcggcctgaaccactgagcccgagcgcagggctcgggccggcgtgcatgcgccggcccgggcctctggggaacaccgtctcgcacgcgcggcgaggccctctccttcaacgactcagtgctggcgcgtgagcggcagggcgggcacgtccttcacgtgcgcctggtgcgtcacccgcgtgcccaggatgaagtgcggttcgaggggatcgaacgtctcctggcccgagtagacaacgaagaacttgccgcccccgtaggcgacatccggcaggtactcctgtggttggtccccggtggagatagggaaacccgaggggtcccacacgtccccgttctcgccccaccgcgcaccccacacggcatgcggaccgtcacgcctgtcgtcccagacgaccagggacttgtcgttgtggtgggcgatgcgcggctcggcctgcgcgccctctgcggtggagatggggatgccttcggggtccttcaccatgcctgtcttgctcacgcgcgcgccgaagatgtccgcgttcccattccggtcatcggtccagaccacctggtaattcttgtgcgtccactccacgtcaggcgtcgtctgggcgccctcggcctgggagatggggaagccgtcgccgtcgaggatggtgccgtcctccttcaccctgttgccgtagatgtccgcattctccgggccttggccgtgctcgtcggaccagacgaccaggaactccttcgttttgttgttccaggtcgatgacgcgtcattcgcgaagttggggacggcgctgagggactcgtcgtccgtatcaaggacgacgccatccttcgtcacccgcgtgaagaagatgaccgtctcttcgtcaccggagacggtgtacgtcaccaggcagatcttcggggagcaggccacacgcaccgggccgacggtttcacccgtctggatggcgcggaacaccggccccaccacggtgccgtccggcttcacccgcaccccgtcgacaccatcgcggctctcccagacgacgaagaagtacttcccgttgaaggcgatggcgggccgctccccattctcgtcactgatgttgatgcggatgccccccgggtcgagcacggtgccgtccggcttcacccgggtgccgtagatgccgccggtccgcacatcggtccagacggcgaagaacttgccgtcaccgtacgcgaccgcggggccgaaacgcgccaccgcggcgggcatcgaggagccacggtgttcatcgagcccggcctcggcgctcgatgtcgcctccgccgtcatctcctccacttcgttctgcgcttcctgttccggcgccaccccgcagccgaccagcatggacccgaacaccagcccggcaatgccggccttcacttcccgcttcatgtgcagcctccccttcgcgaacaacggcgaaagagtggggggctccgcgcgcctcaccagccacccgtggggcgcaggccggataaggtgaggacaggcgcatcgagccac

SEQ ID NO: 1004 - DNA, 11029 bp, Myxococcus xanthus
agcaggctcggcacgaaggcccagagcgcgagccacgcgccccaggcccgaggcggccagcacctccgcggcatcctgggcgcgcgtccaccgccggaacgaggacaggagggcctgtcgcccggcggagcgcggactcatacggtggcggacaggatgtcaccccccgtacccaggctggacgactcctcggtggcgcgttcggcccggaggttcagttcgttgacgatgtccgcgttgccgcgctggagcagttgcaccgacacctcgccgcccgcgagcacgtggtggagggcctccagcacgggccgcagcgtgggggtgagcgtgcgcgcacccaacgggccctccatggcgcccaactcattgcagcgcgccaggtaggccgtcagcgcgtcgtcacgggcggtgtcgccgtgcgagccgtcgtgcgctggtttgatcgcgcggtttcgaggccgcggcgtcgcgagcgcgcccgtgcgggcatcccagcgcggtgggcattctcgtcgcgtgcgaagtggatggaaccggatttctcggactcttggcgtcatgctggctcccccccggggcccggcacagtcgtttcacccccgagcaaagcgaaggcgcccccgcgccgtcaaactcccggccaggcgagtgttgtccagcgtgttctcttcacccttcagggcaggcgggtgatacgggatggacagagggcgcggtggaagaggtgcgcggaatgtctcgagtcttgacgaagccggggccggtcacggtggcggtcctgacgttgctcgtcgcgatggcctccatccagacgggcgcttcgctggccaagcaagtcttccccgtcttgggcgcggcgggggccacggcgcttcgcgtgttcttcgcggcgctcatcctggcggcggtgttccggccctggcggcagcggctcacccgcaaggacttgcgggccgtggccatctacggcgcggcgctgggcgggatgaacctgaccttctacctggcgctggagcgcatcccgctgggcatcgccgtcgccatcgagttcaccgggccgctcgccctggccatcttctccacgcgccgggcgctcgacttcgtgtgggcgctgctggccgtggcaggcatcctgctgattctgccgctgtcggagacgtcgcggtcgctggactggatgggcgtcttctgggcactggtggccgccacctgctgggcgctgtacatcctcttcggtcagcgggccggaggcaccgtccacggcggcacggcggcgtcgctggggatgtgcgtcgcggcgctgctcgtcatgcccttcggggtcgcgcacgccggcatgaagctgctggacgtgtcgctgcttcccatcatcctgtgcgtggccgtgctgtcgagcgcgctgccgtactcgttggagatgtatgccctcaaggcgctccccacgcgcacgttcggcatcctgatgagcctggagccggcgctggccgccgtgtccgggctgctgctgctggatgagcggctgtcgctggtgcagtgggcggccatcggctgcatcatcctggcgtccgtgggcagctccgcgacgtcgcgcaagcccgttgaagccgtcgccgcgagctgaccagaaggggccgccgacaccgttccctggggtcgggcctgtcttcgggctcgcaatggggcccggcgccgggctagaggacggcctcatgcgtgaccgaatccaggccgtgctccgccagcttgcccagtcgcccgatatggaggcgcgctggctccacaccctgtccctgatggagttcatcggcgcgcggaagatttcgcgcaccgtggcggaccggcacccgacgctggaggtgctggggcacctggccgacgagacgcgccacgccttcgccttcaagcgcctgtccgccgaggtcgccggcgcggaaatcaccacgttcctctgcccggaggccgcgggccgctacttccaggcgctggaccacgagctggccacctgggcgacgtcctttacgggcgcgccggacgtctatctgcactacctgctcacgacgacggccatcgaacggcgcgccatggtgctgtacccgctctacaaggccgcgtcccgccagccggccgtgcgcgaggagctggggcgcgtcgtcaccgaggagcagagccaccggctcaccatcgaggatgcgtgtgtcgagcgcctcaccgccgtgggcgccacgctggatgccgcgctggcgctggaagagcggctcttcgcggccttcatcggtgagctggaggccaccgtggcgcgggagtcgggcgcccaggcggccttcgttccggcgcccggcgaggacgtcgcggcgcggtcgcagcaagggtgactacagcgcgtcgtcgtcgcccacaggcgcgcccgtgccatgggcgcctgacaggacaagcgtgccgtccatcagctccgcgcgcaggttgcgggccttgcgcgcccgcttgcggctgagctccacgcccaccgcgtccagacccagcgcgttggccacggccagcacggtgccgtggccacagaaggggtccaccaccgtgcgcgtgcgggtgtgctccaggatgaagcggcacgcgatgagacacgcctccacgcccatgccgcgcgtccacgtcacctcgcccgcttcgggcaggacgtccggcgtggacttcgccatgtccacgcggacgccgcgcgagaagcacagcatgtgggagtacgcgggccggccgaacgtcaccgtcccgggcggccgccggcacaccaccttgtgccagagcaggtcaacgcccacctcctccgcggcgcgggccaccaggtagcccttgtccacccaggtgccctcgtccttcacgtccgtctggtagaagatggccacgccttcgggcggcacgcgcgcgaggatgagcgccgcggcgcggatgaaccaggccttccactccgccagcgacagggacgggaactcggaccagtccggcagggacgcgatggccgagctgccctccaacaccggtcgcgcctccagccaaacgagtgcgtcttcgcagtacaccgtgcgcttcgccgcgcccgtggcgcctgcctgttcgtccaccatgtggtgctggagtctgccagagccgcgcgcactccgcgtcgggctggtcaacacgcccaaaccgtggcttgctagcgcttctgtagatttctacaatcctgttttatctcgttgcaacggagagacggaatgcccacgacttcagcgaaagacgggacttcgctccactaccgtgtcgtgggtgagggtccgcgcacggtcatcctggtccacggttggatggtatcaggcgcggtctgggatgcgctggtggagcgcctggacctgacggggctgcggctggtgattccggacatgcggggctcgggtcagtcgggccggccggacggaggcttcagtctggagtcgctggcgcacgacgtgctggccgtggcggacgccgtggacgcgcggcgcttcacgctggtggggcacagcatgggcggccagctggtgaagtgggtggccgcggaagtgccggcgcgcgtggaggggctggtgctcctcaacacggtgcccgccgcgggtcttccgctgcctccggatgcggcggggctgttccgcacgtcggcggacagccgcgagaagaagcagaccatcctcggactcgcgtgcaagcagttgtcgccggaggccctggaggcgttggtgaaggactcgatgggcgtcagcccggcggccatcgagcacgtcttcgacgcgtggacggcgggtggcttcgccgacaagctggcctcgattacggcgcccacgctggtgttggccacggacgacgccttcctgccggcggccttcctgcgggaggcggtggtgtcgaggattcgcggcgcgcgcctgtcgtaccttcccggccccggtcattacccacaggtggagcgcccggcggagacggcggcgctggtgtccgccttcctcgccggctcccagccggcctgagcgcccgcttcgaggaggcagcacgatggcctggaacatgtccttcgagtacgacgcgctgaacgacgtcgtcaccgcctacttcaccgactgcgtgttggtgagtgaggcggacgtccttcgctggcggaaggaagtcgaggagcacctttccaagtacccgcccaaggtggacctcctcatcaacctggacgggctggtggtgaagttcaccgccggccgcgtcttcggcaaggagcggcgcgaggtgctggagcgctacacgcaccgctcgtatcgcttcggtggtgacgagatgacgcgcatgttcgtgctcaccagcggcgccatcaacggcgcggccgtcaatcactacgccacccgcgacgaggcgctggccgcgctccaggccgagcgcgaggcgctgcgcaagcggggcttttcgcccttcggtggtggcttcgccggcagcaaggtctgagtcttgctccccagcctcatgcgcggcggtgcgtctgaacacacgccccgtcgcaggcgtcgatggctgtcgttgatgtcgtgggcgcgtggcgagttgagggggcctcacacgcccgcgaaccactcgtagccgcggtcctcccagtagcctccggtgggctcgggcaggaagttcacctcggtgaggtacttcaccatcttgtaacccagcttcacgcccgaatagaggcgcagcggcgcgccgtggccgggcgtcagtggctggccgttcattccgtaggccagaatcgtctgcggatggaaggcgctgggccggtcccaggacgagtaataacccgcgtcgaacgagcgcagctccacgtagcccgcgcgggtgtccgcgcccacctggcgggccagctcgctcaggcggacgccatgccaggacgccaccgcggtccagccttccacgcagtggtggcgaatgcgcaggtccgtgcgaggcattcgctggagggcgtccagcgtcagcacggtggggtgcgccacgagcccgcccactcggagcgcccatcccgagggcgcgagcggcaccgtgtcggagacgtagtattcggggaacttgcctggaggcgtcgtctcctcgggaggcagctccggcgccagccggcgttcatcgaacaacagggcctgcgcgcgcgcgttgaagcgctccatgacgcccaggaagccctcgtgagggcggctgctgtcacacgcgctggccgtgagcgcggtggtgcccagcagcgccgtgcgccgcgtgaggaggtgtctaggcatccggcttccttccgcccgtcaccatctccgccaggcttcgcgggtggagcagcaccagggtgatgtggcccacggtgaacagggcgagcagcgccaggatgacgaggtggatggcgcgcgccgcgtcgtagccacctagcagcgaagtgagcgcgccgaactgcacgggcttgtagaggaccagcccggagagcaccgcgagcagtcccagcgccagcgtgcccgtgtacgccagccgctgaaggccgttgtagagcccctgcgcgggcgcgtgttttcgcacgcgcaggtagaaggcgagcgtgtccagggcgttgcgtgtgtcgcggcggggcaggaagaggcggcggcgccactcaccgctgagggcgaggtagagcacgtacgccacgccgttgaggatgaggaaccacgcgaaggcgaagtgccagtgacgggcgccggccagccagttccccagccgcatccattcgggtggagggatgccctggtagggataccagccgtagggccggccctgtggtccgagcatgggataggcgacaagtatctggagtccgctggccgccatgatgagcagcagcggtacgttgagccagtgggtgactcggatgagccacggctgaggcctgcgtcgttcaggggcttgcacgcgcgcggaagaaagcacccggcatcacgcggcgtgggcgcgacttgtcccgcgttggtggacagccatcattcagggcgggggccgctcacccttcgtcgacgtgaggacgggctctggcctcgcggggcaggaagcggcggcggatttcagcgcgcacgatgctcccgagcccgttcgtgcaagttgcaacctggagaatggcggcagggacacaagcccctggaatgacagggggttcgtgagccgtggccgggcacggcgcgtgctcttggggagacacgaccatgctcgcttctccactgccatccctggtgtcctccctgttgttgtcccaggccccttcgccggagccgtctcccgatgccgaagccccgggcctgctgtctcgcctggaggtggaaggcggggtggacgtctacttcggctacaacaccaatcgccccgccgacggtgccagtttcatccctggcacgggcaccaccgcccggcgggacaacgaggtctccatcaacctcgcgtcgctgggcgtgtcgctcgcgcccgagcccgtgggcttcaaggtgttgctgggcttcggcaccggcatcgaggtgctgcaccaggccgagccggaaggcccggccatcgggcccgaggtgtggcgccatctccagcaggccacggtgtcgtacgcgacgggaccgctcacgttggaggcgggcgtctatcccagtcacatcggtctggagtcgttccagtcgcggctcaactggaactacacgcgctcgtggatgggtgagctgtcgccctactaccagtccggcctcaagagcacctgggccttcgatgacgcgtggagcgcgcagctccacctgctcaatggctggcagacgattggagagaacaaccgcggcaaggcgctgggcacgcaggtggcctacgcgggcccgcggctatccaccgccctcaacaccttcgtgggagaagaaggtgacggtggcctgcgactcttcgtggacgccgtggccacctggaaggtgacgcacgccttcgcgctggccgccacggcggacgtgggccggcaggcgcgttccggacagtcggcggccctgtggtacgcggcgggcttcaacgcgcgggtgcaactctccgacgtcgtggccgttgccgcccgggtggaggcctatcgcgacgaggacgggctcatcacgggggccgtccagacgttggcgggcggcaccctcaccctggagttgaagcccgcagaacacctggtactcaagatggaggcgcgccgcgacacctgcaccgcagacgtgttcaccggccgcgccacgggaggggatggcgcgcccatgctcgaggacgccgagacgctcggggtgctcagcgccgtcgcctggttctgaacaggagccccatctcatggacctcgtgctcgttcttgtcaccgccgctttcttcgcgctcgcgtgggtctacgtccacggatgcgagcgcctgtgaggcattgcccgatgactttcgaatatgccgctggcgccgtcctgtccgtgctgctcggtgcctacctcatctacgcgctgcttcgcccggcgcgcttctaggcccccgccatgtccttcatcggttggtcgcaaatcctgttgttcttcgccttggtgctggcggtgacgaagccgctgggggcctatctcttccgtgtcctcgaaggggacacccgtccgctgccgcgcgtgctgggccccttggagcgcctgctgctgcgcctgtgcggcgcggcggaccggcacgaacagacgtgggtggcctacgcgagctcgctgctggcgttcagcctcttcagcgtcctcatcgtctacggcctccagcgcgtgcagcacctgctgccgctcaatccgcaagggctgggagcggtggggccggagctggctttcaacaccgccgtcagcttcaccgcgaacaccaactggcagtcgtacgcgggtgagtccacgctcagctacctcacgcagatggtggcgctggcgtggcagaactttgtctccgccgccgcgggcatcggtgtcgcgctggcgctggcgcgtggtttcacccgccggcccggtccggacggacagaagacgttgggcaacttctgggtggatgtgatgaacgccaccctctacgtgttgctgccgctgagtctgctctacgcgctcttcctggtgtcgcagggcgtgctccagaacttcgcgccctatgcgcaggtcgtgacgctggagggcgcgagtcagacgctggcgcagggaccggtggcctcgcaggaagccatcaagacgctgggcaccaatggcggcggcttcttcaacgccaacagcgcgcaccccttcgagaaccccacgcccttcaccaacctggtgcagatgctgtccatcttcgccatccccgcggccctcacgtacacctacgggaagatggcgggagacacccggcaaggctgggccctgctctcggcgatgtccgtcctcttcctcgtaggcgtggccgcggtgtacgcggcggagtcccaggccaacccggcgttgagtgtcgcggggcaggtggcgcaggcgggaaacatggagggcaaggaggtgcgctacggcatcgcggcctcctcgctcttcgccgccgtcaccaccgcggcctcgtgcggcgcggtgaacgcgatgcacgacagcttcacgcccctgggcggcctggtgcccatggtcaacatgcaactgggcgaggtcgtcttcggcggcgtgggcgcgggcctgtacggcatcctcgtcatggtggtgctcagcgtcttcatcgccgggctgatggtgggccgcacgcccgaatacctcggcaagaaaatcgaggcgcgggagatgaagctcgcgatgttgtacgtgctcgtcttcccgctcttcacgctgggcttcagcgggctggcggccgtgctgccgcagggcgtgtcctcgctcaacaacgcggggccgcacggcctgtccgaaatcctctacgcgtacaccagcggcacggcgaacaacggcagcgccttcgcgggcctcaacgccaacacgcccttctggaacatcaccctgggcgtggcgatgctcggcgggcgcttcctgatgatggtgcccgcgctggccatcgcaggctccatggtgggcaagaaggtggtgccagcgggcccgggcaccttccccacgcacggcgtgctcttcaccggtctgctggtgagcgtgattgtcatcgtcggcgcgctcacgttcttccccgccctctccttgagccccatcgtcgagcacttcctcgccggggctggaaagcgctactgagatgtcctcgcctgcttcgaaaccggcgtcgctgctggacgcctcactgctcaaacccgcgatggtggacagcctgcgaaagctccacccgcgcgacgtggcccgcaaccccgtcatgttcgtggtgtgggctgggagtctgctcaccacggtgttggtggtgaaggatttggtggcgccgcgcccggatgccgcgccgctgggcttcaccgtgcaggtgacgctgtggctgtggttcaccgtgctcttcgccaacttcgcggaggccgtggcggagggccgcggcaaggcccaggctggcgccctgcggaagatgcgcaaggagaccaccgcgcgccgctggaaggacgggcgcgaggagcgcgtgcccgcgccggacctgcgcaagggggacgaggtgatttgcgaggccggggacctcatccccggtgacggtgaggtggtggagggcatcgccagcgtggacgagtccgcgattaccggcgagtccgcgcccgtcatccgggagtcgggtggtgaccgctcggcggtgacgggcggaacgaaggtgctctccgaccgcatccgcgtgcgcatctccgccaaccccggcgactccttcctggaccggatgattggcctggtggaaggcgcggcccggcagaagacgcccaacgaggtggcgctccacatcctgctggtggggctcaccctcatcttcctgttggcgtgcgtgacgctggtgccgctggcgctctactcgggagtgccgctgtcgggcacggcggtggtggcgctgctggtgtgcctcattcccacgacgattggcggcctgctgagcgccattggcatcgcgggcatggaccggctgctgcgcaagaatgtgctggccatgagtggccgcgcggtggaggcggcgggtgacgtggacacgctgctgctcgacaagacggggaccattaccctgggcaaccgcatggccacggagttgctccccatgccgggtgtgcggatggaggagctggccgaggccgcgcagctcgccagtctcgcggatgagacacccgaggggcgctccatcgtcacgctggtgaaggacacgtacaagatgcgcccgcgcgagctccaggcgcaccacgccaccttcgtgcccttcaccgcgcagacacgcatgagcggctgtgacctggtggacccgcacccgcgcagcatccgcaagggcgcggtggacgccatcgtcacgtacgtccgttcccagggcggcgcggtgccggatgagctggcgcaggcgtcgggccgtatcggcgacgcgggtggaacaccgctggcggtggcggacggtgcgcggctgctgggcatcatccacctgaaggacgtggtgaagggcggcatcaaggagcgcttcgaccgcttccgcgccatgggcattcgcacggtgatgattacgggcgacaacccgcgcaccgccgcggcgattgcacgcgaggcgggcgtggatgacttcctggccgaggccactcccgaggccaagctggccctcatccgcaccgagcagggccgcggcaagctggtggccatgacgggcgacggcaccaacgacgcgcccgcgctggcccaggcggacgtgggcgtggcgatgaacaccggcacccaggcggcgaaggaggccgggaacatggtggacctggactccaatcccaccaagctgctggaggtggtggaggtgggcaagcagttgctgatgacgcgcggcacgttgacgaccttctccatcgccaacgacgtgg

SEQ ID NO: 1005 - DNA, 11101 bp, Myxococcus xanthus
  unsure (1)..(11101): unsure at all n locations
ccctgtgaatgacgccaactcggggacctgcaccttgcggatcagcgtgaccgacaagtgtatgggacaccaggtgagcttgctcgccaacggaaagatggtggcgtcgctcgtgcacttcacctggtgcggcaacgtgctccgggagaacgcattctatgaccccgccgacgtacactcggccaccacccgcttcctgtaatagatgacgcccgggtccgcgcaatccacggggaccaccgggttccggtacaggccgccgcaccccgtgtagcggaaggacatgccgcacgcgcccgtgccgctgaagtacggccgccacccgttggagagcaccgcgtacgagttgctgccctcgttcgtgcaggcccggtcccagaacacgcgcccactcacgtcgtcgtactgcgatgggtgtcccgacgggtgcagccacgacgcggcataggtgacgcgcgtcgagcacgcggtggccccggcacagtccgtgtcgagcgccatgacacacgcgttgttgccggtgaagtacggccgccagccgttcgagagcaccgcatacgagttgctgccctcgttgatgcaggtgccatcccacgtcaccaaaccactcgcgatgtcgtactgcgcggtgtgccccgaggggcgaatccacctctcgccgtaggtgatgcgagtgctgcacgcgagcgacgcgccagcggtgcctgccggagcctcctccgcgagcggtgtgtcgttgcgctcgtcgccacaaccggatgcaaaggcagagacggcgcacaccaccgtgagcgccaggatgcgagggaacttcctcatggaaccacctccagatggaggggcacgagttaacacgaaataccagcaaaacaagaaatacaaaccctctgcaccctgccccatgtccttcagtcgaccagagacaacatcacttgaacctccacccgcatgagcaccgggacacgcacgcctggcgcgctacctattcaatggggccgccggagccgccctcggacgagcggccgaagcgccgcatgcacgacgatgccccccaacacggacgccagccgaaagccccaatccccggcgcggtctagaaagcccagcagcggggatcgcgtagatggcggggatggacggcgtcgcgagcgggtgcgcgaccacggcccagcccgtgtaggccggcaggcgccactcgagcgggaactccgtccggtgcgtcggctgcatcacgcccgctagcggcaggggcgtgacaccatccgcggtgaagtcgaaggcccccacctccaccgcgcggcccacggcggctgacctggaagccgcattcggcatccccccgaacatctgttcgacctgggctggagcgcgcaacacgtcatccgcaccgtctatgattgtccggacatgctcccttccagagtctttcttctcattcctctcatcatcctcttcggtgtgtccagcgcgtgggcacagccatacgagcgtacacaatacgaagggctggagctgtgccgtggtgacaggaccgtgacctatgcgatgaccacctcgggtggccacccgaccgctgaagaaagggccgcggtcaccgccgcgttcaacacctggaaccaggccgtggccagttgctcggacctggtgttcacacccggcgaggatgtgccccatcccgcaccgcgacctctcgacgggaagatgctggtgaccttccgccaggtgaactgcccggacatcgtccccgatgacgatgcctgctggcagaatgaatcgtgtcacgacaagtatgactgttggcccttcgcgccaagggacgtcgtcgatgagacgagctatttccgggtgtccaccggtgagattctcggcaccgagatcagcctcaacaacagcaatggcatgctcaccacgctggacggtcccccctgcgacgagggagtcatcgagcccggctgcgtcatcggagatgtccagagcctggtgacacgctccatcggcgaggggctggggctcgccctgctgacacgcaccgattccacgatgtctcgtgtcctgccatggggcgatacgcagaagcgcatcatcgacccaggtacgctccaaggcatctgcgagacctaccctcgagggctgccaacccccgggtgcatcatctcaacggatggcggcgtcccggatggaggggacggcgtcccgtccggcgatggtggcgtgcaggaggctgacggtggtgtcccggacgctggtgacagcgtccctgacggcgatggcggcgctccgtccaagtctggctgcaccaccacctcctcggtgccactcctcggagcgctcatgctcctgctgggggctcgacgcactcgccaacgctcacggggctgaacacgggcacgaggttgccgctccagatgacggacgggttctggcaaggctggacggtggcctacaacggcgcgggcaccgtctatcccgcgacggcccccgggacacgttcttcatcggcaccaacgaaggagcgacggactcgctggtgcaggtcacacctgacgcgggtgaacacgtccaccgcgaatgtcctgcttgagcagccccgcgaaagtccacttgcggcgtcctggccttcctcggctcctgcctcgccgccccctggagcaccatcctcgcctcctcctcgcccgcttgggggagcacggcgcgacaggaggtccccggcgtgcccccatcgccgatcccatcgcgtcgacgaggaggctgggcgagaatcgggccatgccgatcctgccgaaagagcgagacccgaggctgatcacgattcgtcgtggcgggagcctgaccgacgaggaccaccacctgctcgcggagtgggctgccctctgcgcggagcacgtcctgcccttcttcgagaacgcgtgcccggaggacgcgcgcccccgagatgccatcgccgtgggacgagcgtggatcaggggcgaagtgcggatgcgtgacgcccaccaaaccgcgttcgtggccaacgccgcggctcgagggttgcctgacccggccaggttcgcggctctcgcggcaggccaggcggtggccgtcgcccacgtcgctgcgcactacttgggcgcggcagcgtacgccatccgggccgccgccgcttcggtcgccgtgggtaaggcggaaggggcccgtctgcaggagctcggatggcagcgggaacggctccccgccaccctccgagagctggtcctcgaagaccagcggacgcggaacgacatctgctggggcgtcttcaccgggtgacgcaggcccgagacttcacgcattcgcggtgccgggccggattgcggccgccgggaagcccgaggagccgtacggcccggtgagaacgtgcgccaccaccagacgctggccgtgcgcctggacgaagtgctccgcctccacagcgagttggtgatgcgcgagcggctgacggtgcggcgggcgcgaacaccggctcgcggcgattcaggaggcgacgaggtccaccgcaatgagaccaacggcgcggggcgcgagctcgaggccgagacgcccgtgggggccacggtggtgctggactacaaccgggcctacaaccccacttgtgccttctccgcctacagcctgtgcccgctgtcgccgcgccagaaccggcttcccttgcgcgtgccggcaagcgagaaacgcccgcagagtcagtgagcgccgcgtctccccttccgctgtcggaggtctgatgatgaagcccctgcacctcgccgtgctccggatgctgcccgcgctctgtctcgcgtgtgcccacccgccccaggcgccccgcgaggcgccggttgctgcacccgcgctcacctacgagacctacaccgtcggagcaggcgagcccgaggcgatgctcgtcgcgctgcactactccgggtccacacccgggttctggaggccgctgctcgaggactggcgcaccccgacccgcgtcgtgcttccgcgcggcccgcacccgcgcagggagggcttcacctggttcgccgccggccacgagcagaaggtgaccgcggagaagaccgccgatgtggcgcagatggccgcgcggctcgcagagctcatccgcgagctgcgcgccgcacacccccgcatccgccgcgtcgccgtgacgggcttctcctacggcggagacctcgcctgggcgctcgcgctgcgccacccggagcaggtggatgtcgcggtgcccatgggctcgcgcttgctcggagaccccacgcccggtgcaccggccacgcggcgcgtgtgggtgctgcaaggcgaagtcgaccccatcatcactgccccgcagaccgcggcgcgcgtggacgcactgaaggcagccggtgtccccatcgacgtgaaggtctaccctggcctcggccacgacttctcaccgcagctcatcgaagactggcgcaccttcctgcagcagcagctgcgcacggaggcgcagcgatgacgtggaccctggttggcgaggccgcttctccctggtccgaaaaggccctctgggggctgggccccccccccccctagcgtatgcgtaccgcgagcactacccgctcatcggcgaactctcgctgcggctgcgggcgcggcggctgaagggccgcgtgagcacgcccatgctgctcacgcccgaaggcccgctcatcgactccttccacatcgcccgctacgcggacgcgcacggcagcgcgcccacgctctttccggccgagcacgccgaggagatcgccgcctggaacgcccgcagcgaggccgcgctcggcgcggcgcgagtgcgctacctcgaccggctcgcgaacgaccgcgccgcgaagctggagcagcagccacccgccttccctggtttcgtgcgccagctctcggtgcccgcggtggacctcgccatgaccttcctgcgcaggaagtacgggatgccggacagcacggcggcggaggccacgctggtattcgagttggaggcgctgcagcgtgcgctcgcgggcggcaagcgccacctcgtcgcgaaccgcctcacctacgcggacctcgcgatggcggtgacgctgcagttcgtgtcacccgtggacggcgggcacatcgcggtaggccccgccacgcgcgcggcgggcatccacccacaactgtgcgcgcgctatccggacatcgtcgcctggcgcgacgcgctctacgcgcggcaccggcgcagcgagcagcccgccgagcccgtccaggagtagcgtgcctgcccccaccttcagcgtccggcgtcgaagccctcgagcacgccggccacgttgaggccgaggtcctccaccgcgtagccgccctcctgcacgaacaccgtgggcagcctcaactgcgcgaggcgccggcccatgagagggaagtgctcgcgctcgagcgcgaaggcgctgatggggtctcccacgtaggtgtccacgcccagcgacaccaccagcgcatccgggccgaagcgggccacggcgtccagcgcggagtcgagcgcggcgctgtactgcgcccaggtggtgccgcgcggcagcgggaagttgtgggtgaagccctcgccggcgccggccccgcgttcgtcggcgtagccgaggaagtaggggtactccgtctccggcgtgccgtgcagcgagacgacgagtacgtcggcgcgctcccagaagatgtcctgggtgccgttgccgtggtggtagtccacgtccagcaccgccacgcgcgcgcagccgcgctcgcgcaggtgctgcgccgccagcgccgcgttgttgaggaagcagtagccgccgtaggtggagtgacccgcgtggtgccccggaggtcggcacagcgcgtaggcgctgcgctccccctccgccacccaggccgcggccgtcagcgcgcactgcgcggcggcgaaggcggcgtcccaggtgccctggacgatgggcgttccggcgtcgaaggcgtagtagcccatctgtccgttgatgccggagggcaggtggtcgcggcgcatgccccgcgccggaaagccgctcggcagcatgaagccctgcttgccgatggccctccactgcgcgtgcgcggtgcgcaggaactccacgaagccggcgtcgtgcacgccccacagcgactccagtccgaaggcctgcggctcgctcacctccaggccggcctgcctcaccgcctgcaggatgaagtccgcgcgcgcgggcatctcgaagcagggcaccagctcacctcggtgcaactccatgccgccgtcgtgaagggcgtgccgcggggaatgaacgactcgcatcggaatggctccaggttgcacgtgcgccgtgccagcacaagacgttacaggaccttcgtaacgatggcgtgacgcgctcagccgggtactcgcccgccgggaggtccagcttcttcacgaagccgagcacgtccgtagagaacgcgagggccttggcctgctcctccatgagcacgccgctcagcgtcaccttcatcgccacctccgagtggtgggatcgcccttctctcatcggccggaaagtggcgccgcgtcagccgctgcctctagggttccccgcacctgcttcccgaggaccctcgccatgacgctcacgaccgccctgctcctgctcaccctcggcgccgcgccggcccagcccgccgcgaagaagttcgagttcgacaggcactacctcgtcctactcgagcgagtacctggcgccaagaagctgccggaggccgagctggcgcagctgcagaaagagcacctcgcgcacctcacgcgcatgggggagagcggcaagatggtgctcgcgggccccttcgatgagcaggacgacgtgggcatgcgcggcgcgtgcatctaccgcaccgccaccaaggcggaggcgaagcaactcgccgagcaggacccgatggtaaaggcgggccggctgaaggtgcaggtcatggcctggtacacggagaagggctacctggcgttccccaaggccccacccgtcgaggatgccaaggacgtggcaaaggacgcgggcaagtagcgcccacgcaggcgggccacctccgccccgcccccgctccactcgcggtgtcctctccctcctcggtccctgcccgccccggcccggggcgccatgctcgcttcctctgctcccgcttcgggaagcgcctgacccaagagcagaatccgggcagaatggcgcgcatgcacatgagcgccctgttgatggtggcactgctcgcggctcctgcccagccgctcacgtggaaggtgacaggagcggacgtcacgttcgagatgtccgcgaaggacctacgcgccctgcgcgatggcaaggaggtgttcggcctgcagtcacgccaggcagacttcctctccaacttcaaggccgaggagggcaccaacaccttcggctgggagggctcccagtccttgaaggtgctgtcggtggtgggcccctgggtgagctacgagaattcggactcgggcttcaccgggggcgcgcacccgtacgcgagcacgtcctacgtcaccgaggacgtgacgaagcccaagggcgccttctcgctgctgagcgtgtttcccgagaaagacgtggtcgcggcgctcaaggcggaccgcttcatccgcaagcacatccatgatgaggcggcgttcaaggacgccaggacggtggatgcgctgatgcagagcctggagcccggcgaggactgcgtgggcttcgactcaggtgggctcgagtccgtgaagcgctcggtcgcgttccaccacatcgagggtaacaaggtcgccgtgcgcatctcgttcggctacgccgccgaggcgtgccgggggcggagcttcgtggtgggcgtgctgttgaccatctccgcggaactgcggccagcgctcaagcgcgcggcccggcgggaagagggcttcctgatgaaggatgcgaaggcggtgaaggccccttccgtgcacttcacgtgggagtcgcccgaaccgaagcaggagtgagtgagtcgggagagcaccctggcgccagccctcggcgaggcagtccaggtccctggcggtcggaagcggagctgctccaggcccgcgcgcatgtcctcgacgtcacggtggccgtagacgccagccgtaacggtggtcgaggagtacccgaggatgcgctgcaccaccgccagcggcgcacgtcagccttgggagcgtgctcgacgtgtccacagcggcggcacttgtcgactccccctcgacaagctgggcccggttcatcgctgaccggagcaacgcggcaaggtccacgtacggccgtggcgaacagcaccgccactcgggaggcacctgggcaagcaccggcgctacctcctcggccttgagaaaggacgaggcatcgcatcaggcgggtggtgtgcccttcgtcggccggccgtagagtctccgaagctcatccttggcttgctcgagggcctgccgcctttccggcgtcaggccgcggcccgctcggttttcgaagaacgtgagcatcgacatggcggactggaaaggtgaagccttccgtcggctgctttgttccgccgagcgtttcagtgagcgggccatgtctttcgggccccgcgtgaagactccctcttcgaggtcgagcgcgttgcttcgctccgtcacgtcgcgggaccatcggcgttcctgctggccttcacccggctcgcgctggtgacgcgcgggcctcggggctcgctgagacggcggagtgggcatcccgggcgtttccggtgacttcgaaccgcggcccgcgacctctgcctgggtcgggcgtgcccgccgggatgttcccttgcttgtgctcacgtccaaggactccggaatgcggtgtcgcctcggagcacacgggccgcgcggcccgtggcctccaagcagacgatgcgaggtgggttggctggtgtcgccgggtcctggacgttgcgtccctcgtcccggcaccagcaggccacaccccgtctgtcgtgatgctgttcatggcatgaggcgtcgacaggctcaaggttccgcgcggcgctggagcggccgactcacgagggccttcggaagcggctgcctggctcgtcggcccgctcgctcaatgcggttcacgcctcgcgaggagcccacgccagcgtcggccgcgggcactccgatggcttgccgcagcatgagaggtgattgtttttgtcacttctctgccgagcgcatatcgcgaatcgctcgcttcaccgtcggccggacgtgttgcgatcgcgatcgggtggggcgaccatccccgcgacggcgagcgcagggaatgccggggcccttacggagtagnnggnncgatctcgcgtgccgaggggtaggcgaagtcgacccgccgccagccatccacgcggaacgtcgtgtgcaagcgtgcccacgatggccgcccgattgtagtgggcggtgctgtagctgtcgcggtggtgaagttcggttaacaaatggaactgtttacggggggggcggtagccgtgaaanggattggtgtcgaggaacagcaggtttcgggtgccgccctcgaccagatacgagaccaccttcacgccgagccagcggccttcctgcagctggtagtcgaagtagggcgtgagcgagaggtggtcgtaggtcgggtggtcgagctcgcggtaggcctggggcgagacgccgccgaacgggacgtccatgccgacgcagctcgagcgcgctacctcgggcttcgtgtgctggccgccgcgcatcttccaggacatggagtggtgcgtgccgttgtcctcgtggacgcgcacgtagacggtggcctcgaagttcaggagatcgtcggggctgccgatgaagccgttctcaatggcgccgtcacgccaggtgaaggactgctcgccgccgctgggacggaggtggagccgcaccgtctttccggcgggcttgccgctcgcgtacgtgacgcggtggcctggggtcgaccagtaggggacgccggcttcgaggccgggcgtggcctcgtcgcctttcatgttgaagaatggctcggagtcggaggggtcgccgtcgccgaggtagaaactgctgccggagggctcggaggggaacaacatccccactccgtccggaccgacctccgccacgggagcgggaggagtggccggggcggcgagcgccggagcggcggtgccaatgacaagcgcggagatgaacgaagctctgaagaagtttgggatcgtcatgggcggcaggaaccgcgtgcagtgacgagatcatcccgaacggggggcggcggagcgtgcgggtagatgagcacgcggctctatgcgcggagcccgtgcttgagagcgtgaggtgtgaaagaggccgtcggttcctcttagcttttccactcacagtatggatttcactggcgcgcgggccccctgtggctaatctctgccacggccagcaccgggttcgtacgactgcgccacagcgacgaggtgggcgcgaaagcgctggttcgctgccccgggcccctcgccatcccaaccatcaggagtccctacttgtcgacccagtcgcctgagcgatccaacctccgtccctcctccgagctgcgcagtgccagccgaagcgcgcgcgccgcacttcttcttgctgccgtcatgcacctggcaacggccagcacggcgttcgccgcgccttcggtcgcgaacaagagccccgccaaggtcgatatccagacggtcgaagtcaagatgaagagcatcaccaagaagttcgagaggtcggactggaaggaccccaatactctcgatgagatcgcgaaattgctcgatgacgtcgagacccgcatcgctcgcatcaaggagaaggacaaggactgggccacctcgagcgtggagaccttcttctgggagtcccccccgaagtggaagaaggcgagcgaggaggtggaccggccccgcggagatgcaagtccacatggagcgccgcgcgcggttcccgaccatcggtgatctccacggggccgccatccaaacagggctcatgcccgtcgccgctcagcttcacggaacgagcaggcacggcggggaggagagggtcgagatcggcgaggggcct

SEQ ID NO: 1006 - DNA, 13256 bp, Myxococcus xanthus
taaagccccgccgcgccgctcagggcttctcgcccctgcacggtctggaggacgtgccccagacgccgcgcacgcgcctcaacgccgtcatgctcaccgagcagggcgaaggtggcgcgtccggcgcggacggcctcttcacccgcaccgagctgcaggacgccatcctcagcaaccgcggcatgatcgccgagctgctcatcgacgacgtggtggcccgctgcaccggccacacgacggtgccctacggcacggacaccgtggacatcagccaggcgtgctcgctgattgcccagtgggaccgtcgttatgacgtggacagcgtgggcgccatcgtgtggcgcgagttcgcgggcacgttcaccatgggtgagcttcaggcgagcccggcgctgtacgccacgcccttcgacgcggccgaccccatcgccacgccccacacgctggcgccggcgcccgcccagggcaccgaccccgtcctgacgaagctggctcaggccgtgaccgcgctgacgcgcgcgggcctggcgctggacctcccgctgggcgaggcgcagttcaccccccgcgtgagcggcgagcgcatccccatccacgggggcggcaactacgatggcgcggcgaacatcgtcggcttcggcacgctgaagtccaccacgcccaacgccgaggtgggcagcgccacgcggaccgtcgtcaacggacgcacggccctggccaacggcggctacgtcatcaacaacggcagcagcttcatcatggccatggagttcacgcccaccggcgtgcaggccagcgccctgctgacctacagcgagtccagcaacccggcctcgccgtactacgcggaccagacgcggctgttctcccagaagcagtggcggcccatcctcttcacctccgaggaaatcgccgccgcgccggctgagcagatcaccctcaccggcgactgacgtccccgccggcccccgattcgtcgggggccggacacctcgcggcccggcagggcaacgtcgggccgcggatgtccgccctccagtctgattccgtctgctccagggacgcgcgccaatgggtgcgcagaccgtcaggcgccgccgttcgttcctggcgaaggggcaccgggatttcccggaggaatcaccgaggaagcagcagggggacatcatggccacatccgtctacaagaccgccatcatcggcagagtgttcttcctccgctgggaggcaccacccagtcaggaagaaatccacaccgtcttccagcagatgaagggcgcgcacgagcagcttcagcacccgctcgtcctcgtcgccagcctttcaccgaagtcctccgtgcccaattcggagcagcggcgcaacctgtccaccttccattcggacgcgcgcccgctcttcacggagattcacgccatcgtcgaaggcaatgacctgcaatacaacctgcagcgggtcatcatctccggcatcaacctggtgacgcgcaccttcgacgaggcctttcaccgcgtgcacaagcacgctgacctcgtcgctccctacctgggcaagagcctgggcgtggacggcgtgaaggtcatcgaggaggcccgggcgcgcggcgtggtgtgagcgcggcccgtcttccgaacagcgacgtcagctcgcggccggggcacctccggcccgcgacgccgggtccacccgccgcgccagggccgacgcggcggtgccccggacgaagctgtggtcgaagaagtccacatagaggtactccggccacgacaccatggaccgggggccccgcatcaccgcgcgcgtcaactccgtcaccatcatccccgccgcgctcgtcgcgcccaccacgcaggtgggtgcgtggccccggccctggaagcacgcgtccatgtactcgcggagcatgtagcttcccaggtgggggatgatggccggcaggtcgatgcgtccatccggcaggatgtagagcgcttcgtacagcggcgcatccggctggaagacgtgcagcgccgcgccgaatcccaacatcagccccgtcatcaccggcacgccacgctggcggcaggcgcggtggagcacctgcttctcatgcgcccccgcgatgtcgatgacctccaccacgtaatccaccgggccctgcacgccgcccccgccaagcacgtcctccacgttggcctcggtgatgccctccggcacttcccgcagccgcagcgccgggtggatgtcccgacacatccgccccaccacctccaccttggagcggcccaacgtgctttcgaagcagcccacctgccggttcatgttgtggcgctcgtagacgtcgaagtccgccagcgtcacgccgccgacccccaaccgcgccaggtccaccgcgcactggccacccgcgccgcccacgcccgcaaccaacacatgcgtgcgtgacagtttgtccagcgtctccgcatccaccacgcccagattgcgctggaaccgctgctcgaacatgggccgcctcacgttgaagtctggcttccatgtgccccccacccaggagggtggcgagagccccacgggcgcgtgtgttcagcacccctcccacgtcacctggtgccgttcggaccccgtcagtccacccgtactggagagctaatcggttcttgcccgttctggtcgcctgtggtcatttgcgcgcgctcgtcacccacgcctcgcaatccctgctgggttcctcgtgacgccccggaagccgcaccggtgatgcgcgggcttcagcgatgaagcacgcgccgaagtaccccacctggcaggggatgtcagaggttcgatccacagtggcattcacccatgaagtccctgtctggataacactccaggagttacaggggtttggtgattggcgtgaattctgctcgggggggcgacacgtcaggggcgtcatgggccggcgtaactcgactcccccgaacctcttcagccgatccgaggtctgtatgcgttccgtgttcttcctctgcgtctcgttggcatgtctgtcgttggctcgaaccgccgaaggggctccttctgatgacatgcgacacgctgtctcacgggccgcggcgctccagggcgtggcgctggcggagggcgcgccggtcagcgccgcgctccttggttccagcaatctgggaggcagtgagcgggtagcgctgttcggcgacgtggcccactaccgctaccgcctgcaggtggggccgtcgcagcaggacgtcgtcaccctgcaccgggtggtgcgggaggactgggcgtggcggccggcgcgtgcgacgcgcgcggtgttcatggtgcacggcgacgggtggggtttcgaggccgcgttcctctccagcatcggctccgcgttcgtgccaccggagcagtccatcgccgcgtacctggcgaaggagggcgtggacgtgtggggcatcgacctgcggtgggcgggcgtgccgcagaacacgcaggattttcgcttcatgaagagctggacgctggagacgcacgcggccgacgtgggcgtggcgctgggcgtggcgaaactgctgcggctggcgggcggcaacttcatgggcaccatgcacctgctgggctggagccggggcgcggtggtgggctacgcgtacctcaaccgcgaggcccggctgccgcgcgcgctgcgccaggtggacggcttcatccccatggacatggcggtgcgcttctctccgcaggacgcgcagcagcaggcgtgggcgtgtgagcgctatgaggcgctgagcaatgcccgccaggagggccaactggagggtggcctgctcgggccggcgccgggcatcatgttgcaggccattggccagctcgccgcggtgcagccggccgcgccgtcgccgctggtgcaggacgacatcttcgggccgggcacgggccggccctcgaaccgcaagctggccctggtcgcggcgggcgcgacgagcgtgctcttcgcgccgctgcagccggttgtcccggcctaccacctgatgggcagcacgccggataccatgggcctgccggagcggctgtccttcacccacgagggctacctcttcgagttcggccagcgcgccgcgccgtaccagagcatcaacgaggtggtggagacggaggcgtgggcctgcgggaagcacgtgccctacggcgaccgcctgcgtgacgtgaaggtgccggttctgtacgtgggcgccgcgggcggcgtgggccgctacggcgagcacagcgtcacgctgctgggcagccgggacgtcaccctgctcaacgtcagcacgctgccggaagccgcgcgcgccctggactacgggcacgcggacctgttcctggcggacgacgcgcgaatgcgcgtctggaagcccatgctccagtggattcgcgcccactgaggcgcaaggcctagctgtctcctttccacaagccgtggcgccggacccgccggcccagcgtcaccgggtccatccccagcgccacggccgcgcgccgcagcaccccgccgtggcgctccagggcctcgcggatgaactcccgctccacccgatccaaccgcgcgcgcagcgagccatccccacccggctcgttgcgcagggccagggtggagcccagcaccggcggcagcagccgccgcgacaccacctcgcccgggcgggagagcagcaccgagcgctccatgacgttgcgcagctcgcgcacgttgcccggccaggcgtaggcccgcaacgcgtccaccgcgtccggcgcgatgccgctggctgagcggcgcaaggtgcggttgaacacctccaggaagtagagcgccagctccggaacgtcctccggcctgtcccgcagcggggggatgtccacggtgaagctgttgagccggtagaagaggtccgcgcggaagcggccggcgcgcacttcctcgcccatgtccttgttgctggcggccaccacgcgcacgtccacgtggcgcacctgggtgccgcccaccggacgcacgtcccccgtctccagcacgcggaggagcttggcctggaggttggcggtggtgttctcgatttcgtccaggaagatggtgccgccgttggcgagcacgaagagcccggggtggtccgccaccgcgcccgtgaaggagcccttcacgtggccgaagagctcgctctccagcagcgtctccgacagcgcgccgcagtcctgcaccacgagcggcacgtccccccggccactgagccggtggaggatgcgcgccagcacctccttgcccgtgcccgtctcgccttggagcagcacggccacgcggtggggcgccaccaggcgcaccagctccatcacccgctgcatggcggcgctgcggaagcccacctcatccccgccgcgcccgccgggggccggcggcagcttctgcgacagggcgcgctcgcgcagcaagctgcgctccagttccagcgccatgcgccactgttcggtgcgcacgccgtgctcacgccccgcttgaagcaccgcctggtgcagggcctcccgcgtgggtgaaggcccgagcgcgcggaagatgcgcccgtcgttgaagagggccaccagccgctccggcgcggccggcgcgcagtagacgattcgcgatgccaggtcactgggtggccccgcgccggaagggtccgcatcggcgcggcgggcggccagggactccaccagggccagggcctgctcctcgtcctgaccgcacaccaccaggcacgccgcgtccccgcgcgtcaccagcgcgtgggcatccgacgggctggcggcgaagtggagctgggccaccccttccagcgcggccgtcaccgcgcgcgactcctgctcggtggcgaaggccaccaccacctggaggtgcgacgaggcgaggtagcgcgccagcttcacgccgtccgcttcctcgaaggcgcggaagctcacgcccatggccgccaccgcgccggacgcgtcgtgacgccagcgcaccacgccgcgcacgcggatgtgctcaccagagtccggaagggagaacgacagctccacgtcctcgccctcacgcggcccttcggacggcgtgtgcggcgtggcgatgagcccgatgcccgtctcactgatgttgacggcccagcacccatggagcgcgggctgcgtcaccaccttcacgtacaacggcttgcgttcgcttcgaggggcgtaggcggacacaggccgcgtcatgaccaccacagtctacttgagggatgaagcgacgttgacaatttgcgacgttagaagattcgccagccatcactcgacctggatgtaggtacaggtcatgaacgaccgggcggcggaaggtatcaacaagcaaacgagcccgtctcgcggcatgagacacgtcctcgtgctccccctgcgccgccgctgctggcatgctggagccgtcttcatggccatcgccgcaggcacccccagctccggcccgacgctccggattgcccagcgagtcccccgcacggaagcggagggccccggtgtgcgctacgccctctgggtccagggctgccccctgcgctgcccggggtgctgcaacccggagatgttcgcgaccgaacgcggcaccgtggagacggtggaggcactggcccaggcaatcctggccacgcccggtatcgagggactcaccctgctgggcggcgagcccttctcccagcccggtcccgccgcggcgctgtgcgagcgcgtccgcgccgccgggctgagcatcatggtcttcaccggccacacgctcgcggagctgcgggcccaggcgcgggacgacgtggaccggctcctcgcgacggtggacctgctggtggacggccgattcgaaaaggaccagccggagacggcgcggcggtggattggctcgcgcaaccaggtgatgcacttcctcaccggccgctacgctcaggacgacgcgtgcttcaccgccccgaacacggcggaggtgcacttcgtcggcggcaagctcgtcatcaacggctggcccgcgctcgccgaccggctccgtccatgattcgcgtcgctccgtccgagctcgagctgctcacgctcgcccgcgccatcgtcggcctggggcagtacgcccccgtggaggacctgctccgcaaccggcacgccgtcccagcgaagttcagtcccggcgcgatgcaggtcctgcgggacacgctcgccaagggcagcgtgatggcgctcgcccgatgcggcggctggcgccagcagctcacggtgcgcgacgggcaggcacgcaccggccggctctgggagcggcatgctccgcccctcctgcgcttctcccccctcaccttccacgtcctgaagtggcttctggagcagcccctgacgaaacacggggccatgccgctggaggtggacggaacccccacgctcgccgacgaactcatcctctttctctgctgccgcctggtggcgggcaccccctgcgcgccgaccctgggcgcacagcacctcttccgccgctccgcctctgctggctgggcttcccggagcagttcggaacgcaccgtccggagttcgatgccacggccttcgcgccactgctggcggacggcgcgtggctgctgtaggcgatgcggctggagctcgtgctgcgttggcgtgggttggaggagtccaagcgtcacatcgcgtctcccgaggacgcgctggccatgggcaccgcgcaggaggccgtgctcgccgcgttcctcgacgcggtggatggcgcgggccgaagggacctcgcgggcttcctcctcgaagcggcgcgcccgttgctggagcagcccgccacgcgctgggtggagggcctgtcttcctcggcgacgttgtcctcccgggccacggcggctcgtgccgccgccgccttcctgcgcgcgctgggacggctgtcgcgttgggacgcggagcaccgcgccgtgcgcttcttcgacgacgactacgacgccgcccagcacctgctgtccgaatggaacgccttcggtgaagcaggcttccgccgcgccgaggaccacgcccggcagctggccaccgccctcaccagcgccagcggcgcctccgccacacctccaccttcctccgccgggagcgcttcatgagccgcgcctaccgagtctccgtctccgagtccctcaaccgcgtggtccaggccgaggacggcctctgctccaagctggagctgctcccgctcctttcgcgcgaggagctggccgggctgctcgcggccgagctggcgaaccggggcttcacgcaagagggcgacgtggcgctgcgcaccgaggcggatggtgtccgcatcgccatcgacgtcaccaccggtgacgtcagcgtcaccctcagcggcgagcaggaggtggagctgaaggcgcgcggcgagctggccgtggagagccctcacgaggtggagcaggcgaagctgcgggcccaggacctggcgcgcgcgcggctggaggacgcggcggacgtcgccacggacaagctgcgacagcaggtcacccagaagctcgaaggccggctgaaagacctcaagtcggagctggactccatctccaacaaggtgacggcggaggcgctcaaggtgcgcgccgggcagctcggcaccatcgaggaggtccacgaggacgcggcgacgggctcactcaccatcaaggtgcgcgtatgagtcagcgcatccccgaggagtcactgcccacggagctgtcgcccttcgccgccgtcgaggccgcctaccccgccgagctgaaccgcgtctgcgaggcgctgctgcgcgggctgcccgtcatggtggaggcggacaaggagctgacgccctacttctacaagtgcctgcgagacaggctgaagaaggacggcaagcagttcctctacctggacggccgcaccgcgcaggagcctccaccgggcatgcccgcgcccagcatgatggccacgctcatcgcgcagctccggagacgcggtgcgtggcgcggtgcgcgagcgcatcgtcgtgctgccccacctggacctgctcaccaccagcaccgtgcgggcttaccagcgaggcgcgcgaggtcatccccctgttgtacgaaaacccggagatggtctgggtcgggttcaaggacccgtccttcgccgtgccgcgcgtcatcgagaacctcttccctcacaaggagagcatcctcggcgtggggcgcgaccggctgcgctacctcatcacccagcgcgagtgccgcaagttcggaaggggcctgcagccctacgccctctacaagcacgtctccggcatcaacgccgtgcggctgcgtcgcctgctgggcgccatcaccggcgaggactaccccgccaacccgaagcccgcgtatgcgcagttgcgctcggccacgctcaccggttcgctcagcgtgccggagctggagctgcacgcggacatcggcggctacgccaaggtgaagcagcggctccagcaggagattctggacgtcctggcgcacaaggacacgctgagcgacccggaggcggtgaagcgcgtggaggcgctgttgccgcgcgggatgattttctggggccctcccggcactggcaagacgctgttcgccaaggccatggcctcgtcgctgggcgcggccgtccaggtggtgagtgggcccgagctcaagagccgctgggtaggcgagagcgaggagaacctccggcagatcttcgtccgcgcgcggcaggcggcgcccagcatcatcgtcttcgacgaattggactccttcgcgtcggcgcgtggcacgtacacgggctcgggcgtggagcactccatggtgaaccagctcctcacggagatggacggcttccgcaaggaggagctggtcttcgtggtgggcaccaccaacttcgtggagtccctggaccccgcgctgctgcgcccgggccgcttcgagttccagctctgcatcccctaccccaacagcgcggaccggcgcgccatcctgtccatctacaaccagaagctgggcctggagatgacggagcgcgcgctggactacgcggtgaagcgcacgggtgaccgcgtggaaggcactggcacgcgcttctctggcgaccacatccaggccctgtgccgggcactcgcacgtcggcggttgcgcgaaggcgcccagggccccaccgaggcggtggacgtggagcgcgccctcacggagttcctggaccggccggagctcacgcccatggaggagcgcgtcgtggccacacacgaggcggggcacgcggtatgcgcgctcttctgtgagcacgcgcccgccatcgaccgcatcagcatccggggtgacctggcgggctcgctggggcacgtgcagtacgcggacccggcgcaccggtacgtcgtcacgcgaggccagttgctggacagcatctgcatgctcttcggcggccgggaggcggaggcgctgctcctggatgacctctccctgggcagcgcacatgacctggagcgcgccacggagattgcgcgcgagttggtggaggacctgggcatgggcggagacggcgtgcccgtgcggcgctttgatgcaccgggacggcaggcggaccggcatgccctgtccgacgcgacgcgaagcacgctggaggccgcgattcaggaagtcctggccgtccaacgggcccgggcccgcgatatcctccagcgcgagaaggagcgggtcgtggccctgagagatttgctcatcgaacgcaaggtgttggaccgcgaggccttcacccatctggtgcccgcgcccgtggcgccgaagaaggagcccgcgcttggctagcctcatcctccgcctccaggtggacccggcgacgggccgcaaggacgtcatcatccagtacgagagcgacgcggacgcgctgcccatggagcacgaggacgagcaccggcggctcgtggactcgctcatccagggcggcacgctgaaagcctccgaactgggccgcgtcatcgtccagcgcgacacgccgtcgggcaaggcggccgagcccacctccaccgccgaggacgcctccgaaaaggtcagccagaaggcctgatgtccatgctcgtcttcaccagtgaggaggcgctccacctggcgctgacctccggactcgtccccgccgaagtccaggccgcacccgcccgctatcatcggacgcccgacggagcgcttcacgtcctgccggaggtgatgcccgcgaaggatgtgctcgcgcacctcgcgtccctcggcgtgcacgtgacgcggagccgcgcgaaggaggccaccccagtcctctgctgggcggagctggtgacggcgcggcgcgtgccgctggagagcgcaccgaccggcccggtgctgttcctgcccccgagcgccgatgcactcctccccttggcgggcgagatgctgcgcctggggtgcgaccggcaagaggtgtgcttcgcccaagcctcggggggaagcggacagcgcgccttgctgcgcgcgatggcaccgccctacttcaccctcaccagcgcgctggacgcctcgggcccgctgcgtgccttcgttcccgctgtcccagggcaacacgccgtctgggtcgaggtgggctacacgcatccactcgcgcgcacgctgcaagcgcccgcggggacgttgctgctcgtccgtggcgaaggcccctggctgaccgcgccggacggcccgtggacggacctgtaccaacacaccgacctgcggctcccagccccgggcaaggactggacgcccgcgcccaccccgggccggctgacggtgccgctgcgcctcacgcgagccgcacgtacggaacccgcgagcctctgggtgctgctcgagaatgcgctcgcccaggtggagtccctggtccacacggtgccagagccgctgctcgcgcaacttcgcttcgccgtcacggggccaccggaggcgccgtgcatcgtgctccgtgcccgagcgggccgggagcggcccccggagctgggcctgtcgggcatggcgtacgcgccgctgcctcagctcgcggacctcttcctgccgtgtgacggactgctggagccccccgtgcgaagggcccgcctgcgcgcgttgctcgtgccgcaggccgataccgtgacgtggctccaccccaccgggggtggaggcttccgcgcgtagcggctgccggaatccgcgttccagccgctcgacacgtgggtggactacgtcgtggatgccgacgccgacgcactcatgccgtgggtccggagcgccagcttcgacttcgccgccttcgaggccgcggagggtgagtggcagagcgccgcccgcgcgatgcaatcggacgaagacgaggaccggagcccgcgaggcacgcgccgtagccgccgtgaagtgccggcgccccccgtgacgcctgcgagcccgccccccattgtcgcggtccgcgtcgcccaacccgtgcccaccggcgtccgcctggcgccgctcacgcccgcgcaatccagcgcggtggaagaggagctgggttcgctggagaaatcgttcctggccctggaggtgcccgccgattcgccgcagcggcaggagctctggacgcgcatggcggagctgaacggacggctgggccgcaagcgcgacgcgagcctgtgctggacgcgcgcgctgtggtccgcgtccgacaccgaggccaccgagcttgcactgcgctggtccgattcagaaaacgaaggaggcgccacccccgccgaacggatggcgtcacccgcgcccacgggcgatgacgtgcgcagcgtcgccagcagcctggtgcgcgcggtgtgcgtcccaggtgcgcccgcgcctgtcgacgtggcggcactgcagcggtggctggaccggcatgacgcggagctcgacgtccgggcgctctggctcacgcggacggcgctcgacacgctggcgggtggcgatgcactcggacttgcgcgagcgggcgaccggctgctggagatgcttcagcgaggactttccctcgcgagagacgtgccgcgcttcctgcgaggtggcaccgattcggcccatgcgccccgggtgctggcgcagctcgaggccctgctggagcggttcgagcacacaccccgtcgccgctcgtccatcgaagcggcgcccgcactcacgctggcctatgtccgctatgtcttcgccgtgggactcgcgcggctcgggcaggcggaccgtgcccgcaccctggcgtccgcggcgggggaggcagtcgatgcgaaagagccatccacggcttcctttccgagcgtacggcgcgcgcgt

SEQ ID NO: 1007 - DNA, 13466 bp, Myxococcus xanthus
caatctccgtggcgaccatgccgctgccaccgaaggttggaaagcaggtgatggccacgttgagcggggcgttcatgtgcgtgacgggaagaacaggggcttggcgaagctattcctgcgaaaatggtcgagcgggtcggccagtcccaacgcctcgcggaggatgtagggctcgccgtgggtgacgccaatctgcgcgccatggaagcgatccctggcttccagcgaggacaccgacagcggtgagcccaccagcgtgggcggggcgtccggacggggcagtacctggctggcatagcagtgcaccgccgccagcttgcgctcatagacggcggagacgtcgacgatgacgctgggctcggtcaggtgccgcatcgggtagtagaggacctgccgcggcgtgaagggctccgcggcgggctccgcgtcgaacttgcgcacgcccgcgaagaagagggcgcgcgtcaccagcgcactggcggcctcgtggtccgggtggcgctcctgctcccagggcacgacgaccagctccggacgcaggcggcgcagcgcttccaccacgcgggccacggcggcggtgcgggcgcgctcgggctcgggcgtgtcgaagcccgcccacggattgagccagccgtcgggcagctccaggttctcccggtgggccagccccagcgcgcgggtggcggcttccgtctcctccgcgcgggactggagcgtgccgcgcgagctcttctcgccgcgcgtcaggtcgacgatgccggtgcggtagccacgggcggccatgctcgccagcagcccgccgcagaacagctccacgtcatccgggtgggggccaaaggcgaggacgtcgatgccgtaggcggtgccgttcgcgctcatggcgtcaggtccttcgagtcaccggagaaggggacacacgcgtccagcaccctcttcgtgaacgcacgcgtcccgatgcggcaggcgaagtagggcagcccgaggattcgctcctggggcgcgtcctccgggaagaggaaggtgcgcaggcggtccacctgttcggccgcggtggcatcacgccgggcgagcgcgcggcggtaacggcccgtcagccgggacaccgcgacacgcaccgtgccctgggtgcggcgcagcgcgtcctggaggttcgcgtccaccgccgacacctgcccggcgacgcgctccagctcggaggcgaatgcgccgaagaggcgggcctccagggcttcgggtgtctccagcgactccggggcatcacgcgtggccagccgcgtgagcagcgcgtcgcgcggcacgttcacctcatccggctggagccccaccttgcccagccaccgtcgcgcgcggtcatcgagcacgcggaagcgggcccggggaatggcgagtggcatcggacgtcccgcgtgcgcgtagagcggtgccagttgcgcgaagtaggccagctcgcccgggccgccgacatacgcggccgtggggagccaggtgtcctggaggagggggcgcagcagcgcggacgtggtgaagcgcagcggctctcgctccagggcggcatgcagcgcgtcctgggtgatggcgctgctttccgggtgacccaccagactccaggcgtccgcttccgccgggtccagccggtagcgagggccatcgagtgcatcgggtgagaagaagctgagcggcgagcccggacggacatggacctgcaccgtgtagcccgcgcgggtgagcgcctccgctcgggccgcgagcaccgaggagagtgcccccgcttcctggagggcgaagcggtgcacgggcgcggcgaggggcgccagtcgtgcgtctctcgggtcgaggaagacgagtccctcgtcggcgaagagagaggacaggacgtcggtgaaggctcccgcgagcgtggcttcagggcggtaagcccgctccagcagggagaggaattcctccgcatggggttctgcttccagctcggcgcggagggtggccagggcggggaggacgctcggtccaaggtggcggtgggcgatgggcgctcgagacgttgctgcatccggaagctcgagcgccaggcgacagggccctccgcccggacgtgggatgacacagtggtcaatctcagggaggtcgtggtcctccgtctggagccagaagacgggaacacagggccggccagtttcttcctgaagcgcgcgcgccgtgacgatggcggatgcggctttgtagagcgtgtacagcggccccaggaagaggcccatctgctgccccgtcaccaccgccacggtgccaggcttcgcgagcagcgcgaggttgcgctcccgcgcggggctgggcgcgaggcgcgcgttctgcgcgccgaggacgtccagcaacgcgggcgacaccgcgcgcgacgcggcggcggccacggcccgggcgcgcgcttcacggtgtcgatagtcgtcgggaaggaaggagagcgcggacgcatctccgcgaagccacgcggtcgagaacggggacgtcacggcatgccgtgataacaggtcgcgacgggcgcgccaccggaagtgcacgcttgcacgtcatgtgcggccgtgacggcgtgtgtcatcccggggcgaacgcgagccgcgcgcaggggagaggcttgttatagggtccgcccgaatgcggaacctgcttctcggaatgacgctggccatgagccttggaatcgggtcgaaggcgttggcgcagcctcctcggcagctccatgcgggtgaaatcgcggcgggtctgaagcggctcggtgtgacgggcagtgtcctctatgtcgcggcccacccggacgacgagaacacgcgcttgctcgcgtggctggtgggagagcgcggcctgcgcgcgggttacctgtccgtgacgcgcggcgatggtgggcagaacctcatcggcaccgagcaggacgccctgttagggctcatccgcacgcacgagttgctcgccgcgcggagcgtggacggcgcggagcagttcttcacgcgggcgcgggacttcggctactcgaagagcgcggaagaggcgctgcgcatctggggacatgaagaggtgctggcggacgtggtgctcgccatccgccgcttccagccagacgtcatcatcacccgcttcaccacggagccgccaaaccacggccaccacacggcctccgcgcagctcgcggcggaggccttcatcgccgccgccgacccgaagcgcttccccgagcaactctccgaggtgaagccatggaaggcggaccgcctgctgcagaacgcctcccaatggtggttcaaacccgatgaggacctgtcccgctacgtgaagctggaggtgggcggctacgacgcgctgctcgggcgttcatggggcgaggtgtccgcggagagccgcagccagcacaagagccagggcttcggccaggccgtggaccgaggccccagcacggagtacttcacgccgctggcggggacgctgccgaagcgcgacgtgttcgaggggctcgacttctcctggagtcgttggaagggctccgaggccgtgtcccgcgcggtggccgccgcgacgaaggcgttcgatgcgcgcgccccccaccgctcccttcccgcgctcgtccgcgtccacgaggcgctgaccgcgctgccggacacccatccgtggaaggcgcccaagctgcgggagacggaggcgctcatcgccgcctgcgcgggtctgttcctggaggtgcgtgccgccgcgcccacgggcatcccggggttgcccgtggcgttggacgtggtggcgctgaaccgctcgcccgccgctgtcgagtgggtggggctgacgctgccaggcgagaaacccgaggccgtggggaaggcgctgggggcgaacgtgccgttgaagctgtcgcgcacggtgacgctgccgacgacggcgcccatctccacgccctactggctccgcgagcccgtcacgggagggctctacacgctggagggcgaggaccgcgcgctcaccggccagccagagggcgttcccgcgctgtcggtggcgttcgaatacaaggtcgcgggccggcgcttccgcgcggtgcgtccggtggtctacgtctggacggacccggtgcgcggcgagctctaccgtgacttcgaggtcgtcccgcccgtcaccgccacgctggcgcaggacgtgctcatgttccccaacagcgagtcccgtgccgtgccggtggtgctggccgcggggatggaccaggtgctgggcattgtgcgaatggtggcgccgcccggctggcgcgtggagccctcggcggtcgcgttcaagttcgaggcgcgcggagacgagcacaccatcaccttccaggtgacgccgcctcagggctcgacgcggaagggtgacctctccgtgaatgtcgacatgggggaccgcgcctggtcctggcgtgcccgttccgtgtcctatccccacatcccgccgctgacggtgcgccagccctccacggctacggtggtgccgttctccctggccacgaagggcaagcgcatcggctacatccccgggccgggcgaccgcgtcgcggagagcctgagcgcggtgggctacgaggtgacgctgctcccggaggagcggctggcccaggagaagctggagcgcttcgacgccatcctcgtgggcgtgcgcgccttcaacgccaacacgcacctcgccgtccaccgggagcggctgctccagtacgtggaaggcggcggccggttggtggtgcagtacaacaccaacagccgcgtggggccgctcacgtccttcgtaggcccctatccgctggagattggccgcgaccgggtgacggatgagacggcggtgatgacaccgctccgcgctgatgagccgctgctgcgcgcgcccaatgcgctgaccgccgcggacttcgagggctgggtgcaggagcgcggcctctacttcgcgtcgtcatgggacgctcgctaccagcccgtgttcgccatgcacgatgctggcgaggcaccgcttcagggcgcgttgctggtcgctcgccatggcaagggcacgttcatctacacgggcctcgctttcttccgtcagcttcccgccggcgttcccggcgcctaccgcctgttggccaacatcctctctcaatgagcactgccccccatctgaatccgagtgagccttccgccgaggtccccgcgccccggcccgagctcgatgacgcgccgccgctgctgggctcgtggcgcaacatctacatcctggtgctgggcaccttcgtcctgttcctcgccctgggctgggtgctcacggaggtgtattcgtgacggggctcgactggatggtgcttggtggcaccatcgcgttcatcgtggcgtggggcctctggaagtcccgagggacggccaccagcgacgagtacctgcgcggcggccgcgagctgaagtggcccaccatcggcctggcggtgatggccacacaggccagcgccatcacgttcctctccgtccccgggcaggcctacgaggacgggatgcgcttcgtgcagttctacttcggactgccgatcgcgatgatcatcatcagcgccgtcttcgtgcccatctactaccggctgaatgtcatcacggcctatgagtacctggagtcacgcttcgacctgaagacgcggctgttgggcgccttcctcttcctcatccagcgtggactcgcggctggcatcaccatctacgcgcccgccatcatcctctccgccattctcggctggccgctggagcccaccgtcatcgtcatgggcgcggtggtcatcctctacacggtgacgggcggggccaaggcggtgagccagacgcagaagcagcagatggtggtgatgatgggcggcatggtggtggccgccatcgtcatcgtctggcggctgccggagcacgtgtcgttcggcaaggcggtggacgtcgcgggtgccttcggccggatgaacgtggtcagcttcgacttcgacatgcaggaccgctacaacttctggtccggcatcaccggaggactgttcctgtccctgtcgtacttcggcacggaccagtcgcaggtgggccgctatctctccggccgctccatctccgagagccggctggggctgctcttcaacggcgtgctgaaaatcccgatgcagttcctcatcctcttcgtcgggattctcgtcttcgccttctaccagttcaacacgccgccgctgctcttcaacgaggcgctgcgcacccgcgtgcagggcacggcccaggcggccgagtacgccgcgctggagtcgaagtgggagcaggtccagtccggcaagcgcgcggaagtggagcgctacctgtcggccgtcgattcaggcgacgtggcggcaggggcggcgtcgcgggcgctgcttcagggccgcgcggaggaggcgagcgccgtccgcaaggaggccaaggacctggtgtcccgcgcgctgccgggcgcggagacgaaggactccgactacatcttcatctccttcgtgaagcgctggctgcccagcggcctgttcggcctgctcatcgccgtcatcctctccgcggccatgagctccatcgccagcgagctgacggccctgggcacgacgacgacggtggacttctaccggcgggtcttccagcgcaacgcttctgaccggcacgtgctggtggcgtcgaagctgttcactgtgttctggggcgtcgtcgcggtgggcttcgcgaccttcgcgtcgctcttggacaacctcatccaggcggtgaacatcctgggctccatcttctacggcacggtgctgggcatcttcctggtggccttcttcgtgaaacacgtgcgcggccatgccgtgttcgcggcggccgtcatctcccaggcgacggtgattgccctcttcttcctctccgacgtgggctacctctggttcaacgtcatcggctgcgcgctggtggtggcgctgagcctggtgatgcaggccgtcctgccgcgcggcgagacgccggccccggcgccgggggcctgagtccgcggcatccagggcggtgaaggctgggaggcgtccgtgaaggggcgccggcccggccttgaagtatgctcgcctgggagagggacggacatgtctgacgggaagaggcggcccggtcgcccggggcgttccgaggagccacgcatcgccccggaagaggacgaggacgcgacgcgggacattccgctcttcacgcgcccggaggagacgcgcatggggcccgtggagccccgcttcgaggaaacgcgcatgggccccgtggagtccttctcccacgaggaggacctgccccccttggagcctcccgcgctggagacgcggatggggcccgtcccggacgcgaggcccgcccgggcggggcgctcacgcagtgccgccaggagcgcgcggaccgagcctccagcgccgcctgccgaagtccacacggaggtcatgcctcagaaacctcccaggccgcgcggaggcccggaggcgaaggccccgagcgcccccgagaagcgcgccagcccgccgaaggccagtgcgtcccccgccagcgtgggcgtggtgcggctgagtccgctggagcccctgggcgcgaaggtggtggccgcggaagaggctccagcgctgcggacgatgttcgcgaaccactcggcgctgctggccgagcagctccgcgacgcgctgtcgacgaagatgtatggccgcggccctcaccgggtgctgcgcatcgacgagccggaagggcccagtaccgcgggcgggaagttggcgcggcaggccatctccctggtgcctcgcaagggcgcggggacctcgctgacgtgtggctgggtggacgtgtccaagcgtgaggcccagctccgcaacttcgaggcggtggcgaagcggtacgcgcttcaccacggcgagccgctggagatgcaggccgaggagtatgagcgcttcctcaccgacgtcgaggccgtgctcacccaggccgtcatcaaggtccgcgtcatcgtccccgaggaagcgggcgcggtgcgcgtcgcgagcccttccgcctccgcgaagggcgtcccgcccgtctgggcgggactgctggccgtgttggccttcgtgctgggcctgctcgcggggcggatgggctcaggcggctgagctacgccgggggcggggcctcacgctcccagtggcggcgggcgatggactcggtgaagagctggccgaagcccttcgtctccaccttcgcgctgcggacgacgccgcgcgtggcgtccaggcccttgctcggcggcgcctccaggtcgcgcacgcccgcggcgtccagcagggtgttggcgtccgcggagagcgccagcgccttgcagtgcacgtaggcctcgcgcacgaagtccaccgccagcggcacgcgcagcagggccgcgacgctcttctctccaccgggcacgtagacggcgtcgtacatgacggaagacgccgtggagaaggtccgcaggggccgctcctcccggccttcctggctcgtcaccgggctcagcgtggggcccaccagctccagcgtcgcgccgcgctcctccagcaccttgcgcacgccgtccagctccttgccggcgaacccgtccgataccagggccgcgatcttccgcgtccggatggagtcatgcggcgagttctccatgctcagcgccggggacacttccaccgagggtgccgccttcttgcccgcggccttggacggcttggggggcctggtcgctttcggcggcgtgacgcccacggcgcgcgccacgcgcacggccagctccgggtcaacgttcaccagaatctggttcaccacgcgctcgcgaatctccacgcgctccaccttgccaacctcgaactcgagcgcggccacgaggtgctcctgctccggcctcgacaggctcttgtagaagagggtggcctggctgaagtggtcgctgaagctgccgctgcgcgcgcgaatcttgtggccctccacgcgctcctgggtgtggcgaaaggcgctcgcggggttcgccagcaccgggcagccgccgcccagggagttggggtggtagttggcgcgcgacgtgggaatggtctgccgcccgaagccgtcctgctggtggttggtgacggggcacaccggcttgttgatgggcagctccgcgaagttgggcccgcccagccgcgtgagctgcgtgtccaggtacgagaagagccgcgcctgcatcagcgggtcattggtgaagtcgatgccggggacgacgttggccacgcagaaggccacctgctccgtctccgcgaagaagttgtccgggttgcggttgagcgtcagcttgcccacgcgctgcaccggcgccagctcctcggggagcagcttggtggcgtccagcaggtcgaagccgtacttgagctcgtcgccttcggggatgatttgcagccccagctcgtactcggggaagtcaccgcgctcgatggactcccagaggtcgcggcggtggaagtccgggtccttgccggacagcttctgggcctcgtcccacacgagcgagtggttgcccagtagcggcttccagtggaacttgaccaggttcgccttgccggccgcgttgaccagccggaaggtgtggacgccgaagccctccatcatccggaagctgcgcggaatggcgcggtcggacatcagccacatgatcatgtgcgtcgtctcggggacgagcgagacgaagtcccagagcgagtcatgcgccgaggatgcctgggggatttcgttgtgcggctcgggtttgaccgcgtggacgaagtccgggaacttgatgccgtcctggatgaagaagacgggcatgttgttgcccaccaggtcgaagttgccttcctccgtatagaacttggtggcgaagccgcgcacgtcacgcacggtgtccgccgagccacgtgagccgcccacggtggagaagcgcacgaacaccggcgtgcgcagggatgggtcggtgaggaagcgggcctgggtgtacttctccagcgacttgtagacctggaagtaaccgtgggcgcccgcgccccgcgcgtggacggcgcgctccgggatgcgctcgtggtcgaagcgcatcatcttctcccggaagtggaagtcctccaggagcgtggggccgcggatgccggccttcagcgagttgtccgtgtccgagatgggaatgccctggtccgtggtgaggaccttccccaccgcatgcatccggtggggttcgaggctttcgctcttgagcgtggtgggccgggtcttcgccgagggcttgcgcagtttcatgggagcctgtcgccaacgagagaggtgaaggcgccgtctacgctggccgcgtccaccctgaggcgatgaggcttggggggacgtcggcgagtcggcactcgcgcgcgtggcagtgtccaccaccgcgcgctcggacctcgtggcgtcaggcgtgcatcacggcacggcgggcgcggccacggcgggagcaccttccccggccggggcagcagcagcggcggcctcggtctccgcgcgagccttctcctccgctacgcgcgcggcctcagcctccgcgcgcttcttcgcgtcggccacggcgacgtccttcatggtcgccaggcccttctcgaagtccttcccaatcatggcctccatgtccatgagcaggctcatcgccttgctcatgaagttgttctcgccggacatggcccagacgacctgggtgccgccctcggcggcgctgaaggcgaaggtggaggtgttggtggcggcgaagggcttgatgaactcgagcttgatggtgacctgctcgttggccttgctttcggtgatggtcatccggccctcaccgacctggtcattgcccacccaggcgtagcccgcgcccgtgcctgactccgggcccgagtaggtgcgctgctgctgcgggtccagaccgtcccagggggaccaatccgtccagcgacggaagtcattcaccagcgcgaaggcgatgtccgcggacacggggagcaccgcggcgcgctgataggtgaacgtgtccggacggctgacgacgaagccgacgaacagcaggatgacggcggcgaggccgacgagaatcttcttgagcatggggagtgggtcctcaggaggcggcctgggatggccgcgctcctggcgcgcgtcttagagcgtgtccggcgccccacgcaacctacgcacagcacaacgactacgacggagattggttgcggctcagcattcgggaaggcccacgctcaggttggccacctccagcacgttggcggccagcccccctcgcgccgtctccttgtacttgtccttcatgtcgcggccggtgtcgcgcatcgtccggatgaccttgtccaggctgacgaagtggcgcccgtcgccgtggagggccatgcgcgtggcgttgatggccttcacggaggccatggcgttgcgctcgatgcacggcacctgcaccagtccgccaatggggtcgcaggtgaggcccaggttgtgctccatggcgatctccgccgcgttctccacctggagcggcgtgccccccatgacctccgtgagcgcccccgcggccatggagcaggcgctgccgacttcaccctggcagcccacctccgcgccgctgatggaggcgttctccttgtagagcacgccaatggcaccggcggtgagcaggaagcgcaccacgccgtcctcgttcgcgccgggcacgaagcgccagtagtagtgcaggacggcggggatgatgcccgcggcgccgttggtgggcgcggtgacgacgcggcctcccgccgcgttctcctcgttgacggccagggcgtagaggttcacccagtccagcacggtgagcgggttggtgaggccggcctcgggacggctgatgagcttctggtacatgcccgcggcgcggcgctccaccttgaggccaccggggaggatgccgccgctggtgcagccacggcgcacgcaggcctgcatcacgtcccagacgcgcagcagcccggcgcgaatctccgcctcgtcgcgccaggtcttctcgttggcgagcatgagcgagctgaagctcatgcgctcgcgctcgcagtgggccagcagctcggcggcggagtggaaagggaagggcagcggcgtggtgtccttgctcagcgggtccttgcccgccgcggcggcggactcgtcgacgatgaagccgccacccacggagtagtaggcggtcgatgccagctccgcgccgtccgcgccggaggcggtgaagcgcatgccgttgggatggaagggcagcgagcggcggcggtgcatgaccaggtgctcgccgtctcggaacgtcacctcgcgctgaccgagcagcgccacgcggccttccgcgcgccagcgggaaatgatggcgggcacggcctccacgtccacggcctccggtgtctcgcccatcaggcccagcaccacggccttgtcgctgccgtggcccttgcccgtcgcgcccagcgagccgaacagctccaccttgagccgggtgagccgctccagcacgcccgtgtccgccagcttccgggcgaacatgcgcgccgctcgcatgggcccgacggtgtgcgagctggagggtccgattccaatcttgaagaggtcgaagacgctgacggccatggcgagcgcaacatgccacgtttccagttccgtcccagtgtccctccgccgaagcgcatgtcaccgcgtggacggatgaacgtcattggaagtccaacgagcgcgggttgctcgcactccaggcgagagtcctcagtgccgtgcgcgtgtgatgcgctagacgcggtgcgttgtctggcccgctgcgtcgaagtggcgggctcaagcgacggcgcgctgcgggagccgaaggcgagcgtggcgcagttgaaggcgtcgctgccgcgtccgtgagctgctgacgccaaagacacgaagggccgggaagacgtccgtgggacgccggctcccggccctcgtgctgacggacggctactggtcgtcgcagggcgtgcccaggcgggcgccttcgtacacaccgagctcgttgtagatgagcggcaggttctcatccacgggcacctggcgcagctccaggcggcgcttggtgttttcaatccacatggcgggcttcgccttgtcgagcagcaggcggaggtcaccgcgcttggtggagaagatttcaccttcggagtcggagatgacgttggtcatcttctgagccttcaggttgccgcgcggcccgatgaagacgcggtagttcttcttctccgcctcgtggaagccacggtccacgaagtagtaggcgcccttggtgtcacgcagtagcgcgtagggcacgaacttctgcgggttgggctggaaggcggccttgcgcagcagctccgcggccggctcaccgtccagcatggtgagaggaatcttcttctcaccgcaggtcagggagcaggtgcgctcctt

SEQ ID NO: 1008 - DNA, 9867 bp, Myxococcus xanthus
  unsure (1)..(9867): unsure at all n locations
cacgcgcaggcggaagtagaggtcctgacggaaggacccctcctgcacccggcggggcaggtcccggtgggtcgccgcgacgatgcgcacgtccaccttgcggggccgcgtggcgcccactcgccgcacttcgccgtgctggagcatgcgcaacaggcgcgcctgcgcgggggcgggcagttcgccaatctcgtccaggaagagcgtgccaccgtgcgccgcctccacgagccccgggtgcgcggcctgcgcgccggtgaaggcgcccttctcgtggccgaacagctcgctctccagcagtccttcgggaatggccgcgcagttcaccgccaccagcggcccgtccgcccgggggctctgggcgtggagggcccgcgccaccagctccttgccggtgccggattcgcccagcaccagcacggtggccggggagggcgccaccttgcggacgcgctcgaagacctcgcgcatcgcggcgctgttgcccaccatgccgctgacggggtgggcctgctccacctcgcgcttgagcgccgcgttctgccgcgtcagcagtccttcgcgcagcacccgctccacctgcatcagcagctcgtcgtggtcgaagggcttggcgatgtagtccaccgcgcccagcttcatcgcgtccaccgccgacttcacggtggcgtagctggtcatgatgagcaccggcacgcccggacacatgacgatgatgtccgtccccggggcgcccggcaggcgcaggtccgacagcaccaggtcgaacgagtccagtgggtagtcgctcgacgcctcgtgcacggagcccgcttcggacacgtcgtgccccgcgcgcacgagcagccggcgcagctccgtgcggatgatgggctcgtcttcgatgaccaggatgcggctcatgccggggcctcccgctcggggttcacgctggcttccatccggcgtggctccggaaggctcaccacgatgctagtccctcccccctgccgcttgtccacctgcatcgttccgccgtgctctcggacgatgcccgccgcgagcgccaggcccaggcccgttccctcgccggggcccttcgtggtgaagaagggctcgaacacgcgctgcgccagctcggtgggaatcccgtgtccccggtccatgacgcgcaggcgcaccgcgctaccgtcgatgtccgcttccagctccaccacgccgtgctcgggtgaggcgtccatcgcgttggtcagcaggttgacgagcacctgctccagccgctgcgcgtcgccttgcacctccaggccctctggacagcgatgctcgaagctcaccccatgctgcttgcgtgccagccgcgccagttgcacggcttcgctcagcagtggcgccacggcgacgcgcgtgaagggccgcgcctgtccgcccaccgtgccttcgtggctgaagcccaccagcgtccggacgatggcgtcgatgcgccggcattgctggaggatgagccccgcgcgctcctgcaccgccgccgggtcctccaactcgtacttgaggttctgcgtcaggctggcgatggccgtcagcgggttgccaatctcatgggccacgcccgcggccacgcgccccagtgaggccagccggtcctgatgcgccatgcgcgcgtccacggcctttcgtgccgtgaagtcctccaccaggagggccatgccctcggacgagcccgtgccctgctccgcgggagagagccgcgagcggtgcagccggagaatgcgctcgacgcccgccacggtgacacgtgtctccgtgtctccgtccacaccgctggcgaaaccggacagcagcgggccccagggggcgggcagggcatccaggggatggccacgcacggtgtccaccggcacgccggagagctgctcgagcgtcgcgttccagatgacgacctcaccatccggccccacggcgcagacgcccaccgggaggtcctccaggatgcggcgcaggtagcggcgcacggcctccagcgcgggcaccgggccttgcagtccccgcgcgtcgcgaaggcgctcctcgacgaagcggagttgttcggccagggcggtgcgcgcgccgggctccagccgcagcgcctcctccaccgttatgcgcgcgagcacggggcccagcagtcccgacaggtttcgctccacgccgtcgcgcaggcggcgcagctcggagggccggcgctcgtcctgcggcagcgacagggaattcagcgcccggtccacctccgccgtcgcggcctcctcacccagcagcggggccagcttgcggcggaactcgtcgggcgagcccgccaccacgccgcccgcggcgggcgcggcctcctcgcgtgtgcaggcccgcgcggcctctgcttcctcggcggactggcgcgtcgccagcgacacgccgatgaaggccagcccgttgagcgtgagcgaggcgaaggtggcgaagccccagggctcactgtcggagaacccgagcagcgccgccatgcgatgcgtccacgcgacgacgcccggcgacgcccacaggggcaccaccagtgtcaggagccagaggctggcgcccaccgccaggcccgtcagcagcccggcgcgcgtgccccgcttccagaacagcagccccagcacgcccgggatgaactgcgccaccgcgacgaaggacaccagccccaggtccaccagtcccgtgccgcggatgttcagcagccagtggaagccgtagccggccaggatgatgatgccgatgaacagccggcgcgcccacagcagccagccgtatagatgcggctgcccgcgtgcgtagcccagcggcagcaccaggtgcgtgaggcacatgggcgccagggccagtgtggtgacgatgaccatggcgctggccgcggagacaccgcccaggaaggcacccagcgccagccacgtggcgccgcgtgacgcgggcaccgccagcacgtggaagtccgcgggccagggcagtcccagcgcctcgccgctccagagcaccacggggacgaccaggttcatcaccagcaacagcagcgggaaggcccaggtggcggtggccagtccctcacgctccggggcctcggtgaaggccacgtggtagctgcgaggcgtgaggaacgcggccgcgcaagagagcaccagcagcggtgcccaagaggcgtctcgcgccgggcgctgaagtgcgtcgatggcctctggatgcgcgtcgacccaggccaacagcccgtccacgccgccgaacacgttggagaccgcccagacacccacggccaccagtgcgacgagcttcaccgcggactcgaaggcgatggccagcatcaggccttcgtgccgctcgcgcggagtgaggtgccgtgcgccgaagaggacggagaagacggtgaggaccgcgcagaagcccaggcccaccagcgtgggagacgcggagggactgagcacgcgcgcggactccacgacggcccgcacctggagcgccagataggggaggctgcccgccagcaggaacagtgtcaccgccgtaccggtggattgccccgggtagcggaaggccagcacgtccgctagcgacgtgagctgcaactcgcgggacaggcgcagcagcgggcgccacagcacgggtatcagcaggcacgccagggtgacgcccaggtagatgcccaggtagcggaagccatgccgggccgcgtagcccacgctgccgaagtaggaccacgatgtggcgtacacgcccagggccagcgcgtagacgagcggatgctgggtgatgcgcgcggggatggcgcctcgctccgccgcgtaggccaccaggaagagcaccagcaggtaggcgacggacgcggcgacgagcgaaccgagctcgagcgtcatgggccacgactccggtgcgccgcccagccgcccaggaggatgacgcccagccacaccgcgaagggcaggtaccccggcgcgccctccgccagccacagtcggcgcaggggagagccgaagaggagcaccgcgacggcgaagacgagcagcgacggcatcacgggggcgtcgggctcggtagggcgcttcatggtggcgaggataccagccgtgtcgccttcgggtgacgaagccaccacgtgcgtcgtgtggacgcggtgggcctgttcgccgggcgcgggaggagcatcctcacggcgcacctgctgtccggacgtgggcgcacgggcctgcctggccgtggattgaggctcgacaggcaggccgggccgtcctgagaatgcggacggccgagcggcgcctgcgtgcgccatcggggaacggagatgtgcgtggagacgcagcctggcgactttggaccgccgcgagacgaacgtgagatggccgccgtcgcggacatcatgatgcagtcgtatgccctgtcccccgcagacatcgccgcctgggtgcagcgggtgtcgcggccggacctgcggttgttgcgcgagggcggcgaggtggcggccacgctcgtgttcatccgcatggggcagtggtacggcgggcgcagcgtgcccgtcatcggcgtgggcggcgtgggcgtgtctcccgtccaccggggacgcggcaccgccacgcgactgatgcagcacctgctgcgcgaggctcgcgcgacgggcgctccgctgtcggtgctctatcccgcgacgcagccgctctaccggcgcgtggggtacgagcacgcgggcacgcggcaggagatccgcatccaggtcccatcgctgaacttcagtgagcggacgttgtcgctccgggccatcgaggagaaggacacgcaggccatcgtcctgagctaccagcgccacgcgcgtcaccggccgggctggctggaccgcggggacttctcatggggccgcgttcgcaacatgcgcggcgaggtggcacatggctacctggtggagggcagcgccggtgtggagggctacctctacgtcatccgccggcagctcaaggacttcaatcaggagctgttcctcaccgacgtcgtggcccatacgcccgcggcggcgcggaggattctgagcttcctgggggaccaccgttccctggccacggatgtcttctggtacggcggcgtggacgacccgctgctcctgctgcttcgcgagcagacgtacgcggtgaagcaggccacgcactggatggtgcgggtgctggacgtggcctccgcgttggaggcgcgcggctggccggagggactctccggcaccctccatctggacgtcgaggacgacctcttcccggagaaccagggccgcttcgtgctggaggtctcggacggtcaggcgcgcgtgcgccgtggcggcgacggaggcctgcggctgcacgtgcgatacctggcgccgctctacaccggtcacctgtccgcggcgtcgctgcgggccatgggcgcgctggagggtgatgatgcctcggtgcgcgcggcgggcagtctcttcgccggggcaccgccctccctgcgcgacatgttctgacccgggccgggcgctctatcgggcccggcgcgggagtgctaggagcgcaagcagtccttcacaggagcgtgcaggcaatgcgggcattcgtcaccggtggttcaggcttcgtgggcaggcacctcctcaccgcactgaaggtgcgcgggacgcccgctcgggccctggcgcgctccgccgcggcacgggcctcggtgacggaggccggcggggagcccttcgagggcgacctgtcggacgtggagaagctgaaggcgggcatggagggctgtgacaccgtcttccattgcgccgcggtggtgaagggctggggcgcgcgcagcgagttctacgagacgaacgtgcgcggcacggagcgggtgctggaggcggcgcgcgccgcgggcgtcaagcggctggtccacgtcagcacggaggcggtgctggcggatggctcgcccctggagcgggtggatgagacgatgcccctgcccgagcgccccatcggcgactatccctccaccaagggcgaggcggagcgccgggtgctcagcgtgaatgcgccggacttcgtcaccgtggtggtgcgtccccgcttcatctggggcgccggtgacacgtcactgctgccgcagttccaggaggcggtgcggaccgggcgcttccggtggttcggcggtggccgttacctgacgtccacctgccacgtggccaactgcgtggagggcatgctgctggcggcggagaagggccgtggcggcgaggcctatttcctcaccgacggggaacccgtggagttccggggcttcatcaccgccatgctcgcgacgcagggcgtggacgcgggcgagcgcaccctgccatacggcgtggccgcgacggtggcctcggtgggggacttgctgtggggcaccttcggcctgggcggcaggcctccgctcacccgcaccgaggtgctgctcatggggcgggaggtgacggtgcgggacgacaaggcccgccgggagctggggtatgagggccgccgctcccgtgaagaagggctccgcgagatgaaggcggagcatcaggacacggcgtcgcgtatgctctgaggcatgcgaaggttcgagttcgtggaaggctccagctccaagttctgggagccggagctcaagggcaacaccttcatcgtcaccttcggccgcatcggcaccgccggtcagcggcgggagaaggctttcgcggacgaagccggcgcccggaaggaatacgagaagaaggtcgctgagaagctgcgcgagggttacctcgaggtgacggagggcggcgccgccgaggccgcgcccgcgtccgcgccaccgcctgcgccgaagaaggcggagctcccccgccgcgtgcccgcggccacgcccacgcccgagtcgctgaaggccgccgccgaggcactggccgcgctccgggcccggctggggtggcggagctgggaggtgacgtcgcgggcccggcgtgcgaagcgcgcgctgcgggccctgggcggcgtggaccccgcggcccactcggagctggcgggcaccttcaccgcgttgatggagcgcgtcgtcgctccgaagaaggatggccggctcccgctgcggcacgcgctcgcgttgctgggcgaactggacgtggctgccttcacccgcgctgccgaggtgtggctcgccgcgccggacgccgttcccgccgcgacgaccgtggcccggcaggcgtcggcgctggggcagcccgagctggcgctgcgcatgggcatgctgctggcggagcgtcccggtcaggcgggcgcgccttccgaggaggggtggagcaagcggtggacgcgcctgcggccgcacgtggaggagcagctgtcctccagcggcggctcgctggccagttgggcccagtccgtcgatgcctcgaaggacgcgcacctggccagccggttggcccgcctggaggcgtgaggcgtcggcgtcactggctttcaggagcgcgtgggagtgccccacgcgctccgcgagagacggtgggctagcccgggccgccgtcgctgggcgcggacgacttcttggcggcgccctggcccgaggacgggacgctgtcgggctgacggtccatctccgccgtcggataggcgcgcgcggcatccaggtaggactggggcttgatgcgccggcgcatgcgccacgacaggttgtcgggctgcacgagcacgggctcaccttcggcgcgctgctccaccaggtgtccgtcgcagaagcgccacagcttgcggccgtccacctcctgccgcgcgtagaacaggtccgtctgccccacctgggggttgggcgggcaccaggtgcggcgggcggcctcctcccgctcgggcatctcctcgcgccactgccggcgggcatccttcaatgccacggcggccagcaccttgggcccttcttccagccggacatccacctccgtcagcaactcctggccacgacgggcaatctccgggaaggccccggtgttgcggaagccgcactccttcagccggttgagcgtgtagcggtgcacctccatgatgggcggaagtgagccggtggcctcccgcatcatcgccagttggcgagcgtggtccggcgcgtccagcttggagagctgctccgtctcccggaggaagcgcgccatcgtactgttcaccgtcgtcagctcgtccgccagccaccgcggttccgaggacgcacaggggtccgctttcgccttcttgtagtcccggtactccgcccgagacatgccgagcgaataatgctccaccggaggagcgggcttggtcgcgcacgcgctcagcgccgtgcccaggcccgcaagcacgagctgccgaatgtttggcgtcatccgcccattctggcatgtcatttgtgttcaaacaaacgtgcagaagcggacacttcgggttccaggcctgggttccgaggcggacgtgccgcccctgtacggcgtcgcggaggttgcctacaaggatgctcaggcgcagagcacccgttcccagaagtgcgagccggtccatgaagcccgcggtcctcatcatcatcggggtgctcactgcgttgggtggggccctctacctgtcttcgcggcgcgccgcggagcgaacggaagaggcgcgtcccgcggcgcaggcgcccgtatccacccgcgcggtgcggacggaaatcacgttcctctacagcacggagaagaaggcgtgggtggaggaggccgcggcggacttccagaaggcacatccgctcatccgggtgaacctggtgggccggggctcgctggaggccgcgcgggccatcctcgaaggcagtgagcggcccaccgtgtggagccccgccgacagcgcggtgctgcggatgctggagtcggactgggccacggacgccacgcgcgagccgctgttcgccacggagggcgaagcggcgccgcggccgttggtgaagacgccgctcgtcttcgtggcgtgggaggaccgggcggaggtgctccagcgcgccagcggcgggggcgcggtgtcctggaaggtcatccacgacgcggtgtccagtgaccagggctggcccgcggtgggcggccagccggagtggggcttcgtgaagctgggccacacggaccccacgcgctccaactccgggctccaggcgctgctgctggcgtcgctggagttctacggcaagcagagcggattgacggtggccgacctgctggagccgcggttccagacgtggctgagccagttggagcgaggcacgggccgcttcgagcagtccacgggcacgctgatggcggacatggtccgcttcggcccgtcccgctacgacatcgccgtggtgtacgagaacctggccatcgctcagctctcccaaccgcaggggacctggggggcgctgaaggtcctgtacccgacgctcacgtcctggagcgaccatccggcggcggtgctggacggggattgggtgctgccccgccagcgtgaggccgcgctggagtggctgcgctatctgcacagccggccggtgcagcagcgcgcgctggccttcggcttccgccccgcggatgcctccgtgccgctgacgcctcccggagaggccagcctctttcccccgctggccgcgcggggccttcaggtggacgtgccggacggcgcggcagtccctgatggcgcggtggtccgcaacctcctcacgctgtggacgcggtgggtgggcaacgcgcggtcgccgtagcccgtcgcttcgcccgatgctccgacatcagccgtcgagcgccaccaggtcgatgaagccgcgaatccagatgagatttaccgcgtcgcagacgtcacgcggtgtcggcgtcgtcgtctccagcgcggnccgtgtcggcacgccctggcgcgagta

SEQ ID NO: 1009 - DNA, 14330 bp, Myxococcus xanthus
  unsure (1)..(14330): unsure at all n locations
tccgcgtccgttgcttggagcgacagcgtcactgtctcggtcttccccgttttggggctcacgagtatcgaacgcgtcatcacgggtgtcgcttcgcagttctgctcaaatgcacgcgcctccacttggacggagtcgccccaactgctcggcgcaaacacactggcgacgagggaccctcctgagcggtcgcccttgccggcaatctcggcggtggacgctttcccactggcttcgtcccgggcactgacgagcacgcagccaggaaggaaccccgagtagtcgatcgacactttgagggctctgcacgtcggcctgtcacccaggaatgcgtcgacggagtcgcccatgaggtcattgatgtcacatgggtggagttcgtcgaggctgggcacggtgcaggccatgccggacaggagaacaaggcacgccagaaaaatgcggttcatcgcgcctcccgctgcgccgtggcttcgttacccaggaagtaggtgatgaccgctcccgccgccgctgtcgccgcgacaccgaacaagatgttggcgccgagcgccttgccgcgcgccgcgtccagatgtcccatctgctcatcgatactgaaggtgtctcgcgcgctctggatgtcgctccgggagcgcaggccgaggtagctcccgatgccacccgcgagcacccctgcgccaagcaaggccacggggaggggacggatgcggaggcccgttgactcatgtgccatgagttcgggctcggcgctggtgatgagtgaaggggttggcgcaccaggtgatggtgtagcgacggccaacgcggttccctcgggttcgaggacggggcggtcctgcgaaagggcgggcggtggctcgacgggggcccgaagccacgcgttcgctctggagattcttgcgtacgtcgtcgaagtcccgagccaccttgggagagaccctgacggggagctgggagtctggttgaagtgaaagggcttcgcggaatgcgcggagggactgtgagcgtctcccgagatcggcgaggacgatggcttcgtacatcgcggcgtctgcccgttcgtcgtccgtcgtggccagtgccttggcctgggtgagcgtcttcagcgcctgctcgtactcaagttcctcatagagctgcgctgccgccttcagccgtgcgcgaaacgaggagtcgcgcgaactagcttgcgcggctttggccgtcacggtttgcccgagcgccaatcccggtagcagaagcgtgtagctcagcacccatacctggagcggtgctttcttgagagtaaagctttccatgaatggaaaggctaccacgctcgttcgattgtctaagaaagggcgtgcaaaatgaagtgcccgcgtagttcctgcgaggcttacccaacagcgcaagcttcgccaggccatgcgtcaaggagtggcacttcgatgcgtgtcgaggatgcccgtcgccagtttcaggagcttcgttcgcagtgcttccggcgcgagcacctcgaattccgagccgacgtcgcagagctgactgaaggcaatcgcttctcgctcgaagtccacaaccactgtcttgcgcccatccgctgagcacggcgcggaatcaagccgtgcaccctccgctcgcggccgaatcttccgcagcgcctccagcgcctccggagtcaagcgcagcgtgacctcgtactgcgcgcgcttctccgcgaagcgtgagcaccacgccttccagaatgcgggcaggtcgaagcgcgccggccggatgaaggtctccgggcgtatccgtgcaccgtccacacgcgagcctcgatacacacgcggttcatcctcgcccgtgctcgcgacgaggtaccaacggtccgccttgatgacgagcgcgtacgggtccaccaccttgcggctcggcttgccttcgaagtcccggtacgtcagggacacgcggcggtcctgccagaccgcgtcgcgcagcgtcgccagatgaggcacggcctcgcgttctggaaaccacgaggacgcatccacgtgaagccgctggcgtgcgtactccagcgcgggttgctggagtgcgggcagggaggccgccatcttcaccagccccgaacgcagcgccgacgtcaggcccaggtcatccagggcccccggtgccgccacggccgccagtgcatgcagctccgcccgggtgaagcccgtgagttgggtacgccagccttccataaacgccacgccgcccgcggagcctcgggtggcgtacacgggcacgcccgctccggagagcgcgtcgaggtcccggtgaatggtccgttaggagacctcgagctcccttgccagatcgcccgccgtcatctttgggcgtgtctggaggagcagcgtcaaactgacgagtcggtcggcgcgcatgggcaggtctcaaagcgaagtctaggcggggaatcatgacaggggatgtcaggattccccgcctagggtgcgaacacgaacccactgcggtccacggtcgcccgtgggcttggaggagtgcccgccatgaagccactcgaaggacgcgtcgctctggtcgctggagccacccgaggcgcggggcgtggcatcgccaccatgttgggagaggcgggcgccaccgtgtactgcaccgggcgcagcgtgcgcggacggcccgcgacgggctcgcgtccggagaccatcgaggagaccgccgaaatcgtcgacgccaagggtggccggggcatcgccgtccgcgtggaccattccgtcgaatcggaggtcgaagccctttgcgcgcgcatccagcgggagcaggggcggctcgacatcctggtgaacgacatctggggcggcgacggactcaccgagttccgcccggcgttctggaaacagtccgcccggaagggcagcaaatgttcgaacgcgccggttttacgcacctgctcaccagccgccacgccgtgccgctcatgctgggcggtgagcgggggctcatcgtcgaaatcacggatggggactcgttcggctaccgcggcaatcctctgggtacgaacctggggtcaagaatggtccggtcattccgggcttcggcctttcggggaatgttccttgggaaggtttggccgccgcaccgaagggttcaccggcggctggcggctagatcgcccggcttcctccgctccgaggagatgctggagaacttcggcgtcacggaagcgaactggcgcgagggcgcggcgaaggatccgcacttcatcgcctcggagagtccctgctacgtgggccgggcggtggcggcgctcgcggcggatccgaacgtgggcgccaaggccggccgcgtcttcagctcctgggccctggcccgcgaatacggcttcacggacgccgacggctcccagccgcattggggcgactacttcgcgcgcgctttcggcaggccgtaccaggtcgcggacgaggacgcctacacgtcctggcgcgacggccccatggagattgccagcccggattggcccctgggctgagaggccaccgaatgagtggttgcctacctgtgtctacatggtgcctgcactctgacggggagcggccacccaccgccaccgggcgaccattcaggggccgaccgtgacggttggggcacgcgcccgtggacggcgcgcggcggcatcgctagggtgcgcggcttcatggaacgcccttcagtgatttccaccctggaacaagccgtcaaggcccggccgatgccgcgccacgtgggcatcatcatggacggcaacgggcgatgggcggagtcccgagggctgccccggctggaggggcaccgggaggcgacgtcgagtgtgcgtgaagtgacgcgcaccgcgcgccgcctgggcatccaggcgctgacgctctacgcgttctcgtcgcagaactgggcgcgtccggcggaagaggtcgccggattgatggacctgctccgggagtatctggagcgcgagcgctccgaaatcctggacaacggcattcgcctcaacgccattggagacgtggaccggctgccgcgctacgtgcgtgatccgctggaccggctccgggccgactccgcgcacaacaccggcatggtgctgtcgctggcgttgtcctacggcgggcgggaggaaatcctccacgcggcgcggcggctggccgaggccgtggagcgaggcgaactggcggcgggacggttggaggagagcgacttcgagcagttcctctggacgcagggactgcccccgttggacctgatggtgaggaccagtggggagctgcgcgtgtccaacttcctgctctggcaaatggcgtacgcggagatgtgcttcaccgacgccttgtggccggacttccgtactgacgagttccttcgctgcgtgtcgcagtaccagcagcgtgagcgccgcttcggcctcacgtccgcacaggtgcagcgggaggacgctcctcagcaggccaaggcgtgaacgacaagaaccgaaacctcgtcatccgcgtcgtctccgcggtgacactgctgccgctggtcctcctgctgctgttcctcggtggttactggagcgcggccctgctgggcgccgccgccgccgcgtgcgtgggtgagtactacctcatcgtccagaagcgcctgacggtggcctcgtgggttggaatggccttcgccgcggtgctgcctttcctgcccatgcgggacgcggcgcgcacgggcgagacggccttctggctcaccatcgtcttcgcgttcttcgcgtggatctaccacctcttcaagggaccgctggcggaggcgcccacccgcacggcgcacctggtcaacggcttcctctacggcgcggtgggcctcacggccgtgtccgcgctgcgcctgttgcccgaccacggcttggcctgggtcatctgcgcgctggtcatcacctgggccaatgacaccgccgcctacttcttcgggcggttcctggggaagcacaagctctacccggaggtgagccccaacaagacctgggagggcttcttcgggggcatgctgggctcggtgggcggtatgttcattgcccggcagttcttcttccccgtgttcacggtgtgggactgcgtgctgctgggcatcgccggcggcatcctggggccggtgggcgacctgtgtgagtccatgctgaagcgggcctacggggtgaaggactcgggcgtcctcatccccgggcacggtggcgtgttggatcgcatcgacgcgctcctgttcaacgcgcccctggtgttcgtctacgtgcagttcgtccggggtctgctgccctagggaccgccccttccggctgcccgtctgctcggcgggcccggttgcgcgttgtccgcctgggcgcccacgattactgttgcgcccatgctccaaaacatcgggttcttcgtcattctgctcggcgtgctcgtcacggtgcacgagcttggccacttcctggtggcgaaggcctgtggtgtgaaggtcctgaagttctccatcggcttcggacccaagttgatcggcttcaccaagggcgagacggagtaccagattgccctgctgccgctgggcggctacgtgaagatggcgggcgacatgccccacgaggagctcagcccggaggaggccagccggggcttcctggcgcagcccccatggaagcgcggcctcatcgtcctggcggggccggccttcaacctcatcttccccatcctcgtctatttcttcgtcttcctgggcccgcaccaggccacgtccacctacgtggggacggtgagcgagggcatgcccgcgcaggccgccggcatccgccctggagaccgcatcctgtccgtggatggcgagccggtacgcacgttcaacgacatgcgggaggcgttcgtcggccgcttcgagcggcccgtccccatcgtcctggagcgcaatggccagaagctgacgctggacgtgacgcccacgaagaacgtggagacgtcccccatcgacacggtggagcgcggctccattggcgtggaggccgtgtcgaagccgcccatcgtcggcgtgccgccgggctcggtggcggagcaggccggactgcggaccttcgaccgcatcctggccgtcaacggcgtgagcgtggagacggaagcgcgcttccagcaggagctggacaagcacgcggagggcacgcccctggagctcaccctccggcgcatggactccgtggcggcgggcgtcgtgacggggcgggtaccctccgtgctgaagctcaccgtgccgaagcagccgggagtggggctggcgacggtgggcgcggagacgtccgacctgtacctggccaccgtggcgccggggagcgcggccgagaagggcggcctgcggcccggagaccgcatcatcgccctggatggcgagaagccggagtccttcgtcaagttctcctcgaagctgaacgccctgaaggagcgttccttccagttgacgtggcggggcgctgacggcgagcgcacggagacgctggcgcaggcgccgctgaagacggaggacgagatgggcacggcgagctcgcccatcgtcctgggcgtgcgcaactgggtgctctccgcggcggacatgccggtgctggacgaggtgacggtgcatctggggccgggcgccgcgctgaagcaggccgcgctcatcgtcccgaagattgtcgggcagatggtgcgggtcctcggcgggctgctggtgggctcggtgccgatgaacaccgtgggcggccccatcatgatgtaccaactggcgtcgaagagcgccgagcagggcctggacagcttcctccacctgatggcgctcatctccatcaacctgggggtgatgaacctgttgcccatccccgtgctggacggcttccacctgctttccgccgcctgggagggaattcgccgccgccccatccctgttcgcgtccgcgaggtggccaacatggtggggctcgcgctgctcgtcctgctgatgctgttggccgtgaccaacgacatcacccgctagaggacgcatgcgaggaatcgccgttgccggattgctctgcttcggtttcacctccgcgtgcgcctcgcgcgcggccaggcccgacccggtggaggaacccgtccgcccgtcgaagtcgccgaagtcccgcagtggtacgcccggcgtggcgcggcgcgagcagatgccgcgctcgtacctgggcgaagggctggcctcgttctatggccccggcctgcacgggcggcccaccgcgagcggggagcgcttcgaccaggaggcgatgacggccgcgcaccgcaagctgcgcttcggctcgtgcctgcgcgtggtgaacatggagaacgggcgcgcggtgaaggtgcgcgtgaatgaccgggggcccttcatcgacgggcgcatcgtggacctgtccaagggcgccgcccggaagctggacatgctggacaaaggcgtggtgcgcgtccggctgtaccgctgtgcggaccgggtgtcggagattccgcaggaaatgtgggccgcgccggtgtagtgagccgtcccatgttcctctcgctggacacctcgacgttgacgttgtcgctggccctggtggagcgagcgccggatggcgcgctgcgcacgctggagcacgtggtggtgggtccgccgcggaagcagagcgagctgctgcccggcatcgtcggggagctgctcgaacgccatggcgccacgctgcccgccctggaggggctggtggtgggcctggggccgggctccttcacggggctgcgcatcggcctggcgacggtgaagtcgctggcctacgcgacgaagctgaaggtggccggggcctcgtcgctggcggcggtggcgctggagggccccgagggcgtgccgctgtactgcctggcggtggcgcgcaaggacgacctgtacctgggggcctacgtgcgccagggcgggacggtggagccgctggagccggagacggccatgtcacccgcggaggtggccgcgcgcatggccgccgagccccgggccgtggcgctggggcccgcactggtggactaccgcgccgccctggagtcgcagggcgtggcgccacaccggctgctggcggcgccgaccttcccgtcggcggtggcgctggcgcaactggcgcgctttccggaagcgcagtcactggaggcgctcttcgccatggagccgcactacgtgcgggcctcggagccggagcgcaacccgaagttcccgccgctgcccgggccggcgcccaccgcacggttgaaggaagactgagccgcctcgtggtgctcgcgctcccggcctccggtggcgtaaaggacgcgccatgagagacgacttgacgattggcgtggtgggcgcgacgggcgtggtgggccgcgaggtgctcgccgcgctgtacgcgcaggacgtgcccgctgaacaggtgcgcgtcttcggctccgagcgctccaagggcatggaggtggagtacggcgaggactcgctcgaggtggagcaggcgacgccggacgccttccggggtgtgaagctggtgctgctcgccacgcccgccgaggcctctcgcacgctggctccggccgcgcaggccgcgggcgcgtgggtggtggacgccagcagtgccttccgaggtgacggcaacgtccccatggtgctgccgggcttcaacacggatgtgctgggcgcgggcttcaccttcaagggccgcatcgtgtgcctgccgggggcggtgacgaccgccgcggtgcacgtggtggagccgctgcggaaggccttcggcgtggcgcgcgcgcaggtgacggcgctgatggcggcgtccagcgcgggtgtgcgcggtgtggcggagctggagaagcagacggcggacctgctgtcgggccgcgagccggagccgcacgcctttccccaccgcgtggggttcaacctggtgccccaggtgggcggcttcatggtgaattcgccctggacggaggaggagggcggctggacgctggaggcggcccggctcttctcgtccaagggggatgtgcccgtcatcgccgggacggcggtgcaggtgcctaccttctacggccatggcctcaccctcaacgtgcagctcaagaaggcgggcccggtggagcaggtgcgcgcggccctcaagacgtccggggccttgaaggtgctggatgtgcccggtgagcgtgtgtaccccatgcccatgctcgtcacgtccgacccggcggtccatgtgggccgggtgcgcgcattcccccaggcgccggagtgggtgacgctcttcgcctcggtggacaacgccagccggggcgccgccctcaacctggtggaagccggactccgcctggccgagcgccccgcctgacaatttggcaaagcctccggggccgtcctgcctgtttggcgcggcgggacggccctcccggagtgatgcccagcggacgggaaggcgtttcatgtggcctcccgcttgctagcctgggcgtacccatgcgcctcactctcgttggcctcttgctcttcgcgtcgactgccctggggcagaccgtgacgttttcagcctcggccgaaatcctccagaacgatcagattgtcgtctcccaggagaactgcggcttggaccgcacggtcaactggacgcgtgtcgccggcaattgcgacgtgctccacctctggctctcgaacgaatcgagttgcacggggacgccaggggcgggcgacctgtctctcgctgatatcccggtaaatgatactcggctgacggggacggtgaccttcaacgcgtccgacgcgctggtggcggacggcgccaagtgcgagtcacagacgtcaaccaagacgttccggctctgcgccacgaccaagcggctggggactttgggcggttgcgacgactcgttcgtttcggttgggacgccctccatcagcttcatctatgacccggagccccctgcggtgccggagaccccgagcgtcacggggctggacgccgcgctgagtgtctctgtcaaggtgccgagcgatgcggtgtccatggaagtgcaggtccttcagtccgttccgggcgaggacggtggtgtgggcgcgggtgaagtgatttcgaagaagcggcaggtttcgtcgaacgcggtcttccgcatggatcaagggctcgagaacggcgtcgagtatgccgtccaggcgattgccatcgacagggcggggaaccaaagcgaaccttcgcccgcggcgacagggacgcctgttgcgagcaacggcttctaccaagggtacctcggagccggcggcgcggagacaggtggctgcgccgcggcgggtggtggcatcacgggatgcgcgatgctggcgtccctcggagtctggctgtcgtcgaggaggaagcggtcatgagtcgggcatcggccctgggagtcgtggcgctgctcgccacgctgcccgcctgggggcaggacacggtagtggtggaggaggaagcntcnnntctctcgccactgttcgggcggcattcaattccgcttgggtggctacaagcccctcatcgacgaagagtccggcctcactggcacgccgtacgaggactactttggcggcgagtcgctgctgacgttcgaggtggaactccagcgatacttctaccagggcgtgggtacggcgggcgtgggcttctctgcgggttacggcgagaagtacggaacggcgaagctggcctccggtgcggacgccgcggagcgtactgcgctgcgtctgattcccctgagcctcaacgcattctacaagttcgactacgccgccttcgagtggggcatcccgctggtgccttacggcaagctggggctcatctacacgccttggtggatcctcaagggcacgggcactgaggctgtggggggcaaccggggttcgggcggcaagtggggctggggcgcaacgggtggcgtggccttcttgctggacgtgttggaaccgcgcttcgcgcgcgacttcgactccgacctgggcgtcaaccacagctacatcttcgccgagtacacctatgcggatgtggacaacttcggcgggccggggctgaacctgtcgaaccggcgctggatgttcggactggcgctggactactaagcggctcatgccgctcattccgcgccgccctgggtctcttgtcgcgctcctcctgttgacggtcgccgtgggcccctgggcctccggctgccgtcgcgcggtgcggccggacctggggcaggaccggacggtggaagcgggcgtgccggtcgacctcggctcgcagcgcgaggacgccaccgccgtcacctgggacttcggtgacggcagcgacgcccagacggcgccgtgggtgtctcacgcgttcactcgggcaggcgcctataccgtgcgcgccctgcacgagggcgcggaggttggccgcgtccagttgacggtggtgcctcggcccgtgctgcgcgcggtgccctccagcgcgcgcaccgtcatgtggctgcccgagctgcgcggccacgtggagccgctgatggacttctacgcgcggctcgtggggccggagaatgcgcggcgggccgtggagtcatctccgctgctgccgctgctcttcgcggacctggagaacggcaccggctcggtcgtggaccccgacgagggcttcggcttcttcctgctcccggagttcgacggcgtcgtgacgctgctgggcatcacggagccagaggcggccctgaaggccgttgccgatgagctggagcgggcggggcacggcgtgatgccgcagccggacggctccgccaccgtggagcccgcgtcaggcgggcccccgatgttgctcttcgaggaccgaggctacctctatctcgccgtaccggaggggctggaggagcccgacgagggcgagtctcagcaggcgcaggtgctggccattcccgacgcggaagtggcccgccaggcggtgcgaagcctcacggggccgggcatctccgaggacgtgctcctgaccgagcttcgagggaaggtggcgagcggcagcgtgtatctcttctccgggctgcagcccggagtggcgcctgatgaagaaggcacccagccgattcggggcttcgccgcgtcgctggcggtgaagccggagcggatggacctggatggcttcctgtcctcctcgacaccgttgttccagggcgcccgcgcgcccgcgtcggcgttgctgaaagacgcggaactggggcccatcgccgcggcgcagatttccgtgccgcccgaggagctggctcggctggcgttcggtgcgccgggctccgagcgccgcgagcgcatggtggcgtcctggcgtcgtgaaggactggatgtggaggcgttgctcaaggcgctgcgcggcgacgtggtgctgcgcgcgtacttcgacatcccggccttcttccgcaacttcatccggaacaagcggcccgacatcaagggctccatcgtattcgaagcggggctgatggagtcggagcccgtgcgggcgctcgtgcagaagcaactggaggactccgtgctgcgctacacgacgcagcaggaggcgaatggcacgctcttccggacgcggattcgggagcatccggtggagctgcgcatcacgcccgagcgcgccagcctgctggcgggggagctgctgcagggccgtcctcgcggagacgtgggcgccgagctgcgggagcgcttcggtggtgaggccttcagctcgggccatgtgtcggtgatggtggacctgggccggctgcgcgcggacctgcgcgcggcggagaaggtgcccggagtgcccaatatgctgctcggggcgacgaaggcgctttcgggggcgctgctggatcggattacgccgctggactcgggcttcctcgacttcagcccggtggagggcgggggccggctcaagggacgcctgtccttgcgcgcggagcaggaggcttcgcgttgagcgggggcatggcggacgccaggaacgtgcgcatcaccgtcctctatttcgccgcggctcgcgagcgcaccgggcaggtgcgtgaggccctggacttgcccgagggctcgcatgttcgggacgtgttgcggctgctgagcgcgaagtacgcggcgctggcgccactcctgccgcaccttcgtgtggccgtggaccaggagttcgtcggtccggatgccccggtgcgggatggggcggagatggcgctgattccccccgtggcgggaggcgcacctgggaagttcctggtggtggaccgccccctgcggctggaggaggtggtggaggctgtcaggggggagtcatacggcgggctggtgacgttcagcggctccgtgcgcaaccagacgaagggccgccgcgtgttgcgcttggagtacgaggcctacgcgcccatggcggagaagaagctggcggagattggcgcggaggccgcggagcggtttcccggcgtgcgcgtgtccatcatccatcgcgtgggaacgctggtgcccggcgagctggccgtcgtcatcgccgcggcgtcgccgcatcggaaggaggcgttcggtggctgcgagtacgccatcgagcggctcaagcaggacgtccccatctggaagaaggagttcttcgaggatggggaggtctgggtcggcctggggccctgaatcgccgcctcagcggacgcgcaggaaggcggggaccgtgacgtcgtcaccgccgtcgggctgcatgccgagctcttcatccgtgagcggacgcagtggcgtgtccaggcccatggccttgcggcgcgcggcttccttgtcggcggctatcttcatggcgcggaccttggattcctcgatgcgctggggcgtggggcccgcgatgaggaagcccacggggaggctgaggaagaggatgctcacgatgatgagccagccgaagtccttccactggagccggttgacctgttccttgacgacggagccttggatgcgcagcgagagctggccttccgagaggcgaagcgtcatgccctctgcgagctccactgtcgtgcgtccgtcgtgctggcgcaggtccgtctgcggcacggcggcataggcgttgcctttgacggcgcgctcggcacgggcagcgggcggcagatggatgcgccagccctgagcggtgcgctcggcgagcaggaacggctcttcgggcagggtgaagccgtagagcggtagcggtgccgtctcgtccggggcggcgtggacgttcgaatgctccggcccatagctccacgcctcggacagattgttgccccagtacagctcacagaagagtccaccgcctgccttggtgttcatcgcggggggaagcatagggccttgcagagctcgcg

SEQ ID NO: 1010 - DNA, 11620 bp, Myxococcus xanthus
gagctctcagtcccgctctgcgcggcactgttcgcctccggtctggccaccgctgtccccgccgctgcgttcgagctgaagcatgagactggcacgctgagcgtgcccgccacgccgtcccgcctcgccgtctatgacctcggcgtgctcgacacgctgaacgcgctcggcatccgtgccgtggccgtgccgaaggccaccttcccggccacgctgtccgcctacaacagcaatggcgtgccccaggccggcagcctgttcgagcccgataccaaggccctcgcggagctgaagccggacctcatcgtggtgggtgggcgctcgcggaagcaggccgagtccctgagcgcgctcgcgcccaccgtgaacatgtccgttcgcgccgaccacttcgtggaggacgtgacgggccagacgctggcgctgggcaaggccttcggcaagcagacggaagccgacacgctggtgaagaacttcgagaaggagcgggcggcgctgaagaagctgacgggcggcaagtccgccgtgatgctcttcaccctgaatggcaacgtcatggtgcacgcgcccggtgaccgcttcggttatctccacgaactgacgggcttcaacgccgtggtcccgaaggcggagggcagcaacgacggcccgcgaccgccggccgggtcgcccgaagcgaaggcccgtcaggaagccgcggccgccctgctgaagaaggccgtggccgccaacccggagtggctggtggtgctggaccgtggcgccgcgaccggcgggggtgagaacaaggccctggagacgctggccaagcacccggagctcagccagacccgcgccttcaagcagggccgggtcatcgtggtcgacgccccgagctggtacatcgtcggtggcggtatcgcgaacgtgacccgaatcgtccaggacacgacccgcggcctgaagaagtaggccctggcggtcatcctctcctcggggcggcgcgagtcaccgcgctggggagaggcgtttcatgccgcgtcaactgctcgccgatgtgtaccggcggatggagcggagccacacctgacgtgagccccaggcgaagagccccgcgcccaccaccgcccccacgagcgactggggcggcagccgccccagcatggcctgcgccgggaaggtcgtcatcagcgccagcgggatgacgtacgtgaacaccatcgtcaggacgccgcgccccacgccctggaacacggaggacggccagcgcgcgaagtcgaagatggaggtgaacaggtacgtcaggttgtccactcgcacgacgaagaacgccgcgctcactgtcagaatccacagcgagtagagcaagagcgtactcgtccccagcagcagcacggaggccagcagccccgtcaccgacggccaccgtcccaggtgcatgaaggcgtagacgaacagcccgattcccgtcagcacgttgaaggcccgccacggctggaagcgctgcgtggacaccaggaactgcgcgtccgccggcttgagcagcacgaagtccaacgtgcccttgcggatgtgctccaccacccccgtgaggctggggttgatggcgccctccaggatgccctgcagcagcgtgaaccagcccaccacgagcaacgcctcgccgaaattccagccctcgatgttgggccgctcaccgtagacgacgaacagcggcgccagcgccgtgaaggtccagaagagggacgtcagcccctccgtgaagaagtccgcgcggtactgcagggacagcagccccgacgccttgagttgaatgcccagcagccgcagatagcgcttcaccttcacttcagcccccgaacgccgcgaagcgccgcacgccctgcttccacgtcaccgccgccaacgcccccagcaccgccacccaggcccactgggccgccagcagccgcagggactcctcccagccataggcccccgtcagcatctccaccgggacgccaatctgatagcggaagggcaaccagtcgatgatggtgcgcagcgtgggcggcagcagctccaccgggtacatgtagccggagcacacgaagaagagcaccagccacacctccagcaccttctggctgctctccaggaagaagcacagcgcgccaatggccacgttggccaggaaggccacggcccagccgccaatcaccgacagcacgacgaagccccactgccacgcgtgctggggcaccgccttctgccccaccagcgccacgctcagcagcatcaccggcaccgcgaccatcaatcgcatggggaaggcggcgatactctccaccgcgtaggcccacagcggggagatgggacgcagcaggtgcatggccagcgttccctgcttcacctcccaggtgatgagtcacgccggccacgacgtggggagctgccgcaccgggaaggtggccaggaagtagctgatgaagtccgcctcgccgaagcggaccacgggcgcctcgcgagacaccgccatccacagcaccatgttgaccagcggcatggtggtggacagcacccagatgagcatctccgcgcggtaggccaccgcctccgcgaaccccacccgcagcagcgtgggaaaggcgcgcagtgtggtccgggcgctcatgcgggcaccggctccgacaccgccgtccggcgcgccttcgactccgcgaacagttcgctcatcacctcttccagcggcgcgttctccaccgtgaggtccatcaccggcaacgtggacagcgcgcgggtgatggtggcgttgaccgcctcctgctggacctggagcaccgcggtgccgggctcgtgcgtcaccacccgacccagcggcgacaggcgcccggcgtccacttcctccgacaggcgcagcaccacgcgcttctccggccgcacccgctgcaccagcgcgtccaggccgccgtcgtacgacaggaggcccttgtcgatgacgatgacgcgggggcacagcgccgccacgtcatccatgtagtggctggtgaggatgagcgtggcgccgtacttctcgttgtactccttgatgaacgtccgcatggtggcctgcatggccacgtccaggccgatggtcggctcgtccaggaagagcacccggggctggtggatgagcgccgcggccagctcgcacttcatccgctcccccaacgacagttgacgggtgggcttgccgatgaggtccccgatttccaggagctcaatcaggtccgaaatcgtcttcttgtactgggcctggggcacgtcgtagatggcgcggttgagttcgaacgtctccgccggaggcaggtcccacaggagctgctgtttctgccccatgacgagcatgattttcttgaggaaggcctcctcccgcttctgcgggacatggccgtccaccgtcacctcgccgtcggagggatagagcaggccggagaggaccttgagcgtcgtcgtcttcccggcgccattggggcccaggaagcccacccgctctccggggcggatgtcgaaggaaatcccatccacggccttcaccgtggtgtagctacggtggatgagcgagcggagggccgccttcaagcccggcgggcgcttatggactttgtagtgcttgcgaaggccgcgaacggaaatcatgtgcgaccaggatttaacgcggtctccccctccatggcgatctcgccgttgacggcttggcgggacgacaatcggttggcaacggccgcggcgggacgcggcctcacaggtgaaggctgggttcgatgagcaacgcatacagcaaggacctggagcgatggatgccgcggctcatcgccgtctggcgcgcgtcacgcggccggggcggtggcggcgggccggagacgcgcctgacgccccaggaggtgaaggaggtggccgcgggtgtccgccagctctccctgggcctcacgcgggagcggcagctcgccggtgcgcggtacatggacgacccgaagctcctgggcgcctatctcctcttctactggccggtgtcctatgcgcaggcccggcaggtgctcggtgagctgccgaaccgcccccggcaggtgctggacctgggcagcggtccgggcccggtggccttcgccgccctggacgcgggcgggggccaggtcaccgccgccgaccgcagcaaggccgccctcaccctggcgcgaaacctgccgccgaggccggtgaggccctggccacccgcgactgggacccgacgaagaagggcgccacgctgcccgacggccagttcgacctgattacgatgggccacgtcgtcaacgagctgtacggcacgggagacgcggccacggccccccgcgccgcgctgctggagacgattctggcgaaggtgaagcgcggcggcagcctgctggtgatggagcccgcgctgcgcgagacgagccgcggcctgctgcacgtgcgcgacgccatggtggccaagggctacgccgtccgcgcgccctgcatgtaccgcggcccctgccccgccctggtgaaggagacggactggtgccacgccgagcgcgcctggcccatgcctcgcgtggtggaggagctggcgcgcgcggcgagcctgcacaaggaatcgctgaagatgagctacctggtgctggcccccaaggacgaggcgtggccggagctgacgcccgggcggctgttccgcatcgtctccgagcccctggagggcaagggccggcaccgctacatcggctgtggccccgagggccgcgtgggcctggcgatgcaggagcgccaccgcaacgagcgcaacgagcgcttcctcaagctgaaccggggcgacgtcatctccgtgacggagacggagcccaagggtgacgggctcgcgctcgacgagcgcaccgaggtgcgggtggtggctcccgcgggcaagggcgttccacccccgcctccggaggaggacgcgccttcgagcccgggaaccggcccgcgcccgggcgcgccctcctgagtgaagcacccggcccctgactccccggggccggaagacgcagggcctggctcagtgccgggcctgggcatagcctcccgtgaggacgtcgcacatgtggcggaaggccttcacgccgtccttcatggcgcccaccgcgccctgcgcgaggacggtggcctgcacgcggaccagccgcagccggcgcggcgcgggcgtgtgaggagaagtcgcaggacggatgagcgaagcgatgttcatggcgtgctccgtggggtgtgggagacaaccggcagtctccaccccgtccgcgaagcccgcgttgcggcgcggtgaactcgccgtcacatcgtccgtggcctgcctgacagagcgccctccgggcaggaagtccgccgcacactccagacgccctgccaccgacggacggaaggcccacggcggggcccctgttagggtcggccgctcccaccgctacggaaggcctgccccgtgtccgtgtccaaccggccgctgcgttcgctgtacccgcccctggagccctaccgcaccggacgcctgcgcgtctccggtgggcatgaggtgtacttcgaggagagcggcaatccggagggcaagccggtgctcttcgtccacggggggccgggcggaggaacggacccgcgccagcgccgcttcttcgacccgaccgcgtaccgaatcatcctgttcgaccagcgcggctgcggacgcagcaccccacacgcgagcctggaggagaacaccacctgggacctggtggccgacatggagcggctgcgcgagttcctggacatctcccggtggcagctcttcggcggctcatggggcagcaccttgtccctggcctatgcccagacacatcccgagcgcgtctcggagttggtgctgcgcggcatcttcctgctccgcaagcaggagattgactggttctatcagcgaggcgccagcgccctcttcccggatgcgtgggagtactacctggagcccattcctctcgaggagcgtggggacctgctggcggcctaccaccgccggctgatgggttccgacgtgaaggcgcagcaggaggccgcgcgcgcgtggagcgtgtgggaaggacgcaccagttgcctgtaccccaacgcggagctggtggcgcgcaacagcggggacaccttcgcgctcgccttcgcccgcatcgaatgccactacttcgtcaaccggggcttcctgcgcagcgacacccaactgctcgacgacgtgcaccgcatccgcaaaatccccgccgtcatcgtccaggggcgctatgacgtggtgtgccccccagagagcgcctgggccctgcacaaggcgtggccggaggcggagttcgtcatggtgtccgacgcggggcactccgcgaacgagccgggcaacacctccgcgctggtggatgccacggaccgcttccgcgggcgctagagcgcctgctcactcccgtgccggaaccgccgccgtgtcgcgctccgcgtccacgcggcggaaatagaggatgacccacaggctcaccagcgcggccaccgtcaccatggcttcgcccgcgaacgcccctgcctgcggtccccacgccgcggtggccagcttccccaccaccaccgtcagcgcgttgaagaaggcgtgggcgcccaccgcgagccagtaccacttcacctcgccacggatgaagcgctggagcaccaccaccgacagcgcgatgtgcaccaccatggagcccagccgctcgtaggcccccagcagcggcatccaccagtccagcgcggcgatggtggccttggcttccaccacctgcgccacctgctccggcttcagcggcaaggtggaggggtccaacttggacagggcgatgacgttgacgagccccagcgccgtcagcccgcccaccagcagcgccgactccaggccgccgtggcccacgccgaagcccaccgcgtcgcgccaacggcggaagtccttcagcggcttgcggaaggcccacagccgcgccgtctcctcgaagaggcccgcggtgagggacagcacgacaatccagacacccagaagcaccgaggacgtcttcagcgcgtcgcgcatgaagtactgcgccacctgcaccatgggcagccgggtgaacaactgcgacagcgcgaacgccgccgcgccccaacccaccaccttccaggccacgcccagccgccggcgcgcccacagcaccatgcccaccggcatcagcacgtcgaaggtgatggcgaccgcgtagctggcgaccagcctcgtatccacagcgtccacgcggtctctcccctccaggaagcacaggctcttgaaacccagcctcgaggacaccagcgaagcgccgcccgaatccaggggaaatcgccgaaccgccaggattttccggttttgacccgaaaaacaggcggagcctctctctgaggggtggagcttctcccccagccgaaaggcagacgccatgcagcttcctggacacctccaccgaacgggcctcgccgccctggtggtcctcaccaccctgctcagcttcctgcaccccgcgtatgtcctggcggcggaccggggcgcgtgggcgcccaacacctcgtacaccgtgggcgacatcgtctcccacggaggcaagggctacgactgccgacagtcgcaccagtccctcgtcggatgggagccgcccaacgccccggcgctctggctggagcggacagggaatccgccgccggatacccaggcgccctccgcgccgccgtcgctcacatccaccgcgaagacgcatgagagcgtgtcgctgtcctgggacgcgtccacggacaacgtgggcgtcaccggctacgaggtcttcaccaacgcgggcacgtccgcctccgcgtcgacggcgggcgccacccacgtcacggtgacgggcctggccgcgaacaccacgtacaccttcaccgtgagggcgcgcgacgccgcgggcaaccactcggcggcaagcagcgcgcacagcgtgacgacctccccgcgccccgcgcccgacaccgtgccgccctccgccgccagcgccctgcgcgccactggcgtgagcaacagcagcgtgtcgctgtcctggggcgcgtccactgacaacgtgggcgtcaccggctacgaaatcttcgtcaacgggagcgcgtccgcgtccgcgaccacctcgggcgccaccagcgccacggtgacgggcctcgccgcgaacacgacctacgccttcaccgtgaaggcgcgggatgccgcgggcaaccgctcggcggcgagcaatagcgtctccgcgacgacgacggggacgcagcccgtggggaacaaaatcatcgtgggctactggcacaacttcgacaacggctcgacgaacatccggctgcgggacgtctccgcgaagttcaacgtcatccaggtcgccttcgccgagcccgtgggtggcccgggctccggacgcatggccttcacgccgtacaacgccagcgtcgcggacttcaaggcggacatcgccctgctcaagagccagggccgcaaggtgctcatctccattggcggcgcgaatggcaccgtccacctggatgacgccaccgcgcggcaggacttcgccaccaccatgcaggccctcatcgacacctacggcttcgacgggttggatttggacctggagggcagctcgctgtcactcaacggcggcgacaccgacttccgcaaccccaccacgccgcgaatcgtcaacatcatccaggccacgcgccagctcctcaaccagaacggcccgggcttcatcctcaccatggcgcccgagacggcctacgtccaaggcggcatggccgcgtacggcggtccctggggcgcgtacctgcccgtcatccacgcgctgcgagacagactggcgtacctgcacgtacagcattacaacaccggcaccgtcatggcgctcgacggcagggcctacgcgcagagcacgccggacttccacgtgtccatggcggagatgatgcttcaggggttccccgtcggcggcaacaccggcgtgatgttcccgtggctgcgcccggcacaggtactcatcggcctgccgtcgtcaccgcaggcggcgggcggcgggtacacgacgccggccaacgtgcacaaggcgctcgactacctgctcaagggacagtccttcggcggaacctacgtgctgcgcaaccccgccggctaccccggcttcaagggcctgatgacctggtccatcaactgggacgcgttcacgaacttcgagttctccaacagccatcgcgcgtacctggacacctccccctagcgcgccccggcgcgagggcagcgctcctccatgcaatcgattgtcatccgcgacagtgccccagctcggtccgcgcgtccgccgtctcctggacataggccttgcgccacacggacagctcctcccaggcgcggcgggcctctccgcaggcctcttccaccgcgcccgtcaaccgaagcgcccgcgcgagccggcggcgcagcctgggaacgcgggcggagaccacctgccgggccgtgaggtccgccagcgcggtccgcagtggcgccagggcctcggcgggctgacctcgcgcgagatggacgtcccccagcaccagcagcgcctcgatgcgctcggacgacgaaggccccaggtcccgctccatggccacgagcgcctggtccacatgacgacgggcctcgtccacctgcccgagaaagaggagggcatccgccatgtagcgcagtcccgagccatccatctctcccttgtcggccaggggccgctggagcgagacgccgcgagcgtggaagccacgggcctcgtccggacgccccaggagacgcaacagccggcccacctcgtgcgcatccagcgccacctcagggtgggtggcgccataggcacgctcgcgatgcgcccaggaggcctcgggcatactccagctccggcaaacgctcgccctgctcgcccagcacccccagccgattcgacttcacccctatcaacaccgggctgtcggcggccacgctcttgagcgccacggcccagctctcctccgcggcctcccgcgcctgggccgcatgcccccactcgacgtagacgagggtcaggttggacaaggtccgggccaccgacaggttctccgaacccagcgtctggcgaaggatgcccagcgcccgcttgaggacggcctcggcgctcgatagctcccccagaagggccagcgtgccccccaggttcgacagggcccgtcccgtgtcccggtgcgccggcccgaagtgcttctcatggacgcgcagcgcctcctcctgccaacgcttcgcctccagcaaccgtccctgttgccgagccagcaatcccagccggccgttcagctccgcgcgcgtgaacgtctggccccgggcgctggcggtttccagcaaggcacggagcagcgactcggcctccgagaagcggccctcctgctccagagctccgcctgcacctggtccagcaggatgtccagctcggcgtctcgcagcgtctccgccagggcccgggcgcgatggaggaagggccatgcctcctggggccgtcccattccgtacccatgcagccaggcctggaagtgcagcacccgcgcgagcacgcccagatgccgccctgcctcggccgccagagcaccctggaccagggactcgcgcgcgtcctcgaatgcccccgcgtcctcctgcaatcgcgagcagaggtgatgcgcctcggcttccagcggccgatgatgggtggcgagcgcacgcgctcgggcggcaagcgcgattcgcaggccctcgggggtatgccccgcgagcctcttcgcgttcgcccgcgcgagctccgcgcgcaccgcgtccacctccacacgcgccttcgggtcctccggcggagacacggcctcctgcaacgtgcgcacgtccgcgcacccgcccacgccgccgagcgaggcccccagcgcgaagccccgctccaccgtccgcgcgtccgcgccctggagcgccgccgtcagccgcgacagctctcccagccgttggtccaggcacgtcatccgcagccccagcgccgcttccgactgctcgccgaagacacgcgtcgcctcgcacgcggactgatgcgcgcgcgtccagtcctgcgtccactgctccagcgtggaggccacggcctggaacgaggcctcggccgcggggtctcccgtccccagaaaggcctgacgcgtggactcacgcacggacgcgtcccagatgccctcgaggtgccgttcactgccctggcagacttcgctcggcgccgccgcggaaggccccagcacgaggaaccccaggcccaccagtcctcccgcgagcaccgccgtggccgcgctgcgcttccaggcccccacctcccgcgcgaggcgggctcgcagcacctgcatggactcgaagcgccgcgacgggtccacggagaggccccgccgcaccacggccttgagccacgagggcacgccccgctgctccggccgcacctcctggcgctgcatggatgccaggagctcctcgcgcgtggcacccgcgaagggccgctgcccgttgagcgcctcgtagagcgcgacgcagaaggcgaactggtccgaacgggcatct

SEQ ID NO: 1011 - DNA, 12739 bp, Myxococcus xanthus
  unsure (1)..(12739): unsure at all n locations
agatgacctgggacaacgccgcgctgctgagcccggagaccgccaagaggctgagcctcgagcccggtgacctggcggagctgacctacggcggccgcaagctgaccgtgccggtctggattacccccggccacgcggacgacacggtgacgatgtcgctgggctacggccgtgacggcctgcacgaacaggtggccaaggcggtgggcttcaacgccaacgcggtgcgcaccgtgaaggccccctggttcgacggcggcgccacgctcaccaaggtgcgcggcagctacaagttcagcctgacccagacgcactggcggatggagaaccgcccgctggcgctggacatgccgctgtccgagctgaagaacccgtccatcgcgacgcagcacacgctccaccgcgtcaagagcgagctgaagttcggcgtccaggacaacctgccggccttcgactacaacaagggccccagcaacccccagggttacaagtggggcatggctatcgacctgtcccgctgcaccggttgcagcgcgtgcgtgattgcctgccaggcggagaacaacatccccgtcgtgggcaagcagcaggtctccgtgagccgtgagatgcagtggctgcgcatcgaccgctacttcgagggcagcgagagcgacccccggatggtcatgcagccggtgatgtgcgtgcactgcgagaaggccccgtgcgagtacgtctgcccggtgaacgccaccgtgcactcggacgagggcctcaacgacatggtgtacaaccgctgcgtcggcacccggtactgctcgaacaactgcccgtacaaggtgcgccggttcaactacctgcactacacggcggacaagacggccaccgagaagatgctgatgaacccggacgtcaccgtccgcaaccgcggcgtgatggagaagtgcacgtactgcgtccagcgcatcgagcgagtgcgcatcgacgcccgcgtcgagaagcgcctcatcaatgagaaggagctgcagacggcctgccagcagacctgccccacgcaggccatcaccttcggctccctcaacgacccgcagcagcgcgtcacgcagctccacgaggacgagcgcgcgtacaagctgctccacgagctgggcacccgcccgcgcaccgcgcacctcatccgcgtccgcaatcccaaccccgccctcgagcccgccgcgtccgccgctgcgaaccaagggagccactaagccatggctgaaactgcttccaccacgtatcacgacccgctcgagccacgacccctcgtcgcgccgcaccatgacgacgcgaccctgaacgagacgctgctggaccatgtctggcgcaagccgggcaagggctggttcatgctcttcggcctgtcgctcagcgccctgggcctgctcgtcatcggtgtcacctacacgctggcccgcggtatcggcgtgtggggtaacaaccagcctgtcggctgggcgttcgacatcatcaacttcgtctggtgggtcggtatcggccacgccggtacgctcatctccgccatccttctgctcttccagcagaagtggcgcacgagcatcatccggttcgcggaagccatgacgctgttcgccgtcatgtgcgccggtctgttcccactgctgcacaccggccgtccctggttcgccttctggctgttcccctaccccagcaccctgggcgcgtggccgcagttccgctcgccgctggtgtgggacgtgttcgccatctcgacgtacctcacggtgtccgcgctcttctggttcgtgggcctcatcccggacctggcggcgctgcgtgattcgtccaagacgaagctccagcggaccatctacggcctgttcgcgctcggttggcgcggctccggtcggcactggcacaactacaagattgcgtacctgctgctggccggtctctccacgccgctcgtggtgtccgtgcacaccatcgtttcgttcgacttcgccgtctccctgctgcccggctggcacgccaccatcttcccgccctacttcgtggccggcgccgtgttcagcggcttcgcgatggtgatcacgctcatcatcccggcgcgcaagtacctgggtctgcgggacgtcatcacggaccgccacctggagaacatgaacaaggtcatcctggcgacgggtctgctcgtctcctatgggtacctgatggagcacttcgtcgcctggtactcgcagaaccagtacgagctctggaccttctacgtgaaccgcgccacgggcccctacgccggcgtgtactggctgatgatcgcctgcaacgtcatcaccccgaacatcttctggttcaagaagtgccgcaccaacatcgccatcatgtgggtggcgtccatcgcggtgaacatcggcatgtggtgcgagcggttcatcatcatcgtcacctcgctgagccaggacttcctgccgtcctcctggggcatctacaccccgacgtgggtggactggtccatctacatcggcacgctgggcctgttcggcaccctgttcctcctgttcctcaagttcgtgcccgcggtcgccatcagcgaagtgaaggagctccagctcgagctcaagcacgccgctcaccagcacggctctgatgatgcgcttgccggcgccggcaccctcacccacggagctcactaagagccatggaagccaccgttctcgattcctgggtcctggcggagttctcgacgccggacgccctcgtgaccgccacccgccagatgcgggagaagggcttcgagggaatggacacctactctccgtacccgctgcacggcgggtcggaggccctgggtctgccgccctcgcgcgtgcccttcatcgccctgtgcggcggcctgacgggcgtggccacggcgctggccatgcagacgtggatgaacaccatcgactacccgctcaacatcggcggtcgcccgctgctgtcgctgccggcgtgggtgcccatcacgttcgagctgggggtgctgatcgccgccttcggcatcttcttcggtctgctggggctcagccgcctgccccagccgtaccaccccgtcttcgagtccgaggagttccgcaccgcctccacgcacggctactggctgagcgtgccccaggcgacgggcacggacgcggcgccggtcatggatcagctcaaggccctgggcgcgacccaggtgaccctcgtcacgggagagaaggaatgaggtggctcatccccgccgccggactcgccacgctcacgggctgcaacgtcagctcggagttcctccagcgcatggagcaccaggcgaagtacgagtactacgaggcgtccgacttctgggcggacggtcgcgccatgcgcacgcctcccgtgggcacggttccgcgtgagcgcttcgagaagctccccgagctcaaggacccgacccagcgccaggtggccctcaccggccgcagcgccggccagccggtggcccacctgcccatcacggtggaccagaacctgctgaccctgggtcagaagaagtacaacatcgtctgctcgcagtgtcacggcgtgctcggcgatggaaacagcatcgtcgcggagaacatggccctgcgcctgcctccctcgctgctggacctggagagcaagtcggacggccacttctacgtggccatcaacgagggctacggcgtgatgccgtccttctccggtgagctcgacctgcgcgagcgctgggccgtggtcgcctacgtccgcgcactccagacggcccgcaatacccgcacggacggccagcagcccgttccgcaggagaaccgatgagtccccccgtcaccaactcgcacaccaacttcgggccgtacaccggcacgccgaagctcatggtgcccgcgttcgccgtgggcattctctgcctcctggccacgctgggtggcttcttcgccaccgacgccaagggtgagacggcgcacgcctatctgattggcttcacctactgggtgggcatcagcgtcgccttcctcatcatgcaggccatcttccacacggcgaaggccaagtggctcatcgtgctgcgccggacgatggagacggcctccgcggtgattccggtgttcttcgtgctggccctgacactgctggccatggccacctacctctacccatggtgggaaggctccgagctgaccaagggatactccagcctggaactggagcacctgagccacaagcagcacgggtacctgaacaaccacctgtccttcccccccggcgtgggcattcgccacatcatctacttcggcgtgtggacgttcgcggcctggcggccttcggtccgtggagacctgaagcagcacaccgagggtggactcgacttcacggtgaagcagcgcaagttctctccgggtgtgctgccgttccttgccctcaccatcacgttcgcttctttcgactggctgatgagcctcacgccgctctggcagtcgaccatcttcggcgtctattacttcgccggaagcttcctggcggccttctgcatcctgaccatcgtcacggtgagcgcccagggcaaggacctctacggcagcgtcgtgaagctggaccacttccacaacctcggcaagctgatgctcgccttcaccgcgttctgggcctacatcgccttctcccagttcatgctggtgtggatcgcgaacatcccggaagaggcgccctggtacggcctgcgcatgttcggcccgtggcggtcgatgtccatcgccctgttcttcctccacttcctgctgcccttcggcatcctgctgtcgcgcaagctgaagctgcagcctcggaagctggccgtggtggccgtgtacctgctcatcatccacgcggtggacctgtactggctggtgtggccggcgctgaccggtgacgcgggcccgacgttccactggtcgctgctcacggccttcttcggagtgggcggtatcgcggtgggcttcgccctctacctggcgcgtggccactacacgctcacggtgaaggacccctacatcgccgagtccttgaggtacgtgcagccatgaagaagacccaggttgagctcgagtcgcgcgtcatcgtcggcgcgcacggcgtggcggcggaagaagaccacctggtcatgggcaaggtggtgggcgtcggcgtgggtgcgctcgccatcttcgcggtgggcatcgtctgggcctacaccatccaggtccggacgatggctgacatccagccggagggtccgccgccgcgtcccgcggcgatggggcagtacgaggtgggcatcgtcaaccagcgcctgttcgagcaggactggcacgccgtggacaagatcagcggccaggaccaggcgctgcgcgccggctggggtaacgagccgggggtgaagcagcaccccggcatcgacgacgcgatgaagacggtcatcgagcagaagcgcaacccgccccctgctccgacccccacgcctaccccggagaccactcccgggcagacgcctccggcaccgcagcagtagccttcaccgctcccctgtcgtaagagccgtcctgcaatgatgtccacccgctcctacatccttccgcgcgcctgccgcgcgggcttcctcgccgcggcggcgctggtgctggccgtcgcggtgccagccttcgccatgccaggtgccgggaagacgccccgggccatcctggaggcacagcaggacctgccgccccccatccagggtgtggacgtgcaggagcatctgggggagctggtgcccatggacacccgcttcctcgacgcctccgggcgcgaggtgcgcctgggcgacgtggtgccgaaggcgcggcccaccctgctgacgctcgtctattacaactgtcccatgctctgtaacctggtgctcaacgcccaggtgcagtccatgaaggagctcgggctcgagctgggcaaggactacgaagccgttaccgtcagcatcgaccctgacgacacgcccgcccagagcatggagcggcggcgacggcacctgcagtccatgggcaagccggagacggccccctggcacttcctgaccggcacggacgcggaaatccgccggctcgccgacgccctgggcttcaagtacacctacgacgagagcacgaagcagtacgcccacgcagccgtggtgcacgtgctcacgccggaaggcagcatctcccggtatctctacgggacgacgtttcccccctcggacatgaagctggcgttgctggaggcggccaatggccgcgtgggtaccagcttcgatcagatcatcctgtcctgcttcaagtatgacaccgccagtcggcggtatggcttctacatcttcgggttcatccgcctgggcggcatagccgtgttctgcgccctggcgacgatgctgatctacttctggaggcgcgagctgaagaaaggcgcggcggcatgagcgagcttctcaacaatatcctgttcctcccggaggccgcgtccacgttcgcggaacgcatcgactcgctgcatcacttcgtcgtgggtacgacgatggtgatgtcgacggcggtcggtctggcggccctgttcttcttcttccgttaccgccgccgcctcccggcgcaggcgacggagtacatcgtccccaccctgaagacggagttcctcttcgtctccgttcccctcgtgttcttcctggcctggttcggtatcgggttccgggacttcacgtgggtcaccacgccgcccaaggactcgatggatgtctacgtcatgggcaagcagtggatgtggaagttctcctacccggagggccccaacggggtgaacgtgctgcacgtaccggtaaaccgtccggtgcgtctgctcatcacctcgcgtgacgtgctgcactccttctacgtgccggccttccgcatcaagatggatgcgctcccgggccgctacacgcagatctggttcgaggcgaccaagccgggcacgtaccaggtgctgtgcaccgagtactgcggcctgtcgcactcgaagatgctggccgaggtcgtcgtgctcccgcaggaggagtacgagaactggatccaggagcagcgccgcggccgtctgcaggaccgtcaggacgcgctggcggacaactccctggtgccgccggtggcgcgcatggtggagcagggccaggtgctcgcgggcacccagggctgcctcaagtgccactcggtggacggctcgcagcacatcggcccgaccttcctgggcatgtacgaccgcgtggagaagctcgatgacgggcagaccatccgcgtggacgaggcctatatcacccagtcgatgatggacccgggcgcccacctggtggcgggctaccagaacgtgatgccgacctaccagggcaagctgcagggcccggagacggccgccatcgtcgagtacatcaagtcgcttcgcactccgaacgtccgtgagggcgcctccgagggacccgcctatgacgccatccagtagcattgcagccccgggcgccacccccgcgcccgaggagcatcacgaccaccacccgaactacctggttgacggcaccaccatcaaatcgtggctgctgacggttgaccacaagcgtatcgggctcatgttcctgttctgggtcctgctgttcttcctcgtgggcggcatcttcgcgctgctcatccgggtggagctgctgacgccgggcccgaccatcatggacgcgatgacgtacaaccgtacgttcacgctccatggcctggtcatgatcttcctgttcatgattccggccatccccgccgtcttcggcaacttcatgttgccgctgatgctgggtgccaaggacgtggccttcccccggctgaacctgctgtcgctctacatctacctggccggcgcggtgctcgcgctgtggggcatgctcaacggcggcctggacacgggctggacgttctacaccccgtacagcgcgcacacgacgaccacggtggcgccggtgctgttcggtgcgttcatcatcgggttcagctccatcgtcacgggcatcaacttcatcgtgacgtgccacacgatgcgcgcaccgggcatcacctggttcaagatgccgctgttcgtgtgggccatctacgccaccagctgcatccaggtgctggccacgccggtcatcggcctgctgctggtcctggtgacggtggagaacctgttcgggttcggcatgttcgacccggcgcgcggcggtgacccggtgctcttccagcacctgttctggttctacagccacccggccgtgtacatcatggtgctgccgtccttcggcgtgatgagcgaggtcgtcgcgacctacagccgcaagaacatcttcggctaccgcgcggtggcgtactccagcctgggcatcgccttcgtgggtttcttcgcgtggggccaccacatgttcgtgtctggccagtccaccttcgcgggcggcctgttcggcgtgctgaccatgattgtgggcgtgttcaccgccatcaaggtcttcaactgggtgggcaccgtctacaagggcgcggtcgagttcaagacgcccttcgcctacttttgcggcttcctgttcttcaccgtgttcggtggcatgacaggcatcgcgctgggcacggtgtcgctggacgtcgcctggcacgacacctacttcgtggtggcgcacttccacttcatcatggtgggcgcgaccatcatggccttcctggccgccctccactactggttcccgaagatgttcgggcgcacgtaccacgagggttggggtctggtggccgcggcgctcatcatcctgggcttcaacgccacgttcattccccagttcctgctgggcaacaacggcatgccgcggcgctactacgagtacccggagcgcttccaggcgctgaacgtggcctccacggccggcgcgacgctgctggcgttcgggttcatcatcatcgccatgtacctgacgtacgccctgatctacggcaaggcgtccggcaagaacccgtggcgcagcaagggctacgagtggctgtccgagtctccgccgccgacccacaacttcgtggggccgcagccggagttcccggaagagccccacttctacgtggaccccaagaaggccgaggtgcccgatgcagtctagttctcacgccgccgggggcgccgccctgcccgtcccccggctcgccggccacttcgcctcgctcgaggtgcagaaccacgccgcgcgactgggcatgtggctgttcctggcgacggaaatcctgctcttcgccggcctcttcatctgctacggcgtctaccgcttcctcttcccggaggcgtgggccgccgccagccgcagcctggacctgacgctgggcaccgttaatacggtggtgctcatcacctcctcgctcaccgcggcgctcgcggtgcactacgcgaaggaggggaagaacaagatggtcgcggtgcagattggcctcacgctggtgatggccgtcggcttcctcgtcatcaagtacttcgagtatcaccacaagttcgagattggcacgctgccgggccgcttctactcgtacgagggcatccagcttccgggcgtgcccctgtactttacggtctacttctgcgcgacggccctgcacggcatccacgtcgtcatcggcatgatcgtgctggccttctccatggtccgcgcgctgaagaaggctgacttcgggccgaacaactacacgatggtcgagctgggcagcatgtactggcacctcgtcgacctggtgtggatcttcctcttcccgatgctgtacctcgtttgaagggttcctccaccatgggcattgccaacgaatcccggcaagaagaacagaacatgcgcgaggagcaccacggagcgggccgttactggctcatctggggtctgctgctggtgctgacggttgtcacggtcgtcaccggccgtatccacatccccacctggggcctggtgctggcgctcgtcatcgcctccaccaagggcacgctggtgctgctctacttcatgcacctggctgaccaccgcggcgccaaccggctggtgttcgccgtctccatcatcttcgtggtgttgttgctcgccattccgctggtggacctgggcacccgcttccgcggcgccacgcctccgggttcgacgtacagcgacctgcaggcgatcgacatcggcgcggatgccgaggaaggccgctacggcggcgccatccgcaagcaagggaagacgggcgaggagtccggcgctcccaagcagtagggcggtcggggcggncaccgncccacaccacccacacgcggcgccgagggacatccccggcgccgcgtttgcttttgcgggctacagcaacacttcgaagttcagcgccagcgcggtgtccgtggacaccttgcccggaggcggcgcgctgtcgtgcttcaccaggaagctggtgcccagcgacagctgcttggtgagccccacggacagctgcgtctggctgttgaagagcatgcgcgagtcgccgatgacgctcaccagcacctccacgtcctccttgaaggtgacgttctgcgccaggccgtagcggaacacggcgccgaagcgagggccacccaggtcgacgtccggcaggttcatccgcgtggggtagtactggaagcgcgtctcgttggcgtagcggaaggcggcgtccgtgcggaggtaggactcgcggcccttctccttcttctcgtcccaccacagcacgcccagaccgccttcgccgaaggtgcgcgactccacgctcttcacgtggtccgtctccgcgccccccagcaggtagccgctgatgacgtcggtgaagcgccggtcgccgcgcagctccaggcccgcgttgaacgccaccacctgggacacagcctcctcgcccgtcacctcgggcggacggctgcggccataggagccgtaggacttgatggcgtaaatccagtggtccgtcgtgcgctgggcgctggccaggccactcaccgtcagggtggaggcgttacccgtcagcgagatgaggcccaggccgacggtgacgtcccactccccctgcttcttgtcggtggcgggagcggccgcggccgcggcggccgggggcggaacggtggcggcggcggcgcgctcggcggcctcggcggcacgggcgctggcctcggcggcgcgctcagccgcgatggcggcgcgctcggcggcgatggcggcgcgctcctccacgctgaggggcgcggcgggcgcggtctccgcggcgggagccggcggcgtggaagaagtgggcgcaggcgtctgggcctgcagggacgtagcaatcaagaaggcagcggaaagcatcgggtctccaggtcaacgacgccggcaaaaagcctgagtccgggtgtggaagtcctgtgttcccccccgatgccgacgcagctcccttcctgcttcaaaggcccgccgcgcttcaatggcttaatgctcgaattcggacacgccccaccaccgccgcaccgggtgggtccgttcccaccgccttccagacagctgttgaaagaaaaaggcccatgcccctgcccctgcgccccgctccgctcctgctgctctgcgccctgctcgtccccgccgcggcctccgcccagcgcgtcaccgtcccggtggacgtgggggtggggcccgcggccttcgccttcttcggccccgtgttcgacgaccagcccatccacaccgggctgaagctctccgtggaggcggtgctggacaaggagtggatgaagaagaaccagcgtcgcgtgcccccgcgctaccgcaagtacgccaagagcctggatgaggtccgcatctccccgtccatcctcatcccggacgcgctcatcatctcccccaagctgcgcaataccggcatgtacggcgccacctggaagccgctgtcgctgggggtgccgctgacgtccagcccggcacggctgtcgctcggcgcggggctgctgctgacgtacgtctacatgcactcggacacgctgcccaacacgcacttcctgcggcccggcgcggaggtgggcatcgacctggagctccagctctccaagagcttcctgctaggcgtgggctgggagtccgcgttctacgtcccgcaggagttgggaggcctgggcctgcccgagcgcctgcgcgatggcatcttccacgtgggacaggcctaccttcagctccacttccggttcccctacaccgtgcgcttgtgaggcggaaggcaggcaggcctcacgggccctccagggctgctgcgaagcgtcgcgcgcgcgactaccctgccccgccatgcatctggtcgtcgccaacgaagcacagaaggccgagagagaccgccacacctataccgcctgggggtcgccgctcaccgtcgagcagttcctcgagcgggaacagcggctgcgcgcccatccctggagccgggacaccatgcgcacctggctgctgtgcgatgacgccggccgcgtgctcacctcgtgcgagacgttccgcacgcccagctacctgcgcggccccgactgtcagacgacgcgcggcgacagcttcgtcatcgccagcgtctacaccgagccggccctgcgcggacacggccatgccacgcggctgatggaccaggtggccgcggagcttgagcgcacggagccggacgcccaggccgccgtgctctactccgacgtgggcgcccgcatctaccggggctccgggtacctgggagtccccgcc

SEQ ID NO: 1012 - DNA, 14570 bp, Myxococcus xanthus
gggagagctccaggtccagcgagaatgcgcgacgcggaggcaccggcgtgatggacacggaaggagctgcgtcctcttccggcggagggggccggcgcggggccgccacgtgggagggagacgacgggccagggcgacgcgtgcgggacggctccgccacacgcgccggaggaggcgccatgtgcggcgaggagcgacgaaccggagccggcggtgtcggggcaggacgggatggaacgtctctgggtcgactccgctgcggcacggtggactctccgtcgccgatgtccaggtcctccaccaccggcgccgtggcccggtaccccacgggcgaggtggcgacggcagtggacatctccgaatcctcgtcgtcgtcctccgcctggagggcaggcaggtcgcgcggacgcgccatcagcgtggcgggctcgggctcgtcgccggagaaggagaccggcaccgagtccctggaggcgcggcgaggcgtgggccgagcggtgaggccgggcgtgagctgcgcgctgggcaccgaggccaggtcggactcgggcgtggtcgaagacagcgtgggggcggtggactccagcacggacgggcgccgcggcggctcggcgtcctgggagagccgagcgccctgcagtggcacggtggcttcacgccggccgaggcccttggcctcggggatgtggaggatggtgcgctcctcctcctcgcccagcagccggccgatgtactccgacacgtccaggctctgccggagggtgccagaggcgaggaaggactccagcgcgtcgtgcacctccgacgcgcgctggtagcgcagggcgcggtccttcgtgaggcagcgcatgacgatgcgcgagagcgctggcgggtaatcgtcgcgaatcaggtgcggcggcgacgggtcctcgtagcggatggcgtagaggatgccctccgtcgtcggcttggcgaagggctgccggccggtggtgatttcgtacagcatggtgcccagcgcgaagatgtccgcgcggtggtccagccgctcctgcgacacctgctccggcgccaggtagaggaacttgcccttgatgacgcccggcttgctgcgttccatgaacgcgcccgccttggcgatgccgaagtcgaccagcttgacgcgcccgtcgtagccgatcatcacgttctgcgggctgacgtcgcggtggatcaactccagcgggcgcccatccacgccgcggctgtggtgcgcgtaatccaggccggcggccacctgcgcgcagatgcgcgcggcaacaccatagggcaccgtggcgccgaacttggactcctcggccatgacgcgccgcaggtccacgccctccacgtactccatggcgatgaagatgttgtcgccctccttccccagttcgtgcacctgcacgatgttggggtggtggagctgcgcggcgatgcgcgcctcgtccaggaacatctggacgaactcgggctcctccgagaggtacgggaggatgcgcttgagcaccaccagttcggggtccggcggtcgctgggacaggaacagctccgccattcctcccacggcgagccgcttgatcagcaggtagttaccgaacggaatggccgtctggggcgagctcacgaagaaaggccgtctgtctgaaggtgaatggactggacttttccggagcttacccacaatcaccggctcctgggagccagggacccgcatcggtgggttccggacacccaccccgccttccgggcccaaaaagaagccgcccctccccgggtgggcgaggggcggccgaatcaaccgacgagggacacgccctcgtcgcgggcccttactccgtctgggcgccgggggcggccggacgaaacgtctcgggctccgtgaccacaccctgcaggtcgtcacacccctcggggtagagcaccgtcgtccacgtgttcgtcgtgccggggatcacgcccgcgtcattgaagcagctgaacgtgctggtgccaccgtccatgcagggcgcgtgggtgaaggtgtcccacacgccgcggatgccatccgggaaggtcacggagccaccgtcgttcaccatgacgcggtagtcgcagcgcggcgtgccaccatcggtcgtcgtaccgaaggtggtgaggttgttcacgagcacgccgccggagacctcgaagccgaagtgcatggtgtcttcgccatcatcgggagtggcgagccgcttcatggccatgggattggcgtcagtcagagtcagcggcccctggatgtggacacgagcgcccaggtgctccaggttgggccggccgacgccaccatccgcgttaccgaagccgttgtcgatgctgaccgcgatgtcgttgggcgctgtcatcgtgcccgtcttggtgatgaccatcggggtggcttcgcttgcgccgcggaagtcgaagttattcttcaggaccttgcggtagccctcgcggtcccggaagcggctgttgttctggacgtagccctggatggtcacgatgtcgcccttcgcaggcacgtacgtggtcggcggatccgtccggtacttctggacgaagatgccgtcctgagcgttgttcggatcagccacccagaagtccgccgaaacgcccgtgtccttcgaagagacgtagaccaccgtcgtgacgacgacgccctccaggatgatctgaggacggtcgcccagaaggcgcgcctcgcggatggtcaccgtctgaatgcccgcgtcacccgtgcccgcgtcacccgtacccgcgtcacccgtgcccgcgtcgccagtcccggagtccgggctacaggtgccgaggcagccagcgtccggcagcggatccgtatcgtcgtcacggccagaacagccagccatggatgccatcgtcgccgcggtcaccagcgccgccgcgcctagcgtcttgcgcagttgcatttcgagaatctccattcgttacggcgccgcggttcgtgaacaccgacgcctgtcggccaggggttggcgccttataccggtgcctcgaggggggcggcaaggaagcctccttgtcggaggtgtcagtctggtgaaatcgcgaccctctctgttgcgccgagtgaacgattcctgtgaccgcgtgtctgtcgcgaaatccagactgccgtcacgcaccgtgcgtgttcgcgaaccagcgcgtggcgctcacgtcagcgctcatcgcgggctgagggtccatgcagccggattcccgtccggcgatggaaacaccgccaccctcgccccgtggcgtggcctggcttgcgccgcactcggcatgccaccatggaatacgtcctgcactcgttcacttcatgacctcccaaacgtgtctcaccgccctgcttggcttcggcgtcctgacggcctgcatcaatgtccccgacgtcgtcgagccaccggaactcccggacagcgggacgccctatgtcaggctccaactcgccgggggcgcgacccacgttcgcgacactgtcaccgtccacgtcaaaaccaacggcgagtcgaccgacgacgtcgagctcctgctcgatggcgcatcccttgggaacgtcacggccccgaccgaattcgcatgggacacctcggagcatacggaagggcaacactccctgactgcccgtgtcaggctccagaacgcaacgtggcagagcgagccactcgtcgtcaccatcgaccggacaccgcctaccatcgccctgagagcgccggccgacggggaagcggacgtcagcgcatcccaccccatccgggtcgagttctccgaagcgctccatccagacagtctcgccgcattgagcgtcgaactcctcgtcaacggtgaaagcgtcgccaggacactgagcctctccgaatcccagcggaccctggagattcaagcaggcgtcgagcttccgctgccccgagatgtggaggtgaagctcaccggtgtccgggacctcgcggggaacccagtagcagcgcctttggtgagttggtcctggaacgtccctgcgtggctcccggtcggtccccgcgatgggctcgtcatcgaagaaggtgctgcgaccctgtcacggctggcgctgagggagcacgctccgcaagccgcggtcgttgcgttccaggtcgacaacggcgtgggggtacgtcgctggacggggcaaacgtgggagcgactgggcaccgtcctgaagcccaccagcaccaccgccgacctccacttcagcaacgacggcgaaccggtcgttgccttctcccactttttcaaacgagaggacgaagaactcaaccttgtcgacgtggccgaaacggccatccatcgctgggcgggcgccgaatgggaacgttttgcactgaccgccagtgactgggacacggcgtggcctacgaactggcccgtgcagcgcgaagccccctccttcgcgttcgacacgacggggacaccctttctcgcgcacgcgactggcgcctactcgggattcggctgccagggggatgtccatctcgccgtccagacgcagagcgacggaaactggcttcaagtcgacagcccgtctcgcggcgctccagaacagtgcggaatcgtctccacccccaccctggcgttgaacagctcgcggctccccgtcgtcgcctgggctgaagtcatgcacgctggaggtacgccgacccaggacgcgcgcatcttcgtcaagcaacgcacggccgtaggctggaacgcgttgggcggagccatcaggcaccactcgggtggcaccttcgcgtctcagcctgtcttgaaggtatcggccgctgacgtgcccgtcctcgcctggaaggaatccaatcccagcggctctggcacaacggcgacggacattttcgtgcgtcagtgggaagaccgccagtggaaggcactgggcggccctctcagcgcagctcccggcaacacccccgcggacagccccgcgctcgcattggacagcgagggcaccccggtcatcgcctggatcgaagaagagggcaccgccaggcgcgtgcacgtcaggacgtggaccggcgacgcctggctgccgttcggcactgcgcccagtgcgattccggagtccaacggcgccgccacggtatcggtccagttggatacggacggcaccccctgggtggcatgggatgccagccctggcggtgcccctccacgaatcttcgtctaccgcttcaaccgctagccagccccacgccgccagtcgctacactggcggcatggcatcctctcccctccccttcctccgcggcctgcggcccacgctgcacatcgcccaccgtgggggcgcggccgtggcgccggagaacacgctggcggccttccggcaggccgtggagcgctatcgcacggacatgctggagctcgacctccacctcacccgggacggggagctcgtcgttgcccatgacgccacgctggagcgctgcacggacggcacgggccctctggccgcgctcacgctggccgaactccagcggctggacgcgggcttccacttcacgcccgatgaaggccgcaccctcccattccggggccagggcgtgcgcatccccagcttccgcgaactgctgcgcgccttccccaacctgcgcctcaacgtggagctcaagccggatgtccccggcatcgaggacaccttcgcccaggtgcttcaagaggaaggcgccctggagcgggtgtgcatgggcagcgaactggacaccgtggccgagcggctggcggagcgtctcccttccgcctgccacttctacccccgcgatgcactcgcggccttcgtcatcgccctgcgtggcggagacacgccgccggaggacccgcgctacaccgtgctcgacatgccgctctacttcggtgagatccggctggtggactcggacttcctccagcagtgcgcggcccggggcaagtgggtcaacgtctggacggtggatgacccggcggagatgcaccagctcctggcggaaggcgtcggcggcatcatgaccgaccggccggacgtcctgaggcagatcatggacgccccctcgaagccgggataagccccggattcatgcctcgcaccaccgctcgcacgcgctcgaagcccgcccaggccgcccccgcccaggaaaaggcccccgcggcccccccgcgttcccgcaacacgatgcgtgtcaaggtgcccaaggcgcggcgcttcgtggcgctggcgggcaacatcggcgcgggcaagacgacggcggcgaagatgatcagccaggccttcggctacgagctgttcgacgagcccgttatcgacaaccgcttcctgcgtgactactacgcggacatgacgcggtggtccttcacgctccagctcgagttcctcatccggcgcgtcgaacaccacgagctcatccattcgtaccgccgcagctgcgtgcaggaccgcaccctgtacgaggacccggaaatcttcgccaagtacctccatggcctggggcacctgacgaacgcggagctggacctgtactacgagtacttccagcggctgtcgcgccacatcatccggcccgacaaggtcatctgcttcgaggtcggcagcgtggaggtgctcctccagcgcatccgcacccggggacgcgaggaggagaagggcatccgccaccagttccttcggggcctcaacggctactacgccagcttccccctggtgatacaggagaagtacggcgtggactgcctcaccatggacgtgtcgaagcaggacatccggcgaggccggggacgtgaggagttcctcgaccgcgtctccaccttcctgtcctgagcgccgcgcccgcgcctgtcacctgcgcggacattgtctggcccatcgcgttagattctgggatatccaccggatgaaccggcgcggcccggccgcaggctccgtccgacaacccaaggtgcgagatgaccgacctgagcgcgaagaatccgaaggacacggaggtggtgatgacccagctcatcctgcctccggacgccaacaacctggatgctgccttcggcggcaaggtgatgcagtggattgacatctgcggggccgtggccgcgcagcgccactgccggcaggtcgtggtcacggcctccatggatgatttgcacttccacgcccccatcaaggtcggctgggtcgcgctgctgcacggccgggtgctggccgccttccgcacctccatggaggtgggcgtcacggtgcacgcggagaacccgctcaccggcgagcgtcacctcaccaccagcgcgctgctgaccttcgtggccatcgacaaggacggccagcgcgtgccggtgccgccccttctgatggagacggacgcggaccgcatggccttccaggaggcacagacacgtcggacgctgcgtctggcccggcagaaggagaaccagtcctggttgaaggtgatgacgcccatcgcgggtgcctgacgcacgaaggccgggcgacgaggcatccgccccggcccggccttcccgcccgcgtcacgggcgataccgcggcggcgcggctcaggtcgtgaacgacgtgccgcagccgcaggaggacttcgcgttcgggttgttgaacttgaagcccgaaccggtgatggcggagacgtagtcaatctccgtgcccccgaggtactggctgctcatcgggtcggaggcgatcttcacgccgtcctgctcccagacggtgtcaccggccttggactccttgaccaggttcaagtcatagcccaggccgctgcagccagcgggcaccacgcggatggagaagaagtagccctcgaagccttgggccgtgatgacgcttttcacctgctggatggcggcatccgtcaggcgcacggccaccggagtggcctgggaagccggcgaagcggcgggggcggcggaagtcgtgggggtgctgtccatatccatgtctcctctaggggacttataacgcccgggcccggaaaatccatgggcccagcccctgggttatatgcatccgacatggctcggaccttccaaacgctgctggccggagtgaaacaggagattcgcgaggtctccgtggacgacgtgaagcggctgctggacgcccgggcctccgtgcggctgctggatgtccgggaggcggacgaatacgccgggggccggctgccaggggccctccacattccaaggggttacctggagctgcgcatcgaaagccaggtccagcgtgacgaggagctggtcgtctactgcgccgggggcacccgctccgccctggccgccaagacactgaaggagctggggtacgagcgggtggcctccctggccggcggctacaaccggtggagtgacgccgccctgccagtggagaagcccttcgtcctcaccgccgagcagaaggagcgctaccgccgccacctgagcctccccgaggtaggcgaggcgggccaggccaagctgcttcaagcccgcgtcctgctgctgggggccggcgggctgggctcgccggcggcgctgtacctcgcggccgcgggcgtcggaacgctaggcatcgtcgactcggacgtggtcgacctgagcaacctccagcggcaggtcatccacacgcgcgagcgtcagggccagcccaaggtagccagcgcccgagccgcgattgaagcgctcaatccggacgtcaaggtggtgggcttcgaggagcgcctcacctcgcacaacgtgttgacgattctggagggcttcgacctggtgctggacggaggggacaacttccccacgaggtacctgctcaatgacgcatgcgtcatgctcggcaagcccaacgtccacggctccatcttccgcttcgagggccaggtgacgtccttcgtccccggccagggcccctgctaccgctgcctctaccccgccccgcccccgcccgagctggcgccctcgtgtgcggaggcaggcgtcctgggcgtgctgcccggactcatcggtctgctccaggccaccgaggcgctcaagctcatcctcggccagggtgcccccctggtggggcggctcctcaccttcgacgcgctgggtacccgcttccaggagctcaagctgcgtcgggacacgcagtgccccgtgtgcgcgccgggcgcgacggtggagctcatcgactacgagcgcttctgcgccgcccccacgcccgcctgaggacgtcacgccatgcccattcccgagattgcccccgcccgcctcgccgagctgctcgccggccccgcggagtcccgccccgcgctgctcgacgtgcgttttcccacggagaatgcgtgggtcgccctgccggactcgctactgattcccctgcctgagttggaagagcgcgcggaggaactggaagccctgcgcggccggcccgtggtggtctactgccaccatggcgtgcgcagcctggacggcgcggcctacctgatgtcgctgggcatcgacgcggtgtcgctgcgaggcggcatcgacctgtactccctgcaggtggaccccagcctgccccgctactgacggggcggcacgccgctagcccacgaaggcggacaagtcttcggtctgcttgttgatgaggccgggcttgatctcgacctcgaacatgaagggctccttcaggggcccgccctgcagctccagcttgtggcggccctccatgaggtcgagcttcatgcccttgttgcccaggtaggtgccctggtcctggccattgcgcttcacggagatgccgcgcagaccgtccggcttcagcgtcagctggagctggccccggcggaactcgtaggtgaaggacttggcctgaccgggctcaccgaaggcgagcgtgtcgacctcctccttgtagatgccctgctgctcattcaccaggatgagcgtgtcctggagatggacgcccgtcgcattgacgaggggtgtctcccccagctccgtcaccggctgcggactgccgcagcgttcggtgtggcgcaccgagaccttcaccttctcgttggtgttgaccgacagcgtcaccgactgcccgtcggaggcgcggctgttgagcaccgagaggatgggcttgtggaacaccacccccacggccaccagccccacgatgaacccgacggtggcgatgttgcgcttggccacacccgcgcgagcgctccgcgcggacttctccagcgcccggtccacctcggcgtcctcggcgcgcgaacgcgacagggccacgctcgacgtcctcgaacgcggcgggggcgacggcatctccgcgcggctcgacgtgcggcggcgcggaggggcctcggaggggtggatgccggaatgcatcccagtccggcggcgaggaggcggcgcgggctccggcggcggaagcatggtccgctcgtcgtccagctcctcgtcctccatccgggtgcgctcatcgaccgccgccatgctcgcgcgcgagcgggacggaggcggccccgggtcctccacgatttgggcggcgcgcgtggcggagcggcgaggcgggggcggctcgcccatgccggtccggctcaggtccgaacgggagctcgtccgtgcaatctgcgtggagttggggttggacggacggcgcagctccgcggacgtcctgctccggcgcggcggcggggcctcctcgattccggacggcgcatcccactccccctgttcgtcgggctccaccgcgggcaccgcggccgaggtgcgccggggccccatggacgtgcgggaagacgagccgcgctggcgaaccgaggcctcgcccggaggcgcctcccagttcatgtccgcggcggcggaggtgcggctgcggccacgctcctgcggcggcggcgtgggcggcatgggcgtgccggagttcgcggagtcctcgcccacgggaaccacctggccctgggccttctcctcggccagacggtcggcgaagagcgtctccatcagctcggagatctgcaccgagccggccacccagcgctgcccgacgagaatctcctcgagcgccatctggaactggcgcgcgtcccggtagcggtcgtccgagttcttcgcgatggcccgcatcaccaccgggtccatctcctccggaacgtccgccacctgagagggcgcggcgatggcgcactccatggcggcctgcagcgtggccaactccgagtcgcgcttcaacggacgcacgcccgtgagcagttcgtagagcaccaggccgatggcgaagatgtccgcgcgcccgtccagcggcttgccgccggcctgctccggcgccatgtacgcgaacttgcccttgatggcgcccgacttcgtgagcgacgcctgatccgcggccttggcgatgccgaagtccaccagcttcaccgagccgtcgaagctgatcaggatgttctgcggcgagatgtcgcggtgcaccacgcgcaggggccggccggcgtcatccgtgcggctgtgggcgtagtgcaggccctcgcaagcggcggcgacgatgcgaatggccagcggccgcgccacccactgccccgtgctggcggccttgcgcatcacccggcccaggtcctcgccgtggatgaactccatggcgatgtaataggtgccgttggcctcgccgaactcgtagacctgggcgatgttcggatgattgaagcgcgcggcaatcagcgcctcgttccggaacatctccacgaactcacggtcctccgcgaggtgcgggaggatgcgcttcaccacgaggttcttgtggaacccctcgatgcccgtctggcgcgccagccagacctcggccatgccgcccgtggcgagcttcttaagaagctgatatttcccgaatgattgagggttcatcccgggacattgccggcggggagcaggctcaggtggaatgcagcagggcagcgcatcttagaggacagccacttcagaggcaaaggcaccccggattcaaatccggatgggcactgatcgccagcctcctcattgcaactaccacggttgcggctccagcgaacgatcagattcgtgtcgaacgccgtggggacgttctggagctccgctggtccgacgcggaggagcgcctccaggggaccatccaccccgccatgccaacagagggagagcccatctccgtgtcgttgcatgtaggcaacttcgagggtcccgaattcgacggccccctcaccgtcaccttccaccccaccgggtcgccttcccagcagacgaagacgctgacgcgggacggggtcaactggcacacccagttcactccggacgagcccggcccctgggacctggaggtgcggtaccgagggacccacctgaaggtgatcaccgcgcgcttctccgtggccagctcgcccctgccccgcggcatgggctgggggttgattctggtgggtgccggcacggcgctggccctgggcctgcgcaacgtcctgcggcgcgtgaagtcatccggagccacccctggggcaacggagactccgcccccaccggcggcgccctccacgccggaagcgggcagcgtccccatcccaccggccgatcctccgtccgggcagtaactccttccaaccgacgggcattcgtacagggtcgcctgccgcgacattgggaacttccgttccctgtcacggcaacgtgacgaccaagtcactggctttctgcgccatcgggcccgcgtttcgtccggaaccgaacctcccccagccctccgcgtccgctcatcgaacgggcacccgtgttgcactggacgcgctccggtggcggtcggggaggcgtggacatgggtgggtggcgggtgaatgagcggacgaggcggaacctgctcgtcgcaatcttgatgggcatgccggcgtgggctgtcgccaagacacccggcccacggacggaggcagttgccgagcccgtggaggatgcccctctgtcaggtggcgtggtggatgacgttgagcctcccgagcccttgctgccggaggaggacgacgcctcgcaggcgcagctcgagggcgccatggcccagtccctgccgcctccgtcgcagcctgcgcccggcgcgcagccgccttccgtgagtcccctccccggagcggatgacggggcgacggcagagcaggacgcgaacaagcgcaagcaaaagcaacggcccggtcaggcgcaggacgactcgctgggcgagaatccggacgcgattgacgacaagcccaagggcgaggtgcagaccatccgcgtcatcggacgcgtgtccgcacgggcccgcgctgacgagcgcaaccagtaccagcgccgcctctccatcgcggacgcacgcgtgggtgtgagcacgtcactgcccaacctggaagccgaagtgacggcggacctggcggactcgcaaatgctcaaggacgccttcgtgcgtctggcggatgaccgcaagcgattccgcctctacggcggccagttcaagacgcccttcctccagcgctcgctggagtcgtcgtgggacctgcccatccagacccgcggactggtggaggagtacatcacggagacccatcaaatgggtggccgccgcatggggctgatgggcgaagtccggctgaagcagctctgggggctcaagatctccgcgggcttcttccagggggccatcgacaatgcgggcgcgcggttgaaggaggacgccgccgcgcgcgtgagcttgcggcccttcaacttcaagcacgctcaccgtgggagtcagcacctacgtctgcgaagcaatggacctggcgcgcaagcacgcggtggccgcggacgcggagctgaagctggcgggcttcgtcttcaccggcgaggccatttccgggcggctgcccctggggcccttcacggcgcagatgctgctggcccagtacctcatccacgtgggcaacgaatgggccatccagcccgtcgcgggcgtggaggccttgcagcttcgcggcgacacggtgcggggggacggacattcactggtgggcggcttcaacgtgctgctcggcactcgcttccgggccctattccagacggagcgcgcgctgcgccccggcgatgaattccctgggctgcagcattccatcgaactcggcgcacgcttctgagcacggagaccccaacgatgctgtcgttcgcggaaggtgaagtcaccaagctccggcgggaattcaagctggtgctggaagagaagacggccgcggccctgggcacgcgcctgtcgctggagctggaggggcacctgccgtcgcccacgcgcatcgtgtccgtgtacttcgaccggcccggtggcccgctggcggcgcgggccctgctcactccggaagactgtctcaaggttcggacgaaggagtactcaccggaccggggcgcggacggcgaggcgcgggtggtgctggaggtgaaacgagagcgccacggcctcacgcagaagcgccgcgtctgggtgccgcgctcggacctgggccgcgtgctgcgcggcggggccagcctgctgccgctcatcgccggaggcagcctcagcccagtgctggccgtgacgtacacgcgcaacgtgtaccagtcgtcgcaggcgtggcgggcgacggtggatcaggacattcggtacc

SEQ ID NO: 1013 - DNA, 10838 bp, Myxococcus xanthus
taccagagcgggctgcccagcacgcgacggcttgagctgctctcggcgaagccgctccgcagcggcgcggtcgccatgcactaccggcgcgcgcactgagacgcccggccccgcccgccgggagcagggagccgaatcctccctagagcggggcggccccgtatactcccggcccacgctttctggctcacccaacgcatcagagtgatggggcctgttgagctcttcgccctcgggactgtgcgccccaaatcacatccgacatgcccccacttcaacacccttgagaagcaagctgacgacgcccgtcgctctgacatacggccacacaagaagtaaagttcgcggcgaactcaatcgaaaaccttgccttacggcatgctcaggcgtgctggctcgtgcctgctgccgctagagcgactcctgctcagtcgacgttcatttcacccaacttcaatttctgggccccgcgactgtcactgcacgcaccgcggagtcgccaaacgcccagtccgggttctgcggttgctcaacaacgtcccgcgcagtctgacaaggacgcatggctctgttccggcggcccccttcgtccaaagccgtgacacggcctgtaggacctgacaccgtaggagagcgataatcggcacgagcccacgaccgttgccagcatcgcctcgacttggcgccatggttccttccattagtgattcgagccccggacgcgtgcggcacgggttgggggccatggccctgcttctcgtggtcctcatctggggggtgttcgtcgtagttcctgtctggcttcaggccgcgcaggtatgcttcccgaacttcgacctgggtatctattcccaggcagtggcgcgcttgtcgttggcggagcccaacccgtggatcagtgcgcggcaggtcttcatcttcaacgaccacttcgaccccatcctctgggtggcccatcctctggcgcggataatcccacccatgtgggccgcgttggtcgtcgaggcactcttcgtgctgctcaccgtggcccccctgctttggctccacttgaaggggttgctgagccgcaatgccttggttctgctcgcggtactcctgctgctgagtcccagcatggtggaggccatgaagttccccgtccacccgacgacgtggtccgtactgccctgggtgctgacgggattggccttccatctgcgccgccaaggattgctcctggcgtcgctggtcctcctgtttgcctgcaaggaggagttcgctttcggaggcgtcatgctgaccctcgcgctgttcctgcgtggggagcgacgcctcgcgacattcgtgggggcgctgtcgctcgcctggctcacatgggtctatgggctgcgcccttggctcctgggccccaccgtggactacaccttccgcctcagacaggggatggagggaggctggttccactatctctcgctccgtctggctccgcctcatgtgtcgcgcatcggcaccctgacgctgctgttcgtcccactgggggtctgggcatggcgtgaacggctgcggcccgactggacctggctgctggtcctgctcccgatgctgggcatccgcttcctcgccatggcctggcggtttcactatggcgtatcggttgtcgccgcggcgctcatgggcttcctgcctgtcctccgcacccggagcccgccctggtgggtcatcgcctccaccagcgtggtgctcctcgccagcaacgagccgaacctgcggaagctcacgagcacgcttgtctctccccagacctccccgcgtcattgtcccaggacaccggagcgactggcgagcctctctcggggcgtggacatgctcacccagcacagcgagggctcggcgctgctgagcagcaaccttgtcaccttgctggcgcaccgcagcgagatttacgccgtgggcggcccacagccggacgaggggcgcgtccatgagtgggtgctcgtcgagaagcctccgcatggtgacgtctggcccctcacctccacgcgagtgcgggaactcatcgacgtctggcgcacagatgcaagcacgcaagtcattatcgatgacgagaacgttttcatggcgcgagggcgctttactgcgcaccgctgaccctacaacttattgagcgcagttctaagccaacttccgtgacgagaagcgctgcaacccggaccacgggccgctactcctcaagtacgtggaggcattcgctcgagaacaggggctcagtgatattcacggccccccgcgtcccgcggactggcgtcctggccacgctccagaatccttcaaggtggcgcatgcgattcaaccagagcgcaagcctcctccggagggcctcctgcctctgcgtcgacgacttcgatgcggacagacgagcgaagtcgcgacgtggccgcccgacgcgttccggttgatgaagctgatgcggaacctactgaggcagactgcgaccgctatctggaaggagcaccgccggctcgacatccagagggaccgagaagacaagtcgctcgccgccatcgacgtcttcgttcagcacctcatcgactctcgtctacccatcgggtgaatgtgtccacacctatgcctgccctgacataggtcgtcagggcaattgccacgaactggggcgtgtgctcagagccatgatgagaaacatggcgatcaccatgtcgtaggtgagcactgacccgaggcgcatgacagcgccaggtcttgtcgcgcttggccatccacaagggtgcggtcaattttcaacaaggatagatactcgccaggatggggttgtcgagagcttcctcatcatctccaccggtgcatcggtccgcggcatcccacgaggcgcgccggacgcctgagagtcggccccttcgtggcgtcgagaggctgggagatatctgccccccgagtcgagaagcactgcccaactcgttgcgtcacccatcatcatccacctgagcaacaccccgttggaaaacgcaggcgcgtgatttttgtcgcttgcgacgggatgttcaaactccatatcgtttcagctccccaaacccaggagcggtatgcctatcacaatcagcctcaccgaggcgcgcgctattgccaaggatgcctatctgtatggatggcctctctccgaaaattacaacacgatctatgcctactccattgatccggagaacccgaactacaaggctcccttcaatcagatcttcaatgactccaaggtgttcaccccggcggatacggccatcgtgacgccaaacttcgataccccctactcattcatcgccgcggatctcagagcagagccattggtgatcagcgtgccgtccatggtgccggacaaccgctacttctcgttccagttgatcgacctctacacgtacaacttcagctacatcggcacccgggctaccgggaacggtgggggccacttcctgctggcgggcccctcgtgggagagcggcggggacaggtccgatttcgctggcatctgctacagcgcgagtcatttcgccctgcttatcggacgcacgcaactcttcgaacctgatgaaatctctgcagtccaggacctccagagtcagtacaaggtccagaccctgagtgagtttcgcggggactcgaagccgccccaagcacttcccatcagttggccgctccccattaccggagataagagcaagacacccgaggtcttcggcgtcatcaatttcatgctccaattctgccccaccaatcccaccgaggtggggttgatggagcgtttcgctcgaatcggagttggcgccggcctgccgttcgatgtgaagtccctgagccccgacatgcttaaggctttcgaagaaggcattgccgatgcatggaaggagttcgaggacctcaacaaggaagtcgccacaggcgaggcggactcaaacgattttttcggtgcgcgggaatccaacaacaacaactacctgtaccgcttcgcgggagcgaagatcggaatctacggaaactccaagcaggaagccatctatccgatgtacagcgtggatgatgcgggtcagataccggatggctcgacgtctaaatacacgatcaccctcgccaaagacgaaatgccaccggcccaggcgttctggtccatcacgatgtatgacgccaagacccaattgctcatcaacaaccccatcaagcggtatctggtgaacagcgcgatgctggagatgggcgagttcaagactggggaagacggctccctcaccttctacctccagaaggcttgcccccggaaggaggacggggagaagaagaactggctgccagcccctgctgccccgttctacgcggtcatgcgactctacgtcccggagcctcgcgcatacgaaggcgcagacaggtggattccccctccgatgaagcgcgcgggctcagtgtcggaggagagcacctgacccgcgctggtacgccggagtcgctcgcgtttcccatctccaggcgggcctgactcacgcaggatgcggaccatctgctcctcggtaaacctgcttttcctcacgaccgacctacctcctggccgcgaggactctctcactcttcaacgggtccgagaatcggggggcagaccaccgcgtggccgcccccatcttgtcagcgctgcgaactcgaatcgccgctcccggacggctcatcagcgcgatccgcttggtcgaacctcatgcgaaccatggacccggtccttgacaagaagacgacagtgggtgtgtcaccctctctcggcacaggttccctgatctgattaagactcaaggcagccaggagacgaatctgctgccaggctggtcgtatctgttccggaaaccccgatgcttcctgctccgcaacttctcgcaggaggtggcgggtgagccacgttcctgtaccgcgtcgatggacctccgcaaccgcagcttggatttcgcccagtgaatcaggagcttccagttgtgcgttcagcgctccgagtggtgcatggccgagccacggagcaggtggggcacctgaggtcagcgccagagcagcgggaagcgggtgcgtcgcgctgccgctgccatcaaggagccaccaccccccagcatcttcacgcactttgaccggcccacaatccagcttgggcgggtaggcgagccattctcggctgacgtacatcagcgattgagcttctgaaggctcctcgatcggagtgagttcgcctgctgtgccgacgctgaaccactgccccgaggtgtgcaatacgaagtgctgcccgcccgcatccacgaatgtgcgcatgagccggaaaaatgtccacgagacctccccaatctcaatggcctcggccgcctccttggctttctctttcaggcgacggacgaaccgtctgaaatgaaaggcgccagcgcgcccccctcgccagataagttcagcaagggggccggctatcaggaacgcagggttgcagacggcccctcgggtgaagaactgaatccgctggatggattccgccacctgctggctctcgtgcttccctgtcttgcagtaggtggcgaagtgctcacagttattgaaggagagactgtagccccccttcctgagcattcccaacgcaatgaggcacgtgtggtccactacatgcacaggtgtggtgtaatcgacgacctctgacttccctttaccgatgaagtcccgcaggagcgtacgtcggatgcatcccgtgctctttcggccgccttcgaatccggtaaaatggactaccgagccatctccaagatcaatgccgtggtgccaaaaagtgctccgcgcaaccttgatatggtccgccctggccatgcagcctattcctcgcctattcggcacgcatcagcgtccgtacaatttgcgaagctggtgaaacttctcgcgggcagtgcgcttgtcaaatgaggaaaacaacgtcttgctgtcctctgtcgtgtcaaaccacacgcgcgtgtacagcccgctgctgactccaaggtagccatgttccccgttcatctcagccggacaggcgtccaggacatagagatgccgcttggatagcgttcggtagacttgctccaaatccttggaaatcccctgtattggattgaagttcatgagggtctcctggctcgtggaatgagctctcccttgcagtacacttcgtcggcgcagcatcttcctcatcgagcccgcagttcgaagcggctgaaggggaaactgcgatgtcaacacttgacacttcgttccagggaaatggggagccattgtggcgatccctcgtggagcaactcgccttgagtttcggggaggaactcgcgcgccaagtcgcggagcagctagcccagggggctcgcgttatctggcgcagcatgaagcctccctcaaggccggaaagcatcagcccgctggccgtccgcaactacctccggggcagccccttcgggcatttgggccgtgagcaggtagaggcctgggctgcgtccgaactggctgcgctcgctccccaatcccgcacccttgtcttccaggccattgcgaatagttgtccggagcggacggcacagggagttctccgctgcgtcgtcgcctacttcgcccagcaacgatgaccgattgagagcgcccttggagacaccagcccctccgctccggcgactgccctctcagccttcggcaccgtctctcgcgcggtaggcgttcagggggcgcggcgagctgaagaagaggcaggccagcagccggcgggaggcttgtcgctcgctgacgtggcgagccggcgccggcgtgcacgtaggcccggaagcctgcgggccgtgcaatctgcaccccagttgtactcaagccgcgtccggcaaggggtacagcgtcacgatgggcgacgacgagcggctccagaagcgccttcgctcacgtcttcagtcgcgcgcgggccgcgcacaactccgcgagcgtgtcgcagagaaaaagtgaacagccatgccccggcagccttcacttcatggcgggagggatgcagcgctgcatgagcggaagcggcgccccgcagcagggccaaccggcctcacctcgtcagcaacagcgctaagaacggcgcgtcgttccccggtctgaaaagcggcgctccagtccacgggctcgacgtgaacaatgggcgcactcgggagagacacgcccacggcaggaagtcgcgagccacggactccaccgccttgagctctgtcctaagcggcccatcgcctcgcggtggcgcttcagctcattacggaaggactccccctgtgtcagggaagttgtcgcctcggcggatgtgccgggcctggagccaacgaatagcttcggcgagaggtgtctgcgccacgccgtcatgtacaggaagacgtcctttgacacgcaaggccccgagggcagtcgcttcgtggagcgaatcctcacggccgtcaccaccctcaagctgcaacggcgcggtgccctgaacttcctgacggacaccatgcatgctcatcggcgtcgtcatcctacgccctcgctgctgccgactcccgaggcgattcagcttgagaacgctgcatgcgccggtgaccagttacctctgactcagtggctgccgcccaccgccagtagcgcgccgtcgggggaaccgccctggaagcgcggcgcaggacggctcccgttcgtcccatgctcgggactgacgcgttgcacacatgcgatggagtccgaggggagagggcaattgttgggggggcggcctcgggatagaaatctccgacgcagaaggaggagtgaatgtcgagtcgaaccgtctcccggaggacgttgctccaaggtgcgttggtggcagtcgcattcaatcccatgagccggagctgggcctccacgctggaggctggcgcggtccccctgccgccactcgatggcgagttgctgatggacacagcgtcgcggaccgcggccacagaggacttcggtcacatcctccaccgcacgccgtgggcggtgctcgttcccggctcggtgaaggacatcgtggccatggtccgcttcgcgcggcgccagggcgtgaagatcgccgccgctcggggcctcggtgagagccacagcaccttcggccagtcccaggtggcggcgggcatcgtcatcgacatgtccacgctgtcgaccgtccacgagattggcgagaacagcgcctgggtggatgcgggcgtccggtggcacgagctgctccaggcctcgcttccccacggcaagagcccgccggtgctgaccgactacatcgagctgagcgtcggtgggacgcagtctgcggggggcatcggcgggcaggcgtttcgctggggcctccaggtggacaacgtcctggaaatggacgtcgtcacgggtcggggtgagctcgtgcggtgctcgcgctggcgtgagcggcccctgttcgacgccgtgcgctcgggcctgggccagttcggcatcatcgtacgagcgagagtgcggctcgtcgaagtgccgccccgcgctcggacgtacaccgcgctgtacaacgacctccaccgcttcatggaggaccagcggcggctcatcgaggacggtcgcttcgactacgtcgagggctccgccgtcgcctccaacgggggtcgggcgtatcagctcgaggtggtgaagtacttcacgccgggctcggagccgaacgatgcgagactgctcgcgggcctgggcttccagccgggaacgctccaggtgagcgacggcagctacttcgacttcgccaaccggctcgcgccgttggtcgaactgctcaagcaactcggcgtctggggcttcccccatccgtggctggacatgttcgtccccgcccggtccgccgagtccttcgtccaggaggtcctctcgcagaccaccgaggccgacatggggcaggggcccatcctcctctaccccttccgctcctcggagctgaccacgcccttcctacgcacccccaacgacagacacgtcttcctcttctcgctgctgcgcaccgccattccaccgacgccggagaacgtcgcatccctcctgcggaagaaccgcgccatcttcgaccggctcacggccatcggcgggaagatgtatcccgtggatgccttgcccttgagccccgccgactggcgccgccacttccaccccggctgggagcggttcgagcacgcgaagcggcgctacgacccggaccacatcctcacgccgggacaaggtatcttctgatcaacgcctcccaaaggggcctcctcgtgctcggggtcgcatcccctgggagcggctccgaggggagaggctgtgcgctcagggcacgtacacctccgccgtggcaagtgggtgggttcatctgggcttgccccgatttcgcggggcaggctcagactcgttacatttgctgcgagcccctgactggcgcaccttcccaagagtcttggtaacctgggcggccatctgttcgtcctgggccggcgcgacgatgcgctggagcccactcacgaggcagttcggcttcaaaacgagtgagtcgccgcgcatcccgcgcatcatcgctgtcactcaccgtggcctcccttcccgagcaggaccgaaggggcgcacaccgctcatgagcgattcaacaagaggggcgatggcgcatgtgccaccgcccctcttcactgcttcaaggcaacgtcaggacggcgtcagtcctcgcgccgcctccacgcgaggagcgagagcaacgccatcgccagcgggagcgcggcagtcgtcccggtggacgagcaaccgctggactccttcggcgccgggggcgccgggctcaccgtcaccgtgacccggtcctcggcggacaggccactctccgaggagaccttcaccacgaagacgaactccgttgcggctgagacctcaggcgcggtgaactggacacgcgcctgcgtcgcgttctggagcgtcacggtggggccctcgctctggctccacgcgtaggtcagcgtcccctgctccgggtccgtcgccgtggccgtcagcgtgacggacttcgccgagaaggtggccacatcgtcccccgcgctcacggtgggcgcgagcggcacgtggcgcaccgtcacactcaccgtcgcggcctcgccactcaactgcccgtcactcaccacgagctggaagacgagctccgcgctccccttggcgaccgcgggcgcggtgaagctcggggtcagcgtatcagcgcccgtcagcgtgacgggcaggccggagacctgcgtccactgctggctgaccaccgcgtcgccgtccgggtcctccgcgcttccctggagcgtcaccgtgctcccctcgtccaccgtctgcgcggtgcccgcggacaccgccggcgccttgttcacctggcgcacgagcacctggaccgtgtccctgtcccgcagaccgccgtccagcaccgtcaggcggaaggtcagcatggtatcggccagcacctccggcgcggtgaagctgggcgtggccgtgtccgcgccactcatcgcggcgaagggacccgccacctgctcccagcggtacgtgagcgcaccacccgccaggctgctgccgctgccctgcagttgcaccacggacagctcatcgaccgccaggtcctcgcccgcctgcgcatccacatggcccgtcgtgcagaccccctgctcgtccaccagcgccgtgaagggcgtgttcgccaaccccgtgaaggcgatgtcatcgatgaaccagccaaagcccccggccgcctcatccgtgccaatgcggaagcggatgcgaaccacctgtccgcgaaggcggtgctcagg

SEQ ID NO: 1014 - DNA, 9991 bp, Myxococcus xanthus
cggggcagctccagccagtaggtcagcccgcgcgcggcgcagccggtggccatgtccatcatcccctccagggcccaggcgtggagcctgtcgcaggcatgagggtagtccggacggatggcctggtagacgacgacgggcaggcccaggtggttgcccagaccgatggcggcatccagcgcgtggttctgctcggcgcgatggttgaccatgcaccaatagaggacgaagtcgcggcggccggaaggaagcgggaggtccttcaccacctggacgcgcgccgaatcgacgccgagttcggaccacgagaagccttcaggcatggggcctcactgatacgcgagccgtattcgcgtcgcggaggaaaagaagtgcgtggctgtgaacgaggggacagggaaggtcggatggcgctccaatttcccgcacccgaggacaggttgtggttttctgccgtccggccggaccgaaggagtccttgcgtgtcatcattgagaagctggagctatctccccatcaccgccctcgctctcgcgctggtccttccggagcccgcgaaggcgcaggctgacggaacctatccatccccgggggctgcgcagccgccgtctgcccccgcgggttatgcggcccctccgcagcccacgtatcgccagacggcgccgcagcagccggcggatccgtacgcgcagccgccgcagacgcagcagcccgcggacccgtacgcgcagccgccggcgtccgcgcagcccgcggacccgtatgcgcagccgccgcagacgcagctgccggtggacccgtatgcgcagccgcagacgcagcagccgtcagcggatccgtatgcgcaaccgccgtcgtccacgcagccggtggacccgtacgcgcagccgccgcagacgcagcagccggtggacccatatgcgcagccgcagacgccgcagggctatcccccggcgcagaatgcctatcccccgtcggatgcgcgggacccggctcgctatccgggcgattccgcgacggcgagcgacgcgcccacgctgcctccggatccggactcgcttcggacgaagccgcagtcgccgctgacgccggacgaccgggccatggcgaagcggggcgtgcctcccatcgaggacactggggtgatgctggacggcaggccgcgccagggtccgttcctctccggtccgggcagcttcaccttcatcgtgcaccacacgacgctgggcgcgctgggtggcttcttcacgcaggcgttcgccagcgacttcaacttcgacaagagctcgcgagaggcaatgctcgcgggcacgctcatcggcgcgggcctgggcttcggtgcctcgtcgtggtggcagttcaacaactgggtggaccgccccatggccaccttcagcatcgccaactcggtggtgggcggcatgttcaccgcgggcctgatggacctcttcacgcaggacgcgggcgtcctgacgtggtccgccttcctgggcgcggagctgggcgcatggctcacggcgggtatcggcggtggccagcttccgctcaacgacggcttgctgatttcgtccggtgcgggctggggcgcggcctactcggcgctgctgttggccatcatccacttctccgggacgcccgtgtccggcaagacgtggcgggacacgctgctgctggctccgggcatcggcgcgggcgcgctggcgctggccaccatgcgttacaacccgacgccgtcccaaatcgtccgagccaacatcttcggcggtggcgtgggtgcggtggtgctgctcctctccggcgtggtgctgggtggtttcgatcagtccacgccgtacgtcctgtcgttcctcggttcggcgggggccatcaccacggtgagcctgctgtgggaggagagcgtggaccgctccgccctgaagatggctggccgctcagagaaggaccggccgtacacgaacgtttggtggtagacgcggcttagcgcaacctggcgcgcgccatggcatggcggggcaggaggcaccaccttccccccgacatggcgcgcgtcaatccattttcggcccttcttggctcgctggattcctcgctggagcccagcggctacgtgccgcgtggcaatgcggtgccccagccgtctcacgtccgtcccctcttggaggcggccaatcccacggccgagctgcggcgcctgcgggactcgggcgcgctgctgagggacacacgccccgcgatgtatctggtggaggtgcaggggcccactggcaagctcggcggcccgccggtgcgcttcctcctgtgtgctttgaatccggacgcgggcgcctcgctggagcatgacccttaccggcccagggcctgggaggcggagcccgctgtcacgctgaccgcggacgaccatggcgtgctgcgcggattgttggcggaggcttctgcgcgcgccatcgtcgtgtgggaagggcgctacggacagaacaccctgtcgctgcggcgcatcgagccttctcccgtgtcgaagcggctccaagccgtgctggatgaagcgcccatgcgcccgctggcggcgttgcatgagcgcagcccgacgctggcggccgtcgttcccctgtccgacccgggcctggagttgctgcccatccaccgcgcgctcaagggcgtggagaccttcaaggaggagacgttcctcacgctggtgacggcgtatgcgcgcgtctacgagctggatgagcccctgaataacccgcgcggtctggcggtggcgcgagagcgactggccacgctcatcaccgggcaccacgcggtgctgctggtgttgccgggaggacgaggccgcattctccggttccgtcaggggttggacctggcgcacctgaagggggcgccgcgcaatcccacgctgcggagcttggacctggcgttgctcaacgcgctggtgctgcggaccgtgctgggcatcaaggacccggaggcgccggggcactcgcaggtgtacccagtgcagggcctggagtcgctggtgcagggcgtcgagtcggggatgtttcaggcgggcttcgccctcaatccgccgccgctgtgggaggtgcgcgcggtgatggaggcgcaggcgacgctgccacccagcacgcttcgggtcgaaccgttgccgccggcggggctgctctatctggaccgggaggcctgacctcttggcgtgacggttctgagccatgacctgccggaggaccgaccccggcgtgttccgcttgagctccagcctgggcaggggagacgttggactcgatttgtggcggtggagtgcacgggcagcttcgcgcacgtgctgtgcaatccgccgtatcggacgcgagcatccggacgcagcagcatgttcatggagaaggcgattgcccggcacgagctgacatgtgagctccaggacgtggtgcgcgccgcggaccacctgctggtgccgcgcggcgcgctgttcatggtgtatccggcgtcacggttcggggagttgacgtccgtgctcaggcttcaccggatggagccgcgcaccgtgcggtgcgtgcatcccttggcggaccggcccgcgaagctggtgctgcatggggatgacgagcacgcgttcacggatgaggtgaacgcgatgttgatgtgaatgaaggacgcaggggcgcaggggagcacctgctcggccgtccacggctcttcaagcgtgccctggctggcaagatattgagcggaggcagcgcagattttcatgccggagcctgttggcaaccagcctccgccggtgagagttggaggcggcgggaatcgaagccgcacaggcggatttggtccctactcggaccagaggttgcccgcccggttttccctctgaaaagaggggtggccttccgtccaggtgagtccaggaccgtccattggatttggttcttttttggtccctgcggggaactaaaccagccggagtacagcgccggatagaaccccgggcatcgcgccaccttcgggccgtggtgcccatccagcgcgctgtggtggtcagcatacaagcccccgcgcactccaagccaggatgcccgcttgcgccgactgccacctcggaccgtggagcctgcccagtgcatggtgaacgccacgcgcgccgagcgccacctcgaaaccgtgaagcctgccggtgcgtggtgggctccacccgcgccaagcaccgcctcggccgtatgaaagccatccccgctgagcgtcacctcggggccgaagagattgccggcgtgcattggcggccccctggcgccgcgcaccaccagggatcgtggatcccgtccggtgcgtagtggcggccacgggcccataccgagccccacctcagaactgtggagcttgcctgaagcggggtagacgctaccggcgccgcgcatcggcacgggtaccgggagggtcatccggacgggtaccggcgaactcgcgctgcgtcagcccgctcgcttcgaactactcagcgacccgtagccactccggcttcacaactctcttcggcatccgtcgagggatgaccgaaaccgctcaggtcggcaatgccccgcagcacggcgtccgccggacggatacgggccacccaccccacgggtggccccgtgtgcccctgacgatggcttggtcccatgtagctggcgaaagtccccgtcccctggccctatgagactggagaccgacacaaacctcacgagattccacacgctttaggattatctcctacgaatcggtggcggaattgattgctgcccctgtctcccaaaaaccaatttctgagtctgatataaaagctctgcgacatcctgggccgcaagaaatagctctaggcatctatgagtgaattcaaccaggaaaacacttcgtttattcgcttcgtctttgagcccacccgcgtagtaaatcactcgctgctcgacaccctcatacttgtgaaaaccatgggcgatgctactgcaaagtggctcatcccaatagttatgcaagagacggtcgaagacctctgaaccgtccagatattgtgcgcgcgcatctagcgacttgtcttcatattgagaaagagtctggacatcttctctgcgcggagccatccgggaccagcctccgcgattgcgcacgttgttccaaccgacaatgagcgtgagcgattcagaaataatctcatgggagaacagaaacaactgcttaagatcctcgaaagaagtcgtagtaactcccttgcgctcaagcaagtctgggtctctgctctgataataacgcaagccaaacacaggaattaagaatctaaaacgctccacaaacaactcagtaagacaaaggaacttctcctcaagctgctgaaggtaacccctctgattcagcatctcaccaaaatccatgagatctgcaatttgggctgccgaaaatttcttgagcgccttgaatatcagcttggttatctcttcaaagcgctcgggattacgaatcgggctaatgaagagcagattcagacgatgcacagccataagtgattgtaattcgttgcttatggacagctgattgggtgctaggaactccaatctcgcctgcatggtcaaaatttcccgcgcaagctgaggaagcgccctactgagccatagctgatttatgcgctgaatctgcggccaagacgtcttaaggatgtgagaaaaccgctgtatgtttctaccaaactcctcatatcccttgtcgcccatcaccgcgaatgcttttataaatggactaaagtcgagaggtggcgcccttctgtctaacttctggagtttctcggtcagaaattctggcgaggcttcgatgtagaagtcgcctgattcatcatccaccagcttggcatttcgatagtccacccaaaatttgggcttgctttggctgacgaaagctgtagcagagatcaagacgccgcaggatccgcagggcacgcggatcggatgctgctctagataaccaatttggatgcggatcaatgttgtggctgcacaaaactcacactgcacaatttgtcggaagacggccatggcgctgaggactggctcgggtattggttgagatgattctgccgaaaatagggaactctagtacgcaggaacacggacctccaagcccctttggaggtctagtaggcaggcacagaggtgcagctctgcttcctacctcaattgcctagggccacattcctcatagctgtagaatactgggccgctatgccgaaggatatcatcgacttccaactagagcgtgggcgccacgaacaactgttagggaggcaggatgcgctgaccacgctggattcgttcctgctaagcggagaatcggcacgtgggtggttgctggtcaagggagggcccgggagaggtaaaagtgcgctgctctcgagttggctgggggctcgggagttagcggggcagagagttccgcaccatttcctccgccggggcgtggaggactgggaccgtcccgaggtggtagtacgcaacttagcggcacaggtggaggcactctatcccctgcatgccgatttggaggcgaaacccgagtcgcggttgcgagaggtgctgcagcgggtatccaccgcagtcctggtgccacagaggaagcagctcgtgctgttagtcgatggactcgacgagttggatgcgagcggtccaaacccactgccgcgcttcctaccgcatgcactgcctccaggggtgaaggtcctgtgctcttctcgccctatgtacccgcacctgagttggctagaggctcgggataacgtgcgtaccctcgatctagatgggcaacgatgggcggcttctaacgaggaagtggtgcgcgagtactgggcgcacgtggcgcccaaattcacaccatcgcttgagccatccttaatggcccaagcaataaagaatgcacagggaaatgtacttcacgcggtgaaattggcggagtggctgttggagcaacccgccgaggaacggcgggcggcgatgctgcccagcggcctggatgccttccttgaggatgcttggcaacgcatccaagatcaacccatggaagtccgggggatagtgcttgagggattggagttggtggcggtagcccgcgaggcacttcctttatcggtactggccgatgtcgcagaatggaagggtataagtgctagggaacagttcctacgtgtggcgcggccgttcctactggaggagtcaggtcactggggcggggagaaggcgtggcgcctcttccacaaggcattccatgatttcattctatcgaagttaggagagcagggggagctacagcagcaccgccggttggcggagaatatctgcaaatggtcggtggatgcgcctatcagtggttttcgtagaaattatactttacgccatggcgtgacacactggctgaaggcacaggaatggcaacatgtgcgcaagctctgcatggatctaagttttttggaggcaaagtgccaggagattggcattttcgccgtcgaggaagacatgccgcaggcggtggatggggtcggagaactctacaagacggcactgcgggatctacaccaagctgttcgagcggagtctcactggttacgcgaagacgcagcggccttcccgcgattaatttacaatcgactactctcccaggatggaaagctgcacggattgcagagatgctgcattttcccggcggcttgcctgcactccgtctgcgacatcccgtgagactaaggcacggggaggttcggacactcaaagggcatgatggtccggtcaatggctgcacggtgacacccagtgggtgggtggtgtcggcctcggacgacaagacgcttcgggtgtgggagttggaaacggggaaggaactggcacgaatggaaggccatgaaggttgggtgcgaagctgcgcagtaataccggatgggcgggtggtgtcggcttcggatgacaagacgcttcgggtgtgggagttggaaacggggaaggaactggcacggatggaaggccataagggcccagtctggggatgctcggtgactccggatggacggttggtgtcggcttcattcgacgagatgctcagggtgtgggaactaaagacgggaatcaaactggcgcagctggtgggccataaaggggcagtcaatggctgcgcggtgactgtggatgggcgggtggtgtcagcttcgtccgacgggacgcttcgggtgtgggagttggaaacagggaaggaactggcgcggatggagggccatgaagggccggtcaatggctgcgcggtgactgtggatgggcgggtcgtgtcagcttcgtccgacgggacgcttcgggtgtgggagttggaaacggcgaaagaactggcgcggatggagggtcatgaacagccggttaatggctgcgcggcggcagcacatggctgtgtcttgtccgcctgcaacgataagactcttagggtatgggagctggatacagggagagaggtagcacagctggaaggccatgagggcccagtcaagagctgtgctgtaacggaagatggatgggtggtatcggcatcggacgataaaacactaagagtatgggagttggagacggctagacagtcagctcggcgacaagatcataaaggcccggtgtggggatgcacagcaacatcagatgggcggctagtgtcggcctcttccgacaagacgttgaaggtatgggagctgaaaacgaaaaaggagttggcgcggctagaaggccatgatggatgggtgaggggctgcgcagtgacagcgaatgggcggctagtgtcggcctcttccgacaggacacttcgggtctggaatttggaggcagggaaggaactgatgcggctggaaggccatgccgggccggttaatgactgtgcagtaacggcacgtgggcaggtggtgtcggcctcttccgataggacacttcgggtctgggatttggagacagggaaggagctgatgcggctggaaggccatgacgggccagtgtgggactgtgcagtaacggcacgtggacaggtggtgtcggcctcttccgataggacacttcgggtctgggatttggagacagggaaggaactggtgcgactggagggccatgacgggccagtgttgggctgcgtaatgactgcggacggtcgattggtgtcggcctcatctgacaaaactctgagaatatgggaaccaacaacaggcaaggaactcgctcgactagaaggccatagagggccagtatgggattgcgcgatgacggcagatggaatggtgatatcagcttcagacgacaagacgctgggcgtgtgggatatcgcttctggtcaacgcattcatacatttcatgggatgagtggatttcgttcagttgccgtcactagggataccgtttgcgcaggagataccctaggaaacatctggatgacggaaatagaaccggcacgagtcaaccaagagcgaagccccaaagaaaagctcgaatcaggaactaccgtgagcgtcaagatcccagcacccgttctcgaagcatatcgttccaataaactagccctcttcgtcggctccggtctatctctcggtaaagacgttcaaggcgacttccccacctgggggaaactccctgaacgactgctcgatgcttgcaagcgctatgactcgctcgatgaagaaaccatccggttgaagcacgcgctatttaggaaccgcatgcggctcgaatccatgctctccgaactggggacgctccgcaccagcctgggtcgagattatcaaaatgccctcaatcatatttttcgtccccccgatgctgctccgggcaaagcacaacatgccgtgatacaactcggcgtccgcgccatacttacgaccaattacgatcaacttcttgagctgactccagaaatgccccgcagacaaccatatacatggaaagattctgacaaggcgctcgccggcgtgggt

SEQ ID NO: 1015 - DNA, 10424 bp, Myxococcus xanthus
ctctccagacaaactgctcacggacccgtactccaaggccctgcaccgcgaccacgactggagcaagggcagcacggccagcggtccggcccgcacgcaggtgacttacgcggcctccgccaagagcgtgctcgtcaagagcggcgactaccagtggggcgaggtggagcagcagtggcgcgccaaccgccaggacgagaactggcaggggcacggctggcaggacctcatcgtctacgaggttcacgccaagggcttcacggcggaccccgcaagcggtgtgcgcttcccgggtacctaccgcggcttcggtgagaaggcggcctacctggccgagctgggcatcaccgcggtggagctgctgcccatccacgagaagccgctggacggtggctactggggctaccagaccatcaacttcttcgcgcccgagctgtcctatgcggccttcaaggagccgcaccaggtcatcaacgagttcaagtggatggtggagcaactccacaagcacggcatcgaggtgattatcgacgtcgtctacaaccacaccggcgagggtggcctctggcgcgagaagctggagacggatgacgtcatgcccggcgagccgctggagtccctggaccccgcggagacggctggcctctattcgttccgcggcatcgacaaccaagcgtactacgcgctcaacccggacctccgcacgtattggaacaacactggcgtcggtaaccagacgcgccccaaccaccggcccacgcgcaagctcatcatcgacagcctgcgcttctacgtggaagagctccacgtggatggtttccgcttcgacctggcgcccatcctgggtgagcgggacggcgactacaaccgctgggatgacccgcgcaacaccgtgctccaggacgtcatcgacgacccggtgctccagaagtacaacacccgcatcatggccgagccgtggagcgcgggcggctggtactgcatgccgctgggcgagttccccaacgccaagacgcagccgggcaatggctggtacgagtggaacggccgcttccgcgactggtggcgcgcgttcatgaaccaggatggttggaagctcaactccaacgagggttcgctgtgcggccggcctggcaccgtggacggcggcttcctgatgtacggcagccaggagtggttcgagcgcaatggccgccgcccgtatcactccatgaacttcatcaccgtgcacgacggcttcaccatgtacgacctgttcgcgtacgacgagaagcagaaccgctgcggtccgctgaacccggtgtgctgtgacacaccgaacagtcccttctgcgacaaggtcagcggcgaggagcacaaccgttcccgcaactgggggccgattggcgacgagcgcgcggagagcatgcggcggcagatgattcgcaatgccttcatgtcgatgatgatcagccacggcacgccgatgatcctgggcggcgacgagtggatgcgcacgcagttggggaacaacaacgcctactccacgctgtccgacaaccccttcaactggtaccagtggggtacgtacctggcgcgcgacgaacgtcaccgcatgttcgagttcgtgaaggctgccatccgcctgcgcaaggagcatgcctatgccttcgctccgaaggactacggcaagggcgcgccgctggcctggaagagcgcgcagaacacggaggcggcgtgggacagcaagcagttgatgattcactatcacgacgcgtcctacgggccggagttgctggtgctcatcaacatggagccccgcgcggtgacgttcacgctgcccgaaggccgcaagtggacgcggctcatcgacacgcaggcgtacttcgacagctccgcctatctcacgacggcgggcctggatagccggtccacgggtaactcgtggcttgatgcaccgtcaccagtgaacggtccgacgtacgggatgccggaaagaaccatcgtcgtcctgcgtgcggagtaggcaggcaagcaggttgcgctataagcggggcccgcccatgcgagtcctgcctgcgcgcctcggcgccatcctgttgacgttcctgccactcattgccctggccgatgcgcctcgcgatcgcttcggggccgcgggttacttccgcatcatgacccgcccggacttcgcgggcggctcgggccaactgggctattactggctctacggtcggctcctcaacgaaagcccttacggtgagctcaacctccgtctggacgcgttgcaggccacgccggggaccgacgaggtgtgggccgaggtccactcccgtatctctggcaggtcgtttcgttcggcggaccccggtaatggctcactggtgaacttcagcgctgactacctcttcgtccgcgccggcaacatcctgctggaccgggtgacgtggcagctcggcacgctcgaggaccgctggaacgacctgcacatctatgaccagcgtcccggcacgctgctctgggacacggtgggcctgtccggcacgtaccagggcgaccgctacgacgtcctgctggcggtgggggacagcggctacacgctgcgcccgaacaactacaacacggtgctgacgggcgccgcgtcgttccgctaccggttgattcccggccacctggaggtgggtatccgcggccaggtgggctacgagcccgcggtgcgcggcaaccggaacgcgctctacgcgtcgcccgggaccagctacgagaacttcgcgcggcgcgaggtggtgcggcgctacttcgaggccaacccgggcgcggaggacctggtcccggacctcaaggcgcgcagcgcgctgtcgtaccgggccatgggctacgtgggcttcggcggggtggggccgctggtgtggagcaacctgtacctgacgttcgagaagcgccatccgcagcccttctacacggagaacttccggggccgggactggaccgtgtacgtcacggaccagaccgacgagcgctacgacggcaacctcggcaacgaggcctacctgcgcatcatccccgacaagctggaggcgctctggggcgtgtgggctggctactcgttcaacaaggacaacaagatcgccgcgggtgaggacaaccgcgtcatcgcctccacggtgctccgtctccagtacttcctcaccgacaaggttcacctcctggtggagagcaccgtcgcgcgcgagaagagcctgaacggcaatctctaccgcaaccatgtggactcggtgttcaccagcaccgacggcatggcggacgcgcgcggcctggagttcggtgacagcgacacgcgcgacacctggcagttcaaggccggtgtggtgctcaaccccacgggccgcagcatctacgcgcgccccagtctgcggctgctgtacgggctccagcgctccacccaacatgcggcgttcggcaactccttcgtggacagcctggaccagtacaacgtttacgtcggccccgagcgtcactggcactcggtggtcgcgatcgaggccgaaggatggttctgacaaggcgatggagcgtggtggtctccctcacagcggcgctggccgcggtgacgctcgcggcgtgtctgcctcgcgcggcgcctccgcccctggcgcccagcggcacggtggtcgccgtggcctacgtgcgggatgatgcgaggcgggccggcgtggtggcggacgtcccggaaggactgaagcagcgcatcgcggagaccctggccaggcgcaacctgcgcgtggaggtggtgccctacgcggactacgccgcctacttcgcgaaggtgcgcgactcgcagcgccgcttcgagatgctgaaggcgctgacgccggaggcgccgctgcacctgctggtggagacgcgggtgtcgttcttcagccaggtagggggccgcttctcgtgggacatctcggtgcggaccacgggcgcgcgggcggactccgccatggcgcccaccgtcgtcacccaggactacggcgcggcgcttcagttcgaccagcagcgcgaggacgatgcacagttggaggtggccacgcagatcgccgggcaggcgggcgcgctgttcgactccttccttgcctcgcccttcctggtgccggacacggacggtggtccgggcacggtgccgggtctcgacgcgccggccggaccgggcatcgagccgggcacgggcacgccggccgtgcccgagccctaccggggttcgtgggagccgccggcgggagacgcggtctacttcgtgatggtggaccgcttctccaatggagacccgaagaacgacggtgcagtggacctggaggacgcgcaggcctttcacggcggagacctgcaaggcgtcattgaccgactggacgggctgcagcagctcggtgtccgcacggtgtggctttcacccgtcttccagatgcgcaccgacaagttccatgggtacggcgccttccacggtaactgggtggagggtttcggccgggtatagccgcgcttcgtacagtaggccctgttgaagactctgccgtggcagttgtgctgctgggacatgcgggtggttctgtacgtggtgctcaactcacgtggggccatggacgagcctgtcgcgtgagctgcctgattggttctacgccgtgggtcccatcaaggactggggcgattcacgccagttggtcatgggatatgtgcacggccttccggacctctctagtggagaaggaagatgtgtacgcgcacctgctggcgcattcgcgccggtgggtggacgtgctccagcccgcgggcttccggctggacgcggtgaagcacatgcccacctccttctgggctcgctacaacgcgacttgcgccagcacgcggggccggacttcctgctgttgggggagatgctggacggcgacccggtgctgctgtcgaacacgatgaaggaaggccgcttcgggacgatgttcgacttcccgctggccttcgcgctggtggacgtcttttgcagggaccgctccccgtcgcacctgggcgccatcctcttcaacgaccggctatacccggcgccgggctcgctcgtgacgatggtggacaaccacgacctgccccgggtgatgagcgagtgcggtggtgacgtggagcgggtgaagcgggcgctggcggtgcagctcaccgcgcgcggcgtgccggcgctcacctacggcaccgaggagggcctgacgggcgcgaaggagccggagaaccggggggatatgcgcttcacgaaccacccgctgcggtcgtggattggcgggttgctggcgttgcgtcgaggcagtgcggccctccagcgtggcgagacgatgattctcgccgcccgggaggacctctttgcctacgcccgcgtcaccgccgacgaggttgtcgtcatcgccgtgaatacccgtgacagcgccgtggacgtgccgctgcccgacgggctggccggcgcgaagctggagccgctggccctggcgccgccgctggccgccgggggcgcgggcttcatgcgcgtgcccgccggcgaggtggccctggcgcggctgacgcctccggcggcgggcggcttcgccacggcggcgaagctcgcgggtctgcggtggcgggggctgggcacgcggcgccaggtggagctggccgtgggggacccgtcggtgcggttggtgggcagcgggccggagatgggcgggtggaagcccgagcgctcgcttcgtccagggcccgagggcttcgcgctgtcgctgccagtgggcgccgtcttcgagtacaagctcttgcgcggcggctcccagggctcttttgactgggaggacggcgccaatcgtctgctgttcgtggacgaaggcaccgggccgctgcgccagacgctggcgtggagccagcgctgaccgcacctgtttcattcgccccgcctggcgcggggcccactccgaggttcgaagtgaacgaccgactcctccgcgcggcgcgccgccagcccacagacacgacgccggtatggctgatgcgccaggcgggccgctacctgcccgagtaccgggccatccgcggcaacatcgccttcctggacttgtgcaagcacccggacctggcggcggaagtcaccgtccagccggtgacgcgcctgggtgtggacgcggccatcatcttctcggacatcctcatccccgtggaggccatgggcatcaccctggagctgggggacaaggggccgcacttccccgaccccgtgcgctccgcggcggacatcgacaagctgggcgtgccggacccggtggagggcaccggcttcgtggccgaggccatccgccgcacgcgcaaggcactcaatgactccgtgcccgtcatcggcttcgcgggcgcgcccttcaccctggccgcgtacatggtggaggggggcggctccaagagctacatcctcatcaagcggctgatgttcgagcagcccgagttggcgcaccgcctcttcggcaagctcaccgacacgctcatcccctacctgaagatgcaggtggaggcgggcgcgagcatcgtccagattttcgactcgtggggcggcgcgctgtcgccatgggactacgagcgcttctgcattccctacctcaagcgcatggtgtccgagctgaaggccaccggcgtgcccgtcatcgtgttcggcgtgggcatgtcctcgcacctgtcgctgctcaagagcaccggcgcggacgtggtgggcctggactggacgctgcccatggacgagggccggaaggtgctggggccggacgtggcggtgcagggcaacctggacccgctgcacctgttcctcccccgcgaggagctggacggccgcgtgaaggacatcctccgccgcgcgggccccgaagggcacatcttcaacctgggccacggcatcctcccgcccacggaccccgacgccgcgaagttcctggtggaggccgtccaccgccacggcgtggccctgcgccagggcacgctgggtgcctagggtcgccttcccccggggcggacagtcgccccgggggagtgtccaccgattgatttttgaatcaacggacgattgacgcggcgcatcgccgctcgttagatgcccacctcccgacttcgctggaggtgtggcacacatggcaagcgagaagcgcaacggcccccgaagggtggccatcgtccgcggcctgcggaccccgttcgtcaaggcgggctccgtcttctcagggctgacggcgctggatttgggccgcctggtggtccaggagttggtccagaagacggacctggacccgaacgtcatcgaccaggtggtgttcggccaggtcatccccacgttgacggccccgtccattgcccgcgaggtcgtcatcgcggcggggctgccgaagaagattgatgccttcacggtgtcgcgcgcgtgcgccacgtccatccaggcgctgacgacggcggccaacgcgattgccacgggcgaggcggacgtcatcatcgccggtggcaccgagtccatgtcggacgcgcccatcttcaccagccggccgctggcccacgcgctggtggcggcgtccaaggggcgctcgctgccggacaagctcaagcccttccagcgcctcaaggccaaggatttgctgccggtgcccccggccatcgccgagtactccaccggcatgacgatgggggagagcgcggagaagatggccaaggagaacggcatctcccgcgaggagcaggaccgcatcgccttcaactcgcaccgcaacgcggccaaggcgtggaaggacggtctgttcgacaacgaggtcatgcacgtcgtcgtgccgccgaagttcgacaagacggcggagcgcgacaacatcgtccgtgaagactccagcatggaggcgctggggcagctcaagccggcgttcgaccgcaagtacggcacgattacggcgggcaacgcgtcgccgctgacggacggcgccgcggcgctgctgctgatgagcgaggagaaggcgcgcgcgctgggctacgagccgttgggcttcctccgcagccacgcctacgcggccacggacccgggcgaccagttgctccagggcccagcctacgcggtgcccacggcgctcaagcgcgcgggcatgacgctggcggacatcgacctggtggagatgcacgaggccttcgccgcacaggtggccagcaacatccaggcgctggcgtcccaggccttcgcgaagaaggcgggctggagcgcgccggtgggcgaaatcgaccgggagcggctgaacgtgacgggtggctccatcgccatcggtcatccctttggggccacgggggcgcgcatcgtcacccaggccatcaatgagctgaagcgtcggaacaagaacacggcgatgtgcaccgtctgcgcggcgggcggcctgggcgcagtcgtcatcctggagcgtgcgtgatggccaccaaggcggaagagctcgaggtgaagcagggcttctcgtaccaggtggagggcggcgtcgccgtcatcaccttcgacctgccggactcgccggtgaacacgctgtcgccggagacgggcgaggccttcctgcgcgtcatgatgcgcgcggagcgcgagcccgaggtgaaggccgtcgtcttcacgtccggcaagaaggactcgttcgtcgccggggcgaaaatcgacttcctgcagaccatcaagacggcggaggaggccaccgccatcagccgcaacgggcaggagggcttcgacaagctggccgacttccccaagcccgtcgtcgcggccatccacggcgcatgtctgggaggcggcctggagtgggcgctggcgtgtgactaccgcatcgccaccgacagcccgaagacgtcgctggggctgccggaggtgcagttgggcctgattccgggcgcgggcggcacgcagcggctgccggcgctgattggcgtgcaggcggcgctggacctcatcctcaccggcaagagcctcaagcccgcgaaggcgaagaagctgggcgtggtggatgaggtggtgccgacgcccatcctccgcgccatcgcggtgctgcgcgcgaaggagctggccgacgggaagctgaaggtggaccgccgtcatggccagggcttcaagggcgtggccgcgaacggcaaggccaaggggcttgcgggcttcatccagggcctggccaacaaggagctgtgggcggaggtggcgctggaggacaacccgctgggccgcaaggtcctcttcgaccaggcgcgcaagcagctcctgaagaagacgcgcggcaagttccccgcgccggagaaggcgctccaggtcgtgcgcgtgggcctggagtccgggcacaaggcgggccaggaggcggaagcgaaggcctttggcgagctggtggtgtcggacgtctccaagaggctggtggagatcttcttcgccaccacggcgctgaagaaggagaacggcacctccaaccccgacgcgaagccgcgcgaggtgaagaaggtggcggtgctgggcggcgggctgatgggcggcggcatcgcctatgtcaccagcgtgctccagggcgtgcccgtgcgcgtgaaggacaaggatgacgcgggcgtgggccgggccatgaagcaggtgcagtccatcttggacgagcgtgtgaagcggcgctcgctcacgcgccgcgaggccacggcgaagtcggccctggtgacggcgggcacggactacagcggcttcaagtccgcggacctggtcatcgaggcggtgttcgaggacctcaagctcaagcaccgcatcatcgcggaggtggaggccgtcaccggcgaccagaccatcttcgcgtccaacacctccagcatcccgattacggagctggccaagggcagccgccggccggcgcaagtcattggcatgcattacttcagcccggtccacaagatgccgctgctggagatcatcacccacgcgggcaccgcggactgggtgacggccacctgcgtggaggtggggcgcaagcagggcaagacggtcatcgtcgtcaacgacgggccgggcttctacacctcgcgcatcctcgccccgtacatgaacgaggcggcttacctgctggcagaaggcgcggacatcgcggagctggacagggcgctggtcgagttcggcttccccgtgggcccgattaccctcctggacgaggtgggcatcgacgtggcgcagaaggtgggccccatcatggaggccgccttcggcaagcgcatggcggcgcccaaggccctggagaaggtggtggccgacggccgcctgggccgcaagacgcagaagggcttctacctgtacgaggacgggaaaaagcaggaggtggacagctccatctacgccctgctgccgcacggcacggagcgccgctccttcgaccgcgcggagatggcggaacgcgtggtgctgc

SEQ ID NO: 1016 - DNA, 11805 bp, Myxococcus xanthus
  unsure (1)..(11805): unsure at all n locations
tcagccgacgccgtgtcatccgggaacgcgtcgcagtactgggggagggagtactgccagaaggcgaagtacgtctcgatgacggcgtgctccagggcccgctcgaagccaaggtggttgtaggtgaggccctggttcacggcataggcgcgcagcagcgccaccatctcctggcggcggttcagtacggcgcgctggaaggtgtggatttgctcgcggcacccctccagctgcggacctcccacggtggcttggaaggcggggaaacgctcatcttcgccgcgcacgagcggcgccacataggccaccgtcgcgtccacgtcctccgggtggaaccggcggtagaacaccatggtctctccgcccttgctgacgcccgtggacacccaggacgcggaatagatttgcttgattgcctgagcgacccggtggaagtcgtccgctgactgcttgatggtgagctggctccagtcagcgggctccggacggctgggcaggaagaagcggtgctcgatggagagctgattcgcggccagcaacgtcgtcagctcgcgacggcccgcgttcagggacacgtagtagccgctcgcgtagaagaccatgggcgccgtgaccgaacggtgcagaaggaccaatcgctgcttgaatcgctggcactcggggcgtgcgtggtcggcgggctggtcgtactccatgacaaagaagcggtgacccgcggggaccgtgacgccgttggggttctccgcgacggtgaggccgggaatggcccgcagccggtccaggatgtccgcggtcgggtcctggatgacagtcgggtcgcccgggttcgagacaccgccatccggcggcccgaacgggcactcctgtggttccgtgcccccgtctccggtgcccccgtccgtcgggcccgagcctccgtcctcctcacccgtgcccgcgtcatcggtgcccgcgtcgtccggctccgtgcccgcgtcatcggtgcccgcgtcgtccggctccgtgcccgcgtcgtcggtgcctgcgtcgtccggctccgtgcccgcgtcgtcggtgcctgcgtcgtccggctccgtgcccgcgtcgtcggtgcctgcgtcgtccggctccgtgcccgcgtcgtcggtgcctgcgtcgtccggctccgtgcccgcgtcgtcggtgcccgcgtcgtccggctcggtgcccgcgtcgtccgtacctgcgtcatcggtgcccgcgtcatcggtgcccgcatcgtccctgcctgcgtcgggcgtctggatgcctgcatcctggcggggctcgggcgtgtcgccgccgcaggccgtctgtgtcaaggccagcagcagcggaagtagcagcaggatggagtgagacaaccttcttgaacggagcatgaacccctcagttgatggacgcggtgtcgcagatgccttggctgcgagactgtagcgcatcggtctgccgtcgccgtgccccgttgtggtgcgggtgccagtccccgcgcgccgctggaggattccagccggagcgctgtctgccttcacgttcgatggggcgcttgccgtcatccgagcacgcgcgatgtaatgcgtgcatgccccatcgcgtgacgttcgccgtcgatgccgtgaagcccgccgtcctgcccttggaagaggtcggactcaccgaagccctgagtgggcggttggacgccaaggtgctcggggcctcccatcgcgaggcgcggttcgttcgtcccgaggcgacccatccactgctctccgcggtgcatctcgccttcagcgggcaccgcccattggtgctgtctccggacatcctctggatcaccatcgcccaggggctggccctgcacatcacccgcaacgcggaggcgctgcgattcgatctggtacgtcaccaggggcgcaagcagttggtggtgacacgcgacgcgtcccagacggacctcgcatcggatgatttctggcccggcgtcgtggacgacttctccgggatgattcaagggcactcgcccgcactgcacgacctgatggtgtgcgatttctccacgacggggccggtggagcgcgtggtcagtcaaatcgtgctgatggatgcgatgcgggagtacttcgactacgtggtgatgtgcatctgcggcattcccaccatcacgctcgagggctcaccggaggactggcgcaagctgcgggacaaggtcggacagcttcctcggtacggcatggaaacctgggcccggcacctgctgccgctgtgtgaccagttcatccgagcttccgagggacgggaggatcgcaaattctggcaatccatctacaagctgcaccacgcctatggcagcgataccttcaatggctggattggcaagctgttccccttccttcgcaatcaattgacgggcgaatatgactttcccaatccgatgctggaggcccaggcgctgggcaagcccgacgccacggagaagggcgaaaccctgtccagtgacagattgcccaccgggctgtcccgggtgtcgctcctgctcgcagtggccaccgattcagggatggtgaaggcacggatggccctgacggcgggcttcatggggacgctccagtccgcggagacgctggcgctgcggccggtgccaggctgggtggtccacgaggacctggggctggatgcgatgctccggcgcatcaaggatgagcaccgcatggccgatgccctctcggaggcacgtcacagcaagtggcgcgacctgtggggggaatgtggaatcccggcggacatcagccagttctacgccgcatgcgacggcgcgtcgctcttcggccagggggatgcggccgtgtaccgcatccgggcgtcgggggcgctggagttccacgacgggacgcgctggaacaagacccgtctggcagatccgcaatccagcggctacccgcacggctggacgcgcttctgtgacgtgggcgaacacggcttcctggcctaccgtttcaactcacagcagcatgggaagctcccgctctactgggtggaaagcgctcagtcgcggaccggcgtgtgcgtcgccgcctcgctgacggagttccttcacaaggcgctcaattcacaggggcgcgtctacttccaggagccgggcttcacgccgggagaggtcgaggagttgtggttctgattcccttgagagggattactcccgcctgagcgtgaccgtggcggcgccgtcgatggcttcgcgtggcttgcccagggagagcccccggagcgccttgttgatgcactgggcgagcgggatgagctggggcgggtgcatgcgtgctccgaggacgatgccctcgggggagtagaccacggcgtaggtatcctgacggcatgcgacgtcctcgccgttccgcgcgtagcaactgtcgagcgcgggcaggcgcccttcaatggactcggcgacccagccgtccgcgtacccgcggggcgcgggcgcgacggcgccgttctccgtcaggcggggcagctcgatgactcggaggtgggcgagctcctccgtgggcgtcatcccagaggccgtcaagacgagccctcccgttgcggcgaggcccaccgccagcgcgctggcgaccatgaggagggtctgcaggcgggagcgcgtgcgcggcggggggacgtgttccgccgcaacgaggacgggctgcgggccggagctcgtgtgcggtgtggcgacgtgttccgccgcgacaggcgttgagggtaccggtgctgtgttcgcgggctccaggggcgcggcgcttgcgacttcaggctgaggggccgaaggggccgccacggaggcggcgtgaatccagtgctcgagcgcctgggccagctcgtgggagtccgcgtagcgcgtggccgggtccttctccagcgtgcgcgccaccacctgggagaaaccgtccggcacgtccgtgcgcacgccgttgagcggagcgggcacctggtgcatgacggcggagagcagggccacgttgtccgccacatcgatgggccgctgtcccgtcaccatctggtacaggcaggcgcccagcgagtagatgtccgcgcgtccgtcgacagggcggcagcggatctgctccggggccatgtacgacggcgtgccgacccatgcgccagactccgtgcccagcgcggtggcgtcgtcttcgtgcatgagccgcgcgacgccgaagtccagcagcttcacgtggagggcttcggtccccgtgtcgaccaggaagatgttgtcgggcttgatgtcgcggtggacgacgccggcttgatgcgccaccaccagcgcgttcgccacctgatgggcaatggcccccgcgcgttccacgggcagagggccatccttattcagcagccatttcagagtctggcccttcagcaactccatcaccaggaacgccggttcatcgggtgcgtcgtgaaagtccatcacctcgacgatgttcggatgcttcacgcccgcggtggcctgggcctcgcggcggaagcgtgcagtgcacggccggctcaccgaggaggtgctgccggagcaccttgacggcctcggttcggcctacgtccagttgctccgcctcgtagacggtgcccatcccccccacgccaatccgctggcgcagtcgatacttctgccccagcactgttccaaccaaggatgagcgactcatgacgcaacgtgtatacccgagcctgatgaagaacgttggcgacgatccgcccgatgacggatgcagccgccgttgaattcgcggaaggcccttcgctcagcgacctaccggtattgtaattgtttcaggagtttcgcggggctgtttcacccggggtcgtggtgacctctcccaggtggggcggacccatcgagccaggggcgcagcatcttcccgacgacctccgtcgtgagtccctgggcgtacgccagaacggggcgtagggctcgtcgtcggcggctttcattcacggattctactggcggtgtcccgcgctccgagcggctcacgccggacttcgcgggcacgttcttctcaaagcttgggctttttcgctttctgagacggatttcgcgtgtggattcccgaacttggcggtgttcgagcgtcgcgtgtgccgttcgtgaactgcaccgttgacgtgagggccctcgctcatttctatcgtcccacgcatctcgcgagggagtcgccttggcaggacagaccgttgagttgacccaggagaacttcgagcgcatcacccaggaggccggggtgtgcgtggtggacttctgggcggagtggtgtggtccctgccgcggcttcgcgccgaccttcgaggccgccgcgaaggagttcccgaacatcaccttcggcaagctcgatacggaggcgcaggaagaggtctccggccggatggagattcgctccattcccacgctggtggccttcaaggatggcgtcgaggtccggcgcgcctcgggcgcgatgtcggcctcggcgttcgcgacctggctgagcaagctggactccgtggacctggccgtcgagcagcagcgggcggcgaaccgcaagctgacggaggaggggacgccgccgcctggcattccgccccacgcggaatgggacgccggagacgaggagtggtgctccggcgacaccgacgaggagggtgagaagcacggcccctggaagtactggcgcgcggatggaaccctctgcaacgagtgcatcttcgtccacggcaagccccacggccccttcaagcgcttccatgagagcggagaggtgtcccaggatggcgcgttcgagcagggcaatctgcacggcccgcgcacctggtacgcgtccgaccaattcaccaccgagcggatgcatgagaacggcgtcagcgagaaggtccgccgcacggtgatggtctacgcgaacggccgcgtgacgcaggtgctgcactacaatggcgccggcgaacgcgtggtgccctccaccggagagccgtaccccacgcggcccgcgaacctccccgagaaggctgagtaccgcgaggaccaggaccagtgggcgtccgtgtcgctcaacgcgaaggccgagcggcacgggctgtgccgattctgggaccgggaggggcagctcctctgggagtgcgaattccacgaaggcagccggcatggccgctatcactcccgcgccgtggacgagtacgcggaccctcgggtgcggttcgacgaaggggagatggaggacgacttcgcgtgcggcacgtggaagttgctggatgcggagggcaacgctgtcgtcacccgggacctgggcgttgtccaggaccacgagacgttggatgcctcggaggtgttctcgaaccttccgaggagcgccgctgaatggcgtgcgttcgccgagcaggctcgggcggaccggcgataccgggaggcgctgctggccatggcgcgggcaagcgccgtgtcgctggatgcgggcccgctgaaggcatggctcgagtcgctcaccctgcctcgaacggaggcgagtgctcgcgagaatgccgaaggcgtgatgaacagcgcgggggatgagcgggcggcgttggcggatgcgatgatgcgtggcgcggaggccgcgatgttgcttcggggcttcgcggtgctccacgaccagcaggaccggccccgggcggcgttggacttcatcctggccgcgatgctgctcgcgccggagcgctcggcgtacctgttcactcggagcctcatcctggcgaacctggggctgggcgagcagatgcagaaggacgcggaggcgctggcgccggcggagccggattcgtggaagttcctctcggcttaccggcgggtgctgtttccgcgcttcgagttctggccgggacgtgagcccgcgcactgcacgttcgatgaggtccccgacgggcccacgaaggagctggacgcggtgcaggccgtggtccgcaagtacgccactcgactccagttgctgcgcgcggagattctctcccgcttcaagcccggcacgaacgtgccctggctgccgcccgatgtgtcgtccttgctgccggacgggcccgtcgaactggagcagacggaggtcgaggacgcggatggtgactcggtggatgtcgacgagacgctgtccacgaaggggatggggattccggccttgtcccgtgcggcccgtggagactggagcgcgctgacctggctcttgtgggcgtgcggggtggattcgattcggatgccggatgcgctgacgcctccggccgacttcggtcaggccgcgggacaggccacgcagcggctgtggcagtgccgcaaccggcggtcccgtggtcgcatcgacccggacctgccaacgttcgatttcgaaggggttgccctccaggagctgcatcccaatctggcggggattgccgaagagcagtacgcggagacgcaggcgatgttcttctggctgaccgacgcgaaccacgtgtctccgtggcaggccaatctgagggggtagtcatgaagcggattcgtcagacgattgaagtctccgagcccctgtggcgggcgctggaattgatgagccgcgacatgggcgtggaccgggatgcgctggtggcgcaggccctgttccaactcgcgcgccagaatggctacgtgtcccccaccgcggtgtcgctgggcggggaggcgcaggtggccggtggggccgtgacggctgcggagcccgtggtccaggccgctgcacccgtggtggtggcgtcgagcgtggtcgcgcctccggtccccgaaccggtggcagcggctgttccgcccgtcaatccagggggcggcgcgcaggagtcggtgtctgccgtggcagtggtggcggatacggctgccccggtcgtgggcgccttctcggcggacgacgcgacggaggagcccgcgacggaacctcctggcgtcacctcggtgccattgtccgtggcgcaggtgaattccactgagctggtgctcgcgcgaatgcaggagattctcgcggaggtcgaggcatccgtgctgccgtcggaggggctggccgcgcaatcagacgacgccgacgatgatggatccgacgactccgatgatgaggagtctgacgacgccgacgatgatgaatccgacgactccgatgacgaggagtctgacgacgccgacgatgatgaatccgacgactccgatgacgaggagtctgacgacgccgatgatgaggattccgaggagtcgtcggacgaggactcggaagacgatgcgtccgatgaggatgccgaggagtcgtcggatgaggactcggaagacgatgcgtccgatgaggatgccgaggaggaggattcggaggacgactcggagtccgaagaagctgcgtcggacgatgaggcggaggtaccggcgggcagcggtgtgaagggggatgtgtccagtgacgacattgccgcggagcttgcggcactgggtatcgaggatgagcccgcggaggctgccaaggtggaggcacccgtcgcgacgccgattacggcacgtccactggtggcgcgtcctgtgccgaagatccggccacctgacgaagccgcgacgattctggaggaccagtcggcggagacgaccaacatcgtgaaggctcccgcgccactggaggtcttcgtccagtgggcgcaaggcgcgccggtggccgtctccacggagcgtttcacgattggccggggccctcgctgcagcctcgtcgtgaagtcggagcgtgtctcgcgcgagcacgcggtcgtgacgcgggtgggggacgaggttttcatcgaggacctcaactcctcgaacggaacttggttcaacaacgagcgaatcacacggcagcaggtctcggacggtgacgagtacatgctcggcacggaggccgtgtccttcacgatgcgtcccgcgggcggttgaacaagagggggcggcggctactcgaggagttgcatcaggtccgcacgcgtaatcgcggtggctccggagccgccgccgagcgctgcctcgaacagctcccgcttcttcgcctggagcgtgagaatcttctcctcgacggtcccctgggacaccagccggtacaccatgacaggccgctgctgaccgatgcggtgcgcgcggtccgcggcctgtgcttccacggacgggttccaccatgggtccacgaggaagacgtggtccgccgccgtgaggttgagccccgtcgctcccgccttgagggaaatcaacatcaccggtgggcccttcgggtcctggaacgacgccgccaccgcgcctcggttcgccgtgctgccatccagccggatgaagccgatgcccgcttcctggagcgcgggttcgatgaggtccagcatcgacgtccactgtgagaagaccagcgccttgtgcccgtcctccaccgccgtacccagtgcctccaccagggcttgcaccttggacgaggtcttcgcctgctggcccggcacgagggccgggtggcacgccgcctgccgcagccgcagcagggcctccaaggccttcaacacgctgccgcccgcctcgagctgcgacaccacttcctcgcgcgtcgccgcgtagatggcgtcgtagacggcgcgctcccgctccgtgagcgtcacgtggcgcacggcgtccgtccggggcggcagctccggcgccacgtcccgcttgagcctgcgcaggatgaagggccggatgcgcgcccgcagccgctccgccgcgcccttgtggttgtccgcgaccggccgcgcccagcgctcctcgaagtctttccgtccgccgagcaggccctggttggtgaagtgcatcaggctccagagctcctccagccggttctcgatgggcgtgccactcagcgccagcttgaagtccgcctgcaatccatacgcggctcgcgccacctggctgtctgggttcttgatggcctgggcctcgtccagcacgacggtgctccactgcttcgcgcccaggacctccgcgtccaggcgcatcaaggcatacgtcgtcaacgtcacgtcggccgactcatccagcgcgcgtccggggccgtggtacacggagaccttcagcgagggacggaagcgcttcacctccgcctcccagttgggcagcacgctcgtgggcgccaccaccagggtgcccgggcccagcgtgcagatggtctgcagcgtcttgcccaggcccatgtcgtccgcgagcacgccgcccagtcccgcctgccggaggaaggtgagccagctcacgccctggagctgatacgcgcgcagcgtcgccgtgaggtcttccggcagctgcggctcgggaagcttctcgaagcccttcaccaggggcgccagccgctccaggcccggcggggaggggtgctccagcgcttcacacaggccagtgagctgcgggatggcgtggttggcgagccggccatcccggcctcgcgcggacagcaggtccgccacgcgctggccatgggacttcagccactccgcgggcaggggcgcccagccgccaccttccaacggcaccagcccgagcccttcttcccaggcccgcatgaccgccgccgcatccacggagcggggcgactcccggtcctcgccctccacctggaagtcgaaggagaagcccacgtgcggcacgccctcggtgacggcgcccgtgtccaccttgagcaccgggcgcagttgcacgttcgggttcgtcaccaccgccgcgccatcccccgtgaggcccccgcgccagcgccgcagcttgtcggcgagctggacggcttccttcccctgcaccgtgacgcgccgcccgggggccatgttcagctcgtcgcggagctggtggatgagcatctgctcggcggcctcgtcgcgcacgggcgcggcgcccttcaggtacaccatgcgtccgctgtcgatgcgcacggtcggcggcgagccatacaccagcgtcggcagcacggagaggccggtgtcgagctggttcaactccagggagatgcgaggcttcagcgtgcggtcgatgggcggcagccgttgacttcgcacatccaccggcatgcgccgtgcgatgtccggcagcacctttcccgtcaggtctcccatctggtggggcgcgaaggcgcgctcctgcggcagcttctccagccagggtcccgtgaggccttgttcccccaggggacagagcgtcccgctgcacagcgcgaggccggggctcaccacctcggtgacgcgcgggtccttctccaccttgagcaccgtgttctcaccgcggtcctccacggtgacgcggggcatgaggggctcgctcgtcaccgacaccagggcgccgtcgaagagcacggtgcgcgcgggctccaggacgcgcagcagcgcgttgagccgctcgggtggcagcgcgccccgggtgggcttcagcagcagcttgtccgagagcaggtcgcacggctgcgtctggatgcgagcggcctccacgggattggtgagcagcgaggccaggctgcgcgccagcagtcgcgcggtgttgtccggacgcacgaccagccgctccaactggagcccgtcgtccacgcgcttgaaccggtacaccatgccctccggtttcggcgcgccagccgcgggtgcgctgggcctggtgatggtgatcgcacctgggcgcgcggcgggggtggccggacgctgcgcgggggtacgccgcgccgtggcatgctggtggagaatcagcgccgncgcgaccacgtgctcgcaggggtccacccggccgcggcagtcgcactcccagatggcctcatccaggtagagcaccgtcttcacggggggcgggccggctgggcacttccacccgca

SEQ ID NO: 1017 - DNA, 11199 bp, Myxococcus xanthus
cgggcatgacacggggcacatccttcaagatgaggtccagcgcgtcacgcagcgtgagcgccagcgacgtgtccagtacgtgcgacgacgtcatgcccaggtgcagccagcgcgcgctgggccccacccgctcttccatgaaggtgaggaaagcgatgacgtcgtgcttggtggtgcgctcaatctcctcgattttcgccgcgtccccgggcgtgaagtctccggcgcgagccaggcagtcctgcagcgcctcgcggggcgccagcccggcctccaccatgccctccagggcggcgagttccacgtcgcgccaacggctgtaacgggcctcgtcggaccagagggaggacatctcctgacggctgtatcgcggaatcactcgtagaccttcacggcaaagtcccgccgcgccgcgagccggaggagttccagcacggcgtcggaggacggacccaacttcctggcggcggtgagattgagagacaagtccaacccctcaggctgaaccaccgccagcgctcctggattcaccttctcgtggatgatgcggttggccagccgcccggcctgctggccgatggccgtgggactgggcgagagcgccaacgtggccccttccttcacctggctgggcgttagagcggccaacggcacccggtgcgccgccgcgaaggcgatgagcgcctggacgaccgccgcgttgcccactgtcttgtccgccaccatcagcagcgcgtccaccttgcccaccgcgccgtccaacgccttctccgcccggccccccgcctccaattccagcgggaggatggacatgcccctcgaggccgccgccgcgcgggcctgcgtcaccgtccccgaggagaaccgcgggtcatgcaggatgcctacgcgcttcaccttcggcgacacggccttcagcgcctccagctctggccccatgtcgctggtgagggagataccggtgacgttggcgccatccaggccgtacttctcgtagtagggcaccatggcgaagaggacgggcacgtcctcgcccagcgagcgccgtgcggcgttggcggccaggggccccagggccagcaccagcgcgggcttctgggccgccagcttcttgaagagccgcgcggccgcgcccgcgctttcgtccagcatgacctcctgcacctcggcccgggcctccgccgcgaagccggcgatgacggaggcatacggcgccaagtgggcggacttcaccgccaccacgcggggacgggcgggctgctgcgccacgaccgccgccggcagcagcgcgacgaggagcgcggcgacgcagcccttcattgccgcacgctcgcgcagcagcggaagcccaccgcgttcgagcgcacggtgggcacgccgttgctccgcgccgagcaacgtgacgccgggtccggctggtcgaaggcgccgcccttcagcgcgtatgcttgggcgccgacgcgggtggccgtccactccgccgcgttgcccgccaggtccatcaccgcgtagcccgacttgcagcgctcgaagcgcccggaggccgccagtccacccgggctcgccgcggtgttgcacgcgcccacggcctgctcctcgccgaaggggaaccgcgagttgccggggcccttgcatgccttctcccattcctcttccgtgcagagccgcttgccctcgcgctcgcacattccccgcgcctcttcccaggccacggccaccttcggcatcgcgccagcccggttggggaattcgtactcatccacgcagaacgaagacacctggatgctcgcgacggagcgctcgtccgggctggccagtgcgtcatcgtcgctccggcccatcttgaaggctccgccactcaccagtcgcatgcccgcaggacagccgcccacgggcgccgccagcgctgccgcgccaccgggtccggcaacaggcgccgtcccctgccctctggacttctgcagcgccttgatggccaggaagcccccgcccgcgcccaacgccaggcagccgaggacgagcaacaccaacctccacatggaacgctggggcttcgccgcgcgcgtggcggacttggtgagcaccgctccgcgaggcgcggcgcgagaactggacccttccgacggttcgctccgcttcgcgccggaacgagcgcccgactctgccacctccgaaccccggcggcgggtgcgaacacctgagtcctcggaggcacggccgcgagctcggctgccggtgtcctcggcgccgccttctcgcgaacgagacgacgcctcgtcctgcgcgccgtcgcgagcacgcgaccgggaacggcccaccgcgggcgcggcatccagcgtgggcgcggcggggcgccccgcgggcaccgctggcgcttcgtccagggtcatcgcagcagtggagcggccatccgtcaccgcgggggcatccacctgcgtgggcgcggtggagcggctcagcgcggcctcggacggggcgccacgctcactggcgtcctcggaatccttccgcgctggcgcggcgcgcgagggcacggggggagatgacgcaggccgcgaagcactgccctgcgccgagggtgccgccttcgcggcgacgacaggtggtgcgatgaagggcagcgcctgctccgtcaggtgctgcggcgcgggcgaggccgcgggcttgccccgtcccatgatggcggccagcgacgccgcgtccagcggctgcgtggcatccaccggcggcggcaggtccggaatgggtgcgggcggcttgggcgcggcgacaccgggcggtggaggcaggtcctcctcctgcacggccgggagcatgcccgtgggcaccgggggcggaggcctcgccgcctgcctcgcggtgttcgcggccgacgagcccggaggcgccgggaggctccgcgcgcgcgacaccaccgcggccggcgtgcgcgccaggatgttggagaactcggtgaggaactcacccgccgtcttcggacgggccagcgggttgaagttgagcgcgcgccggtacagtgcctcgatggaggtcggcaggtccgggtggtgcatcgtcagaccggggatgacgccgtcctcgggcacgagcccggtgagcatctcccccacgatggccgcgagcgagtacacgtccatgcgcgtgtccagctcgcccccgcccacgtactccggcgcgatgtagacgtccgcgcgctgccccttctgcgcctgcacgaagggcaggtgcggcacggccaggcccaggccgtagtccgtcaccttgagcaggtccggcaggacgatgacgttctccggcttgacgtcggagtgcggtccgaagcggtgcgccgcgtccagggccgccgccatctgcgccagcagcggctccacttccttcagcgagaagagctgcccccgcgcggtgcgctgctccatcatccggcgcagcgtcatgccctccagcagctgcatggtgatgaagggcctgtccccatccacgccctcctcgtacacgcgcaggaggttcggatgattgagcttcttggccacgcgcatggacagcgcgaactgcatgcgttcctcgggctgctgcaccaggcgcgggtgcaccgccttgagcgccacttcgacgtcaatctcctcgtcctgggctcggaagacgaagcccatgggcccggagcccaccacttcctggatggcgtagcggccggcgacgacgtcccctggcttgtagggtgcgccgtccgcgccgcgccggcgagcagccccggcgggaggacgcgccgaggcatcgtgcttcagcccgcaggtggggcaggtgtcttgggaggcaggaacgaggctgccgcagcggtagcagagcaaagctggcgtactccaggaggcagtcggggggccacctcgggggaaggcccagcctcttattctgcacgctcccctgtcatcaaggaacgccgagcgaggaagtcagcaactagcgccccgtggacccgaagccatttccaccccgggaggtttcctccagaaactccacctccaggagggagaccggcggcacggcggccaccaccagttgggccacgcggtcgccccggcgcagggtgaagggctcatgggagaggttgatgaggatgacctgcacctccccccggtagtccgcgtccaccgtccccggcgagttgaggagcgtgacgccatgccggagcgccaggcccgagcgcgggcgcacctgcccttcgtacccagcgggtagcgcgagcgcgagcccggtgggcaccgccagccggtccaggggccccagcacccgttccccgtcgatgtccgcgcgcaggtccaggcccgcggcctgtgccgtttcgtagcggggaagtggcagaggctccgcatgggtgcgcacgcggcgcaccttcaccgtgaggggggaagacatgcgctgggactaacacagcttcccccgcttcgtgccacggacgggtgacaacctcgcgcgtcggcccctcagggcgcagggtccttcgccacgggccgaagggcggtgcggaacttcagcgggtccatgggccgcgccgccagctccaactggtagtgcaggtggggaccggtggagcgtcccgtgttgcccgaatgcgccacccgttctccccggcgcacgcgctgtcccaccttcaccagcagctccgagttgtgacagtacgccgtcgtgacgccccgcccgtggtccaccacgagcacgcggccattcacggcgtcctcgctggcacgccggacgacgccatccgccaccgccaccacgggcgtccccaccggcacgcccaggtccacaccggtgtgcatcttccggcgccccagcaccgggtggaagcgatcgccgaagggactcgttacacgcgcgctctcatgaacgggccacgcgagcccgaaggcggtggccagcgccagggcctgcgcggcgcccacggacgcgtcctcgaagcccggcgggagctgacccgacaggcgctccagcgtgggcgccccaccctccgcctccacccgctccagcgcgtagcgcgcggggacgcggcccgcgaagagcgccgtgagccgggcctcctcccctggaaagtccttggacagcgcggtgtgcaggctgcgcgcggccgccgggcccgtctgcggatccaacagcgacgcggcggggacgcccagctccgcggccagctccagcgcgggctggcgggctcgcacctgggcacccttgagcgccaggtgggttccccaggccagggcctccgcgtccgtgagggcccgggacagaggaacgtcgggagccatcaatggcggtgacagcgaggtgccactgacgccgtcgtagtacgcgagcaagggccgcgcgctgctgcgcgtccccgtggcccatgccgtggccttgcgcaccagcgcgcccgccggcgtgtggtggtacgccgcccacaagcacagcgtcgccatgcagaagtccagcagtcctttcgcctggcgcgggaacatggccacctaccggaagaaggacagcacgggcgtcgcatccaccaccgccgccacggccagcggcaccacgaccgcgcagcccagcagtccgcgccgcaaggccgctctgcccccggcttcctcacacaccgcgtccgcgtgttgcaggttgcgcagcaccgcgcgccacccgagcgaaaccaggacgcccaccagcgaggccacggccagtgcccgcgccgccacgtccgcggcaccatccccgaagagctcacgccaggagaggtacaccgagccctggatgagcctggccaccgcgcacgcgcccgccagcaccacggccgccgtcgccagaggccgcagccaccgcatgggcgtgggcttgcgcaggcaccgcgaccacagctgatgccacgtcggacgcgcggctttctggggctccagcaccacgcgccatgcctccgcgggaaccggtgcggcggactcccggtagcccagcgcgggcagcgccaacaccacgtccgcggccagctcccacgcgagcgcgaggaagcgcgcaatccgggtgcgctgctccagcgacacccactccaccaggggcgccgtcagcgaatagcggcccacgagcgcgtcgaagcccgcgtccacccggtccaccagcgccagcaaccgttcatccaacgtgtccgccgccgagtgcacccccaccgccaccagcgcgaccagtcccagcggcatgaacgcccagcggaaggcccccaggaaacgggagacgtccgccaggaagggcgtggacgacgacgcaggcggtggtcgaggtggcaaacagcctccgtgcggatggggctcgcacctcaacgcacggcccgcccagaagtgtctaagccaccccggcccgaaacgaaaacaccccctcccgcgcggtggcggaagggggcgtcatgagcgccgggctctcaaggaaggagcccgggctttcgggcgcgaatcaggccttggcgtcaggctgcgtgggcgcgggcgccggctgcgcggcggcctcaccggcggcggcgccctgctgcgcggcgcgctccgccatggcctccttgcgcgacaggcgaatcttgcccgtcttgtcgatgctgacgaccttcaccaacacctcgtcgccctcgttcagcacgtcggagacgctcttgacgcgcttgtcggacagctcggagatgtggatgaggccgtcggtgcccgggaacagctccacgaaggcgccgaactcggcgatcttgcgcaccgtacccgtgtagatcttcccgatctccgcctcgcgggtcagcgcctgaatcatcgcgatggcggccttcacggcctcgccgttcgcgctggcgatgtccacgcggcccgagtcctcgatgttaatcgcggcacccgtgcgggcgatgatgtccttgatgaccttgccgcccggcccgatgacgttcttgatgaactcgggacgaatctggatggtggtgatgcgcggcgcgtactggctgatctccttgcgggactcggccagcgtcttgagcatctcacccaggatgtggaggcggccctgacgcgcctgctccagcgcgcggctcatgatttccgtcgtgaggccggtgatcttgatgtccatctggatggacgtgatgcccttcgaggtgccgcacaccttgaagtccatgtcgcccaggtggtcctcgtcaccgaggatgtcggagaggatggcaatcttgtcgccctccttcaccagacccatggcgatacccgccacaggggccttgagcggaacacccgcgtccatcagcgccagcgtgccgccgcagacggaggccatggacgaggagccgttggactccaggatgtccgacaccaagcgcaccgtgtacgggaaggactcgctcttcggcaccatgttgcgcagcgcgcgctccgccagcgccccgtggccgacttcacggcggcccgggccacgcagcggcttcgtctcgttcacgctgaacggcgggaagttgtagtgcagcatgaagcgcttgaaggccatgccgcccagcatctccaggcgctgctcgtcatcgctggtacccagcgtggtgaccacgagcgcctgcgtctcgccgcgcgtgaagacggcgctgccgtgggtgcgcgggagcacgcccacctcgcacgtaatcgaacggaccacgtcgtggccacggtcgccgatgcggccaccgttgaccgtcatctcgcgcatgtgctcgtacttcaggtcctccaccaccgccttggcgtgcttctccaccaggggggtgtagccgtcgcccagctgctccttgagcttggcgagcgcctccttcttcgtcttgccgagcgcctcgtaacgcgcgcccttctccttgatgccgtagcccgccttgatgccgtccatggccagctcacgcaccttggcgcgcaggccctcgtccacggcggcgggcttctcgaaggagcgaacctgcttgttcagctcgcgccgcagctcgtcctgcaggtccagcgcgggctgcgccgtcgtgaagccgaagtcgagcgccgcgaccatgtcggcctcggagacctcctccgcgccaccttccaccatgacgatggccttacggctcaccgccatgaccaggtccaggtcgctctgctcgcgctgcttcgcggtggggttggccaccagctgaccgccgacgcggcccacgcggatgccggcaatggggccgtcaaacgggatgtccgacacccacagcgccgcggaggcgccggtgatgccgtggatgtcaccctcgttctccgggtcggaggagatgacgctggcgatgatctgcgtctcgtacgcgtagccttccgggaacagcgggcggcaggagcggtcgaccaggcggctggccagcgtctccttctccgtgagacggccctcgcgcttgaagtagctgccggggatgcggccggccgaatacagcttctcctggtactccaccgtcaggggaaggaagtcgatgtccttcttctcccgggcgctcaccgccgtcaccagcagcatggtgtcgccatagcggaccaccacggaaccgtcggcctgcttcgccagacggcccacttcgatgctcagctcgctctcgccaatcttgacgctcttcttcaacatgtccgtgcctctggatccttcagggcgaagaccccaccgcgcgcacccggtccgagaaatggacccggcaccccgggagggccctcggggtgtttgagcggtcaccagggcctggaacaggcgccagttgaggcaaccgccagcatgtactgcggagggcgcttgcggagcgccggagggatgtctcggaacttttgatccctggtcgcaggggccgaccgcggtcagcccatccgaacggaaaccaaaacctccgcagccaccactcccttgcccgcctccacccaccgcgcttcgactgcttcacgtcactgcattacggcctatgtcctaaacgcgcggggcgctggtttccgccagcgccccgggtcctgctcaactgcctacttgcggatgccgaggccgtcgatgagcttcttgtaccgcgcgacgtccttggacttcaggtagtccagcaggcggcggcgctgaccgaccagcttcagcagaccgcggcgggagtggtggtccttcttgtgcgtcttgaagtgctcggtgagcatggtgatgcgctcggacagcagcgccacctggacctcgggggaacccgtgtccgactcgtgggtccggaacttcgacaccagctccgacttacgctcctggtgcagcgacatgagactcttccttgcccgctccggtggaggttgctgctcgcgtcaccacggtccgcggaggggtacagaccgggtacatccttctgacgagcggggggcttataagcttcaccccccgtggggtcaaccttcgacgcctgcccgccagccccggaaagtccgggaccacgagaagacgtacagccacaaccccgcgaaaaatcccggcgttacaccaggacgcgcaaatagcgcaggcggccaccggccacttcggccaccgccagcagcgcgtcgtccgggcccatgacgcgcacccgtcccaccttcccggcggggacctccaccgggacaccgtgggagacgcgcttggcatcggcggcgcccacccggacctccggcagttccaccagcgcatgcgacatggtcatcagccggctggccagcgcgccctccttcagcagctccggcacgtccgccagcggcagcgcctgcgccagggtgaaggggccactggcggtgtgcagcagtgcctccaggtgggcaccacaacccagcgcccggcccacctcctgggccagggtgcgcacgaagaagccctggagcagcgcaccgacagctgcaggcgctcggcggagaagtcccgcagcaccaactcgtacaccgtcacctgacgggcggcgcgctccacttcctcgcccgcacgagccagttcgtagagccgcttcccgcccaccttgacggccgaatacatgggtgggacctggtcgaaagtgccccggaagcgcgccaacgcggattcaatcagcgcgggcgtcagggcgggcacgggcgcctgcgccgtcacctgcccttccgcgtccagggtgtccgtctccgagcccagacgcaccgtggcgtcgtaggccttgtcgccctcggtgatgaagcccgcgaccttggtggcttcccccaggcagagcggcagcactccagtggccagcgggtccagcgtccccgtgtggcccaccttcttcaggcgaagcagcgaacgcacctggcggaccacgtcgaacgacgtgggaccggtgggcttgtcaatgacgaggacgccgtccatggcacgccaatcgtggaggcccggagctggacctaccagccttccttgttgcggacttcgcgcagcagccggtcaatcttgtcaccttcgcccaccgattcgtcgaaggagaagaagatttccggcgacacgcgcaggttgacggcggacgtcacctcgcggcgcacgaagcccttggcggcttccaggcccttctgcgtgtccgcccgctcctgctcgttgcccatcatcgaatagaagacacgggccacgcgaaggtccggggagaccttcacgcctgtaatcgtgatgtagccgatgcgcggatccctcagcatgccccgggtgagcaagtcaccgatggccgcctggatttcctgccccacgcgctccggtcgggaatgcgtcgtcatttcttctcccagtctcgcgggttgcgcagggaacgggcccgagcccgtgcctcgtcgaacgtcatccgtccaccgctcgacggagacgggcggctcgtgccgccatccatgccgccttcatggcggctttcccactctcccaacccctccgcctccgcgagcgagccgcgctcgccgcgcaggaagcgggcaatggcggcctccgaatgcgccgccgcctgctctggggaaaggtccaactcctccacgtcctcatccacggcctgcgccgagaaggaacctcgcgaggccgcctggccgctcgcgaagagctggtccccgaagccgaggatttccgtctcccgcgacaacagcggggcgacatacatctcctcgacggagtggatgattttctccagctgctcgtccacgtggcgccgctcgttgcccaccaccgcgagcgccagtgacg

SEQ ID NO: 1018 - DNA, 12277 bp, Myxococcus xanthus
gtgctctaaggcaagctgtccgaccagttccaactgggggagcgcgtgctggccgcgctgcgagaagcgcgcgtcacggtgtggatgaccgcgcagtccgccaatggccagtcactggccgtcgtcgtgcctcgccccgacgcggagcacgcgcggtccgtgctcgtcaccgagctggcgcaggagctgtcacgccgcgaagtggaaccgctggaggtccgccagccggtgacgctgctgacgctggtggcggagaccatgggccacggcgtcaacgtggccgggcgcttcttcagcgcgctgggcgcggtgggcgtcaacgtgcgcgccagcgcccagggtgccagctcccgctccctttcgtgtgtcgtcgacgcggcggacaccgccgtcgccgcgcgcaccacgcacgcggccttcaacctggcccatcagcaggtgagcctcttcgtcctcggccgaggcacggtgggcggacaactgctggcccagctgcgcgcccagcaagcgctgctccgggacaggcacggcatcgcgctgcgcgtcgtggggctggcggacagcaagcgcgcgctcttcgacgcggcggggctcacgctcgatggcgtggaggcgcggctcgaaggcgtgacgcccgaggcgccccaggcgcgcaccctggtccccttgttggacgcgctccggcggctgcccgtccccatcctggtcgactgcaccgccgcgggcgggttggaggcgctctacacggaggccttccagcgcggcatccacgtggtggcggccaacaagaagccgctggcgctgccgtgggaggcccgcgaagcgctggtggacacggcgcgccgcaaccacgtcgcgtaccactacgagacgacggtggcgtccagcctgcccgtcatcgacacgctggcgaacctggtgcgcaccggtgacaccgttcgcctcatcaccgcgtccctgtccggcagcctgggcttcatctgcaacgaactgacggccggcgtgcccctgtcccgggccgtccgcaccgcccgggagcgcggcttcacggagccggaccctcgcgaggacctgagcggcacggacgtcgcgcgcaaggcgctcatcctcgctcgggagctgggcctgccgctctccctgtcggacgtggcgctggagcccttcgtcgccacggacgaatgcgccagcgtggactcgttcttccaggtgctcgccacgcaggatgcggcctacgcggagcgcgtggcccgctgccgccacgccggcaccgtgctgcgctacctggcacgcatcgacccatcgaaggcgggcacaggcagtcccgtcatccgtgtgggccccgtaggcgttgaagcgggccaccccgcggcggacctccgcggctccgagtccttcgtctccttcaccaccacccgccacagcgacttcccgctcaccgttcgaggcgcgggcgcgggcggcgccgtcaccgcgtccggcgtgctggcggacatcctccgcatctcccagacgctgcgcggtcgctgagcgcgccaccgaaagggtcctctcatgaaactcgccaccgctctcgtccacgccggcgtgcgccgcgaccccaccaccggcgcggtcgccgtccccatctaccaatccgccaccttccagcaccccgcgctcgggcaatccaccggctacgactactcgcgcacgcgaaaccccacccgctccgcgctggaggatgcgctggcgcaactggagggtggcagccggggcctggccttcagctccggcatggcggcgctgcactgtgccctccagctcttcggcccggaggaccacatcctcctcaccgaggacctctacggcggcacctaccggctggtggaccgcatcctccacgtcccctgcaccttcgtggacacctcacaccccagcgccgtgcgggacgcgctgcgccccaacacccgcgccatcgtcgtggagacgcccaccaacccgatgatgcgcaccgccgacctctccgaactggcggccattgcccgcaaggccggggtgctgctcatcgtcgacaacaccttcctcacgccgtggttgcaacgcccgctggagctgggcgcggacatcgtcgtgcacagcgcgacgaagtacctggccggacacaacgacgtcgtcgcgggcgcgctggtggtcaaggacgccgcgctgggcgagcggctggcgtacctccagaacggcatcggcgcgattctcggtccgcaggacgcgtacctggtgattcgcggcctgaagacgctggccctgcgcatggagcggcaccaggccaacgcgcgggaagtggccgcgtggctgcgcgcccacccgggcgtggagcgcgtcttctatcccggcgtgggcggaatgctgtccttcaccgtcgcccacgcggccctggtgccccaggtgctcgcgtccgtgcagttgtgtctcttcgccgagtcgctcggcggcgttgaaacgctcatcacctaccccaccacgcagacccacgctgacatccccgccgagcgccgggaggcgctgggcatctccgaccggctgctccggctctccgtaggaatcgaggactcccatgacatcatcgccgacctggcccaggcgcttcgcgacccgtctgctgcacacggggcatgagcaggaccccaccacgggcgccgccgctgtccccatctaccaggtgtccatgttcgaccagccgggcctggagacgcccggcgagttcgactacgcgcgctccggcaatcccacgcgcaaggccctggagggcgtgctcgcggcactggacgaaggccacgcggcctttgccttcggctctggcatggccgccgtgtccagcgtgctgatgctcttcagcgcgggggaccacgtcgtcgtgacggacgactgttacggcggcacctaccgggtgctcacacgcgtcttcagccgcttcggcctgcaggccaccttcgtggacaccagcgacccggacgccgtgcgcgcagccctccgccccaacacacgagcgctgctggtggagagcgtgagcaatcccttcctcaagcgcaccgacatccccgcgatggcgcgggtggcccaggcgcatggggcgctgctcatcgtggacaacacgttcctgtccccggccctctcgcgtccgctgaccgagggcgcggacatcgtcatccactccgccaccaagtacctcggcggccacagtgacgtcgtcgccggtgcggtggtggtgaagacgcccgcgctcgcgcaggagctcggcttcctccagaacgcggtgggcgcagtgctgggaccccaggactgcttcctcctccagcggggcatcaagacgctgcaggtccgcctggagcgacaggtgcgcacggcgggagccctggcgaagtggctcaccgagcggccggaggtgcggcgggtcttctatccgggcacgggcgcggtggtgtcgttccggctggcccaggacacgctggcggcgcccttcgtggaatcgctccagctccccctgctgggtgtgtcgctgggcgcggtggagagcatcgtcaccgtccctgcgcggcactcccacgcctccgtgcccgtcgccgagcgggagcgccgaggcatcaccgacggactcatccgcttctcggtgggactggaggacctggaggacctgcaagaggacttcgtgcgggcattcacgcaggcagaccgcgcggcggcataggccgtcaggttgacatggcgcgtcggctccattacctgtctgtgccgatgctcgctggttgcgccatgttcggattctgtcgcggaggcatgtgttgtcatgcccccacgggtccgtccgttcgcgcgcgctgagcctccctcacgaaacgaaccgacgttcctcccggcccgttgcctgcttcgtccaggcacgggccgtccttcgcgcacctcgtgcgagcccccgtcccaccttcgcagtccccaggagcagtccatgcgcggcaccccggacacgaatgagcagcggccccctgggcccgcgcgagccacgcccagccggagcgccacgccgtgattgcgtttcgcggagtcagcaaggtctacacggcgggcgggcgggaggtcgcggcgctgaggaacgtgtcgctccgggtggaggccggtgaaatccacggcgtgctgggacagagcggcgccggcaaatccacgctcatccgctgcgccaacctcctggagcgccccaccgagggctccgtctccgtcgacggacaggacttgctggccctcagtccggaggcactgcgcaaggcacgccagggcatcgggatgatcttccagcacttcaacctcttcggctcgaagacggtggcggcgaacgtcgcgtacccgctggaagtggcgggcaccccacgcgaggccatccgcgaacgcgtggaggagctgctgtcgctcgtgggactgtccgacaaggcgcaggcctacccctcgcagctctccggcggacagaaccagggggtgggcatcgcgcgggcgctggcgccccggcctcgcgtcctgctttccgacgaggccacctccgcgctggacccggagacgacgcgctcggtgctggggttgctgcgtgacatcaaccagaagctcggcgtgacgctgctcctcatcacccatcagatggacgtggtgaaggccatctgcgactcggtatcggtgctggagcggggacggctcgtggagcagggcaaggtgacggagctgctcgcccatcccagcacccggctgcatcaactgtgctttccggccttcgccgcgccgacggacgcaccctcgggccgccgagtggcgctgacgctcgcgggcgagcacgcccggcggcccctcctgggcaccctggcgcgccaattcgacgtggacgccctgctggtcgaaggcgccatggagcgcgtgggcaacacccgcgtggggaggctcctcgtcgacctccagggttccgccgatgccgtgagccaggcactcgcctacctgcgtgagcagggactgacgctcgaggaggccgcaaatggatagccagcttccgcgcctgctgggcgtggccaccggtgagacgctctacatgacgtccgtggcctcggcgctcgtcctcctcgcgggactgcccttgggcgtgctgctggtcgtcacggaccggggtggcctgtgggaacgtccggcgctgaaccgggtgctgggcacgctcgtcaacgtgggccgctccatcccgttcatcatcctcatggtggccatcgtcccgctcacccgcctgctggtgggcaccaccatcggcaccaccgccgccatcgttcccctggtcgtggcggccattcccttcatgggccgcgtcgtcgagcagagcctccgcgaagtggacgccgggctggtggaggccgccatcgccatgggctccacccaccgccgcatcgtcttccaggtcctcattccggaggcgctgccgtcgctcgtgcgcggcaccgcgctcgtcatcatcagcctgctgggttacagcgccatggcgggcgcggtgggcggcggcggcctgggcgacctcgcggtgaagtacggctacatgcgcttccgcaccgacgtcatgttgggctgcctggtggtgttgctggtgctggtgcagctcgtccaatggctgggtgacgcgctggcctcccgcttcgaccacaccggcgcgcgctcgtcgcgctgacgcgccctctcctccccgctgcccctggagtcttccgacatgaagtccccctctcgttccctgctcaccccgctgctgctctccgtgacgctgctgctcacggcctgccagaagcaggaggcgtcctcgggcgagtcttccggcgtccgcacgttgaaggtcggcgtcaacccggttccccacggagacattctccgcgccgccgccgcagtggccctgcgcgagggcgtgcgcgtcgacgtggtggagttcaccgactacgtccagccgaacatcgcgctgtctgacaaacagctcgacgccaactacttccagcacgtgccctacctggagcgcttcgccggagacaggaagctcgcgttgacgagcgccggcccggtgcacctggagcccctggcgctctactccacgaagttccgtcagctcgcggagcttccggagggcgcgcaggtgacgctgcccgccgaccccagcaacctggcgcgggcgctgcgcctgctcgaagcccagggtctgctgcgcctgcgcgaagaagcgggcgccacggcgacggtgcgggacgtggtgggcaacccgcgcaagctcgacctgcgggagattgatgcggagcagcagcctcgcacgctggaggacgtggccgccgccgtcatcaacggcaactacttcctggaggcccagaagcacctgaagctggacgcgaaggtgctggcccgcgaggcggcgcgggagaacccctacgccaatgtgctcgccgtgcgtcagggtgacgagcagcgccccgaggtgcgcacgctggtgaaggcgctccagtccgacgacgtgcgccgctacatcgagtccacctacggcggcgcggtggtgcccgccttctgacggacgccacgtcttccttgcgcgccgtgcccggtccgagcatgacaggggctcgcgcgcggggccctcccagccccgccaggcgagggagcgagcacatggccttgcggttcaagaacctcgatggcagcgggccgcagccgttcagcagcatcttcaagtgggccgtggcggacaagctcgccggccgccgccgcaaggccccagcccgcgccgaggtcccccgcgtggagcctgacctcgcgctgctcgccacgccgcccgcgacgggagaaggcgcgcggctgacgtggctggggcatgcgagctggctcgtgcagttggacggactgtcgctgctcatcgacccggtgctgcgcgacgccatcagcggcgtcatccggcgcaacgtcccgcccggtgtccccctggagaagctgccgcccatcaccgccagcctcgtctcccacaaccactacgaccacctggacctgcccacgctggagaaggtgggcgcgcccatcgtcaccggcctgggccatgcgccggtgttccggggctcgggcctgggcgtcacggagctggactggtggcgctccacgcaggtgggcgctgtcacggtgcacttcgtcccctcgcagcactggagccgccgcggcctcaacgacgtcaacgagatgctctggggcggcttcgtcatcgaaggctccagcgcccgcgtcttccactccggcgacaccgcctacttcgagggcttcaaggagattggcctgcgctacccgggcatcgacgccgcgatgctgcccattggcgcgtatgacccggcctggttcatgcgccgtcagcacatgaaccccgaggaagccgtgcaggccttcgaggacctgggcgccgcgcgcttcctggccatgcactggggcaccttcaagctcaccgacgagccgctcgacgaaccgccccgccgcctggacgcggagtggacccggcggggcctggcgcgtgagcgcgtcgaagtgctgccggtaggtggaacactcaccgtgcgccacggttgaaacccaccaggggctatgttgtgggaagggcatgctcctgcccaccctcctcgccatgacgctgcatcaggcaccgtcgtccctcaccaccgtctccgaacagagcggctggacgcgcacgggccgctactcggaagtggagtctctctgccgcgccttccccaaggcgtttcccggcaaggtccgctgcgacacggttggcaccacgccggaaggccggccgctgcttgcgctcgtcgccagcgcggatggcaccctcacgcccgccgccgcggcgcgcaagcagcgccccgtcgtcttcttccagggcggcatccactccggtgagattgacggcaaggacgctggcttctggctgctgcgcgacctgctcgccgggaaggagcagcccggcgtcctcaagcgcgtcaccgccgtcttcgtccccgtcttcaacgtggacggccatgagcgcttcggccccaaccaccgtcccaaccagaatggccccgaggagatgggctggcgcgccaccgcgcagaacctcaacctcaaccgcgactacgccaaggcggaggccccggagatggtggccctgctgaagtacctccacgcgtgggacccgctcgtctacgccgacctgcacgccaccaacggcgccaagttcgaacatgacgtgtccgtaggcatcgagccgcagaagtccggaccggccgcgctgcgcgagctgggcgtgaagctgcgcgaggagctcttcaccgagctggagtcccagcagcacctgcccgtgcccttctacccgtccttcatcgaggacgatgatcccagctccggcttcgcctacggcgtgccgccgccgcgcttcagccatgcctactgggccgcgcaccgccgcttcggcgtgctggtggagacacactcatggaagccctatgcggagcgcgtgaaggccacgcggaatatcgtggccagcctgctgcggctggtggcccgtgacggcgccgccctgcgcgcggcggtgaaggcggcggacgcggcggacgcggccggcaagacgcgcgaggtggtgctcacgtggaagaacacggagcagaagcggaccatcgacttccggggctacgcctatgagcggggcgcctccgacgtgtccggccagacgtggattcgctacgacgacacgaagccccaggtctggaaggtgccctacttcgaggagattcagcccgcgctcaccgcctcgctgcccgcggggggctacctggttccgcccgcgcacgccacctgggtggaagcgaagctggccgcgcacggcctgcgctcgcagcgcctcgccaagcccgtggccagcgcggcggtggaaagcttccgcgccaccgaggcgaagtggagcatccagtccgtggagaaccggcagacgctcaacgtgaagggcgcgtgggagccgcaatcacagacgctccccgcgggcacgctgtacgtgccggtggcgcaggagggcgtggagctggtggcgcacctgtttgagcccacggggccggactcgctgctgtcctggggcttcttcaacgcccacttcgagcagaaggagtacgtggaggactacgtgctggagcccttcgcgcgggagctgctcgcgaaggacgcttcggtgaaggcggagtgggaagcgaagttgaaggacccggccttcgccaaggacgcgcgcgcccgcctgcgcttcttctatgagcgccacccggcccgcgacgtccagctccgcgtctaccccgtgctgcgcatccaggccgcgccccaggggttggcggcggtgaagcccgcgaagccgtaggaagcctggccatgaaatgaagacgccccggagccagcaggccccggggcgtttttcattcagccctgctgactccggcctccttcttcaacgaaggccggagcgcttccgcatcatcagccgatgatgccttcgcaggcgcagtagctctggttgcagaccgcgttcggaccgcagccgccgcagtccgacttacaggcacaggcgcacgtgttggggtccgcctggtaccggtcaccgcagttcagcgcggccgtgtcacacacgcagccgcacgcgtcctggctgaacgtgaagcccggcgcgcaggtggccgtctgggcacacgagcacgagcaggtgtccgtgttgcacgtctcgtaggtgccgcacgtgccgccgcagtccggcgcgcaggtgaaggcgcacaccgcggggtccgtgttgcacacctggcccgggtcaccgccgccgccgcagtccgccgggcactcgcactggtccgtggtgcggttgcacgtcagcttgccttcgcagaagtccgggtcgttcgggtcgtggtacgggtccgccgcgcacggcgcggggatgccgttcgggttcgtcgtgcggtccgtccagtagcggtaggacagcgccgcctgggtggtccccgcgttctgcgggcggcacccgccgtagaaggacaccgcgcggctgatgccgtccacgtcgaagccgtgagtgcggctgcgtggcaggtctcccggcgtggggcactgcgacgcgttcgccaccgcgtccatggccaccttcagcgaggcgccgatgggcggcttctgcgtccggtaacccaccgacgcgatgacgctgtcgatgatggcgttgatggtggtggtgatggcgttcgagtcccggatgctgccgtacacgccgccggtggcctggatgatgtccaggtgccgcgggttccgggggtcttcctgggtctggcaccaggtgctggtgtcgttggtggcgttctcatgcgggcagaggatgccgtgcacgtcgatgggctgattcagcgggttgcggttcgtccccggctcgttgcccgtgcccaggaagtactggctgtacgtatcgatggtgccgttggactggtcccgcgtgtccgtcaggatgacgaccacgaccttggcgcccgcgcggaagcgcgtctccgccgtgccaccggacgaggccaacaggttgatgacggcgcgagcggcctccagcggacgctccgtgccgtttccgctctgccccacccagcactgcgagttggacgaacaggtggtgggctgggtccccgcggggatggtgacggtggtgcactggccgttgccgccgcaggtgctgttctgcgtcagccacgcccggaactggttgatgttcggcgtgaagccacgcagcagccccgagttcgaaccactgccataggtataggtggtgctcaccatcgccagccgataatccagcgtcgcgttggccagcttgtccgccacggccgtggccgcgttggccagcgactgctgcgacgaggccatggagccgctgtcgtccaccacgaagatgaagtccaccaccgcctgccgcacggtgaacttctcgcactgcaccgcgtccgcgtcaccgaactgcgccagcgccgagccacccgccgtgtccgccgtcgtgaagaggctgcccgcctcgttgtaacgagacgtcggggtgatggccagcaccaccaccacgctctggtcggagcggtgcacgtactgcgcctgcatggtgaagggcccggtgatgccggccgttcccgtcagctctcccgtgcttccgggcaccagcgagcgggtcagggtgttggtgaacgtcttcaggtccgcgccgcccgacatggcgtaacgcgccgacagcgcggcgtagccgtcccaggtattgaaggtctgctggaagtcacgcgtggcggagttgaacgacgcggagcggatgcccgcctcgtcgttcgtggggttggacgacgagcccacgcggccgcgcttgtacgcaatcagcgtcacctgcttggtggcgtcccagccgatgatgcccaccgcgttgttgccatcgcggatggtgcgcaggttggcgtccgtgaaggtggagggcagcgccagccgcaggtccgcgccgttctcttccttgaaggtgacggtgcgcaggttggacgtgcggcaggcctggcccgccggcgtgttggccgcgccgtcggcagagtcgttcgggttcagctcgcccgcgtccacgcgcccgttctggttggcgtcctccgcgccgtcctggatgccgtcaccgtcgctgtcggggttcgtcggggacgtggtggtggtcgggtccgcgtcgcccacgtagccacagttctgacgcggcgcctgcgccgtcgtcacacccagctccaggccgtccagcaggccgtcaccgtccgtgtcggggttggtcgggtccgtctcgcccgggtccacgcggccgttaccgttggtgtcctcaccgcggaagccattgcggcccgggccgtcctggagaccgtcgcagtcggtgtccgccaggcgggggtccgtctcaccggcgtccacgcggccgttgcggttcttgtcctcgacaccgtccgggatgccgtcgccgtccgtgtcggcgttgttcgggtccgtgcccgtcgcaacctccaccgagtccgggatgccgtcgaagtcggcgtccggaatcgacgcggcgcagtccgccacgcgcgggtccgtctcgttgccgtccacgatgccgttgcggttgacgtcctcgtcaccgtcgctgcaggtgtcgccgtccgaatccggggcgagcgggttggtgccggtgcgctttagagca

SEQ ID NO: 1019 - DNA, 11563 bp, Myxococcus xanthus
tctaaagagcccccgctgccccggcaaggggcgggcaggccgcgcgcgaagtgggcccgccacgtgggggcttccgggcccatgcggaagagctggggcaccacctcgtccacgggcgcgtgcgtcagccagcttccgggcgtgcaccatgaggcgagaccggtgatggacagcgccatcgatgggggcagcttctgacggagcgcctggagcagcgcgacgtaggcgtcgtattcggacgcgcgggcatcgaagtcaatctggagcgccgtcagctccggaaggcgcgccagcgtggcgagccggtccgccagcgcgtgcagtcgctcgggcgggtaccgcgcgagcgacgcgcccggatgggcttccatccgcaccgtggcccgcaagggtgtcccgggcgggacgtggagcggctgccggcgcgggtgttcgcgcacctccgtctccgtgagcgcgagcgtggcgcgcaggaaggccacgctgaccgggcgccccgtccgcgcgaggaagcggaggtcttccggccgctcccaggcccagagcaccacccgtggaggctccggcggcggcgtgggcgtgctgcacgacatgagcacggcgagggtggccagcaggccgcgccgtgtccggggtgccacgaggggcgaaggggatgggagaagcatcgtggtcgtcgggccgcactcgcgcggtggaccggcctgtttgcaacgcgcgttccgggtgcgcgccgcctcaggcctgggccgcgcgcttgttctgggcgcggcgccggagccagttgcggaggaaggccatcaccgcggggtgctgtgactcacggaaggcgtctggcgggccgtactccacgatgcggccttcgtgcatcagggccaggtggtccgccatgccaaaggcggaggccacgtccggcgtaatcaccagcgaggtggcgccgagctgctgcttgccggtggtgatgatttcattcaccgccgcggtggtgagtggatccagtccggcggtggggtcgtcgtagaggagaatcttcggctggaggatggtggcgcgcgcgaagcccacgcgcttctgcatgccgccggacagctcgccggggaagcgctgcgtcgcgtgcgacaggcccacgcgctccagcgtcttgttcaccgtctcggcgatttccgcctcgggcatgcgggtgcgctcgcgcagggggaaggccacgttgtcgaacacggtgagcgagtcgaagagggcgttcgcctggaagaggatgccctgcttgcggcgcatctggtcgagcgcggcctcgttcatccgcgcgatgtcctcgccatccaccaggacggtgccccggtccggctgcaagagggccatgatgtgcttcatcagcaccgtcttgcccgacccggacacgcccatcagcacgcaggtggtgccctctggcacttccaggttcaccccccgcagcgcctgctggtctccgaaggacttgtggaggtcccgcacttcgatggccagctggcgggaggacggtgggctcgagggactcatggccgcgcgaacatagtgcgcgtccgccgccttccgcctccaagaagcggctgcctggcgtggggaaggggcgcccggccgcccggcttccatcccggtgtggaatggcggtcagaggcggggcggaccctcgccacggggcttgccctgggagcggagggcgcgatgcttcgaggtccgtgggtgagacggaatgacacatggggcgtccagaggccgggcgcctgggaggcaaggcgtttggcgacggtgtccctggaggacgtgcgcaaggtgtaccggggcggcgtggccgcggtgaagggcgtgagcctggacatcgcggacggcgagttcatctcgctggtgggtccgtcgggctgcggcaagtccacgacgctgaacctcatcgccgggctggaggagatgtcgggcggcacgcttcgcatcgatggcgcggtggtgaacgacatgtcaccgcgggagcgggacatcgccatggtgttccagagctacgcgctctacccgcacctggacgtggcacggaacctcgccttcccgctgaaggtggcgggggtggcgaaggcggacatcgacgcgcgcgtgcgcgaggtggcgtcgctgctggggctggagggcctgctgtcgcgcaagccgaaggagctttcgggaggccagcggcagcgcgtggcattggggcgtgccctggtccgccgtcccaaggtgtttctcttcgacgagccgctgtccaacctggacgcggcgttgcgcacgcagatgcggggggaaatcaagaagctgcacgagcagctcaaggccaccttcgtctacgtcacccacgaccaggcggaggcgatgacgctgtcggaccgcgtggtggtgatgaaccagggcgaggtgcagcaggtggccccgccgcgcgagctgtacgacgcgccggcgaacctgttcgtggcgggcttcttcggcgcgccacgcatcaacctggtgaagccccggacgctggggctgccggacgcggacgtggtgttggggcttcgtcccgagcacctggaggtggggcagggcacgccgccaccggaggcgctggagggccacgtgtacctggtggagtccatgggggcggagagctgggtgacggtggacgtggccggggagcgcatggtggcgcgcgccgccggggacttccgtgtgccaacgggcgctccggtgtggctgcggtatgacgcggcgaagctgcggcgcttcgacgcgaagtcgggccgagccctgtagcgggcctcaggcgtagacctgttctccctccaggctcatgtcgagccggcggttgagttggtccagccgctcatatcgctcgcgcagcaggtcgcgatgggcgtgcgggtccgcatgggccatctcttccaagagcgcgcgcagcgctgtgtccagcgcttgcttcacgtcgcgcgcctccacggcggacagttccagcaacatggtgcacctcctgcctggaacgttaggcacgcacccgcccatgtggcctcgatgcctgcccggagtacgccagggctggcggcctggcgcctcgcgttctcctggcaggacatgcggttcggcggcccctgcgttcgcgtggtggtggagcggcgggccgtcgtcgcgagcgctccaccgtgtgcgccattgcaggtgcgtcccgtcatgcccgctcgcactgttgtctgggagtcccggacgggccgggcacccgagcgcgaggaggccggaatgattcggacagacgacgtacacgaaggcatgaccgtgcggacggcgacaggccatgtcatcgggcgcgtggcgggcatcggggacacgcacttcgaactggagcaggggctggtgcccattccccggcgcgactacctggtggagttctccgacgtggacttcatccgtggccacgacgtctacctggtcaacgcggaccatccgctcctcgcgctggaggtggatgacgacggcggcgcgctcccgcctcgccattccgagggactggagcgcgagcccgtgaatgtcgacgtggagtcttgagccgcgagaaaacgagtgacgcaaggcgttgcacgctcgctccggcccgctctggacaggttgtcggacaggcctcaagtgccgggtaagcgtcgggaatcactcaggttggaccgccctggaatgtcagacggtcagtctagacatgactgcttcgacgggcattccaggtggggtcatgcaacggttttcggcatcatgtgtcacggtcatcctcttcgctgtctcgttcgcttgcagcgcgggtccgcgcgcggaggacgggggaaacggggcggcggagcagggcctgttcttgtccacaccccgcaagctcctgcccttcgtggtgatggagagcgggcgtgtgctggcctcgggcgggcatgacgggagccgaacgctgggcagctgcgaggtgttcgagccggagacgggccggtggcgtgagacgggggccctgcgcacgcgccggcgcaaccacgccgcggtgcggctgacggacggccgagtgctggtgatgggcggctccaacggcctggcgatgggcgcgcttgcggacgcggaggtgtatgcgccggacaccgggacgtggacggaggtgcgccccatgggcgtggcgcgcaatgacccggccgcggtgctgcttgcggatgggcgcgtgctggtggcgggtgggacggatgtggaccagcggccgttgcgctcggcggagttgttcgatcctgcgacggggatgtggagcgccgcgtcgcctccgggcttctcacggggtggggcccagacggcggtggtgctggccaacggcaaggccctgttcgtgagtggcctgcaggcggagttgtatgacccggtgacggggctctgggagaaggcgggactcaccggtggggcggcgggcacgcaccggctggcgcactcggtgacgttgctgccggatgggcgcgtgttggtggtggggggaaccacggcacgcgcggcggccacggcggaggtgtattcgccggagacgggggtgtggacgctggtgggagcgcccaaggtgcctcgtgagcatcatgcgacggtggtgctgccggatggcgcggtgctgatgatgggcggcgagcactacacgacgggggcgctcgcgtcggtggagcgcttcgacttgaagacggagacgtggtcttccgcgcccgcgctggacgagccgcgcgagaagctgggcgccctggcgctgggagatggcgcggtgctggtgatgggcggtggcaacgaggcggcgggcatgctgtccgagagcgagcgctatgtcccggatgcctgtgtcgtggcgccgtgtgctgcgcgagagttgggtggggccgaggcggtgatggagctctccgtggccgggcaggtcgagtgacgcgcgtctcgcgggcctcgctgtgtgtgggtgagcgcggcgaggctcgaggtcgctggggggcgaacgggcaggcaggcgttgagggtgactccagcgctaacgccgggtgagatgggggcatgaacccgtggaaggcgtcgctggtggtgtgcgtgtggctcgtggcgtgtggtggctcggaggcaccgcagcgctcctacgctggctggtcggagcgcgtggcggcatccgcgtgcgcgtatgaggaacagtgcggaaccctgacggtgtcacgcgagcagtgcgaggcggaccgcatcgcggcctacgcggcggtggagccggacctgtcgcgaaccgaaagtggcgcgaaggcgggctgcgtgcagtgcatgcgcgcgcgcatcgatgaactcgacgcggccaccgcgagcggctgccagcaatccatcgacgaagcccgcttgctcgctgtgtgcggcgtggatggcgcggcctgtgcgggcgtgccctgactccggcgatttcacggctgctccctgcgttccggcgtcgcgggcctctcggggcgtgagccgctgacggcgtgcggactccgcgcgccgcgcgccggtgcgtgacagactgcgcggccatgcgcactcggaccctgttgcttgccccgttgctgctctccacttcctgcgccaccgtctctccgaaggcacaggcaccggacgccaccaccgccgaggcgaagtccccggcacccgagcgtcccttcggcaccctgcgtgagcaggcgaagcgccagcaggcgtggctggccgagcgcgtggagaaggccctgccccagctcatgcgccagtacggcgtggacatgtgggtcatccccatgcgcgagtacaacgaggaccccgtcttcaaggcgctcgtgtcgcccacgtcgttcgccgcgcgccgccggaccatctacgtgttcttcgaccgtggccccgagcagggcgtggagcggcttgcgctgggcggtggttcgcagggaggcctctacacgccgcgccgcgcgcagcggcaggtggacggaggcggtgtgagccgcgaggccgagctgtggggccccgagcagtggcaggtgctcaagcaggtggtggaggaacggcagcccaagcgcatcgccctcaacgtgtcgcgcaccttcgcgttcgcggacggcctcagccatggtgagtacgagggcatgtcggaggcgctcgggccggactgggtgaagcgcttcacgtcggtggacgggctggcggtggacttcatcgcctggcgcagcgcggacgaggcccgcttctacgaggagcagacgaagctcgcgtggaacatcatcgagacggccttctccaatcaggtcattaccccgggcgtcaccaccacccgtgacgtggagtggtggatgcggcagcgcctggcggacctggggctggagacgtggttccagccgtcggtggacctccagcgacagggcgtcacggagaaggagctgggcgaggacccgatcatccaacgcggcgacgtgctgcactgcgactacggcgtcaccgcactgggcctcaacaccgacacccagcacatgggctacgtgctgcgcgagggggagacggacgtccccgcagggctgaaggccgcgctgaagacgtccaaccggctgcaggacatcgtcttcgaggagctgcgtcccggtcgcacgggcaacgacatcctccgcacctcccgcgagcggatgcgcgccgagggcatcgacggcaccgtgtactcgcatcccatcggcctgcacggccacggcgccggccccatggtggggctgtgggaccggcaggagggcgtgcccggcaatggagaccacaaggtgattgcgaaccagtggtactccatcgaactccaggccacgtcagtggtgccggagtggaacggccagcaggtgcgctcggcacaggaagaggacatcaccatcgacgccgagggccgcgtgcactgggcctggaagcgccagacggacttccacctggtgcgctgagcacgaggcccgtgaggcatggcgagcggcaccatgaaggcgccgctcgcggcctcactgcgggcgcatgacggtgttgcccaacaaggcccaagggttcccgtcctcgtcgagctggaacccagacaacccaaacccgatgaattgcttgggttcccaacccgtggcacggagcctgcgaatgtagctcctgcccgcgtagctgttcgtaccccgctcgctccacgccaaccagggctcgaggtctcggccgacgacgagatggagcggtgagtagttcggctcgtggctggggccgatgaattcgggcgaggtccaggtcggctgtgaatcggccagcgatgcggatgagaaaagcatggcctcggtgtgcataatggtgccgttccaggggtcaatagaggtgccatgctcagtccaggccatgagcacgcgatggtcttgctgaagcgcgagagtgaggttgtccacggatgagggcgccatgaaggggatgggcgcgcccacgggaacccaacttccgttctcgaataccttgacgtggatgtaaccagcgggtggcccgaggtcgatggctgcctcctgccagctcgcgaccactcgcgtgtcatccgctgcgatggtcactcgccgtgcaaggtccctcggcaccgggttctcactgaggggcgtaccgagcgattgccactctgtgcctgtccatcggaggacgcgaacctcggtttcgtttgggttggtactctggcccactgtgatgacaggtctgccctgtggtgccaccgtcagcttgacccagtcgtacttggagggagtgtcgatcgggactgggaagtgttcccagcctgtcccggtgaagctggcgacatggatctgctccaacccggtgccggcatccctctcgcgccactcggcgacaatctcgccgtcccgtgctccgaactggaacgcaacgaggttcgaggcgccctcgatgaccgtatgaaatgaggggagccgttgccaggcatggccgtcccaccgcgccagggcgggcacttgggtgttggtcctgtaatcaaattgaaggaatccgacgacgggcattgttccggcaatgccacgctcaagcaggaagattgttggtagggggaagacgtcgtccaagagcaggggtgccgtgacggcggcaaagggcccgtagtctgcgtagtgccggaaggcgaagtctggaaggccagggtcgagtgagttgccggccaggtcggtcaggctccgccggaggagtgtcgcagccagcgtgacgggaggctggagtggtgatgtcggcaccagctcgagaaccgttccattctccttgaggaccgcttgatgttcgaccgggagtgggcggccgtaggtcgtgttgagcagttcggtcgcctcggacggaagcgaatccggcagcagtggctccgagaagacgaacgctatcggtgacgacacggacggatagtagtggctggggcgcctggcgacgatggtgggcggggtgcggtccaccgtgacggatacttcttcgccgtcgaagctccgcttgccggccatggcgcgcacgacgaaggcgaagcggccttctgcgtgtgcggcgcagtcgacaacatatcggtagggcgcctccagcgtcgtggtggtctcgccgttcgtgaggagttccacacgctctggcgtgccgccttcgacggaggctgagagagcccacagcccctcccgacagaacgcggggccctccgtctgcaaggtgacgcgcagctcgtggggccgctcctggggtcgattcggaggcgtcggctcggaccggaaggagccgtaagcggcggtgcccagtgtcgcaaagagcagcgaggcggcccatcgggcgcgggtacttcgggggttcatgaggagcctttcgggggacacgccaaaccgttgcatcgggactcggcgcgtgcagcctggtccgagtccgtgcttggcgacaatgccaggcacggtggttgtcccggtgcgcagagacccgttgaagcggccgtccctgaccacgccgccgcgcttctccggacagacgccctgtgatggcgcgtgtccttcgtgacccggtcgacgaacgtcctcctccgggcctccctccagacgcctgtcgtcagtggacgggctcggaggcaggccagttcctccgcgccccgggcgcatctgcctcacccagccgtcagtggtgcgacgctcccgtcattgactggagccgcgtcaccgccttcgttgtagaggttgatgacctcctccagcgcggcgttgctcgccgtcttactgtgggcgaaccacggcgccgcccgacaaggcccaggggaatgcgttcccatcaagcaggaaccctgacaacgtctctcctgaaatgatttgcttgggctcccagccggtggcgcggcgcttgcggtagtagctcttggtgtcagaagccggcgtgtgctcgctccaggtcaaccagggctcgttgtcgtgatcgacgaccagcctgagcgagtcatgggtgctgactctgctcaagacctcgacttgttcgataggggcccactcggctcgccaggagtccagggccgcggacgtgagccggagggtgctgacgtttgcattggtgtgacgctcgctccaggcgatgacgacgcggtcgtagtcttgaagcgcgagctcgactcgctccatgagtgtgccttccgtgatggggaggggctcgcccacgggagaccagcttccgttctcaaagacgcggacgtggaggttgagggtgtcgccgctgacggatcgctctacccagctcacgaccaccttcgagtcaacgacgatggctgcgtgctgcgaagagctgaatcgctccgggttctcgccgagcgcgtctcctaaggccaaccactccgtgcctgtccaacggatgacgcgcaactcggtctcgagaaagtcgatgagccgctccactgcgaggacgggccttccaaactcgcccaacgtcatcttgacctgggtggagtcggattcaacggcgtggggcatccccacgcgttcccagtccgtcccgacgtagcgcaccacatggatatggtcgaacccggtttcttcatcccgctcgagccaggtcgcgacgatggattcgccgtgcgcggcaacctgaagattctgggcgggccgagtccgttcagtcgccgctcggagcggagggagttgctgccatgtatggccatcccaccgcgcgacggatggctcgtccgattccggtgagtaaagattggcaaagccgacgacgggcatcgtcctgggaaagacacctccgagtgcgagggacacgggatagtaggtgttgagcgggccctcatgctcggtgacgcggctgaacggccagtaggtggcgctgtgggtgcgggtgtagaccgacaggttcggttcgagcaggtttccagcccggtcggtcagtgttcgctggagcagctccgcatggagcgtgacgggcgggcggagcggcgacgacggcaccaactcaaggaccgttccgtcctcactgaggaccgcttgatgggggacggagaatccgttctggtcgcgcagttgggtgggcgtggcttgaatcgagcctgggagcagcggctccgagaagacgaacgccagtggagcgctcactgacgggtggctgaggagcgggcgacgggagacgatggtgggcgccgtgcggtccaccaccacggaggcctcttccgcctcgaagttctgttcctcgcccacggcactcgccaggaacgagaagcggccctcggcgtgcgtggcgcagtcgatgacgtgccggtacggcgcctccagtgtcatgggcgcctgctcgttcgtgaggagctccacgcgctctggcgtgccgccttccacggtgacggagagcgtccactgtccttcccggcagaattcgggcccttcggtccgcaccgtgacgcgcagctcgggaggcggttcctcttcgccaatgggcggaggctggccaggtttgggctctgacttcagggggtcacaagcggcggttcccagggccaggtagagcaacgggagcgcccagcggacgcgagtactacgggggggcatgagaaacctctcggaggattttcgcgagtcatgccttggacacgcgaagcctctgagttgggactcagcgcatgaagccgattccgagactgcccccaagcgacagcgcggacgcggtgcccgcctcctcacgcacccaagtgtgtcccgcgttcacgagcagcgacatcccgaaggctccgtacacggggagccacgcacctcccactgcgcccacggtgggctgcagggcgagcgccttctccccattgctgggctgccactgctgggacagggtggcgccgacctccaccgcgccgtgaagccgcaggttccgccagacgcgtgcgtcatgtcccacgcccagccgcagtgtgtggtcgttctgccggaggttgccggaagggtgccgcccatgccgcacgtccaccccagcggtcagcaggttcgcccagggcgcggtccattggtagtggagcgcggcggtgccacccaccatggcgcccaag

SEQ ID NO: 1020 - DNA, 11778 bp, Myxococcus xanthus
gctctaaagccctggaagcacacatctgcagggtagacatgccggactcctgcataggcacacgccctgctcattccgctcgtagacatcgagtcgtgctgcggaacgctctgtcacggagggaaccaacgacttcaccgcgatggctgtcgtcagcacgacatcatcggaccgggtaagaaaaacaggatgcctacacccgacgccctctcgggggagcactgtgcgccggatttcctcatggtcgcggcgaatccactcctgggcctgggcccagtacgcgtccgacggaaagcggtctcccatggcgttgaagcacagcaatcgccgggcacctacgccgaaggaggccgagaagaaatggcaggatacgctgggactcagccgccccaacacttcaatgacttcgtcggaggccgtgcagtcaatgatcgtctcacactgcccaacgagctctggaagtggcaaacctcccaccctcaatgtttggcggaacgactgtgcacgcaagtctggattgaggttccgcagccgagcagcgagcgcatgggccttggaatagcgcacggaaccgaggtccagtgagtgacgaacgagattgcctgcctcaagatcatcaccatccaggatgaccaggcgagacacgccgccacgaacgagcaactccgccacgctcgagcccaacgagccagcgccgagcagcgcaacccatctcccacgaagcgcctctggcaatgctcctcgactccgaaggtcggaaggggcccagttgtcggttcgtatccaatcgatgggcaatgaccgctggaacatcaccgcctggtcgtgacgccagtaattctgctccgtgcgccggaatccacgcggcgcgatgtctcgatacgcgaagcgcggcaatcgcatcgcccaccaatgcaggcgcgccgagggagccccttgggtttccggaatggggaatcccagaaggcagagatgacgctcaccatctcggagacgagtggccagcccatgcagggcgtcacgcaggctccattcgagctggtgggccgccgcctccagttccgtccagagcactggaggcgcatacggtggcagcaccggaatctgtcgacaccgcagccacggaacccgaaagcgccgcctcttgtgaacgcgacgaagcaggtccccccattcgaaagaaaacagccagcgcccatcgattgtatagaacgccgtcgcggcgaatacacgaggattgcccggcagcggcgccagctcgacccagccctgcgtttcttcaatcctttcccaagtcgcgagcgactccgcgtcctcacggaacaccacctgagtcgaatccatgtgtggcaaggccggtaactcgaacggagccccattcggcagaagccggccacgcgcagcggcctccagccactcccgggcccgggcaacatgccatcccagcctcgatgcagcatcaagcggctcttcatcccgggcccgaagccccagtgcggcaagcccggtctgcagacacagcttgccgtcccgccagggcctcgtctcgggtccgcgccgattcaggttctggtggggacgcgtctcctcgattcccccttgcttcgacggatggacatcgatgtctcccaaggggtagctcgcatcaacgagcacgtgccaaggcgtccactccggaatcgtgctgccttccgtgttcgcgcgaagccgcagtggtagcacccagcattgcgcttccgggtgccactgtatgtcggcgagcaaatccacgtcagcgcccccatccaacgcgcgccgtcccatccgaagcgcatccgtcaactcgggagcctcactcacgtgcgaaccggcctccccccacggtgcccggaccgccttcatgtttggagaaacctcccttcgagggagagccgccccctcctgcatcgggcgcgttggggaacttgtcgccgaagagttccctccacagtggtgcggccgcctgggcatcaggagcatcgaacgcctgtcgcgccgtctgcgaggccttcacgacttgagcgtgaaacttcgcgaagtccgagccggagatacgcgccatgacattctggtcaacgccacggtccggcgagtggggtgactgatgcgccgctgcatgaatggcgtatcgctgcgcgaaattctccagcgtccggacgaccccttccgcgaccgaggtgattccatccgggcagcaatcaccgatgaggtgttcgagcgggtagcttttgggccgttccggtagttcatccaggtgaacgagtcgccaccacttgagcgccttgacgacgttgacgaaatgccgcgaacaccgggcattcttctggctggtccaggtcaactgcgcgagcggatgcgtgtcctgccaggccccggcgtcacggtcaggaatgcgaagccgctgcgacctccaaagtgaggctgactcctcgacgaccttcagcagggattggtccgtgtcctcgtcggcacgcaactgcccttcgctcttggccaactcactgtagacgccggcttccgcttccgacggtgcagcggtgatgaccaggtccatttcgacgtacgacaactcgataccaaaagagcggccctgctgccgatacttgccggcatagtgctggtccagaaagggcttgaagcaggccatcgcctgcgcgggcgtgaattcggactccttcattcgggtcacgacgatgaggtcgacgtcggccctcttgccatccttcggacggactgccgtgcgccgcttgtaactcccctgcaggaacaagctcacgaacccaggtgagagcttttcgtcggccaggaggcgctccttcagcgtcgagtgcccggtaatcatgtcctggcgctgagctgccgtaggacgaatgccctggaggaagtcttcgaaataggtgggaagtggaagtgccatgtcacattaatcacgcaagacatggcaattattacctgccgaatttcagactgaattcagcaaggactcggtaccaccagccgtgccgcagggtcaccgaggagcacgtagttcgtaacgtcgtgccgctccagccacagcaaggctctctccatcgcatccgtcgaagtcggatgtcctctggacacagcctcggcctccgcctggtactgcttgcggagacgttcgtccgcctgcctggcgaagcgggacaatgtctcgagcgccggccccgcccggtgtccatccaccaaactcgacagcacagcttccagcctgtgcgaatgggatcgtcctgtcgaggcgtcgtgaaaggcatgggtccaggcaaggtccatgtgagccaccactgccagcggccccttcggattggccaaggcggcctgtggcagcgcggccatgaagggctgaccgtctacgggccttgagcgaatgagcgcagccagctctcgcggaggaaccacaccctctctcacgagctgctccatccaagggaggtacacgctccgcacgggcgtgccagctccaaagcatgcgaaatagaaccagatgccgcctggaagaaatggccgctgccggatgtccgacgccgtcaaggtctgccccgcgccgagtgacaagttcccctggacgtgccgctgctccgccggacttgcccatccctgcgcgctgccgccgatgccatggctcaagctgaagagcaaagttggttccgactcccccgccagctccagaagccggttcgcagaacccattcgaagcttctcttgaaccaacgcgcttgctggaaaatacccccgcccccgagcatcgccgcagcgtcgccccacgaccgaaacgatatattcctggccaacacgtacagcagtcgtcccatcatccacggagaggaaaaggacgcgagccttgcgagtgggcgccacggactgctcgctctcgacgaccttgctggagtaggccgcgtagtcttcgtcctcggcgaaggccaggcgcccgacgaaacaagcgccatcgcccgtcagcgactcctgaagctccagcgacaggtcctctggactgcccgcgagcaggacgtaccgagggtgctcgcgggtgggccttgcgcgaggatgcagcacacggtccctgaagtcgtgcgccctcgtactgtccagcccgggcggcaccgcatggatatcgaccaccgcgccttgctgcgcgcttcgcagctcacacagcggggcgaggttggccgcgatgcgcgcgccgcgcgccccactggggaccagcagcgcccatcgctgctgcggcagcgaatcaggctcggctgccatgttggacagatgcgtgggcgtggagagaggaaccggacgcggagccctccacaaggactcaggcgacagcggcgcatccatcacctgactcccatcctccgcagaggcgagcaggagactcagcgtcacttcgtctcctcccgtcttccggagcgagtggttgccgaaccggatggatccccccccgtgttggtatccgtactgaaaggggggagctgatacaggaccctggcaccctcaatgttcatctgcgcaacgaagccatcgagctcggagagggagccttgaaccgcgaagatggcctgggtggaatcgtccattgccccgtaggccttgaacgtctcagtctcttcagacttgacgatgaaaacgacccgaccttttgggggatacccgtcgaagaaggactgaccattccactcggagaactcttgtaccggcaccgtaggaccttgcatgtttccctctctgcatcaatcgaccgcgctgcccgcggcacgagcactcactcgaagacaaggactgcgttcacccactccgaatcgcctcccgcgctcagccactggagacgctcgtcgcggaccgccacggccagactcgcacccgcgaggacgcgatcgcgcacggcaccgaagaaggcggatgagtccaggtccggaatcgggtgcgtggcggccagaaccgctcgcgctcccgcagccaggaaggcactgggtagacttccagcgcgatggagcgccgcgttgggccgccccccctcacatgccgcaagcacgacgagcggcgcaccggtaagttggctggcccggatgctgtcctcgaacagcgtgtccctcccatccgcaccaggagcgagaagcaggtaggcgaagttcgaatcaggatccaccttcccatgtgtcgccaaatcaatctcggtggcggtcgagatggcctcgagtacctgggtcggcgttgccgccagatctcggagaaaccgagcctcggccccaggcgcagtgcgcggcaaccactgcaagggcacttcgtttcgctcctcgctgtaacgcacctcgttcacgaccaggtgcgtgcctggacctgctggaggcggaggcgctgcggcgcgagtgcggtagcgccaggcgatacccggcggcaggagccctgagcgtccttgcaaaggaggtcgtgccaggacgtccaccaaggtgcacgcctggagcgccgccaacatctccggtgggacggccccctccatactcgctgcctcgaatctgctgcttcgcaacggcacgtatgcactcaggagttgcccctgagcgccgcgagcaaccagcaagctgcgctcggtgtccgctgtgagccccagcacgcacctggcgggggtctcgaagcccagttcggcaccaaaccgggccagcgcagcgatgaagtccccggtgtcggcatccgcgaagatgagggaggtgtagctatacgcgcgcgcatgtgccgctgagacgtcatccagcggaagggcctctgcttgccgaatggcctcgtccaggagcattcgcccacgtgccgggtcaacctccacgagaatgcgaccatgaaggaacttcgcatacgcacgctgcccaggagtgttgcctggttcccgagccaacgcctgctccaccatgagggcatcacgtggcgagcggcgtgttcgtgcgacgtctaccagcgccgcgactccatgctgtgtcaggggcagacctgtatccattgcccggtccagggaagcccgcgcctcatccagttcgagcgcccagatggcaaggtgcgccaggttctggtggatattgcgagtgctccacttatcgccctcagccatcaacagcgcttccccgtaataggcgcggcctagagtcacgtccgcagcctggcgcgcgacattccccaaggcctggagcatgacgccttcaaggtcccactggttcggcctcgccaaggccagcccatcacgtgcgtgctgcgcggcggcgttgacccgaaagagccagctcttcacgtgcgacaggtcgttctcgatgaagatgcatcggtagacgagccgttcccggcggcagatgtcgagtgcctgctccaacggtgcaagcgcctctttgtaatgctcctgctgacgttcgagcatcgcctgtgcctgaagtcccaagacccgaaaccaggggtcttcatcgtgctgggttcggcgcaccagctcgcttgcataggcaggcaggcgctgcatgacatgcgcgagcgcccccagcgccaggtctgtctcgtccgaggtcaagaagcgctggagcaaggcatcctgctcactctcggggatacggcccgagatgagccttgcatactgctccgccaggggagcacgacgagagaagtcccgtgcggcgacctgatgaacatagtcagccagaacggtgccactacccacggacgcatcgagccgctctgccagaggcaacagcgcgagcacgtccgtcgaggaggtccgtgcacgcaccgcatggtagaagtcgcgacgcagcagcgggacatcgacgaaggtcaacgccctcgcgagctcttgggcgccacgattgatgaggtccgcgcccgtctggtccgcggccagccagcgttccttgcggcgcagtgtgctcgacagtctggcccttcggtcacgcgcctcactgcgccacccctcgtcggtttctcggtgctcgaactccgtcaggtccttcatcgccgaaagtggaagccccaggtcacgataaacgaggctgcgattccacaatgcctgtacatggccaggctgcatggcgagcaccgtgtcgaagaggcgcaacgcctccctgagttcttccgtcgctctcgcggcatccagaggcttcgacgcgacgtagtgggccactccgaggtcgcaaagcacatccgcggattgccaccgcaggtcgctcctcattccttccaggatcgccttagcgctggaaggctcggggacgcccgttgccagataagcgaccgcgagctgatgaaggtctccgcgtttctccaactcgctcagcaatgcgagtgagcggttcggtccagagcgtgcggccgcgccgcccatcatcacctgaggcggccgccggtaccggtccgccgccagatatgtgacgcgcgcctccagcgtccgctgaggttgcgcccacagttccggcaacgcgcgaggtgcctgtggccgcaacgttcccaacagaatgaaggcaacggccaccatggaagcaagcgcgaaaccgcccgccatccagcggttccgaggcagcgcatgccagggaatgtccaccggcccatgtcgctcgatatagcctcgtccgagttggtcaagctgcaagagtcgagtcagctcgacctgacacttctcacaatccgccagatgctgaccaaacgcctgggcctccatgggtggaagatccccatccgcgaaggactggagctggtcgcagggagaggaagacatcagtgggttccctcatcaacgtaaggcttgagcagttcgctgagccgctgacgcgcgtcaaacagtcgcttggccacggtgccgggagagacgcctagcttcaaggcaatctcctggttgcgcagcccctgagatcgaagcaggaaggtaaggcgctgctgctgagggagctttccgatggcccaatcgaaacgctcctcggtaatccgttcgtaggtcgcgccgctcgccccttgctgtgccaaggtccagcgagtaatcgtcggatcgccctctgccttcttccgacccatggcccctcgaatcaggtcatagaagtgatgcgtcatgaccttgatgagccagccttcggctggcccgtccttgggctcgctcggcgcggcttcgtaatgctcgatgaagcgcaacaaggtttcctgcacgaggtccttggggtcaatcccgaccgcgccccggcagagcttttcggcagtgggcatcaaacgcccgtagtacctctcatgccactcgtcgaagttgctggccacggtctccccggcgctcgtcatgacagcgtcccttgctgctcccgaataggaaaacgcaggtcatctggaatgttacgtgggactctgcgaatttccggggcctttagcggcggcgggccggttgaccttgaacgccaccattccagggtacctccacgtatccttccaccttgcgaaaattgaagagcttgagcgtcgcgtgtactttcgggttgtaggcccttcccagtgctgccgcgaggctggcggggcccgtcatcgcaagccatatctccttgatgaagggaagctcttggtggatgcgatcaaggtatccgcgaaactcagccacggcacgggctgtgtcctcgggtcctctcaccaccgtaggtgaaggcccacgtgcggccacaagcctgacccatccgggcggcgtcgcgcatctcaaccattcctccatatcttcggaacgaatggccggctgaacctccaccgtcatgacgacacgcccacccgcctcaacacacgaggcaagatctggccaggcttccagccggaagaagggctccccttcaggcaacgggagctcggagtcatagccacatgaccagacaccactctggccgcgctgctgctggtagacgcgaaccttgcgccgtgccaggccccacccgaggtggaacatgagaggaagcggcgcgcagccaaagaggtccacgtgggagacacgcgctcccagcgcagagacaagcttgtcggcctggtcgatggcgctctgccactcccttcgcttcgacggcaggccgtccgcgacgcgaccgagtggccgtagcaacacgacatccggctcaggccccaaacggccttccagggcttccgcgatactggtggtcggcacgtcgaagtttacttcgtaggccacgactacctccctccgcaccgaggctggaagcccatgctcctcggagaagagccatcgctgccctggtgggactttctccggagtcacgacgaagagctgggagagaagcccagtcgagagtactgacactcagtgaggcctgcgccgcctggaatgattttctcaccgaggttttctcgcgatagagcgacgagtgaaacgcccgggtcacgcgaatcgaaccatcgatggacagcggcatctgtgaggcaatgactgccggaatgcccatctggtgaaggtcgtgtgccactccgccaagcattttgcccgcctcaccggggttcccaccgtgacacgcgctcaacaccacggcctgaatgtcgtccctgaattcccccagcacatccacaagcatgttcccatggatgcgcaattcccttccgggccgatggtggtcgtcccagcaaaggccaaatgagcctccaggaacagggccgccgtggcagaggaaatgaaggacgcgataggggcggcgctcaaccttagcttgccgcaatttttcccggagagagtccagtgtgacatgctccaggacgtccttcgcccgatcgaactcggagcatgcgtgctgaatctcggcgaggtgattatcctcggatactccgtccgcggcgtccgaccaggcgaagagcaaccgccccggtgcccctgatacacgcgctgaagaatccgccgtctcccattcgaatgacagagggcagggctcaagagatgcaagccgcatgttgttcctgagcagggtcagtgcccatgggagactgaacaactccagtgcattgaatctcaaatgcagcccaatgggccaaccgcggctcttcgcatcgaggatttcatcttcataggctgaccacccccccagcgccttcaagacgtcttcaaggaaattccgcaacaccatccccatcttcttttgggcattggggctgggcgtcggggtcaggaactctggtctcaactcttcaacgaggccccattggaaggtcgcggcgcccgtctttccattcgcgtcccttgcgatgtactgccttggttgaccgtcgaatgcgtatggcgcgctcactgcggccggactcatcaactcaagggtcaattcgactccagttggccttgtcatggacacctaccgaaccgggaagtccgttcccaggagttctcgccagagatcaagtgcttcgaccgtgtatcccgaatactccaattccagtgctcgcttggacacacgcacggcttgcgtcaaccgctggtgcgcttgaacgaggcgtccctgaggaatccaactggtaatggttggtccagagcttccagggacagggcactgattcagaatattggcgcacatataatcaaacaactgcgccagtccctccgcgtagctcttatcccctagcgagtgggtcactcctcggcaggccaagacttctaggagaaatgaaggcaccggcttgtcgtggcgaaaattccagcgcttgatggcctttatccaaggtttcagcttcttcttcgccacgtcattcgcatcgtcgcacgcttcctgatgcttgcgaggattactgcgaatccactgaccggctcgcctatctggaatcaggtagccaccctgttcccacgggtcgtagagcgcaggaacaacatcgaagccgatctcggtcccagtgaagttgatattgaccgagcgattctggagtcgcgtttccttatcatggaactccgcacggagcgcccattgcacgcgggctagcgcatcctcaggttcaggtggattccttccatcatctgcaagaacgaggaagagatcgatatcgtggagtggtcgaatcgccgtgttccgaccataggaccctgaaataaaggactcggtgggccgcaactgtcggcgcattgcgttgaagacgtactgctcttgtcgcgttgcatctcgtgcttctccatcatggagacgcagggagttcatgaacgtctcgaatgcctgagcaaccgtcagcatgggcaatatggtctccttcgccctaaagaacgatggagtgcctagaaattacgaagtggcccctacagcggcttcgagggtgggcttgtcagcccctacctgtagggtctctacccttcatgacatccgtcttcgacctcatccttcgcaggctggagcaaggccaccccgagcaactgctgttgctcctcttcggcggacagacaccggccttcgtccgaatggctgactccagccttccgcagtccgagcggcgcgcggataccgtcatggtcgtggaagccggtggagcgcgcttcgcggtggacgtcgaaattcaggcacaggcggacccgcacttcgcggcgcggctgctggactacacggtccgcatccaccaccgggagaagctacccgtactgcccgtcgccatctacctcgtgccagaagccgagggcgcaccaccgccatacggctttgagtgttcggggctgcgcgtcctcaccttcgacttccaggtggtccgcctctgggaagtggactacctccagccggccttacgagcgggcacccttag

SEQ ID NO: 1021 - DNA, 10733 bp, Myxococcus xanthus
cgtgctgctcccgatggagcgcgcctcgccccgcgccatccagggcgagggcgagggcgtcatgaagtcgctccaggtctggcagaacgtcaccgaggccctggagctgttgcgctccatgctgcggcgctgaaccgcgcgccgcgcgctagcggaactggccagagccctcggcactgcggttgtcgaggactctgtccagcgtgtcttccagttgctggccgtccacggcggtgacgcgcacggagaaggggccgtcgcccattccactcaagttgacgaagtagttgtagctctcgcgcgggacgtcctgccatccaccggtgccgcgtcgccactccagcttctggatgggcaggcggtggttgcggacctggatggcagtccaccagggattgctgccgttcttgaagtggtactcgatgttccccgccacgtcgcaggacaccggcgtccaggtgatgttgacccggccctgctgcatctccgcgatgcgggcgaaggcttcccggctcaggtccaggtggccggattcacactccgggcagcggtccacgatgcgcacgcggaccgagcccttggggccggtgatgtccacgcactgtccacaggccgcgctgttggcgtactggggcgtgttcatggcggccaccatcaagtcacctgttggctcgtagctgcaattgccggagccggtggcattgtagaaggtggcgatgccctgttgctcctcgcccagcggcgcgccgccgccagacgggtcgtcactgcaaccgccacaggcgacgaacaccgcggcgacagggaggaggaagcgtcgggacttcgagcgaagggggtgcatggccactcagcataccccgcaaaaacggcatcggggtggaagggcccccgggcaccctccaccccgacgtgtgtgcgggcttgcgccccggtgtcagcggccccggacggaggcgcccttgagggcgcgggcctgcgtcaccagccgcacgaactccttgcggtcggcgtcaccctcggtggcgccctcggccagcttctcggccgtggccaggctccaaccctccgcggaggggctgtcgcggaggacgtcggcggtggcggccacggcgacggcgaagcggaagtccggcgacgcctgcgccagcgtgtcacgcagcttcgtgcgctcgaagcggaattcgcgctcggaggcctcggtgccgttgggcgccttggcgcggacgcggacggtggccagcgcctcggtggcttcacccgtcagctccacctcgtacacggcggtgacgttgtggccggcgccaatctcgcccgcgtccaccttgtcgttgcggaagtcgtggtcagcgacgtcgcggttctcatagcccaccagccggtagcggcggacggcggcggggttgaactccacctggaacttcacgtccttggcgatgacctccagcgtgccggtgagctgagtctcgaacaccttcttcgcctcgcgcaggctgtccacgtagaagcagttgccgttgcccttgtccgcgagcttctccatcaggtcgtcgcggtagttgcccatgccgaagcccacggtggtgagggtgacgccctcggccgtgtacttgtggatgctgtccagcatggcgttggcgctcacgttccggccgatgttggcgtcaccgtcggtgaggacgacgacgcgggacaccacgctgccggaggccttcttcacggcgtggcggtaggccagttccatgccggagcccatcgccgtgccaccaccggccgtgagcgagtcgagcgcggcgtggatgctcttcgcgtcggtggcgggcgtcggcggcagcacgtcccgggtgttgcccgcgtaggtgacgatggcgacggtgtcgttctcgttgaggttcttgacggcgaccttgatggcctccctcgcgagcggcagcttgtcctccgagtgcatggagccgctcgtgtccacgaggaacacgaggtgcgcgggcttgcgctgcgagcgcgagaccaccttgccctgcacgcccacgcgcaggaagtggcgcttggcgtcgaagggcgagggcgcgccctccagatgcaccgcgaaggcgcccgtctccgggggcgcgtagcggaacttgaagtagttgacgaactcctccacgcggacggcggaggcgggcgggagctggccgttgacgaggtaacggcgtgacaccgtgtacgacgcggtgtctacgtccgcggcgaacgtggagagcgggtccttggccgtctcgacgaaggcgttggccttccaggcctcgaaggtgttgccgcccgcgggagcggcgtcttgtggtttggactcgaggggcgcgcccgccaaggcgtcagcggacggcttcatggggcgcggttcgcgccggtgcagctcggccttgcccagggagaccttcttggcggcttgcggcgcgggtgcgcgcgcaacgggcccggcgagcgcggaagccgggggagccgcaggggccggggctgccacggaatgctcggcgctggcccggtccgcgacgtactcctctcgctcaggagcgtgcgcggcgtcgtcatccctggcaacggactgtgcggcccccaggctcggccgctcgtcggcggcggggctccggttgtggcacgcgggcagggtgctggcgacgagaagggcacttccccagacagtcagttggcgcttcagcgagaagggggacatcagggctccaaggtcggtgagtaggtcgcctcccgaaaacgcatggcccgcgagaaagggtctaaagccgaatgaattttccggcgaacacccgggccgggcgtccttgtctggagcacctccgtctgacagggtgccgcgccatgcagaccgccaggccatttcgaattttgggtgtccagcagatcgccattggaggcgcggacaaggcgccgctccgcaagctctgggtcgacctgctgggcttgacgccccacggcacctaccgcagcgagcgcgagaacgtggacgaggacatcgtcaccgcgggcgcgggccccttcaaggtggaggtggacttgatgcagcccgtggatccggagaagaagccccgcgtccacgagacgccgctcaaccacgtgggcctctgggtggacgacctgcccgtggccgtgcagtggctggagtcccagggccttcgcttcgcccccggcggcatccgcaagggggctgcgggcttcgacatctgcttcatccaccccaagggcagtgagcagttccccttcggaggagagggcgtgctcatcgagctggtgcaggcgccgaaggaggtcatcgccgccttcgagtcgctatccaccgcgggtcactgagtcagcgcccggcgggggcgtgctggccctgccggaacagccgtcccgagagattacggagcgcgggccgcagcacgcgctccagccggtccagggcgacgcacagcacgaaggtgaggccgatgatgacggccgtcagcacccagtactggagccagccactgcggtctccccagaagcgctggaaggagaagacgccgcccagccgatagaagagcagcatctcgtggaagaagtacgcggacagcgacgacgtgccgaacacctccacgaagcgccgcagccgagacggcgctgcgttcacgggaacccgggcctccagccacgtcaacacgagcagcaccgtgctcacccagccgaagcgcgccgccgcgttggagggattggcgacgaagaagcggtggggcgggtagaggtcgtagaggaagtcaccgagcaccgcgcccgtgaagcccagccccatcagcaccagcagcgctttgatgagcccggcgcggccccaggcgcccgccaccgttcccgcgaagacgcccagccacgcgtagcccagccagggcaggagcgggaagggcgcgaaggaggacttctccgtcagcgtggcccaggggccatccacctgttcacccaggggcgacacggcgaacgtggccatggccagcatgaaggcgccgacgctcagcaccttggggcgcgcggagagcagtgcggccaccggcaggacgatgagcaggcacaggcccacgcactggaggatgtccatgcggaagagccactggggctcgcgcagcagggggaaccacgcccagttgaccagggtggccaccgcgagcacctcgccagcgcggcggaggttgcggtggacgcgctcgcggagcacgccgctggcggcgctgcggaccatcatcagggcggtggcgaagccggcggagaagatgaacgcgggggccaccagcccgtcgacgcgcagcagccgcgccacccattcgctctgccgcagctcgggcaggagcaaggccagggtgtgcgtctggaccatgaagagcaccgcgatgccccggagccagtcgatggctcggatgcgatcacgggagacgagggcaggggaggcgggcgtggacgtcacggcccgcctaccctagagcatcagcggacccagctcacgttactgatggcgaatttagagccgtcctgtttctccgcgttcgtcatcggcgagtacacccgcgtggagaaagtgttggccgccgtgtccacctccaccaaccgcgtcaggttcgatgtgttctcgtggtacgacgtcaggatttggtggatggtgttgccgtggacccccgtgctggtccggtacgcggcattgcccgtgtgcccggagaagacgaaccgcacgttggcgtactgcttgatgagctggtcgaacacgtattgcgggctgttgttgccatagccgccgttgctctgctcgatggcgccgctgccattcaggtgggagtgggtgttgatgatgacgttgtgacgcggatgttgcgccagcaccgtcttcgcccagtccacggcgcccgtgcgggcccacagctccaggttgagcacgagccagtccaggtcgccagcggagaacgtgtggtaggagttgtcgatcttccccggctcgtagacgccccccagcgcggtgaagcgcgtgagcgggaagtgcgcgttgaaggtggtggtgtcgcgcaagttggcgttgacgttgcccgggcaggcgctgccgccggggcacacggccgcggtgtcatggttgccaatggcgtagacgtagggcaggccggcggcgtccagaatctccgtggcctcgctggcgcgcacgtactggatgtggtccggcgtgtcccagttcacgacgtcgcccgtgtgcagcacgaagcgcaggtcgagcgagctccggttgtccaccagccactggagccggtgcgtgagtcgcgtgggtggcgtggtgaggacctcgttctgtgtgtcggggatgacggcgaaggtgaacttcgtgtcgaccggcggcgcggactccggggcggcgtagaatttgatgccctggttgacccagccggtggaggcgagcgcgtcgcgctgggcctcggtgatggcgaagcggtgcttgcgcagcgtggtgttggagaagcggtacaccggaacgaggcatgaggcggccgtcttcgacgcgtagaagccgacgttctcgtccgtcgtgtagcccccgttctgcatgaggtcgttccgctcggcctcatcgatggtccagaagtgctcctgccggctagggctgtagatgcggtagacgggggacagccccgtccccgtggaggccgcggcgagaaaggccacgccccggtcttccgtgtagccccaggtggtggcggcgttggcggcctcgttcgcgttgagcgtgtagaggctgtcttcgttggccggcttgatgcggtgatggacggcccggctcatcgagtcgcagttcagcgcggactcggtggtggcgatctcgacttcgggctgcgattccaccgggccgccgcacgccgccaggaggcccagcagtgccacggggaccgaggttctcaggtgtctcaaaggtgtctcctcgcagggggtgtcgcggacagggatggccgcaaaacgagtattgcgagaaaatcaatagcacccgagccgtggtccaggaagacccaccctgggcagtgtctaccggtaaccagtggcgtcggcgggcttgcccgcgtcctggacctcgacgacgtagcgccaggcatcgggctggctgccatccaggtccgcgaagccgtagacgcgtgcgagctggccgctggacagggactgtccgttccaccgggccttgtccgcgtccgatgccagcgcggccacggctcggccgacataggccggcgtctccgagatgacgaagtggggctccttcaccgtcgcgtcgcgccagttcgcctcggtgacgccgaagtgctccagcatgccttcggagcgcatccagcccggcgtcagcgcgacggcggtggcgccatggggcctgagctctcgagcctggctccaggccagccggagcacggaggccttcgcgaggtcgtagaacgtggagatgcggtagttcgtcgcgttgtagtcggcggtgccgtcggtgacctcgaccacgagccctcccgggcggcggatgagcagcggcagggcgaagtggctggtgatgaggtgcgtgtccacgcccagccggagcagccgcagccccttgtcgagcgagtgctcccacacgctcttgttccactcaaagatggactcgccgccccagatgtcgttgacgagcacgtccagccggccctgttccccatcgatgcgctccaccagggcctggacctgttcgggcaccaggtggtccgtctgcacggcgacgccgagcccacccgccgccgtcacctgctcggcggtctcttcaatggtctccggccggttctgctccgagcgctgggcccgtgtcgtccggcccgtgacgtagacggtggcgcccgccgcgccgagctgcaccgcgatgccccggcctgctcctcgcgtgccgcccgcgaccagtgccacgcgtcccttcagtgaatccttcatgtcccgcatgcctgcctcctgggggatgtccatacgaggggcgagcctacggaggattgttgacacctcctgtcatgattgggcgagttggcggggttcacggaggaacgcgccgcggcctttcacctcctcacctgttcgacatcgcgcgaggaggttgtgcggctcagggcgcggggcaggtgagtctcggctccggcgcgtcgacgtcctggagccgcagcaggcagcgaagggcgtcggggtccgcggagtccgtcaggtacgtccggcgccacagcatcgctgcaacgcgccggggaagcgtgggatccggcgcgacgagggcccggcggacggcattgcctccccgaggcgctgtcgccgccgcggcttcgagcttggcgacttcgtccgggcagccatccgggcagttgtagaggaacaccgcgtggccgtgctccaggttgtggacatagaggcagggggagacgggctcggaggcgctcccgcacggggccacgctgccgcagtggaggccggagttgggcggattctctccgttgccacacccttcgctcgagcaggtgtcgaggtggtgggaggggctcggcgccgacagcggaaagctgaaccgctcgcaggcgtcggcatcgtcgggagcagtgtcgccgcagccggcgagcgcgaggactgtcaggagggggaggagcgggcgtggcatcacggccgcgtcataccgcatcagccgggaaacgcgccccgccgctccacgtcaatgtcgcgcaggcccttgaagcccagtccggcggcgaagcggaggaagtcctcccgggagaggctgcctccggttgcgttgaacgggagccctccgagctccatcggcgtccggctgcgaacggcgaagtccacgcggcccggcaggtagcccgcgttggcggcgatgatgatgtgctcggggagtcgctgggcccagcgcaccgcgacctgcggatggacctgggcctccgagctgaacagcaacagcgccacgggactggcgatgcgcggtggcgtcttcgagcacctcagcacctcgcgctgcacctccagtcgacagtcatgcaatgtgtcgacgccagggacgttgccccgggtgatatcggtggcgctgcccgcgcgaaggaggactcccaacgccagcggtgccgcgtaccgggaggacttccgggccgcgttcagcaaggccacggattccgtcacggcggtgcgccccgcccggcggagggcgtccttgaggaagggaatgggcgcatccacgccctggtccgccacggtccccaggacggccagccattccaacgggcccggcaccacgcagggcgacacgagcgcgtaggtgagcaggctgcaactgaccgcgggctccaatccccgtgcggagagcacggtcgtgcccgccttgccagcgggggccgcttggggcgccacgatgagcgtggggaggcccggcggagcgacggagtcgtccatcgcatccgacgacatctcgagcaccacccatgcgtcgggctgtgccgcgcggaggcgctgctgaaaggttggcgagagggcatgctcgcccttggccggtacctgcgccttgacccgcgctcccatggcctggagcgcgcggagcatcagcgcccctgcggcgagcccgtccacactggggtggggcgccaccacgacgtggcgatccttcagcgtcatcaagaagtcacgagcgttcgccagcgcctcttcggatgcgggccagtggggggccttcatgtgtccgagcaacatggggtgaaggtttaacgccgtggggcgacacgggaggccgggcatggagcgcccgcacggtacccggccgggcagagccagtgccgaaccgggagggggaccacccagtttcggagtgtcaacagtcgcgggttcttctacggtccgcggccatgaaccggaaacgtcccctgaattccctcctgcgtgcggccgcggtcatggtgctgcccgccttcctggggtgtgcccaggattcgcaagtgacacgcgaggcgcccacgcccgccgagtctcccgccgccgcgtcgcagccctcgccggcagaggcgaaggccttcgcggagaaggtgaacgcggacctcaagagcctgtggacgaagcaagccaccgcggagtggatcaagtccacgtacatcaccgatgacaccgagcagaacgccgccttcgtcaacgaagaggtgctggcctacgtcaacggcgccatcaaggaggcgcggcgcttcgagggcctgacgttggacgcggacaccgcgcgcatgctgcacctgctcaaggtgtcccaggcgctgccggcgccgtcggacgcggagcggcggtccgagctggccgccacggcggcgaagctggagggcctctacggcaagggcaagtactgcgggccggacgggaaggggaagtgccgcgacctggaggtgctgtccgacgtcatcgcggagagccgcaactttgacgaactgctggacgcgtggcagggctggcactccgtggcccgtcccatgcggccgctgtacgagcgcctggtgtccatctccaacgagggcgcgaaggacatcggcttcaacgacctgggcacgctctggcgctccgcgtatgacatgtcgccgggcgagttcgaggtcgaggcccagcgcctgtggggccaggtgaagccgctctatgacgacctgcactgctacgtgcgcggccgtctggcgaagcagtacggcgccgacaaggtacccgacggcaagccgattcccgcgcacctgctgggcaacatgtgggcgcaggagtggaacaacatctacccgctggtggagcccttccccggacaggccagcctggacgtggacgcggcgctgaagcagcagaagtatgacgcgatgcgcatggtgaagctgggtgagaagttcttcacctcgctgggtctcaaggagctgccgccgagcttcttcgagcgctcgcagttcaccaagccggaaggccgcgacgtcgtctgccacgccagcgcctgggacgtgaacttcagcaacgacctgcgcatcaagatgtgcatcaagcccacggaggaggacctcgtcaccatccaccacgagctgggccacaactactactacacgtactactaccagctcccggtgctctatcaggccggcgcgaacgacggcttccacgaggccattggtgacgcgctcacgctgtccatcaccccgggctacctgcagcaggcggggttgctgaaggccgttccgaagaacgagaagaacctcatcaaccttcagatgaaggacgcgctggagaagattgccttcctgccgttcggtctgctcgtggaccagtggcgctgggaggtgttctccggccgcgtgcagccggcggactacaacaagtcctggtggacgctgcgggagaagtaccagggcgtcgccgcgccggtggcccgttcggagcaggacttcgacccgggggccaagtaccacgtgcctgcaaacgttccgtatacgcggtatttcctggcgcgcatcctccagttccagttccacaaggcgctctgcgaggcgtctggctacaagggcgccctccacgagtgctccatctatgggaacaaggatgccggcaagcggctccaggccatgttggagctgggtgcgagcaagccgtggcccgacgcgctccaggccatgacgggaacccggcagatggatgccacgccgctgctcgactacttcagc

SEQ ID NO: 1022 - DNA, 12173 bp, Myxococcus xanthus
gacgtagcccatgcgccagcccgtcatggagtacgccttgctcatgccgttcacgaccaccagccgcggcaccaggtccggcgctacgtcgctgatgcccaggcgttcgtcggtgtagagcagcttctcgtagatgtcgtccgtgacgatgaggcagtcgtggggccgcagcacctccgcgatgcgctccagcgccgcgcgcgaatagacggcgccggtgggattgcctgggctgttgatgatgacggcgcgcgtgcgcggcgtgagcgcgcggcggatggcgtccgggtccggcgcgaagccgtcctcctcgcgcgtggggacgatgacgggcgtggcacccgccagccgcaccatgtccgggtagctgacccagaagggcgcgaagatgatgacctcgtccccctcctccagcgccgcctggcagaagttgtagaggccctgcttgccaccggacgtgacgagcacctggtccggcgtgtagcgcaagccgttgtcccgctcgagcttggcgcagatggcctcgcgcagctccgggatgccgttggtcggggtgtacttggtgaagcccgctcgcagtgcgtccaccgcggcctgcttcacgtaatccggcgtgtcgaagtccggctctcccgcggccaggactactacatccacacccttggcgacgagcgccttggcgcgcgagttgagagcgagcgtcggagacggcttgatggcctggagccggtgagcgagtttcatgtcccctgcctaacgcggagccccactccggacaaggggactgcctgctacttccgtccagcgaacttggccttcaaaccttcgtgcacgttgggcggcaccagcccggtgacgtccccaccgaaggaggccacctcccggacgaggttggaggagatgtagaagtagtcctcccccgtcatcatgaagacggtctccacgtcgggtgccagcttgcggttcatgttcgcgagctggaactcgtattcgaagtccgacaccgcccgcagcccgcgaacgatgacgcccgcgttgcggcgccgcacgtagtccaccagcagaccgtggaaggcgtcgacctccacccggtcgtcctggacggcctctcgaatcaacgtgagccgctcctcttcggagaagagcggtgtcttcttcgggttcaccgcgatggccacgatgagccgatcgaacatcttcaggctgcgctgaatgaggctcaggtgcccgttggtgagcggatcaaaagaaccaggatagatggcgaccagcatgtgccgggaagtctcggatgcccccgggagccggtcaaggtctgctcacggcgcccgatagaagctcaccaacgtatccccgaagcggcgctggtcttcccggtcaagcccggcatgtgtgtccggcgccgcctcgcgcttgtcgtgctccaccaccaccatgccagagggggtcagcagcccggcggccacgatgccgtccagcaccgtctccaccacgcgcgcggtgtacggcgggtccgcgaagatgagctcgaagcggtcgccccgccgcttcagcgtctccagcgcccgggccaccggcgcggccagcacctccacctgcccggcgagccccacggcctgcgcgttctcacggcagagggtgagcgcctcgcggtcctggtccaccagcaccgcctgtcccgcgccacgggacacggcctccaggcccagcgcgccggtgccggcgtagaggtccagcacccgctggccgtccaggaactggcccagcacgttgaagagcgtctcccggacgcggtcggccgtgggacggatatgaagggacgaggacttggggccggccagggcgcggcccttggcggtgcctgcgacgattcgcatgggccccttctacaccgctccggcctcagtcgccccgcttctccgccaggaagcgcagtgacgcctgccccgtgcgcgtggcacccagcgcggacagtacctcggtggcctccatgaaggacagggcctgcagcttctcccgcgcggtgtcgttcagcggcggcagttgctcctccagaacgctcagcagctggtctgagggcagcccggcggctgtggccttcttcgccacgctggcgcggacttgcgggggccacgcccccagcgcgagccgatcgaagccgcccacgcaggccaccttgcgcacgcccgccgccacgtacgtgggcagcccgccggccagcgccgcgcccgcctcacccaccgacagcacggcgtcgtactccgcgggcagttgcaccaggctgcgcaccagccgcacgtccggctcgccctcacctagcgcggactccggcacacggacgaagtccactggcaccttccactgcctgaggccctccagcagcgtccggtacgcgtccacgaacccgccagaagcggccggtcccgtcagctccagcgccagctcgcgctcggtcaccggcgccaccagggcattcacggcctccacggcctcataggagtccagccgggacaggtccaacgacaccagcgagaagccggcgtccaccacgcggtagatgccgtccttcagggcgtccagggtgtccgcgtccgcccgggccacccgaatgggcccggcctggaggaacaggggccgcgcgtgttcggcctcggcggccgcctggtgcgcggccacgacgaagcgctcgggcgccccccggtcagacagcgggtgtgggcaggccagccccagcacggcgtcttccgaccgggccgcgcgcagcaggcccggcaaggcgcccttcgcttggaccggcaggcacggcagcgccaccggcgcctccgccagggcacgcagcagctcccggggattgagcagcggaacgcgcgaacccgcgcccacccgcgccaccgtgttccccggccgtaacgtcagcaccttgtccagcacgttcatggagcgcggagaatcatccgcccgcgccgcccgaggcaaggcgaagctgctgggagcgtccgctggggcacgcggacggggggccccggccgggccccagggccgtcagtggacctcgcccaggtgggagtaggtctcgctctcgatttgaatcgtggtgtggtcgattccgaagcggtcgaacaggtcgtgcttcaccgcggagagaatctcgtcgttgttgcagaccatggggtcctgcaccaccaggtgcgcggacagcgcgtacacgccgctggagatggtccacacgtgcaggtcatgcaccgccgtgacgccctgcgcgcgcagcatcagctccttgatttgcgccaggtccacgtgcgccggaaccgcctccatcagcacgtccaccgcgtcgcgcaccagccgcaccgcgccgatgacgatgacgatggagatgaccaccgagatgatggggtccacgacgtaccagcccgtgtacgccatgatgcccgcgcccacgagcacgcccaccgacgacagcgtatcccccagcacgtgcaggaaggccccgcgcacgttcatggagtgggagcggtgcaggaaccccagcgcgcccaggttggccaagaggcccaccgacgccacgatggccatgggcccgatgttcacttgcgccggcgagcgcacccgctcccaggcctcatagaggatgaagccggtgatgcccatcagcagcacgccgttgagcagcgcgctgaggatctccatccggtagtagccgtacgtcttcttcacgtccgccggcttgcccgcgaaccacagcgccaccaggttcagcgccagcgcggacacgtccgtcagcatgtggcccgcgtcggacatcagggccagcgagttcgtcagccagccgcccaccgcctccgccagcgcgatggtggccgtcagcaccagggagaagatgagccggcgcttgtccttcttccgctcctccgccagtccgcccctccggggaccgtgcccatgaccgtgcccatggccatgatgatgatggccatggccatgtccgtcgccgtggtcatgctcgtggccatgcccggattcaccgcgggtgtaaggggaagtagtcacgggagtgaggggtgcggctaatgcccagtcatgaggtatgagaggccgggaatctggctgccgccaggcccggcatcccctgctccggagcgtggggagacgcgacggaggtggggatggactacgggaagcatctgaacctgcacaccatcatcatgctcagggatgtcatccgcaagtggtggcaggtcgagctggcgttcgcggaccgccacggcatggtgcatgagtggcagcgcggggaaatcagcccgccgccgaacgccttctgccgtgcctccctgacctcaaaagagggcttgcggcgctgcggccagtccgtccgtgtactgaacgagaagttcaaggccaacaagaaggtgcgccgctcgctcatccacgactgccacctcaacttcagcatcgtgggcgcgcccctctacatcgccaacgaatacgaggggttcctcttcgtcgagggcttcgcccgccagcctcttgacgcgcgcgaagcggacgtcctcaagtcgaaggtgcgccagttcgccccgcagcacgcgaccctggacgggaggagcgagcaggttcccgtcctggacggcgccgagctgagcaagctgtccgacctgctcgagtgcgcggcgaacgaaatcgccaaccacgaagcggcggaggcctcccggcaggaggacggcgcgcccgggtcgtcccgtgagctgagcgaccgctaccgcttcgagaagatcatcgggcgctccgggcccatgatggaggtgttccggttgatggagaaggtggccaactccgactccaccgtcctcatcaatggcgagtccggcaccggcaaggagctggtggcccgcgccatccacctcagcggcccgcgcgcgcagcagcccttcgtggtgcagaactgctccgccttcaacgacaacctgctggagagcgccctcttcggccacacccgcggcgccttcaccggcgcgctgcgcgacaagaagggactcttcgaggtcgccgacagcggcacgttcttcctggatgaagtgggcgacatgtccgccgcgctgcaggtgaagctcctgcgcgtgctccaagagggaaccttcctgcccgtgggcggcacgcagctcaaggaggtcaacgtccgcgtcatcgccgccacccacaaggacctgagcgagctggtgaagcggggcgagttccgcgaggacctctactaccgcatcaacgtcatccgcgtgcagctgccgcccctgcgggagcggcgcgacgacatgcccgtcctcatcgaccacttcctgcgcaaacaccaccgcgagggccagcgcgcgcgggggctggacgcggaggccctggccatcctgggcgcgtacgcgtggccggggaacatccgcgagttggagaacgaaatcgaacgcctgctcgtgctggggggcgacttggagtccatccccgccgagctcatctccagccgcatccgcgacgccgtgttgcccggaggaggccccttcatctctccgcgcgcccacggcaagctgcacgaggccgtggaggccctggagcgggagatgattcagcagggactgatgcgcacgcgctacaacaagagccggctggcgcgagagctgggcatcagccgctccaacctcatcttgaagatctcgcgctacggcctggacaagggcctgcccgaggacgagtcggagatgggcgacgcatgagccctggtccgcggtacttccaccaggatcgcctgcgcgtcccggatggcgcgcagttgtattaccaggtccagggagatggccttccgggcatggtcttctgtgacggcctgggctgtgacggcttcgcctggaagtacctggcgccctacctggtccggaaccaccgcgtgctgcgctggcactaccggggccacggccgctccaccgtccccgaggaccgctctcgcatcggcatgctgtacacctgcgatgacctgcggcggatgctcgacgccgtggggatggagcgcgtcgtcctcttcggccactccatgggcgtccaggtggcgctggagttccagcgccgctacgcccagcgcgtgtgtgggctcgtcctggtgtgcggcagctacggcaacccgctggacaccttccacgactccaccgcgctcaagcgggcattcccgctcatccgccgcgtggtggagcgctaccccgagcagtccgcccgcatcatccacacggtgctgcgcacggagctggccgtgcagttggccatcaccctggagatgaaccgggagcgcatcgcccgcaacgacctggccccctacttcgaccacctggcccggatggaccccgtcgtcttcgtgcgcaccctggagtccatggcggagcacaacgcgtgggaccacctgcctcatgtggacgtccccacgctggtggtggcgggcggccaggacaagttcacgccgggttggatctccgaggaaatggccgaccggatccccggcgccgagctggagctcatccccgaaggcacccacaccaccccactcgaagcccccgggcgggtggaggcccgcgtcgagcgcttcctccgggagcgactgaacgtgcgtaccggcgccccctcacccacgcctacaccggtggtgagccctcccgctggcccctgagccctccggaaggggccggccccctggcgttgttcatggatgacaggagtgaaaacccgcccgcacggacgctgggcttccggctgcattgcaggggacgcactcgcggcatataagcgccgacctcccgggttccggtggggttcggaagccccggcgtcctcgggcgttccccacctgccatcacagttcggttcgtatgattcctcgcgaaaatattcgtaacgtcgccattgtcgctcacgtcgaccatggcaagaccacgctcgtcgatcacctgcttcgccaggcgggcactttccgtagcaacgagcacgtcgccgaacgggtgatggactcgaacgacctcgagcgcgagaagggcatcaccattctcgcgaagaacaccgcggtcaattacaagggaatgcagatcaacatcatcgacaccccgggtcacgccgactttggtggtgaggtggagcgtggtctgcgcctcgttgagggcgtcatcctgctggtggacgccgccgaaggccccctgccccagacgcgcttcgtgctcagcaaggccctggccatgggcctgaagacggtgctggtcatcaacaagatcgaccgccaggacgcccgcgcgaaggacgtgctggacctggtgtactcgctctacatcgacctgggcgcggacgagcagcagttggagatgcccgtcctctacaccatcgcccgccagggtcaggcgtccacgcagctggaggtccccggcaagacgctggagcccctgtacgacgccatcatcaaccacatcccgcctccgccgaagtcggacgagccgtcgctgcagctgctggtcgccaacctggactacgacgactacgtcggccgtctggccgtgggccgcgtgcagtccggccgcatcaccgccaacatgcctgtctccgtctgccgcgagggcggcaaggtgcatccgggtaaaatcgtcaagctctacggcttctccggcctgaagcgcgtggagattccggacgcgggtcccgggtgaaatcgtgtccatcgccggcatcgaggagatctccatcggcgacaccatcgccgacgccgagaagccggtggccctgccccgcatcgccgtggacgagcccacgatgatgatggtcttcaaggtcaacgacgggccgctcgcgggcaaggaaggcaagttcgtcacctcccgcaacctgcgtgagcgcctctaccgcgaggcctaccgcaacgtgggcgtccgcgtggaggacaccgacacgccggacgcgttccgcgtggtgggccgtggcgagctcgccctggccgtcatcatcgagaacatgcgccgcgagggctacgagctgacggcctccaacccggagccgatcaccaaggagatcgacgggcaggtccacgagcccatggagctgctcttctgcgacgtgccggagaacagcgtgggcgtggtgacggagcgcctggggccccgcaagggccgcatggtggacatgggctccctgggctcgggccgtacccggctccagttccgcatccccgcgcgtggcctcatcggcttccgctcggagttcctcaccatcacccgtggcgagggcatcatgagcagccagttcgacggctacgagccgtggttcggctacatccccaagcgccagaatggcgccatcgtctccgaccgcctgggcgacaccgtgccctacgcgctcttcagcatccaggagcgtggctcgctcttcatcggcgccggcaccacggtgtacgagggcatgatcatcggcgagcactcgcacgcgtccgagctgaacgtgaactgctgccgtgagaagaagctcaccaacatccgcgccgccggccgcgacgagaacgtcatcctcaccactccgcgggaaatcagcctggagaaggcgctggagtggatcgccgacgacgagctggtcgaggtgacgcccaagtccatccgcatgcgcaagaaggcgctggcggtgggcgagcgctaccgcgccgagcgtgaccgcaagcgcgaggagcgcgcgtccgaaggcgagtaggccttcgctctgctggggcgctcacggggcgctccgcatccccagggcccgttcccactgcgttgggggcgggcccttcgtgtatgcgggcttcagaacgtgtacttcaccttcgggaagatggcgaaggaggtgatgttgggcccgatgatgtagcgggccagcaggtccgcgccgacggagaagtggtccatgcccgtggcgtactccacgccgaagcccaggcccgcgttgggcgcgttgacggcgcgtcccgggtcgccctcgtcggggtccacgggcgctggatccagccgcgtgtagcccgccacgaccttgggcgtgaggaacagccggtccatgacgcgcacgtggtaggccgccgacaggttgaagaaggccatggtgaagttgtccgacagcgcgcacgtctccgtgccgggcaggtagcccgcgaagcagttctgcgcggacgagccgagcccgaagtgcgcccccagcgacagcttctccgtgaggtcgtaccccaccccgagctgaaggtacgtctgggcgttggagtagacgttctccccgcccacggtgaagaacacgccgatgtccgtctcggtgaagaaaccacggcgcggctcgaacgccaccccttccggcggtgtggccgcaagaaccggagacgacagcagcgcgagcgcggcaatcaactgagacttcttcacgggtcctcccgacagacgtgccctcccagcgcaacgcgggagcgccgcagacgttaatgacgcccccccggaaccggcagtgggggaaaacgaaagtggcgtggaccgtttcgcccacgccacttgggtccttcacgggccgctaccgtcgctcaccctcccgcgccagcgggcgcgaagagccaggggtacgtcaccgacaccacgccgccgcccttgggctccgggaacttccagcggcggattcgcgacagcatgcagcgctccgccgcggcgttgttcagcgtcgtctcggagacactcgcgtcggacaccgcgcccgcggggtcgatgacgaaggacaccgccaccttgccggcgaggctcggatccttgttcagctccgactcgtagcagtacttgatctccccctggtgccgccggatgaccttggcgatgacgtccttgtccaggccgcccaccaccgtcgtcttgccggggatgaccttggtgatggacttgccacggccgcccaggtcgatgccgcccgacccgcccgtgccacggccggtgccctgcgtcccgagaccaccgatgcccagcgcggtgccaccaccgcccttgccagtgccacgcgagcccacgccgcccacgccctgcgcgtcacccatggccgcgccgcccttgaggccgcccagcgcatcgttgatgccggtgccgaagccgccgggaccgaacacgtccgatgccccacccttcatgcccttgaaggcgcccagcaggccggccttgcccaccgcctgacggtccttctccttcttgctcttgtccaccacgggcgtgccgggcttggaaggcgccgcttcctgctgcttcgcctcctccttgccgaacttgccttcctcgtgcttcgccttggcgccctcttccggcgcggacagttggagcttcttcgcctccagcctcttctccggggcgatgaggaacttcgccacgcgctggtgcgactccaagatgtccgcgctgtgcggaagctccgggcgcggagactgcaccatcttcagcaccaccgccaggcccgccagcatgcagatgctggtgatcttgaagaacgtgaagtcagagtccttcagcgacgcggcggtgatgaccggagacggcttcacgtagcgcgcgacgaaggacaccgtgcccagcgacacctccacccggtcgtgcaggcccagggtgaagcgctgctcggcgtcgtcgccggcctggccggagagcgcgcccgcggcccgcagcgcgtccttggtgcgcacgttgccctggttggtgacgaaggcgcgcgagcccgcgggagcccgcacctccaacacatccttcttgctgacggccagcacgtggctcttgcccacggacggcgcgaagacgttgaagaagttctgcttcgcctcgccgatggtgacgggcacgccgtccttgaagtgctggacctccagcagggtgtcgccccacagcagcgcgacctggaggacgcgcgcctcgggcgtgggcatggcctcgggaggcagcggctcctggaggtgcggcgccaccgtccgccgcggcgtggccgtgttcgccacattcggcgtggacgtccgcgccgaggagggcgtcgtgcgaggctggagccctggaggcacctgccggggtggctcgaccggaatcacaccgggagaggccacccgctccacgcggttgcccagcgccgtggacacctggcgcatgggcggcggcggcgtgggaaccaggttcggcaggtccgcgcgcgtctgcgtctgcatctgcatgccacgcggcggcggtggcgtggccaccggcccctggaacaccggccccgcaacccgcgcacccgcgggaagcggacgctccggctgggtcgctccgaagagcacctccacctggctgccgcccaccatcaacacatccccggggttgagcgccgtggggaggacgagccgctgtccccgcacttccgtgccaccctcactgcccaggtcgatggccgtgaccgagccatccttgtccaccttcagcatcacatggagattcgagacccgcgggtcctgaatcttcactgccgcctgagcgcccgaccccacaatgacgctctcggcctccgacacggcttccgccgtggagccatccggcccggtgatccgaagcgtcaagccgttgttcttcgccgccgccatgaggattttccctcttccattccgcccttagaacgactgccgccgcccgctgccgctagaggttgtcgactgacttttgtaactctggatcgaagttgtcccggaccttgatgaggctctggaagtccgtcttcttccggtggagtacgtacgagccctcaggcttcgtgagctcgccttccaccgcgacatccgtgaagtcgatgaccgtcttcttccggacgacggtgcggtcctcctcctggacgatcttcaccgtgtctctcggctcctgtgacatcgccaccgagggtgccgcccacaggcccagcaccaccaccgctgataccagtcgcctcatgctcaacctcccaatgcacagcgcgatccaacctcaagtccttgaatccagaggagctcgcctgctcatccggggactgaagcctggagagaggaaaaaagttccgtccctcttcgtcaaaactccagcctgcctgctgaggtgatgcctcgggtgccaggtggccccgatggaaacgacgcacggcgctccccgagc

SEQ ID NO: 1023 - DNA, 14027 bp, Myxococcus xanthus
tctacggtttctcactctgcccaggcggacgcggtcaatcaggttgccgacgccggcgccgacgaggccgagcgcgacgtgcagccggtagtggtccgcgggcgtctggcggaccaggtggatgaccagcaggaagacggggatggccaccgcgctgaggatgagctgggcgtagggcagcgaccggaacatgccgaaggtgatgccggtgttctccacgtactggaagcggatgacgtcgccgaagacgctcatgccggtgtagcccaggggcttcacgtgctcgcggaccaggaccttcgtccattggtcgaggatgagcaacagcgtggccagcccgcccacgacaaggtactttcgacgctccggagtcatttgcggcgcagcctcctacaaatgaggtggccggacaaccaccgggagtgtcggcgagcggatgcacatcgtgctcgcagggccactggcagaccgagttaccgcgtggggaagggccaggcgacgagggccaccggtaccggtgtgggccgctccatgtacagggagtgcgcgaacgggccgacctcccttgtctcggagagtgcgttgaaccggcctgtcatttcgagttcggccccacttcgctccatcgaatggtcgatgaacagcgtcaggacgcctgtgtggacccagccgaactcgaaagtgaagagtcccaccacgcattccagccgtccccggcgaggagggtggcctccggcgatgagcgcctccgcgacgcgggcggcgggggctgagtccagatggctctcgctcaggctccaggatgcaagagggcgctcgaagcggatgggggtgcgcagacacagcaccgcgtgttgaaccgcaggcgggagggaggcgtcttcacccagcagcgccgcggcgcgcgcgaagcggcttgcgtcggagggctctgtggcgacgagatagttccaggccgcggagaaggggccgcctccgtattccaccagatagtcgtcgggagcttgaacccccacggcggccgtcccttcgggggcacggtagtagccgtatttctggagcgtttccaactgccagagccccgggcccacccggccaaggcgggcagcccagcggtcgctcggaaagtccctggcttcaggcattcgcggccgtgtccaggcccagtgcgtcgtcaccgcccaatcacccatggcgaagcatcccagcacgagggccagggggaaacgagtgcttctgttcgtccaacggccggaccaagatgggggcagtgtcttcccgtctcgccagtcgcccgcgttgttcccgctgcaacctggcgcttcacctgtgtctgtgtgacgagattccccaggtccacacgcggacgcgaatcctcctcctgcagcacgtgatggagatcgcgaagaagagcaacaccggcggcgtggccgcgctggcgctggtgaactcgaagcgcctcatccacggctccctcagcgggagcgcggagctggagctgctctccgagcctgggacgtggctgctctatcccgatgggccgccaccccggcccgatacgccgccaccccggcaactggtggtgctggacgcgagctggtcccaggcgcggcggatgacacagcgggtcgccgcgctacggacgctgcctcgcctggcgctgccgccaccggagccaggactcctccggctccgcgaaccctcgcacccctccgggatgtccaccctggatgccgtggctcgagcggtggcggcgctggaagggcccgaagtggccatgcccctggcgcggctcgccgcgctccgagtccagcggatcgccgagtgtgggacgttgtattgagccccaagtatccgtgcgcggctccgtgtcttcgtgaattgacacgcgcttgagccggtcttgatggactcggggtgtttgtgattgcgctgccaggaggcattcgccgcttctccgcggagccgacgctggctcgcggcggcgcccgacaccgcgatgtcagtggcgtgagttaaagagaatgtcgcggcagatgaacctcctccagggacctcatgaagaaacagaaaaactcgctcttgcggataaaatgaaatccgcgtaacatctctgtgacgtcagcgtaggctggctcttctatttcaagaagttacgagggggcgccccgggatgttcaggggcgttgccgggcggatgtgacggtatccgtgcccaaggcggcatgggcgtcctcctgggcgtggtgtgtctttcgattgggcggctcagattcttcaaccaaggctctgcggcccatcgtcggctgcggggctgttcttaattcttcgccatgtccgcacgcatcagagagcgtcaggagagctggggcaccatcatctacgacaacctccgcgatgagttctctgcgaaggtgttcgagggctgcgtgcctgtgccgcggagtcccatcggttgtggatggctcgtcaccgcgccgtgcaacctcgtgtgtatccactgctacgggaacgtcgaggacctgccgtcgaagcggctctccacgccccagcagctcaaggtggccgacgaagtcatccgcgcgggaatcatgcgacagattctctccggcggtgagccgttgatgcgccgagacacgctgaacgtcatcgacaagctcacggaccatggtgtcgccaccatcctcggtaccaacggcaccttcctgacgcagcagatgatgaagacggtgtctcgctgcacgcgcgtggaaatcagcctcgattccatggacgagcgggtcaacaacgagattcgccccagccgcaacgccaagggtaacacctaccaggagacgctccgggccatgggcctgtgcgtggaccatggcgtggcgccgcgaatcctgacctgtctcaaccgccacaacagccagcatgtcgaggagctggcccagttcatctacgagcggggcatccgcgactgggccatctcctggacgctctccgccggccgcgcgtatcacatctacggcgagttgatgccggaggagacgtcgcacgtcaccgcggccgtggagcggctgcgggtgcgctacccggacatgcagattcgcctgtcggaccgcaccgtcaactacagccgctactacttcctcatctggccagacggcatcatgggcaccgaggagatcgtcaccggcaagaagctcttcttcgcctcgctggtgacgggctccgtccaggacggttggaagcaagagaactacgacctggacgcacacttccggaagtgggtgggggaccgcatcgaggtcattcccgcggaaggccggaagcccctggtcgcataggatgtccgtggcatggagctgattgacgtcatcgacacccagggacaggtggtggggagcgcgccccgcgaccagatctacggccagaagctgccccatcgcatcgtgcatgtgatggtggagcgcgacggcaaggtcttcctgcagcggcgctcccggcacatgaccttcatgcccggccacctgtgcacgtccgcgggaggccacgtgagcgcgggcgaggcgcccctggaggccgcccagcgggagctccaggaggaactgggcctggagggctcgctggtgcccgtggcggagttcgtcttcgacgatgggcaccaccggcgcatctttctctaccgcgcccgaatggaaggcccgctgcgcttctccgagcgggaggtggacgggggcctgttcctggcgccggaggagttggggcgcctgctggacgagccctgtcatccccagttgtggccctgtctggagcgcctcttccccgggccgagcgccgacgcgcggacgcgatggaaacagtcctctactcgctgacgtccgtcctgctgcggtcgggaaacagcgtcttcgaccggctcagctacgggctccgccgccagtccatcctcgtcctcaacttcgccaacaacttcgtcccgttcctcttgctggcggcgctgacgccgctgctgccgatgacggacagggcggggtgggcgctctatggcaacgcgaggctcgcgctgttcgcggtgagcgtccagggggtggccttcgccttctcctacggcttccggcacctcacggtcgcccgggtgaacatcgcctcgcgcatcggggatgtgctcatccccctggcgctcatgctgtccggccgaacggtgcactggaccgagtacctgttcgccctcgccgtgtccggctgctcgttgctggccgcgggaggtggctcggacagccgccgcgccctgtggctgccggcgttcttcatcaccgtggccgtcctcgtgcagagcctctgcggggagctcttcttccagggccagccttcgggcgtggcgtccaacctggaggtgagcaccgccttgatgttctggaggagcgcggcgtgtctggtgctgctgctcctcttcggcgcccgggggacgctgggggcgcagttgagcgagctggtcgtggacggccgcgcacgcaccaacctgctggtgcgcgccctcttcaccgtgggcaatcaggtcgccttcgtcatggcgctggcggcgggaaaccgcgtcgtcgcctggcccatcctcaactcggtgacgctcttctccctggtgttcgccaacgccttcatccaggaggcgcccgcgcgacgcgaggtgttcgccgtcgtggccatcgtcgcgttggccgtgctcaaggccgcgctgtagttcgtgtcggcgccaggtccggcagcacctggtccgcgaagcgcagcgagagggcggtgagcgtcagcgtcgggttgatggcgccgttgttcgggaagttgccgttggtgagggcgaacaggttcttcgtcccgaagacgaggtgcctcccgtccacgacgcccgagtccggcccttggccgaagcgcgccgtgcccaccgagtggtccgcccggcgaatcacgcccgaaacccagacctccgactcgcggcagcccgcggtcttcatcacctgcatcaaggtgtcggtcatccactgccagcgcgcggcgaaccccgcgtccaccgcgtagtgaatctccacctggcgctcgcccggcttgcccgtgaagcgcaggcggttctccgcctgggggaactcctcgatgaagccatggaggttgagccggctctcccgggcgaaggaggcgatgtactcgggcgccagttgctcctggcggacccatgactgcaggtccggctcctccgggtactcggagaagatcatcttcccggcggcctgctgctccggcgtgtcgaagtgccgagagaagagggcgggcatggggacttcgcgcccgttgaactcccgggggggctttgccagcttgccctcgagcttcagcatcgggtgggtaaccaggtagcgcccgagcgcgggcaggcgctgctcatcgaagcccgagtgccacagcagcttgggcgtctccagggcgcccgcggccaccagcacggcgtccgcgtccagcgtggccgtctcgccctcgggggtgcggtaggtgacgccctgggccaccgctcccgccatgcgcacggccagcaccgggctgctcgcgagcaaccggaagcccggatgggactccatgtccgccagcagcagggtggggtcgaagcgcgcgcccatcgggcaataccggcacgtgccaaacgtcatgcacgggccgcccacaccctcgccgccggggcctctgcgcgacatgggaatgtggtcataggtgatgcccagcgccttcaaggcgtggcgcaccggctccgactcgatgggatacggcgggctgttccacttgtagggctgcgagcgccagggcgtgggatgtccgtccacgggcgcgttggggccggtgacgttcagcagggactcagcctggctgtaatagggctcgagctgggtgtagctgaagggccagtcgttccccttgccggtgcgcttgcgcagctccaggtcctcgggctggaggcggggcgtccagccgctccagtgcagcgtcgacccgcccaccgccatgagccggctgcccttgatgaggaagtggtcgcgctcgggttggacaccggggcgggagttggcgtcaccctgcgagtcctcacaggcgtggtagggccgcacgcccgtggtgacgaagtccagccagcggcgcgagtcccgcatgggcgtgcgagggccggcttcgagcatcaccacctcgtagccccgctccagcgcggcgcgggcggtgatgaccgcggcaacaccacttccgacgatacacagcctcatggttgtcaaatcctgtcggcgaccgcgctgactacagttcgtccgaggcgtgataggagcccgattcgtgcggctcgtgccagagcccgcccatgtggccattcatgtttccgaagccaaacgtccggaagcccccgccgaccagcgacatgatggccagctcgcccaccaccttcacgcggtggagctctggcagctccaagagccattccgcggagagcttctcgggccgtttcacctccgccgcgaaacgggtgtaggtggccaggtatgagggacgctcctcgcatttgagacgcagatagccttccagcagcgcctcgttgagctggccgtccattcccacgaagcgtgagagccagcgggccgtatcgagcaggacctcccgcacgtcgtcgggaaggggccctgcgctgtcgggcgcgatgagctggaggggggccgagcccaccgtgggaggcgcaagccgcgggcgaagcgtgccgcaactggaggccaccacgccgattcccaaccactgcaggagctgtctgcgattcagcagcgcttccctcgatacagtcccggaggaaggagatgttttcacggcgttgttcatgacggctcagccctcatgctgccccagtcttcccagcggaagcaagggttgcggacattgcctcgattgctgctccatggcaaagagcggaggcgatatgtggatcgtccggctggcgctccgacgcccctataccttcgtggtggcggcgctgctgctcgtcttcgtgagtgtgcaggtcatccacgaatcccccacggacatcctccccgaggtcgacatccccgtcatcagcgtcgtctggagctatgacgggctgcccgcgcagcagatcgagcggcagattacccaatacagtgaatactccctggccaacaacgtggcgaacctggcccggcaggaaagccagtcattcgacggtgtatcggtcgcccggttgtatctacaccccggggctgacgtggccgaggccatggcccaggtgacggcgtcctcgcaatccatcacccggcgcatgcctccggggacgcagccgcccatcatcctccggtattcggccagcagtgtgcccatcctccaggtgtcgttcagcagtgagacgctcaccgagtcgcaaatctacgaccatgtgaatcaacgcgtccggcctctgctcggcacggtccggggcgcgcgcattccccagctcatgggcggcaaggtccgtcagatgaccgtggatctggacctggaagccctcgaggcccatgggctggcgccgcacgacgtcgcctcggcggtctccgcgcagaacctggtcctgcccacggggaacatcaagatgggcgcgcacgagtaccgcgtgacgctcaacagcagtccggagacgctcgccgcgctcaatgacatcccggtgcgccggagcgatggccgcgtcgtgtttctccgagacgtggcgcacgtgcatgacggcttcgcggtgcagacgaacatcgcccgggaggagggccggcgctccgtcatcctgtccgtgatgaagacgggggacgcctcgacgctggaggtcgcccgccgcgtgcgcgaactgctgcccaccatccaggccgccgcgccggagggattgtcggtgcggttgctggcggaccagtcctccttcgtgacgaccgccatccacgggctcctggttgaaggcgtcatcgccgcgctgctgacggcgacgatgatcctcctgttcctggggagctggcggagcacgctcatcatcgccatctccattcccttgtcggtgctcgcggccatcctggtgttgcggggcctcgggtacacgctcgactcgatgacgctgggcgggctggcgctcgcggtgggcatcctcgtggatgacgccacggtggagatagagaacatccaccgcaacctggccatggggaagccgctcacccaggccatcctggatggtgcggagcagatcgccgtgcccgccttcgtcgcctcgctctccattggcatcgtcttcgtctcggtgctcttcctggaggggccggcccgatacttgttcctgcccatgggcctggcggtggggctctccgtcatggcctcgtatctgctctcgcgcacgctggtgcccacgctcgtacagttcctgctgcgcgcggaggttcagcggcacgggcagccccagacgggctggctggcgcgactgcaccaccgattcgaggagggcttcgaccgcttccgtgcgcggtacgtgagggcgctccagggggccctggcccggccgcgccgcgtgctggttttcttcctgctcgcggtgctggcggcggtggggttgatgcccttcgtgggccgcgacttctttcccaccgtggacgcgggccagctccgccttcacgtcgtggcgccgccggggacgcgcatcgaggagacggagcggtacctgtcgctcgtggaggacgccgtgcgcgagctcatccccgccgaggaccgggtgagcctgattgacatgatgggcatgccgggcggctacaacctcgcgctgacggacacctccaacgtgagcagcgcggacggggaggtcctcgtgacgctggctccgaagcgccgggtccggacggacgcgtacgtccggctgctgcgcgaggagttgccgcggcgcttccccgagctcacgttctacttccagcccgcggacatcgtgacgcagattctcaacttcgggctgccgtcgcccattgacgtgcaggtctccggctcccaacgcgaggccacctatgccatcgcgcggaagctcgaggtggagctgggacaggtccgcggcgcggtggacgtgcgcctgtcgcaggtggtgaacgcgcctcggctgcacttcgaggtggaccgggtccgctccagcgcggtggggctcacgcagcgggacgtggccaacaacgtgctgctcaccgtgtcatccagctcgcaggtgagccccagcttctggatcgacccgaagacggggaacagctatccggtgtcggtgcgcgtgccggagacgcgggtgtcctcggtggaggacctgacgcggatggcgctgcccacccgggaagggccccagctcctgggtgacctcacccgggtgcagcgcgagtggacgcccgtcttcgtcacccatgtggacatccagcccaccttcaacgtccgcgcggacgtccaggacacggacctgggcagcgtggcgtcgcggctggagcggatcgtcgaccgctaccgagaggagctgccgccgggctcgcgcatccaggtgcgtgggcaggtggagagcatgcgcaccagcttcgaccggctgctgttgggcctgctgttcgcggcggtgctcgtctatgcgctgatggtggtcaacttccagtcctggctggaccccttcatcatcatcaccgcgctgccgggggcggtggtgggcatggtggtttcgctgttcgccacgcagacgcccttcagcattccctcgttgatgggcgccatcatgagcgtgggcgtggccacggcgaactccgtgctggtggtgtccttcgccaacgagcagctcgcgctcggcgcgagcgcggcggaggctgcgctcgaagcggggcgggtgcgggtgcgccccgtgttgatgacggcgctggccatgggcctgggcatgctccccatgtccctgaacctgggcgagggcggcgagcagaacgccgcgctcggctgcgcggtcattggcggcctcgtgggcgccacggtggcgaccctgttcttcgttcccgtcgtttacagtctgatgcaggcgcggcgggctgtccgcgcggcggcccctgaactcgagccctcggtgacagcgtgacggagcagacccctggcgtggatgccgcggcgcccgacgccgcggcgcgaggcgggcgctggccctgggtgttcgccgccttgctcctggtgctgctggggctcggcgtggcgccacggttggagcggtcgcgcgcgttggatcggcgtgaagcggaagcccgtctgccgccgctcgtggccaccgcgcgcgtgacgcggtccgagccgaaggcggagctcacgttgccagggacggtccttcccagtcagcgcgcgtcactgcacgcccgcatcaatggcttcgtgggacgcatccacgtcgacctgggcgaccgggtccgcgcgggccagttgctggcggagcttgaagcgcccgagctccaggcggagtgtcaccgggcccgggcgcgcctggatgagacggagcggaacctggagctcgctcgcgcgtccgcgcggcgcgggcagattctcgcgggagagggcaacgtcagccacgaggtggcggaggaggcgcgggcgcgggccaactccgcggaggcttcgctgaagagcgcgaaggcggaggtggagcgcctcgaagcgttgtacgcatttcgccgcgtggtggcgccgtttgatggtgtcatcgtgcgtcgcaacgtggaccggggagcgctggtcaccgcgggcagtggcagcggaatgacgagcctgttcgaactcgcgcagacgcacacgctgaaggtctacgtggacgtgccgcagtccctcgcccatgacatccggccggggctcgaggcgcggatcttcacgctggatgcgcccgcgcgggcgctgccggggcgcgtggtgcggaccgcgggggtgttggacccagggacccgcacgctcctgacggaggtgcagctcgccaacacagaggcgctgttcgccgggtcattcgtgcgcgtccggttgctcatcgagcgcgaggctccgcccatgctcattccggccagcgcgctggccgtgcggagggaggggcccacggtcctcgtggtgggggaggcgaatgccgtccagcagcgcgtggtcgtgctggggcgtgacctgggcgcgcatgtcgaggtgatggacggattgtccgcggaggacagggtggtgctgagcccaccggacaccctgggcgatgggcgcgtggtgcgcgtcgcggaagggcgtgccgcgcgctagttcgcgtggagctcagcaaaatcggatagggctgcgatgtcggtcagccttgatatgctgtgcggactggagacttcgatgaagcgttttctgtggctgtctgttttcgcggtggcgtcggtgtccaacgtggcctccgcgagtgaggagctctcgaaggccaagaactgctcgacgtgtcattcagcgacggcgcggctggtcggtccctcgttcaaggagattgccgcccgctatgcgaagcaggagggcgtggaggacaagctggcgcagcgcgtgcgcaagggcagcagcggtgtctggggcgccattccgatgccggcgaacgcccaggtgtcggaggccgaggcgcgcgcgctggtgaagtggatcatgacgcagaagtagcccgcggaggtgcccatttcctgcgcacgtcgttgcaggtaatgggccggcatgccgaagaagaatgtgtcgctggcggcgcagtggaagcgcgtggaactgagcacggaggtgccgccgcccgtggcttttctccccgtgggtcgtccggtatagaccggggcatggcgttcatcgcgttctccaccatcaagggcggcgtcggcaagacgacgctctgctcgcatgtggcggcggccctcgcggatgccggccgccaggtgctgctgctggacctggacccccaggcccatgcgtcgctggtgctggggctggagagccgggaaggcccgtgcgtgggggatgcgctcgggccccgtcccaagcacacgctggcgcaggtggtcgtggcttcaccgaagcggcccggcttgttcatcgcccccgccgcgccgcgcatggccgcgcaggagcgcgagctgtttcagtggggccaccgcctccaggcgattcctcgcgcgctcaagacgctggggtggacgccggacatcatcctcgcggacaccccgcccagcatcggcgcctacaccgaggccgtgctcgcctccgcggacctggtcgtggcccccgtgcccaccggcgccttcgcgctccaggggctgggggaaatcgagaccgcctggcgtgacgttcgcgagcagggcggtgagctggtggcggtggtgaatctgtgggatcgccgcaccaccgcgaccaacgaggccatggagggcgcgctgagcgagtccaccgtgcccgtcctgcgggctcggattccgcgatcggagtccatcaaccaggcggggctgggctacgaggtggtgttcgacacgagcccgcaggcggccggcgtggaggagctgcgggccctggcgcaggagttggcgaagcgcgtggggctgcgctgaaacggcgaacggcaccgtccgccacgagggcgcacggtgccgtcccggggaagccgaatcagaggttgtagtggcccgaggcctcgggctggtagggcaccgcgacgatgcgcagccgcttggagcgtccgcccggcaggggccaggtgatggtctgccccacggtcagtccgatgagcgcgctgccgatgggggccaggacggagatgcggccatcgtcgctgctggcgtcgcgcgggtagacaagggtgacctcccggcgctctcccgattgttcgtcctcgaagacgaccttgctgtttatcgtcacgacgtcgggcggcacctcttccgaagcgacgacgcgggcccgggtcagctccgcgtcaagcatttccgcgaactcggccgtgcggccgcctccgttgtggtccaccacctggcgcaggcgctccaagtcggcttcggtcacgatgagggtctgttcgcttcgcatgtcaggggcctcctgtgggagggagtaatgggttaagcccattctaactgcctcgcctgctatttattcccgagtcgcccccaaaaggcgacccggtcgtttcattccgctcagaaggcgcagtccgtgccccgggtgggcagcgcggaacgccccccagaaagatacgcatcgcaggccttggcggcttcgcggccgtccgacagggcccagacgatgaggctggcgccccggctcgcgtccccggcgcagaataccccgtccgcggacgtggcgaagcgcgcgtccacctgcaccgtgccgcggggtgacagcttcacccccaactcctcggagaggttgcccgcctcgggccccgtgaagcccatggccagcaccagcaggtccgtttcgaacgtcacctcggtgccgggacgttcaatgaggcggggcagggcgccaggaccgggctggaactcgatttccacggcgtgcagcgtctggagccgtccgtcgctgcccgtcagccgcttcgtcatcagcgcgaagcggcgctcgccgccttcctcctggctggtggaggtgcggaagatgacgggccacctcggccaggggttgccctccgcgcgcaccgggggcggcgcggggaggagctccacctgccgcacgctcgccgccccctgacgcagcgcggtacccaggcagtccgagccggtgtcgccgccgcccagcaccacgacgtgccggccggccgcgtccaggcgtgggtccttctggccatggcccgagacgagccggttctggtgctccaggtactccatggcctggacgacaccggacagttcgcgtccggggacttccagctcgcgcggacggcgcgcgcccatggccagcaccagggcgtcatgcttcgcgcgcagctcgcggtagctcagggcgccgcc

SEQ ID NO: 1024 - DNA, 10263 bp, Myxococcus xanthus
  unsure (1)..(10263): unsure at all n locations
gtgctctaaagttgatgacggtgtgaaacacaccgtcacccgctcgttccatcgacagggattgaacaagcgtcgaacaaccgtggcatgtgtcagggggtgagcatggtggccatcatccgctgctccgaaggggccagcgacacgcgcacgggctgacactgggcaggcttgggcctgccagcgtccgttccctgagtctccgaggtcggcgcggcgctcacacagacctggtcgctgcccggcacgacactcgcgaagcgcgcgggctcgctcagggtcaacgtctgcacctgtgaggggcaacaccgggtcaacctcaactcacggtgcacttgagcagcttctgcaacatgggatgtaacaactcacccccgcgcaacgactcacgccaacgcgcggggatgccattcacgccgtggatgagcccggcgatacctcccgccaccgccgcggtggtgtcggtatcccggcccaggcgcacggcggccttcaccccctgctcgtaggtgtcgtgctcgaccacgcactggcgcgcggagcggaggcaatccaccacgtagcccgtgcccgtgcctcgaatctcctcccagcccggcggcaggacatgcgtgtccagttcagtgcgagcctcgaagccttcgggatacagattgcggaacgtctccaccgcgtccgtccatgcctccgaagcacgcgcgccttggaggatgcggcgggcccacaagcaatacagcgcacagcacacctgggagcgcatgtgtccatgcgtgacgcgagactgagtcatcgcgtccgaggcgagcttcgcgtcattgcctgaatgccagagcgccaatggcagcacgcgcatcaacgagccattgccgttgtctcgttcgtccttggggccggccatcagcgcgggcgtccctgcgtggaccaaggccagggccgtgcgtgtctggatgcccacgtcgaacacctggccatccaccgcgaggtagccccactccagccagttcaccaggcggcggcccaggtcttccgggtccaatcgcccatggtagagcaacgaatccagcaggcacagcgcatgcgcgccatcgtcggaccaggtccccggcggcaccccgtcatgcgcgcgctggaagccctcgggcggctggaagtcgatgtcctcgggcggtggaatccgcgcgggtgcgtggaactcgtagggcacgcccaaggcatcccccaccagcaatccgtagattcccccggcgatctgctcctcgcgactcggcatggtgttgcccccccacggtgaggcgaaacacgctacgacaacgtccgagcgcgcgtacagcggacgcacgccgctgaacgctggggggcatggatgtcgcaacaagtttgcgccttcaggccccgccatgcaggctttcacgcgaaccgggccatgccgagcccccacgcccaggagcccccatgtcggccgtatcgcccctagcccaacccgaggcctggaacctggtggcgccggagtacgtgcgcgagctgatgcccaccttcgagacgttctccagggaggccctgctccgggccggcgtagcgcaagggacgcgtgtcgtggacgtcgccacggggccgggcacgctcgcgctgctcgccgcgcgcgacggcgcccgcgtcacagcagtcgatttctccccggagatgattgccgccctgcgcggccggaccgcggaggcgaagctcgacgtcgacatcctggagggtgacggcatggcgctgcccttcgaggcgaacgcgttcgacgccgccttctccatgttcggcctgatgttcttcccggaccgggcacgtggcttccaggagcttcaccgggtactgaagccgggcggccgggccgtcgtgtccagttggacgccctttgaacgctcgaaagagctgcgcgccgtgtacacgcgcctctgggagcagatgggcgcgaagccatcacagccgggcgccatccccctgtccgaccccgacacctgtcagcgggagatgtccagcgcgggcttcacccacgtcacggtgaacgaagtggaaggctccatcgactacccgtccacagcggccatggtggatgccaccacccgctccagcgcgcccgtcgtgctggcacgcagggcgctgggcccgcagtgggagccgctgctctggtccatgcacgagtacgcgcaggcggagctgggaccggggccccagcgcgtcaccctcacggcctacctgacgacaggcaccaggccgtagcggacggccgcgtcgagcgtgttgcgcatcagcatggcgatggtcatgggccccacgccaccgggcacgggggtgatgaatgacgcgcgctcggcggcagcggcgaattccacgtcgcccacgagcttgccgtccggcttgcgattcatccccacgtcaatcaccaccgcgccgggctttatccacgcgcccttcaccagctcggccgcccccaccgccaccaccaggatgtccgcgccctccacttcccggcgcaggtcgctcttgctgtggcagatggtcaccgtggcgttcttctggagcagcatcagcgccatgggcttgcccacgatgttgctgcgccccaccaccaccgcccgcttgcccgcggggtcgcagccaatctcctccagcagccgcatcaccccgtagggcgtacacgcccgggtggtggaccggcccagcagcaggttgccggcgttgagcgggtggaagccgtccacgtccttctccggcttcacggcggagatgatgacgtccgggtcgatgtgcctgggcaacggcaactgaaccaggatgccgtgcaccgccgggtccgcgttgagctggtggatgacctccagcagcgccgcctgggtgatgccctcgtccgggtggagctcccaggagcggaagcccacctcctccgcggccttcttcttcccattgacgtagaccttggaggcggggtcctcccccacgcgcaccacggccagccccggcgtcaggccatgctcgagcttgagccggtcgacctccgccttgacctccgctcgcacgcgcgccgcaactgccttgccatcaatcaactgggcgttcacccgtgccactctatgcgaaactcccccgccggaaagggagcggaacgtcggccatgggcgcaggaacagttctgggagcaatgctggggttgatggcggggctgctcgtgggcagcccctgggccattgtcctgctgctcatcgcgggcggcttcgcggggcgctactacgacgcccagcacgccctaccgcccgaagacccggaggcgctgtccggcttctcccacgccccctacgcttccgcccatgacgccacgtcggaggcggcgctcgtgcctcgcgaggaggagccctacgagcagttcgccagtgacttgtgcgccgtgttcgtcgaggtggcccacgcggatggcgaggtccgccgcgacgaggtacgcgtggtgcggcgctacttccagacgaccctgggctacggccccgaggccctggaggtcgtccggagccacctcaaggtcttcctggcccacccgcccgacctggacgcggccgtcagcgcctgccatgcccagctcccctcggccgagcggcaccggctgctggacacgctctacgagctggcgctggccgacggaggaatgcagcgctccgaacgggaggtcctgcgccgcgtcgccgagggcctgggcatctccgaagcggacgagcaggccatcatcgccctgcacctgggcgccggggatgaacactacgccgcgctgggcctgatgccggacgccaccgacgtcgaggtgaagcgagccttccggcagctcgccgcggagcaccaccccgacaaatccgcccacctcggccgtcaggccgccgagcaggccgcccgtcgcttccagcagattcgcgacgcctacgaagagattcggcgcctgcgcgggctgtagcgccggattacatccctcacagtcgcccacgacgaggacgcactttccgccatgagtcagcagcgcaacggccccaagaagaaggaagcggctttcagcaacaaccccttcaagtccgccatccaggtgatgaaggaccaggagaagaaggaggcgcaggagaaggccgcggcggaggtcgcgaagcgcaaggccgcggcgcccccgccccgggccacgaaggcgcccaaggtccgcgaggaggacgatgcctcccttttcttctccgccatggacggtgtgcagcagctcacccaccggggcgaagcgcccgcgcccaacccgcgcctgcctgcaatcatcgatgaaaacgcggaggcgctcgcgcagctctccgagctggtcgccggccagggcgacttcgacttcaccggcacggatgagtgcatcgaaggagcgagccccggcatcgaccggaacctgatgcgcgcgctgcgccggggcgacttcgccatccagggacagctggacctgcacgggaagacacagagcgaggcgcgcgacgcgctggaacgcttcctgggtgacagccgccgcgcgaagaagcgctgcgtgctcgtcgtgcacggtcgcggtttgaactccaaggaccagattcccgtgctgaaggagcggctcaagggatggctgtccgagaagcggattggccggatggtgctggcgttcgctaccgcacggcctcaggacggaggcaccggcgcggtgtacgtgctgctccggcggtagtctttacgcgagcccgacactgtgcatacatgccgccatggcacgcgatctgatcgacctgcatatccacgtgggtggcgctgtggcgccccacatcctctggtccatcgcccaccagcagggcttcaagctcccggtgaagaactacttcgacttcgtggagctcatcacctcccgtccgggcaaggtgggaagcctggacgactacctgaaaatcctccacacctggacggagaagatccagtcgtcccccagcgcgattgagcgctccgtctacgaggtcatcggcaaggagtaccgcggcagccgcgtgacgcagatggagctgcgcttcaacccgatgaagcgcaacctgaactccgagctggacctggaccacatcatccacgccgcgctgcgcggcatggaccgcgcggtgctggagtacggcgtgaagatgggcctcatcttctgcctggcccgcgagttcgaccaccggctcaacagcatcatcgtggacaaggccatcaagtaccgcacgcgcggcgtgtacggcatcgacctggccggcacggagacgaacgccatggagctgaagccggaggtcgtcacccagtacgaagagctcttctcgcgggcgcgccgcgccgggctcaagtgcacggtgcacaccggcgagacgcgcggcaccggcgccgagggtgtcatggccgtggtggagaagctccagccgcaccgcatcggccacggcatccgcgccgcctacgacgagcacgcgatgaaggtgcttcgcgagcgcgacctcgtcctggagctgtgccccacgtccaacctgcacaccaaggccgtggagggcgtggaggagctgcgccacatcgtccgcaccttctgggaccgcaaggtgaagttcaccatcaacaccgacggcccctacctgctggagacggacatgcggcgggagatcgacatcatcgaacagaacggcatcctcacgcccgagcaggtggatcagacgctcgcctgggcccgtgaggcctcgttcatccccgcttgagccacgccatgtacggactcacccgctcgctcctcttccagctctccgcggagcgcgcgcaccggctcggcatggcggggcttcactacctgggccgctcacgggacttgtgcgagtccctgcgcgagaaggccctggagggcgccccgcccggcctggccgtcgaagtggccgggctgcgctttgcccaccccgtggcgcttgccccccgcctggacaaggacgcggaggcggtggacggcctcttcgcctgcggcttctccgcagtggagattggcaccctcacgcccaggccccagcccggcaaccccagccctcgcctgttccgcctgccggagcaccgcgcgctcatcaaccgcatgggcttcaacaaccacggcgccacccaggccgccgcgcggctgcggatgcagacgtggcgtccgggcccgctgggggtgaacatcggcaagaacaaggacacgccgctggagcaggcggtggatgactacgtggcctgcgtggacgcgctggcgcccctgggcgactacgtggtggtcaacgcctcgtcccccaacacgccgggcctgcgcaagctccaggagcccgagcagttggggcagctcctgggcgcggtgcaggagcgcctggccaccgtggccccgggtaagccgctgttcctcaagattgccccggatctgtcccccgaggcagtggacgaggtggtggatgtcgcgcgggcccagaagctcgccggcctcatcgccaccaacaccaccgtggcccggcccttcgagcatcccctggcgaaggaagccggcggcctgtccggcgcgcccgtccgcgagcccgccaacgccgtcatccgccgcgcctggctgcgcagcgggggcgcgctgcccatcatcggcgtggggggtgtcttcaccgcccaggacgtctacgaaaagctgcgcgcgggcgcgtcggtggtgcaggtgtacacgggcttcatctacgagggcccgggcatggtgggaaacatcctccccaccctggccaccctgctcgcccgcgacggctacaagcaggtccgcgacgtcatcggcgccgagcaccggaagccgggcgcacccaactgacgcgccgcatcaatccgcggacaaaaaatgagcgctcgccggcgccttggagtttcaccggcgagcgccccgggcccagtgcttgacgggcctcgaaagctattgctgcacggtgagcgagccgccgaccgtgctgacatccaccgcatgggtgcctgagccatacgtctgctcgcggccgcccaacctcgcgggactgtcgttgaaacgaccaccgacagtattgaattccaatctcacatccgcctgggccggcagcttcagccggacatccccgcccaccgaggacacagaagtagccacgaccttccgcggtgccaatgccacggtgccgttcaccgtgctgacatccaaccgctcctccgaaccgctcacttccacacggccattgactgtcgccagcgactgccgccccgtcacgcccgccaccgtcaccggaccgcccaccgtcgccaaatccaaacgcgcccgccgtggcaccttcgccgtgaacctcaccgcgggcccgctccgacggcaggaccgcgtttcttgttcacacggaccgcaacaaacccgcgcccggatgactcccttttcttggacgacttccacgcccacttcgttccgggaactctccgcgccttcccaaacaaccgagattaccacgtcattcccgtctaccgcatctacgcgcaccgcgccatcaacattgccgatgtgaacttcaggcataccgtccgtattgaacgtccacgtctgggtggacggcgcggcggcgaggatgagcagcaagggcaggaccatgtgcgggctccggaaggggtgggatgcccccttccctacgccccggccccgcccccattgcgcctggtggagacgcagtatccacaccgctctgacatgcctcaggcgtccgcgccccgggcaatccgctgatacagcgcgtcatggcgccggaccatcttctccagggagagctcgcgcgccacgaagtcccgcgccgcatgccccatgcttctcgccttctcgggattcgcgagaagctgacggaaggcctgggccaactgagcgggacgctcggggtccaccacgaggccgcgttcgccatcgcggaccaggtcggtgttgccacccactcgggtcaccaccatgggaagccccgcggccatgccctccatcaccgcgttggacatgccctccgcggtggagcagaggacgccgaaggtcgcccgggcgtagatggcgggcacgtccgtgcggtgccgtaggaagtgcacggtatcggacacgcccagctcaccggccagcttctccaggcccggccggcgcggaccatctcccaccaggaaggcgtgcagcgtgatgccggaatggcgcaattgggccagcgcgagcagcaggtcctcctgccgcttcaccgggtgattcatgttggccacgtggaccaccaccggcgcggcccccgtgtcggggagcggcccgcgcagcccttcgcgcctgcgggactcgaagcgcggcaagtccaggccgttgtggatgacggacacgcgcgaggccggcaggccctcctcggtgatgagctggtggcggatggcctccgcgttgccaatcacatggtccgccatgcggcacagccgcgactgcaccgcgcgccgcgcacgcccctgccagtgcgccaggtccaaccggcccacgatgaccttcgtgcccgcgagcttcgccgccggcacggccaccatcgtggagtagaagtcatgcacgtgcaccagctccacgcggttcgccttgagccagcgtgccatgcggtacacctgatacgccgtgttcggctgcaccacggagcccttgagcgggaaggccgcgggtgcgtggcccagcttccacaccgcggcaatcagcggccccgaatcatccagcacggacacctgcaaccggtagctggcgggcagtccccgcagcagctccagcacctgcacttcggtccctccaatgtggaaagaccgggtgaactgaaccagacggaggggctcctgccccatccgcgcctcctcacgccgcatgtccggacccctcccacgtcgccaccaccggctcgctcggagccggaccccattgcctgtccaacgcctcggacgcgcgcgccacccggtgcgccgccgccgccaggccgaagagcacgtacaagtgcgcggacaggatgtagccagagaacaagtcacacacgaggtagcccacgactgacgcggacaaggctcgcgccagccaccccacttccttgtcccgcgacgcctcgaaggcgccgcccgcggcaccacccgtgaacaccatgaagaacaacaggcccacccagcccagctcgccgatgacgtccaggaagatgttgtgggccacgtacgcccggcgcgcctcggggggcgcgtacatgggccacgcgtagcggaagccacccgcccccacgcccagcagcggcttgtccaggctgatgcggctggccacctgccacgcgtagacgcggcccatggcggacgcgtcctcgtggaactcggccaccgtctcgttgcgctgccagaagctctgcggcgcgaagacgagcaggcccatcacgaagagcgagcccacgacaatggcctggatgcggcgcttctcgcggatggcccacaccgccatggccgcggagagaccgatgaagccgccgcgcgagtgcgagacgacaatggccgccaccgccaggatggccgccgtcaaacacgccagacgccacagccagccgctgctcttgcgggccacgaaggccaccgccagcggcaccaccagcgccaggttcatggccatgtggttcgggtccgcgtagacgcccacccagcgcgcgcggaagccttccaccaggtcctcacccaccaggtaccagttgatggcgccaatggacgtcaccaccgacgccagcaccatggccccgcacaccaccgccagccggcggccggtggtgatgacgttaatgaaggtgatgtagatggccgtcagcttcagcagctcgacgcccgtggcggtcgtcacctccggaatcacggaccacccgacggacgccaccgccaacgtggagaaggcgatcagcgccagaccgcgcgagccgtccaggtacagcggctccgcccgccccagccggcgtatcaccatgagtcccgccgccagccccgacgtcaccaacgcgaggcgcagcggtgcgagcgccgggatccactcgcccggcaccgagtacatgaccgccgcgaaagcggtcagcgcatagaaggcccacacgtcacggcgctgcccctgctctcccagcaccattcactccacctcccggcagttgcgtcgcgcaccaatacgcgtgcctgggcgaaagcagaggacatnctgagagcacg

SEQ ID NO: 1025 - DNA, 10871 bp, Myxococcus xanthus
ggtcctgcgtcaccagcaccaccgtcttgcgcagcctggcgaagatgccgcgcaggtcaccttgcagctcgtgacggaccagcggatccaacgcgcccaggggctcgtccagcagcaacacgtccgggtccaacatcaacgcgcgcatcagcgccacccgctgacgctgaccaccggagagctgcgagggataacgcgccagcgcgtccgtgggaaagcgcgtcaactccaccaatgcctccagccgctcgcgcgtcttcgccgcgggccagcgcaggtggctcgccatgagggtgacgttctcctcgcccgtgagatgcggaaagaggccgccaccctggagcgcgtaccccacgcgatggcgcaccgcgagcaacgcatcgcctcccgtgggcagcggcttgccatcgaagaggacgcgcccggtgtcacacggcagcaacccattgagcaggcgcagcagtgttgacttgccacagccgctcggccccagcagcaccgtggtgcgtcctgtcggcaggctcaagctgagcggatgcaaggcctgcgtggccccgtagcatttggagacgtcctgaagctcgtacacgagatgtcgtccttcgcagcatcaaggcagggtgaacgcgccgttgcagacggcgggatacggaggctcggaggcccggtggctgcacgcggcgaagagcgctcggccctcccacgtcacggccgcggcccacacgagcagcggcccctcggaagaaggcaccgtgaagcgcgcgcatcgcgtgtccaggttctccagtcggcagggcacttcctcgacgggccccgctcccggcagcgcgtccaccaactccgccacgctctgcgagcgccagcgctccgttacctgggattgggccggttcgtagaggctccacaacagcgatgccccctcgcagcgaatgcgtcccgcgcgcgccgtggacgcagcgagcagacatccatccggtactgccagggcccgccatggcaggcgcggcggaacgagcagcgcctcgcgtcccagcgtctcgccctcggggctgccattcgaggcgagggactcgagcaactccaagcagcgcgccagcaggggccgcacgggagcctggaccacgcacccgagctgccgcacccgccccagtgtcccggtgatagcggatgcatacccggcggcgcgacagtcctccgcctcgcacgcctcgacccggaccgagggccacggacttcccgccagcggcagcgcttcctccaccaccgtggcaccgggccccaaccgttcggtgattcgggcctgggcatccttcagtgcctgctcgggcgtcaggtcctcccgctcggtcaaccacaccgtcacgccatcgcagcggtacagccgcgagtcggcccggtccggcaccggcgtgcacccctcgaacaaggcgcgggcttcgggaaggaaggggcccacgggcgtcgcgccctcgggggccacgggcgacacacgaggcgcgggcgcggcgcacgagcacagggccccggccaggtacacccatagcagcctcgcggcggtcctcatgccgccggagttaggcgccccctcttcgtcacgtcaacccggcaggccgggcgaatggatggcgcgttcactcgaatgactctttcagcccctgagcccgctgcagatgacggtccgcgaggttgcccgtcctgtcgagcatgagggtgaacgccccatcgttcttgtacgtcgcctgcgcctgcttcacgagccgcagggcttcctcctggtcctcgatgacgcgcttcaggaaggcctcgtcgaagtcagggccctgcgccttgcggagcacgtccaggtgctgctgggcatgcgccacggcctgctccaggcgggcgtccgcgcgctgcatgggcagactcggccccgggatgaggcccccgtccttgctccccgagccgccaatccccgcggtggtccggggctgcgtgaggtccgccaccacgatgtccatggacggcgagcttccccacgccttcaagtcctgcaagtgccggcggtggtcctctaccagccgcaacgcgaactgccgcacctgcgggttggccgacttctccaacgccaggttgcccgccgcgatggtcttcgcgtcgaagagggcgagctgtcccaggagcaggtcccgcgctgacaagacgtcccgtgtctgccccgcctggggcgcctccgcccgggcggtgagccccaccagggggcccgtgccccacagggccgcaaggaccgccacgccgcctgctctgccaagccttccagtcatgtccacctcccgacgaagcgatgtccgaaggtgggtgccgcgtggcgcccacggcaaacacggcctgcccggcggggcctccccatggggccccgtgaacacgagactcagccctggcgcttggccgctgccacgacgttggcgccagcaggcccgggcagcggcaccacgccgaacgtcacggcggagtgcctgccaggcgggcggacacgcgctgctacactgggcgccatggcgaggattctcatggcggcccaccccacggcgggtcacaccaacgcgctgcgcgccattggagggcgcttgcgtgaactcggccacgacctggccatcgcaacggtcgtagcgccggcacgctttcccggcctgatgccagagccgctgcgcttcgcctcccagctgccggaagccctgcgccaggacggactcaggctggtgccgctgcgccctgctccggccgcgctctggtacggcgcgcgcatcacccgggcccggggactcgacgagctggggtgggcgctccggctgttcaccaccggcatggaggggcatgcacggcgcatcgccgaggaaatcgaagcctctgggactgacgtcgtgctggcggactacctcatgcccgcggccctgctcgcggcccggaggacccggcgcccctatgtggcgctgtatcattccgccctccccttccccgtggagggcgcggcgccttttgggagtgggctcgaggacgacgccccccgcgatgccacatggacccaggccgaacagcgggggctcgcgctgctgcgctggttcgatgcgcgtgtcgcccgtgccgcgaagcgcctgcgcgtccccttgaagacgaacggactgctcgcggcgcccatctccgacgacctcaacctgatggcgacgaccccggcgctggagcccggcctcgagccgctgcccggcccggtggagatgaccggcccgtgcctgccccggcccgtgccctcgagcatggatgaccccgcgctcaccgccatccggcccggccgcacgcacgtctacgtgtcactgggcacggtgttcaacgaccagccgcacgtcttccacgccatcctggacgggctggcgcggcacgacgtggacgtggtggtcagcgcgggtgccagcttcgaacggctccaggcccgcgcgggcccgcgcacgcaggtgttccgccgcgttccccaggtgcccctgcttcagaaggtggacctggtggtgacgcacggtgggaacaacaccgtgcaggaatcgctcgcggccgggcggcccatggtcgtcgtgcccttcggcggcgaccagctcgcgaacgcgcggcgcgtggagcggctgggcgtgggccgcgccgtgccgccctccgcgctgagcgccgacgccatcgcccacgcgttcacccaggtgtcccagccagaagtggccaccaaggcccgcgccctggccgcgacgctggagggtgtggacggcaccgaacgcgcggcccaggccgtgctgcggctcctcacgacatgacacggggcggagcgtccccctccgcgcgctccgccccgcatccgtccccgctcgcctcagggcgtgcaggcgccgtgcgtcacgctggtgcacgggtcgctggcgccacaccgcgtccagcgcgcgcagcgaagcgcgttgtagtcctcgaacgcctgaacgctcgtggtgcgccggccctggctctgcgactccaggcacagctcgtagtcagtgatgggcgtgttggagatttcatagacagtctcatccgccgccagcatcccgctggcgctggcacactgcagcgcgttcgcgggcgagctcgcgcggacctccaccacgcgccgggcgcacaggttcgtgtcctggatgcccaccgtatacaccgtgccattcgggtcgcaggtgtgcgccgccacggactggcagctcccgctgacacacacggcgttcgcgcggcagaactggctgttccccgacgagacacagcacgcctcgcccacttcgccgcagttgcggcagcgctcgcccgcggactccatgacacacgtcaacgtgccactgcaggacgtggtgcccgcgttgacgcagcaagcgccgccttcgttgccacacggctcacacgtgccgctgcggcagaccagcccggcgttgcagctagcggagtccgtcctgcaggcacagccgttggttccatactggctgggggaacacgacgatgagctgctctggcaaccgccgcagcccgccaggagggccatgaacaccatcatcagcccccgaagaaggggaaggttcgatttcacgaggaaggtccttgtttgaggaagagtggaagtcgtgctggccggaatgcggctcacgggctcagcaccaggtggacgcgctgcccctgtccatccagggcctgcaccagcacgctgaagtcgtcggcgagcgcgagcgccctcaggacgcggtagccggccttcttcaactcctccggcagcacctcatccaaccgcgtggccgtcttcccgtcgggtgaggcgaggaagggcacctgcgtcttgccgtcctcggcggtggcggtccccagcacccagcctccatcgttgatggccacggccttcgcggacacggcgcccttgggcatcggcagccaccgggcctcctcctgccgcgaccagacgaaaggacgggggcgcttgtccgaatcaagcgcggtgcccacgaacacccccacgtcgttcagcgcggtgacctcggactcgttgtccagcagcacctgcacgtccttgccgtagacgcgcgcggcgcggagccccttctccgtctccagcgtcaccgccacctcccccagcgcgttgaagaggacgcggctcgggagcagctcggacaggccagggtgcctcgcgggccccacctcgtctacgaggtagatgcccttgccgtcgttcgggtcacgcaccagcagcgtaccgtgtgcgttggccgtcacggcctcccagccttcaagccactgctccgcgcccgccttcacgtcctccgaacggagcaggaacgcgttggggcccttggcggtatatgccgtgccgaagatgtcccccgtcgagttgacgcccgtcacgcgcacctgctccgcgccgagcacctcgttcagccagtacgcctcgcccttgcccgtcagcaggacgtccgactccgcctccttgtaccgggcaatcaccgccccaccgttgagcaggtgcgcgggggcgtagagcgaatcgatgaggtaccagcgcacgaaggggaagacatgtacgaggcacgggcgcacgcccaccttcacgctcttccggacgccgcccgacgcgccgtagacgacggtgggccccgtccagtagggcggcaggcgcagcgtgaagcgcgcggagcgctggccctccgggacgcgcacgggcagcacgcccacgctcgcatccacgctcatcaggtccaccaggatgccgccggtgggcgcggggctgctgagcaccacgtcgccggacagttcgctgggccccgaggacgggcaacggctgctgggggtgaccaccgccatcgacgacagccgggggcgcgggacgccgccatacgcgacgaactgcttcacctggacgtcctccgtgaagtcgatgtcgaagatgaaggtcttgtagccgctcaccttcgcgctggagccaggcgcaagggtcagctccacgttgtgggggcaggcggcgctgttacagaaggggtcatccgagccacgcacctgccgggcgtaggccttgagcgtcccccgcacacgcgtcacgtaggtggagtcccccaggttgtagcggctgggcaaggtgtcatcgaaggtccaggtgatgacgttcccggagcgcgagccatacatgtgcagcaccaggtccgagttgagaccgaactgccgcgccggcacgttgaggttcagcgtgttcgccgccttcggcagcagccagtagcccgtggcgtagtcattgcctttcacgcggatgcgcgcggcattgagccggatgttcgtgccgcgccacacgtcgtccacgacgtccgcgtgggcggcctgcgccaggaagaagccaagcagggccaggggcaacagcccgttgagactgcgtttcatgaggacctcgactgcggtgggtgggttgaagcgaaggggctcagccgccgcggctggccgaggcctgggccatcagcgccatgacgcgggcccgggtggcgggctgctggccgggacggaccgagagggcctggagcatccggaggacggcggcgctgtcgtccatgcggggggtgaggacgttgagcagcgcggcctcggcccccggcgccagttgccccgccacgacccagccgctcaggcgctccagctcgggtgcgcccagggtgcgcgcattcagcgcgtccagcagcgcgccttgcacggcacgcgctggctcggacatcagcgcgtccagcaacatgcgcgtggcggcctcctggggcgcggtgcgcagggcccccgcggcggcggagcgcacctcgggcgcctcgtcacgcaagtggggcgacgccaggtccatgacgcgctccgtgccgctgttgcccagcgcgcgcagggagtgctccagcgactcggcgttgtccgcgcgggccagggcgtcctccagcgggcgcaggaactcggccacctcggggctgcccgcgggcaggcgggagacgacggcgcccagggcgtaggcggacgcgcgctcggcgccgacgtcacccgcggtccgggcctccgtgttcatccgcgccagcagccggcccgtctcgggctccggctcgcggaggaggcccgcgcgctgcaccatcagcccatgcgcgccggcatgctcgcgggcctccgtggagacaatcagctcgcgcagcgtggcctgggcctcggcgtgccccgcgccggccagcaggtccagcatcagctcgcgcatcgcgggagacctgcccttctggaggaacagttgccccagctcaccggcccggtggggctccagtttgagcgcggcgatggccctccgcgcgaaggtgcccagctcggggatggcgccggggtcggtggcggacgccagcacctggagcgccgcgtccaccgtcatgccgtcggcctggctggtcgtcagcgccagcgcctcgtcgccctcgaaagccacctgcgacggcgcgcggacaatgggcttgtcctccgtggccggcggcagcggcttctgctgacgcgtggagaacgcgaggcgcaggcggacgcgccgcgacatcagcgagcggccatcggtgtgcgtggcatccaggatttcgtcgtgggacaccccggccaggaagccctccgggtcccggtcgaagtgcgtgagggagctcagcgtttgccggaaggctggcgccgtggcggcggcacgcagggactggtagcgcgcacggcggcgcgtcaggcgtgcgtcctcgccgtcgaactggaagcgcgcctccacctcgcccgtctgcgtggactcaacggcgctccactcggcggcgtcgcgcagctccgtggggaacaactccgccgccagcgtctgcgcgacctggcggaacaggggcggctccgcgtcggagaaccggacggccaccagcgcgccccgggcgtccagctccagccacgccgaagccgtctggggcaggtgcgcctgcacggccgcggcgtcggggaagagcgcctggccagagagcgtcgcgtcgtgccgatccagccgcttcaccgccagccgcacgcgcgcgccattcgcgcggacctccagggcctggagcgtcagctcaccctccaggctcagcgtgccgtccatcgtctggggcgcatccccctgctgcggaacggggagcgccacgcgctgcaggtcgttccagacgaagtggtacgtgcgctcctcccccacggtccaccggtagagcggcagccgggaggcgctcacgggcgcggcggccaccacggcttccggcgtggcgtgatggaagtaggaccagacgggcaccgcgcccacgaacagcagggtggtggtcagcgcggccgtgcggacggcgagcctcgagcgacgcatgaaggactccagacagatgagggagaagcgccgccgcggcggcggatgggcacaccgcggcggcgaggggcccccggctcgcgtcaggcacgagccagggggggtgagacggactagtagacgcggaccagcggcagcgacttggactcgttgtagatgttccaggtgttgccgaagccgctccagctcacgatggtggtctcgcccttcaggaagagcagctcaccgaagagcttgatgctgccgtccaggaagcgcagctcgatgtcgagcttcgacgacgccctcaggaacagcgtgttcggattcgtcgggtgcgagggcgagctcaggtagaggccgatgtcgccatagagcggcacgttgacgcgggcgatgaccagctcgcccctcacgcccacctggagacccggaaccccgatgcccacggacgcgaagcccttgaccgaggcgaacggggtgatggtcccgtacaggtccacgcccagcaggtcttcggagcaattgcgggtgacggcgccgccaatgttcatcttcacgcccgcctccgcggacaggccgccctgcacggtgacggggacgaacacgacgacgaaggtcgtggaggccttcgcggcgtcactgtcgaagacgggcttgccctcatagaaggtgaagcgcagcgggtagtgcttgtcgtggctgtagagagaggtgcccagcacgcgcgcatccagcttgaggcggatgccattgccttccgtgccagcctcgccgctcacgtgcgccatctcgtgccgggtgggaccgaacacgttcgcataggcgttgaactcgccgtagagccgcacgtcgctgtcacaccaggcgcccagggccttgttgcgcaggcccgagcccggctggacgtactcccagccggccacgtagttgtagccaccaccgaaggtgtcgccacccgcgtagccactgtcgctggcctctcccccgtgccgcaccgcgcccgtggacgggttcgtcggcgtgttcagcccgtggatgtgggcgccgtagagggcgaggtactgcgccagcaacgacgaggagagcgtgtagtccttccggtccaggcccttcacctcgagcttgtccgcgttgcgcacgaagctctccggaccgaagtcgttgccggtcaggaagaggcacgcctgcaggtcggcctcgcggcgcggggccatggcggcctccagcatcgtcttgtagcggcgggggctccagtcacacaccgtggggccctgggtgtcgaggcagccgtccttctgcgccttgaccagcgactcctcgatggcctggtccaacccgtacagccgctccgcggtcagcttgtccagctccaccgtctcgtggtcgcgcgagcggaggaccttcgaggcctgcgcccactccgcgtagacggcgtcgcgctgacgcagcagcgcggtgaaggactcctgctccacctggtagtggttgagcacgtcatccgcgatgtagctgaactgctcggcctgcttctggtgccattcgtccgacggagcgacccagttgcgcgcctccacgttgttggccagcttcgccgcctcggacttgaagacgtagccgtcgatgcccttcgggtagcggccgggcgtgaagtggaagtacgcgttcttcgccgcgcgctgcccgtcccagatgggcgccagcttctcctggtccccgctgtagagcacgcggtgcgcgatgccgtccttgccgaaggcgccgttgaagaaggcgcggtagtcgtcgccgtaccggcccgcctgccgctcgaagcggctgaagtcgaggtacttctcgtcaacgaactcctggcaggacgtcacctgggtgccgtccttctcccagctccgaatccgagacaggtagacctgctcctccttcgtcaggttctccaggctcttgcggtagagaatctgccccttgagcacctgccccatgatgctctggtccatgccctggaagcgcgtgtgcttcgggatgtggggcgcgtaggccaccgtgtccaccccgccccccagctcctcgggcagcagcgccacgcgcttgggagcagcctcccaaccggccttccactccgactccacgaccccctggcagtacgcgtcgtggacgctgccgcaactgccggcgcggtagtcggcgtccacgcactgctgcgacgtgggcttgggacagtcctgcgcgaagctcgcgggcgcggccagcaccgtcgcggacaagcccgcccaacgcaactggcggcgtagctgtttcgtgtgtttccgctgattcatgtaacgcgtcgtccttgttgagggaccggctccgggctcggcccggcggtggcccagagcacggcgcgtgccggaggcgctccacccgcgctccagagggaggccacggggaacgcgaggacacgcgggcaacaaggggatgcgaggtgttgtctgcgaggctacgggcgcgg

SEQ ID NO: 1026 - DNA, 9564 bp, Myxococcus xanthus
cggtgggcgacccggccggccttcgcggcgtgtcgctgggccccattggcatgcccgcgggaagcgcggtgcgcgccgagcccggcctgtccgcgtacttcatcgagcagcgatggattcccgtcatggagtacagcccccacttcgtggacgggctggcctccttccgggcccagttcgaaatcgactacatgtggggccggtcggccaacgcgctccagcagaacgagggcggcggcttcaacgccgaccaggtcaacatccagacgaagaacgtcaacgtcgcgctgtatcccacgcgcaagccgcgtgagctgacgttgctggtgggcacgcagccagtctacgacaacgtctacgaccccacgcgcacgccgctgtcggacatcacccgcaccggctacaagatgagcttcctgggcagcgatgccacgggcatctccatcttcagtggctacaagggcctggccaagctgagcctgatgccgctgggcaccgcgcaggcggacaagggcacgcgcaacgacccgcgcctgaagtacatctggctcatcaccggtgactacgtctacccggtgcggcccaacaccaacgtgggcctgtcgctgtggttcctcaacgaccagacgaagggtgacgcctacgccttcgagggcctggtgaagagcggtccgtcctccacgggcctcaacaccttcacgggtacggcgcgcttcgacatcgcgcggcccacgggcaacgtcttctgggcgggcgccaacttcaaccacaacatcgacttccgcacgggccggttcggcgcgtccggcttcgtcatgtacaacggcggcaagtacgtcagcgacgacccggagcgctccgccctggccgagctcaacatctccggcctctccgccaacctggagctgatgtaccagtggggccgcgggcccgcggacatgctcacgctggagggcatgtacaccaccggcgacgacgacctctccgacagccgttacaccggtgccttcacgctcaaccagtacggtctgccgggcgcggtgtggttcaaccacaagatgctcatcctgttcccgttcaccagcacggtgaacaactacacgggcgcggtgacggacatctccaaccagggctacggcatgcgcgccgccatcgccaccgcggcgtgggacatggtgcccaacaagctgaacctcaagctgggcgtgggcaccgccacctccgacgcgacgcccgtgcggtggacgcccgaggtcgagcgcggccggtacatcggcaccgaggtcaacgcggagctgcgctaccacatccgctacctcatgacggccggtctgcacgcgggctacctgttccggggcagcttctacgacggctcgcccaccatccggaccaatcccttctccgtcttcaccaccttcacctggtacgcgttctgaccatgagcacctcccgcgcattcacggccctgctcctcgcggcggggctctcctccgccggttgcgtgcgctcgtacgcgcaccagcccgcgctctccttccaggatttggactacacctccgagggctcgaagcagccctggccggtgaaacggattccgcttccgcgcaccgcgaatcagtacggcatggccgtggtgccacagattgcctacgtcgacatgcccggcagcggcccggacgcgaaggccgtcgtcttcatccacggcctgggttcgtacctgaagttctggcgggcgcagctggacgccttccagaagcagggctaccgcgtcatcgcggtggacctgcccggctacggcaagtccgacaagcccggcaccttcccgtacaccatggaggccatggcggacgcggtgctggagttggtggacggcctgggcctggacaagcccgtgctcgccggtcactccatgggcgggcagacgtcgctctccttcgccatccgctacccggagtcgctgagcgggctggtgctggcgtcgcccgccggcttcgagaagttcagctggcgggagaaggagtggttcgcgcgggcgatgagctccgagttcatcaagtccgcgccggaggccagcatctggggcagcgtgcgccaggccaacttcatgcactggcggccggagttggagtggctgattgaggagcgcgtgcggctggcgaagtcgcccgagttcgacgcctacgcctacgccaacgtgcgcacggtgcgaggcctgtcccacaacgacttcgtgcgcgacaacctgcaccgcgtcaccgtgcccaccgtcatcatctacggcacggatgaccggctcatccccagccccttcctccacggcggagagacgcgcggcatcatggagtacggcgcgtcccacattcccggcgcgaagctggtggcgctggagggctgtgggcacaccgtgcagctcgactgtgcggagcgcttcaacgaggcggccttcgccttcgtccgtgacgcggcggcggggcgcatcgaggtgccgtccgctcccgcgaaggaggaggcgccgcggccggagtctcctcccgcgccggcgtccgagccgctcacgccggagagcctgcctccgcccacgccgggccaggaaggcgagccgacgccgggcgtgctgccccagccgtagtggggtggtgagccggtccacctccaccctttcgcgagggtggaggtgccgggtgcggatgactacgggatggtgtggttgaccaccatgtcgtactgaacctcggccgtcaggtccttcgagttgaagtggccgtagggatagccggtgtagcgcttctcacccgtctgcccggggatgcgtgacgtgtactcaccgtagacgatgccgtcgtagccgatgatttcgtccgccgtggagtagatggtgtagcggaaggcgccctcgtaaccgctcgtcgagcgcaagtcattgaggtacgtcgagcggccggtgacgctgccccagaagaggtagcccgggtacaggccgttggtggagccgcaggtgggcgtcgacgggccggacatgtaacaagacgtcaggcccaggttggcgccggcgatgccgacgaaggtgtccaccgaggacgtgagcggtacgccgacgttgtatgtgccgccgtccgccgcgtcgtgggccgtgccgccgaggatggccttgcgcgccagcgtcacgcccatggagtgggcgatgatgtccaccttcgaggccccggtgtacgccttcaccgcctcgatgaacttgcgcaccttcatcacgttctgcttcgagtggtactggttcgccgactggagcgcgttggccgggccccacgtcgtcgcgtacagctcgctcgtcttgtaaccccgcgagtggaagtactcgagggagttggtccagcccgtctggccgaagaccgagcccaccgccttgtccgagttgccgtggatgaagatgacgggctgcttcgtcacggtgtcggaggcgctggccttgccgccgtagctgccgcccgtgaggtccgtgcgaatgaagtcgtagctgtcgtagccgttggacgacagccagttgcggaaatgggtggtggcgccggaggtggagaccgccgcggcttccaccgcgccgagcgcttcttcgtgggacgcgatgtcctcgccacagccggtggcgatgccaagcagcagcgtgctcgcgagatacagcgaaggcctcagtcgcatgggcatactccttcgtttgtttgggaattcgatacacagtctagagacatctcgcgcgcgcgtcttccgctgactggacgtgcgcggacgttgtcgcgttgcgtcgcgtggtaagcaacgcgccatgcgcgcacgcaaggtcgtcatccggaaagcaggtgggtacgagcagctccaccttgaagaggtgaatcaggattcacctggaatcggtgaggtccgggtggccaccgaagccattggggtgaactatgcggactgcgtcatccgcatggggctgtacgcctccgcgaaggaatatgtggggtggcccatcaccccgggcttcgagttcgcgggccacgtggatgccgtgggaccaggcgtggaagacctggcacccggagcgcgggtgttcggcgtgacgcgcttcggtggttacgccacccacgtcacggtgccccgtcaccaggtgttcacattgcccgcgcggctgagcatggagcaggccgcggggttccccacggtgttcctcaccgcgtactacgcgctgttcgaactggcgcatccgcgtccgggggccaacgtgctggtgcactcggcggcggggggcgtgggtggggcgttgctccagttgggccgcatcgccgggtgccggatggtgggcgtggtgggcgggacgcacaaggtggagacggcccgcgcgcagggggcggaggtcgtcatcgacaagagtcgggaggacttgtggagcgtggccaagaaggcggcgccccgtggttatgacgtggtgctggatgcgaacgggccgtccacgttgcgcgacagctacaagcacctggcgtcgccggggaagctcgtcatctacggcttccactccatgctgccgcgcaccggtgggcggccgaactacgcgaagctggcctgggactggctgcgcacgccgcggttcgatccgctgacgctcaccaacgacaacaccagcgtgctggcgttcaacctgtcgtacctgttcgagcagcgcgccgtattggaggagtccatggcgcagctcttgggctggttggaggaggggaagctggtgccgccaccggtgaagtcgtttccgttggacgcggtggcggatgcgcaccgggcactggagtccggcggcacggtggggaagctggtgttggtgccgtgaatgcgtgcttcagagggggagctgcgcgccctgcagggtgaggaggctctgcgggacgacccatgccgcctccgggtcggagagcacgccgaggtacgcgcccggcaccacatgggggccgtgcgccaccgggactctcaaccggaggggcacctttcgcggcgctgggtgggacgggtgccacggggtgacgtggaggtcgagcaggtagtgggtgctgcggccgtcgctgtccggcacctgctccacgatggccgaatccgtgatgcgcgcccacgtcaggatggcgcggcgcacgtgctcagcgtgttcggcctggttgtgctggcgggctttgccctcctggctgaaccggagcgcggcgaagatccacgccaccagtccaccgatgaagcccaccatggccacggcgcgctcgttttcgtagagggcgtaggcgcccagtaacggaaggccgatgccgatgatgatggtgttcgtggtcccttgataatgcgcgggcggcttcggctgaacgcgcagcggtggaggcggccacggtggcgtggcgccctcggcgagggtcgacggcgcggggctcaatgcaacgagctgggtgttgtggtgcgcgagcatgttcgtgacgactttctgtgtgcctggggtgacgcacattcaggccgtgctgtgtgtcccggcacgtactttcaagcacgcgacggcacggccgaaagccccattctatcgagcgggccgaggcgcctgttggggagcggcgtccttcgcaggaggactctgggggcgtgcgcgctgacgctcccgcatcatcgcgtcgatttggcggcccagcgcagggattcgctgcgtgtagctgatggacgtgctgacgtaagggaagccgtcttcgcccttcgcgaagtccgccgcgtcggccactttcgcgtcgtagtagcggtagcccaggttggacaggaacacgacgatgtatcggcgccagggtttgccgggcagggagcggacgatgccgccgtcgctgccgtagttctccgtcagccctgtcttatggaggaatgtgacttccgccgtcgcgttgcaggggcgcgtgtcccggccgaaggcggtctccgccgccgttacggtgccgtcctcggagttcacccatcgagtagggacggccgcggggatgcctggttccgcgcgcgcatctccgcacagcagcgtggatgacagcgcttcgtgcagggcctggtcggcgagtagggattggaggtgggttctggacgcgccagagagttccttcgccgtcacatcgcggcccgatgcggtgcgccagaggacaccggggcctccttcgatgagcagcagcagccgcgctgtatccagcgctgtcatgtgaatctggccggggttccagctccggcctgtcaccggggacgtgccatggacttgcagcgtgtccaggcccagcgccgccagctccgcgttgaggctcgccatcgcgccttgttcgtggagcagcttcaccagggcctcggtggcggtgttgtccgattcggtcaccatcggctccagccagtcacgtatcgggcgcgtgcccttgtcctcggtgtctcggaggaagcgccagggctggtcccacgtgaggtgaccctggtccacccaccggaggacgcgaaaggcgatgagcagcttgaagagcgaggcggggtagggcgccatgaagcggagcggcgctttgtctcgtccggggaccaggggctccgtgggtgtggcatcgtgggcgccgctgtcccagcggtccagattccacgctgtgtaacgcactgccgtggtgcccagcgtttcgacgtcgatggggacgatggcgccagttgggtagtcgcgtgacagcagcacgttggcggcggccgtgggacggctccgggcgtccagttcgatgacggcgacgtcgacgtagggtgcgtgggcgatgcgcgcaccgtcgcgcttgaagtcgagcacctggtcaaagcctgcgtcccgcacggccgcgaggagtgactgctccagcgtggcggaggctttggcgcggcgtgtgcgttcagtgcgcgggagccgcgtggatgcggctcctgcttccgcacacagcaggaggagcattgcgacgagcagccatgggggggatgggggctgcatgtcgtgtggccctccgagcgggtggggaggtgacggtgaggcgggttgcttgcccgcttccctttcctgagccgacgcgatgccgccgggttcagctagcgtggataccatgcccatcgtccatgactggctggcccggcgtgccgcgctggcccctgagcgtaccgccctcatcgacgccgaccatggcgagcgacgcatctcctttcgtgaatggaacgattcggcttcgcgtaccgccgctttcctccaccatgcgctgggtgtggggcgaggggaccgtgtcgcggtgctcgcctacaactgcgtcgagttcctcgacctcttcttcgcgtgcgcgaagctgggcgccgtccttcagcctctcaactggcggctgagtgccacggagctgggggggctgctcgcggatgccgagccatccgtgttcgtcttcgggccggagttccgaacccaggtggaggccgtgcggtctggcgcgtccttcgtgcgccactggctcagtctcgcggctccagggccgagcgagcgggccttctccgagcgcgacacgcagacggacgtggcccttcctccgctggagctagaggaggatgctccatgggtgctctgctacacgggcggaagcaccggtctgccgaaggccgcggtgctcacgcaccgctccatcaccgccaacgcggtgaacacggtgatgggctggggcctgaccgccgatgacgtggcgatcctcaacgcgccgttgttccatgccggaggactcagcgtcttcaccgcgccgctggcctacgccggcggcgcatcggtggtgtgccggagcttccatgtggagggcgtgttcgacctcgtgcggcggggcgtggtaagtctcttcttcggtgtgcccaccatgttcatcgagatgcagcgccacccgcgtttcgatgccgtggacctgtcacgcctcaagctggtcatcagcggcggcgcgccctgcccggcccccgttttcgagcgcttcttcgctcggggcgtggacttcaagacggggtatggcctcaccgaagcgggccccaacaacttctggcttccaccggaagacgtgcgccgcaagccaggggcggtgggcgtgcccctgttccacgtcgaggctcgcatcgacggtgagacgcagccgggcgacgtgggcgagctgctcttgcgaggccctcacctgtgtgcgggctactggcgccgtccgggggacactgcccgcaccttcgcggacggctggctgcacaccggtgacctggccacgcgggacgcggagggatgcttccgcatcgtgggccgcagcaaggacctcatcatctccggcggtgagaacatctacccgtcggaagtggagagcgtcctcgcggggcatcccgatgtggccgaggtcgccgtcatcggcgtggcggaccccaagtggggggagacgccgcgcgcgctcgtcgtcgcacggccgggcacctcgccttcggctgaggccctgctgcgcttctgcgacggacggctcgctcgatacaagacgccgaagtcgattcgtttcgtggacgccctgccgaggacctccgccggcaaggttgaccggcgcacgctcggtgccgcgcacggcgcgccctgagttgcccacaagtcctccccaggcccgtgtccctggcggctgcgcatccgttcgtgcgttgccgctggcttcttcacggacctggggggcattggcctccaggtcctggaaaacggcccgtgcctgttccatgaccgtgcgcatggcctcggcatcgacgcggcggacctgccacgtatcggcacgccgttcttccgcacggacctcagccacacgtgcaggaccgggggcgtgggtttgtggctcgcgctcgcccggcgcatcgtggacgcgcacggcggtgcccggtgctggagcgccggcctggcgtggggacccccgtgggaatgacaccgccgacatggcccccggacccagacacgccggctggtggcgttcgcgaagccatcgtgctcggcttcacgaggcattcatgggggccagcgcgcggcgaatcagaggctggcgaagagcaggctccgtttgtggcgcagtcctgggaggttggcggccatgtgtgccgcggacaattcacccccgcgccgtgaagcgtccggccaggtccttcagcttggacgcccgtgcccgcaggtcttccacggagcgggcaatctgctgcacgccagccaccgactccgtcgagcgcactgagagcgcctggatgctcccggcgatgctctcccccgacgcggactggcgcgtgttttcgtccgccatccgctccaccttcccgccaatctcattcacacccgagagcagccgcgacagcgcttctcccgccgtcgtggacaagcccagcccttcctgcgccgccgtggtgccctggcgcatcaggtccgccgccgcccgcgtgtccgcctcgctccggctcagcagcgtctgcacctgccccaccgcatcccgcgtccggttcgccagcttgcgcacctctccggccggcccgtgggagccc

SEQ ID NO: 1027 - DNA, 10317 bp, Myxococcus xanthus
ctctacggcatcgccccgccctcgtccatgaggcgggtgaagaaggcgtgtgtctcgttgtcggcgattccctcctggtggtcgacgcagccgtccaaggtgacgttgatgctgaaggtcaaaagtcccatgcggcgagtctaagccatacactcctggcgatggaacggcaggccgtcgcagaacttgtcgctgaggatgtgcgccaggagcgaaggtgtcgcgagcgcgcgcggcaggaactgcggcggcagcggtgcggtcacgctcgtcggctcggcagtgtccgccgcgtcggcgtcgcggtcccccctgagtcagggaagatgtcgcctctgccgtgagggcctctctcacttgcactgacgcacggttcaatgggggactgatgctgcgcccgaggcttgaggaggcgcagcctggttcgggaccggcagccccgcctcgcgcatcagctacggccagcggaacttcgcgagaggggcttgggcggaacagccagctccatgccttggcggtgaccggggcaaagatgggaactaccggaggggtaccgagtccagcatggcgattcctccgtcatccccagcggtcttgaaagttcaggcctgccgagaagggggggaggtgtcggaagcccggcccccctcggtgatagccccgcatcacagccgcacgcgcacctgccccgtgcgcgcctcgctcactggcattgatgcactgccgcaggggccactgcgcacccatggcgcaacggccgaatcttgggtcggcacagggggacaccacgtcttggcagtcgcgggccgtacctctcgcacatgctgcgacctaccacatccgggtggtgtcctccctgctcaccagggtggccagcgtctacgtgtcgccgctcagctcaccctggagggagacgtccgtctttcccgtctccgtgcaggaggaggagcgcggtgagaagcacagctcgcattgatgtctcctttagagcgggcggcatggtgctgggtgaagaaggattggagtgtactcggcgtcgcggtgatgctcggaggtggctgtgggagcgtcaggtgtggcggcgattcctggcccgccgcgcgcccgtggatcgcggctccctcgcgacgtgagcgcccacgcgggggcgtcattcccgctgacgcaggcgcagtttcaccggcgtggatttcacttcggtggcgttgattcgcttgaggtaacgaactggtgtcgcatcgccggagccatcaggcgcggtcgaagcgccggaaccaatcgtccgtccgctcggcctggtcatcgctgctgcccgtcgcgaaccatggagattgttcccgcgcgcgctcgatcagcggccgcaacaacctgtggagccgatggtagtcgggcgcggtttcgccacgggtgcgatcgatgaacccaggcgacgcgccaagttggaagagcacgccggcgccgaggtgcgtccattcgatgggcgcctccaaggtctgctcgacattcttcgggctgcccagctctctgaggagctcgtcgcacaccaaggtgagccagttcaccgtcttcccggcgttgttcgctaccgcgtggcgatcctgtagtgagcgtacgatgtccatctgaggatggcgcatcgatttttgccacgcgaaggactcaccaacttcggacgagtaacgtgaaacctggtagccgaaaccggcgcaacccgacctgtaaggaaaaatctcggcgattcgacgcaccagcgcagccatgtcgcgcacgcgtgcgaggccgtcctccggcgcaaacgtcatgcacagagaattcgccagttgatcggggtcccctcggcgatctcgatcacgcccgtagaccttgaacaaatgcttgggagcatccagcgcgtgctcgccgtccttgagctccagcgccacgattccgtccttgtcttgcggattccgtagcgacgactcgagcataccgaaggtcttcggaccgaccgggcggtgcttgcgcatgttctcgtcggcgtagaagcgcagtcgctcacgcggacagagctcgaagtacatctcctggcaacgcagcagcacctcggggatcgccaagaacgaaacgtccgtgaagagggtgatggcaaagaccccatgacgctcgagatgctgctggaggaggagatacggggcctggtgggagccgggcgctggcagcaggtggcggggcgctacaggctctgagttcgatagcgatgggccatgcatgacatcgacgttcgcaacgccctgtgggagcaactcggcgccgcgcatgcaggcgaggacgacacgcgcctgctcgacgagttcgggctggagctcggtgacgtccgcgtcaatgtcgtggtcatcgatggtgagattcacggctacgcgagcaagagcgagcgcgacgccctgacacggctacctcgtcaggtggctgcctacggcgccgcacttgaccgcgcgaccctcgtcgtcgcggaaggacgcttggtcaaggcatcagctctcgtgccggagtggtggggattgagtatcgcgcactcagttgggggaagtgcggtgcgtgtcgaagcccatcggttcacagcgcgaaatccggagccgcgcggggcgtgcgtaacaagccccgcgcgttcctctacgagcgtctcacgcaatgccttgcgcctgaccagctaagggcccagatgcgccgggtattgaagtcgcgaacacgctggcgtgctggcgaacagcgaacgtgaggtgatggtacgttcccactcgttgccacgctgtgcgatgacgccgcgtctcgttccccagtcctcgtaggccatgaaccgcatgatagacgcgtcggctactgacgcacgaagccgcgcgggtggctgcgcgcggtgctcgtgggccgcagattcgcggactcgaactgctcgtagcggaagccggagcccggctcgaagacgttggcggtcacctcccaggccgtgccctgaccgctgggggcgggcctgctcggagccagcgtgctgggctgcgggaagtcgaaggcctgcgcgcccgcctgtgcctgcgagagatgcacccagtcccacgacatccctcgcgcgcctcgacgcacggagatcaactccgtgcccgcgggcgcggtgagctgatacgccccctccgcgaccgtcggcaccgtcccggtgccgcattcactcagccccggcgccacgccccggatgccatccggtagcgccaccgcgccgacagcacccgcgggaggattgtagacccaggtcgtcaacgtctcgcagagcgatgcccccacgaccgtcgcctcgagcgagacggcctgagtggcgggtgcggacgcagggatgtaggtcgcggagaacgtcctcgacgtgccgcccgtgctctctggggggccattgggctgcgcgggaagtcctgactggaggcgaacccctcgcgcatagcgggcattgatgaaggcgggccaatccgcgggaggcacgagggtgcctgtcgtcgtcgtggtcgccagggggcctggttccagcgcgatgtccaacgtcgtgtccgcgaccagcggccccacctcccccacgtccttgtgagaataaaggcctcccgactcgtagtaggcatagacggagagcggaacgcccgccggcacccccgtgagcttgtagctggcgaccccacccgtcagaccgacgtagaacgtggtcgcgctgaagccggtgggcgcgaccacccagatggtggcgccactgaagccgctcgtcactccgcccgaaatcgtccccgacagcgtgacggtctccgccgcagacgacgaagtggcccgctgccacgccgttccgtcgaaggtccacaccgccccggtccccgtgaggaggacgaggtcgcctgtcgtggggtccgtctcgagcttcaccccaccactgctcggaggactccccgctgcgccctgcgcggtgaccgtggtccacgcccccgcgctgaaccggagcagatcgttgcgcgcggcaccgttggacgttcctccgaagagatacatccccgcgccgggccgataagccatcaatccaccgcgacggaccgccggcagcgagggcgcgctcgcccaggcattggtcgagcggttgtacgtggagcacgtcgccaggtcggcgccgatgggcgcgccgctcgcaccgccgcagatccacatgagcccggagctcgtgtcgagcgcggcggcggcgaaggcgcgggcggtcggcaacgtcccggtgggagacaacttggcccacccctgggcatggctccaaagctcgttgttgacgaacaggcctccctgcgagcccgtcccggaggtacctccgaacagcaagatgctgcccgagaccggggaggccgtcaccgccgcgcccgaacgcgcggagggccccggcgcccccacctgctgccaggtccgagtggctgagttgaactgccacgtgtccgacagcttcgaccccgtgcagctctctccaccgaagagcacgctgatgccgctcccgcgatactggaaggcgccaccgacccgcgccggaggcgccgcgggcgccgagagtcccgggacggcccactcctcccaggtcccggtcgcgacggaggtgagcgccaccgtgtcattgagacaccccgtgggctggtttgcacccgagccccgtccgcctgtcatgatgaagcctcccgcctgcgcatcccaggtggcgctcgcgctgccgcgcggcaggggcaccgggtagccggggacgagcagcgtcaccagcgaggcattcacctgcgccatcgtggcgttggagagccccgctccgttggcggtcacgtccacggtatccgatacgccatccagccccaggccggtgaaataggcgcgcccctctgcatccgtgagcgcttcacgcgcgggcacgtactccacgccattctttcgcacccgtacgcccgcaccctcgtgtgcgcgcccatcctctccaatcacgaagacggtcagcgcgtccgtgatggggctgccctccggctccacgcccaccgtgccactggacccgagcgcccgcggagccaccacctccagcgacagcgttgcctgggctgtctgcccgttcgcgtccgtgacgacgacgtccaccgcgtggcttcccgccatgccgggcgcgggaatccccgagaggatgccggtgtcctcgtctatcgtgagaccagatgggagtccggtggcgctcacctggagcggcgcggtgccacccgccgcgaggattgcctccgcgacaccgggggcacgacggtacgtcacgccttccgtggcttgggtcagctccgtcgtgaggatggcgggggccgagtccagcgaggctgcggagatgtctgtctttggaggcgcggtgaggtcgggggaatggacagcgggggattccatacagccttggctcagcaatgcggaaagaaagccaaggcccaggatacgagcggtggtcatgaacgctccaggtcacgagggacctctctcagccaggccctccacctcgaagcatgccgaatcgcgttgccaggcccacccaagagaggatttgaagccgacgcagggtggcggaccggacgagcagcgtcaaggttgatgggcttgcatcgaggcccgacacagggaaggacgcgcaaggcctcgctccaacgtgggtcggtgccccttcgggcatcccgcgctccgggagccttcccgcttcgcccccgccgtgtccatctcgacagggcacggccgcgcgccgtacgtggacacggcctcccgggtccgcgccgcgctgaagttctctccgacacctcgacgtaggcgtcccgggcacgccgggcagccgcatggcgccgaccaagaatgcctggccgcacgacgcgttcgaggacgccgatgccgccgaggcccgcggcgtagagctcgagcggctcaaccccggctcgcgcttcgcggtcgccgaacgctgacgcccctggggccgcgcagccccgcgtgtcgccacccggcgcgtcagcgcagcgttacgcggcggcgcgggggcgggtgctctgcggagtcttgggggctctcgggcgtggcctgctgggtgggaacttctcgctctctcgtcttccgcgcacacggagccgaacgggaggtgcccctgctctccatcctgttcgagaatcacgaacctcgctttagggttgaggcgccggtgagcgagcctcgggagcctggagaaccaggtctcctggtcggggccccttgttggcgcgccagccgggggccagctccaacacccagccctcgccttcccagcgtgcatctcgggggcccgacgggggggcgttcaccgtggccgtcttccagtccgaggagaggagcacgtcggaggtcgcagtgagcgagccccacgcatcgacgatgcgggcgccgggatacaccgtgccgtgctcggcgagcgggatgagctcaccagggttgaattggatacgcatgcgcaccagggggaggtgtagcactgggccctccaccaacttcttgcgcagcgcctcggcccgggcctgggtgaggcgggcccgctcgcgttcggtctctcgcagagcggcgcctccgtagcgcgcttcgcgctcgggtgagggctcaggcatgcccagccgcagtgcgtcctggagcagcgttcccaggtccgccccggcgagcgctcgggcacgccacccctgggcgcggggacccgcctcgtccagcaggaggccataggcgggtcctgatgcatatgcgaaggagcgcacgaaggagcttcgcttgacggcatcgtcgaggttctccagcgccagggcccgcctgccacgtgcgtcggccaccgccagcgtcacacccgtgtattcggcgaggccttcgtgctcctcgaggagcccttccgcgaccgccgcttcagggaagagcgctcggcgctcgcgacggaacaccagtgcgtcctcgacggcgcgggtgcggaccgaggggggcgttgcgcgcagggcggccgcgagggcacgccactcgagttgcagcagcgtgcggccctcgatgccatcgaggtgggcattgtccttctcccgccctgggtggcccaaggtggtgcggagccgatgaaaggcctcgtgggcaagcagggcacggcgacgcgcgggggcatcgggcaacggagcttggagctggacccaggtggttcccgcccaagtcagcgccgtgttggcgatggtgagttccgaggggaacactcccacccagggccctgttcccgaaccgctcggccaggtgctcgcgacgaagacgcgcgtgacgggatggacgacgaggagaggggcacacagcgactgtccccacagtcgccgtcccgcggcgtcacacgttcgttggaattccgcgaaggtcgaggtgagtgcccctacctccagaacgtcgggcactgtcttcacctcggggtcggccacggccgacccgaagcttgagatgccaatcgccgccacagccacctgcgcgagtctcatccgccgaaggaatctcatcgagccattgtaccgcgccggattgttgagacaccaggttggttgtaatcagcagcctgcttcgactgcatcagctcccgccgggcctgactcggcgagaggaagtggtggcgctccaacagccagtgctcgttgtagcgctgtgcccactccagcagcgcccgccgcagttcctccacggtggagaaggggcgcacccagagcagttgctccttgaggggcgaatgaagtgctcggcacagctgttgccctcgggactgcggacgaaggacgggctggacgcgtcctggttgcgctcaggaggcagcgaccgaatatcgggtaggcacaggtcggttcacgcaacgtccagccagagcgcggcacctgcacggtctgacgagacgcttaccgcgcccgggccaacctccaggccttccccgatggcgagttcgagggtgggctcacttccaaccgccgcgatccgcagtcgtgacgtcatcgcgagcagatagccttggcgcgcccggtcgacgataagagtctcctcgctacccggaacgagatccacccaccacaatcgcgcatcggctcggagcggcatctcgggatcgcccgccagcaactggcgaccttggcccgcgagctcgcgagtgaagtacgcgggcgccccgccgaacgtgttcggctgaaaccaaatctgcagcattcgcgtcggctggtcggtgtcgttgccttcggcgtggacgattccgctgcgtgcagagatcaactgagcggaccttggtccgagggtcacgccgtgcgcctggtcaccgtggtgcgacaatgacccgtcgactacgacgctgagaatatccatctcgcgatgtgggtggattgggaagcgcgagtgcggcgcgaacgtcgcgtcagcgagcacgagaacgggtcccatgcgtcgcccttctcctgcccttgggcccaccgtcgcgacgaagtgatctcgaagcgagagccactgcagcgtggtggtgggaagagattcgatggtgcgatgaacgaggtggggcatcgattgtctcctaggccgaaagcatccggacagcgcgagggcgccgcctccgatcaggacggcgcgcttggacagcgtcacgccttgattccgaagggggcgtcgagcacgtagcaccatccctcgtctgccccgcgccgcatgacgtccgacttcatcgtagttctcctgggtccgtcgtcgaatgacggtacccacgatgaatagttgttgtcggcgcgattgatgactccgcgtttttgcacatatcgtgtgcgttcatgcacatttcatgggacgagatccagaccatcgaggcactggtacgaacgggaagcgtcgaggcagccgggcgcgagctcttgctgcgacactcgtcggtgtcccgccgcatcgcgggactcgaagcgcggtacggggcggtgctgttcgtgcgcggttcgcggcttgtgccgaccccgctggcggcggaaatcgcgctccgcgccggatcgatgcgaacccaagcaaccgaggtggcgggtctgatgaccgcggagcagcggggacggcagcagcgagtggtgattacgacgagcgacgtcctggctccgctcttgtttctggcgctgtccaccatctcaccgacgcaatccgtggaagtactggtgagcgaccaggagatggctctggtgccgggacgcgtcgacctcgcgcttcgtccgaagcacgaaccgggtggcgcgctacgtggacgtcggcttggacggttgcggatcggggtctatcgaaggtccagcgggacggcgaactggatacttccgagctcggccctccgcgccaagacctcgatgcaatggtggcgcttcgttccgaaggatgcacccgaagccgttctgtgtgactcgctgctcgggattcgagatgcctgctgtgccggactcggactcgcggcatttccgagctttctcgctcatggagaccctcggctccgattggagagagagctcgaaggaggacctccgctctggctcctcgcgccggctgttcgcgagggggcaaggggcctcaaggggacgcatgacgccctcttccgggccctgcgcgcgaccgaaggggccttcgcgaagtagggtcagcgggacaccgcacgtcggtcccaacgctcggcgaagatgaagtcccgcattcgtcatggcccccctgtggcagggaagatgtcgcctctgccgcgcgcgcctcgctccctcgcattgacgcatgcctgggcgcgctgaatggaggagggcttgaagtccgcttcccctgaggtttcgacatgcgcaaagtctcgacgcccaccctgcttctctcgatctgcgccgtcggcatcatcattgccctgggagcgacgtggtggatgggcaggacgagcatcctcgtcgtcaatgcgtcggaacgagagctgcggagtctggaggtgaagttcccgggacgcacatgtcgttatgaaaatgtcgcccctcaagccgaggtccggtgtgaggggcgggcggacggggatggctacgtcgaggtctcgtaccgtttcgatgaaggggccgaactcggcgtgttttcgacgaagtacgtcaatcccacgctgggatggcggggctccatgttgctgcggcccgatggcaccatcgacgccaccagggctcggtagcgcctgcagggtggcccctgtgttagggaaaatggggcaggttggtctgctccccgaatgaagccctgcgcgaactcgttctc

SEQ ID NO: 1028 - DNA, 10644 bp, Myxococcus xanthus
acctcgatgccgagcagcgccaggtcctcgcgcgtcgcgatgcaggcgggacgctggccgtcgcgcgaaccgatggcgtcgatgagcgtgcccgggtgctccggctccatggtgttgcggatgcgcagggagattccggactcgatgagcggaatcatcgtgcgcgggtgcagcatgcgggcacccaccgccgccagctccaggccctcgccatgggtgaggtgcgccacggggtaggcgtccgtgaccagctccgggtcggcggtgtgcaggccgagcacgtccgtccacaccgtgacttccgacgcgcccaggccctgggccaccagcgccgcggtgtagtcggagccgttgcggcccagcgtggtggtgcgtccatccggcgtcgcggcgatgaagccggggagcacgggcacctcgacgccccacgtctcccgggcggcttggagtcgctcccgcgtccgaaccaggtccacccgcgccgcgccaaagcggtcatccgtcaccaggagctgccgcgcgtcacggaaggtggcgggcgtgcgatgggccgtgagcagctccgccagcagcgtggcggacaccaactcaccgaacgacagcacccggtctctcgtgggggcggagcactctcgcgtgagtgagacgccatggagcaactgacgcagcggcgcgaggagcccgtcgacacgctcggccagcgcggtggcttgtccgggcgccagcgccgcggcgttggccttcgcgaggtcggcgatgcgcgtggccaccgcgagcgcgccttccaggtcaccctcggtggcgaggtgggccgcgtccagcagccagtccgtggtgtcgcccatcgcggagacgaccactgccagcgggccttgccgcgcgtgcttgccaatcagctccactacctggcggagccgcgtgggtgagcccacggacgtgccaccgaacttcatcacctgcagggacgtgctgctcattgaagaacctcaagggggccggcgggccctgattcgaaagggaagggcagacgcggcgccctgtgccggacacacgccggccagacgcggcgcgcgagcgcccacggagggaagagtgaatgggttggagttggagccctggcggactagcgcgtgccgccgggccagcgcattcgacgcgtgacgcgcgcgcggcgaagcacgggcaacacggtcgcggcggtcaacggtgcgggtgcggagcaggtggatggaaccacggaggtcctctctcaccgaagcgggagggagccctccggcttcggacgcttggattgctcggggagcccctgctcctcgaaccgcatcgtttggacaccttggaggtccgactccaggttgtcgggccaccgcgcgaggcggcggccgctcttgatgctgcgcacgaaataagcgtggacccgggtgtctgtcaatgcctcgtgtggttttcacttccgtcacggcatcttccattcacgtcagggtttggcgggaatgcccggtgcccggggcggatgccggcggtgcgtgggtgtgctggtgcccacgctcaagccggagtacgccgacatcctgcggaaggtggacctggtcgagcgcggtgtcccgggcgtggcgcgcgaggcgctgaagaagcaactggagcgaagctgcggcagctgcgccgcgcacggatgcctggactgctcttgcaagccatcccaccgggcaggcgaggccttggcgcctggctcggcggacgtctgaatgcgcttgcaccgggacggtccgcctcgttaactccccccaggtgccgaggggcgcctgcccgaaaagacgacgtcaccctcgcttctctccgccgttcgacagttccagatgagttccttccacggcccacgaacgggtgagggccgacgccaagggacttttcatgcgaaccgtcgtcaccctccacgaatgcaaggtccgcgcgtcgctcctgctcaaggagctggcttcggcggatgcgtcgcgcgcggcccaggcagcggagcggctgcgcgtcctgcccggcttcgcgggactggccttgggcgaggtgctcgcgcgcaaggagacggtgcagcacaagcatgcgctgactgtcatcgcgcgtgagcaggggcacgccacctggggcgagctgaagcaggtgcgtgagctcgacttcgagcacctgctcgcccccgtgggcggctcccacctcaaccgctggttctcctcctatgcggaggccgctgactccctgcggacgcagggcggcttcctctttccattccgcgagcagttcttcgtctgcgaggccagcctcgtcgaggcgctcggtgtcgaccccgaggacgcggactggtcgctcatgggccgcgactggatggcgccgaaggatggggccgcgcaggcccggcttgcccagcggttcgccctgcattcgccttcccacgcttcaacttccccagacacgaggtctcccatgtccgctggctcccgccgctccgaactgaaacgtgcctaccgagaagcaccgcctcccatgggcgtgtacgccgtgcgctgcctcgccaacggcaaggtgctggtgggcgcgagcgccaacgtccagggcatgctcaatcgcatccgcttcgagctgtccacgggcatggaccgcctgcccacgctgctggaggactggaagcgctacggggcggagcagttcaccttcgaggtgctcgacgtgctgaagccttccgacgagcccgtggtggcgccggaggaggagctgaaggtgctggaggcgctctggttggaccggctcaagccttacggcgacgcgggctacaacgtgcaaggcggttgaggttggccgcctgcttccttccatggggcaagtacagtggcctgtggcaacttgccacgttcaccacccgtcgggattgcgttacgcggagactccatttcaagggagtccgccatggtgtccgctcatcgtcgtgccgtccgtatgcttcccttcgcgctgctgggcgtcctgggctgtggcgatggcatggaagtcgccatccccttcgaggcccgggtgggcagcgagcccttcgcatgtggccgcatctacaccggggtggggacgaccgggacgacgtatgagcccatggacctgcgcgtgtacctgcacgacgtccggctcgtcacggccgacggcatcgaggtgccactgaagctcgagcaggacgggcggtggcagacacgaggcacggcgctgctcgacttcgcggacaaggcgggcctgtgcaccaacggcacgcaggcgacgaacctgcgaatcaccggcacggcgcccgagggcacctacaccggcctgcgcttcaagctgggcgtgccggagacgcagaaccacctcgacgtgtccacggcgccctcgccgctgaacgacacgagcctctactggggctggcgctcgggctatctcttcacgcgcatcgaaggccggacgaagggacttcccgaagggcacgtcatgcacctggggagcacggactgtgcaccgccgccggagggccagacgaacggcaccgcgggatgtacgttcggcaaccgtccggaggtggccctggactcgttcgacctggcgtctggcaaggtggtgctggatttgggggcgctcttctcaggctcgaacctggacgagaacgcggaggtgcccaacacctccgtggggtgcatgtcgcagcaggcggacccggactgcgcgcccgtgttcagccggatggggctgacgcaccggagccaggagctggcaccggggcctcaggcgttcatcaaggcggagtaggagggggacgtcatggcgtggcgcgtgggaagaagagcaggggtactggcggtgctggcctggctgggcgcgggttgtggcggcaaggacggcgaggcggagcgctacgtgtggaagctgcccacggggtttcccacgccgcgagtgcccgcggacaatccgatgacggaggagaaggtgcagttgggccggaggctcttcttcgacgtgcgcctgtcacggaacgagacgcagtcctgcgcgtcctgccatgacccggcgcgggccttcaccgagcccctgatgacgtcgcagggcagcacgggcgagacgcaccgccgcaactcccaggggctggccaacgtcgcctatgccacgagtctcacctgggcgaatccctcgctcacgacgctggaggcgcaggcgttggtgcccttgttcggcaaggagccggtggagttgggcttcggtgacagggaagaggagttgctcggccgactgcgcgcggtcccggaactggaggcggagttccagcgcgcgtttccggaggccgtggagcccgtgtccgtggccacgctgacgcgggcgctggcgtcgttccagcgcaccctcatctccggcaactccgcgtatgaccgctatgtgtatggcaatgacgtggaggccatgacgcggcagcagaagcggggcatggagttgttcttctcggagcggctggagtgtgaccattgccactccggcttcaacttccaggacgccacggtgcacgagacgacgtccgagcccatcttcccctaccacaacacgggcctgtacaacgtggacgggcagggggcgtatccggcgaaggacccgggcctcatcgagctgacgggccgtcccgaggacatgggccgcttccgcgcgccgtccctgcgcaacgtggccgtcaccgggccgtacatgcatgacggcagtctggccacgctgtcggacgtgctggaccactacgccgcgggaggacacgcgcggcgggtgcgcggcggcgaggccagtccgctgcaaagtggcttcgtgagaggcttcacgttgaccgcggaggagaaggaagacgtcttggcgttcctcgagtcgctcaccgacacggagttcctgacggacccgcgcttctcggacccgtccagcgtgccgtgaggaccgctgtgctcactgcggggggcgccagcgtggtggaggccaccatgccgccgcggtagtgctccaggacgtcttccaggggcgcgagccgtccgtcatgaacgcgttgaacacgcactcgcgacgggctccgcctccacggcctgttcgcggcgctgctcgttgtagacggacagccgcagcgtcagcacgtaggtgacgcagcaggcgaggacggcgggcgggccatacgcggagccgaacacctccagcaccagggcaatggccgccagtggaacgcccaccaccgccaccagcgcggaggcgatgcccaccaccacgaacaccgtcacatccgccggccccgtgcccgttaccgacgcgagcatctgcgccgtggccgcgcccgacacgccgcccagcaccatgctggggatgagcatgcccgccgagccacccgactgcaccgtgaagcccgtggtgagcagcttcccacccacgatgagcagcaggtaccaccacagcgacagcggccccggcgtatccgccaacagctgggcgatggtgtactcgcccatgcccagcacgtgccggaagtccatgcccgcgccgtagtagagccctccggccaccaggatggtgcacagcgcccccatggcgccgcgcagcaccgggctgacgcgctccaccacctggcgcgtgtgtttcatggtcaggccgaacagcagcgcgacgggcgcggacaccgccacggccaccagcgcggtgaggccgtactcccccagcgtgtacgtgtgcgggtgcggcggcgccacgaagatgggcttgaagccgaggaggcggttgttgagcgcgtacgcgatgattcccgccagcaggcagtacgccagcttccggtagacaatgcggttgccgtagacgacctcgagcgcgaagagcgcggcggcgaacggcgcgttgagcagcgttcccaccgccgcggcgatgcccgccagttggcaggtgcgcagcgtgtgctcggagcgggcacgggtgatgcgggccacgcccgcgcccagggactcgcccaccagcaccaccggaccctccagcccgcccgacgcgccggtgcccagcgtgagcaacgtggccaccgctttgcgcagggcgagccggatggcgggccgtgagtagcgagggcgcgggtcgtccgccgggtcctcgtaggtgatgtggtagttgaagagcgcgacattcaccccatccgaggccacgtcgctccagccgggccggcggttgagcagccctcgcagcagtccgcccagcagcagcacgcccgcgagcaccagcggcgcccaccagaggctccgccccgacgcgaacgccagcagcgtgtcactggtggcatggacgccgtaccgcagcgccgagcacaccccccagatgagcaccgtgcccaggaccacccggcccaccgtgcgcagcaccgtgtcccacgagtcgtgaagagcactctgctcttcgtccaggggctctcgacggccagccatggagcgagagggaatgtgctttgaggtcaagatgaatgtccgtggccggaggagcgattacctctagagaaacacccagtaagcgtcggccgggtgcttcgttggcctgggcgattcgttggcctgggcgaaaggagcctcgaagcgccatgccccaacacccttcgcacgtgccgcattcccgcacgccccctccctctccggccggggaggcgcctgccatcgaccccgtctgcggcatgaaggtggacccgaacgccccgaagggcggtcacctggagcacgccgggctgacctacgccttctgcaatccccggtgccgggagcggtttcgcgcggacccggagcgctacctctcgcccgcggagaccgcgccggaaccgacgccggcgccggggaccctgtacgtctgccccatggacccggaggtccgccagtcgcatcccggcgcctgccccaagtgcggcatggcgctggagccagagacgcttcccgtccaggaatcccgcgtggagtacgtgtgccccatgcatccggaggtggtgaaggacggcccggggacctgccccaagtgcggcatggcgctggagccgcgcacggtgctggcggaggagccgccggacccggagctgcaatccatgcggctgcgcttccgcgtgggcctggcgctcactgcgccgctgctcgtgctggccatgtcggacatgcttcccgggcagcccgtgcaacgcgcggtgtccgcgggcgtgctggcctgggcgcagctcgtgctggccacgcccgtggtgctctgggtgggctggcccttcttccagcgtggctgggcgtcggtgcgcaaccggcacctcaacatgttcaccctcatcgcgctggggacgggcgcggcgtatctgttcagcgtcttcgccacactgctgccgcgggccctgccacagggactgcgcacggggcacggcggctccgcgcccctctatttcgaagccgccgccgtcatcgtcaccctggtcgcgctgggacaggtgttggagctgcgcgcccggcacgcgacttccggtgcgctgcgggcgctgctgagcctcgcgccgccagtggcgcggcgaatgggagaggacggtcacgaggaggatgtgccgctcgcgagcgtccagtctggggacacgctgcgcgtgcgccccggagagaaggtgcccgtggacggcgtggtgctccaaggggccagcgcggtggatgagtccatggtgacgggcgagtcgctgcccgtggagaaggccccgggcgcgcaggtgacgggcgggacggtgaatggcacaggctcattggtgatgcgcgccgagcgcgtgggccaggacacgttgctctcccgcatcgtccagcgcgtgagtgaagcgcaacgcacccgcgcgccgattcagcggctcgccgacaaggtggcgggcgtcttcgtgccggtggtcatcgcggtggcggtggtgacggcgggcgtgtgggccatctggggccccgagccccggttggtgcacgcggtggtcaacgcggtggcggtgctcatcattgcctgcccctgtgcgctggggctggccacgcccatgtccgtcatggtgggcaccgggcgcggcgcccaggcgggcgtcctcatccgcgacgcggcggcgctggagcggctggaagcggtggacacgctggtggtggacaagacgggcacgctcaccgagggcaagccgcgcctcgtgacggtggtgcccgcgccgggcttcgaggaggcgcggctgctgcggctggccgcgagcctggagcgtggcagtgagcacccgttggccgcggccatcgtcgcgggcgcgaaggcgcgtggcgtgacgctggcgcccgtggaggacttccgctcgctcacgggcaagggcgtcgtggccagggtggagggcgcctccgtggcctggggcaacgcggccctgacggaagcgctccaggtgcatggcggggaactgacctcccgggccgaggcgctgcgggcagaaggcgagacggtggtgctggtggcggtggaggggaaggcagcggggttgctcggcgtcgaggacccggtgaagtcctccacgccggaggccctcgcgttgctgcgcgaggaagggcttcgggtggtgatgctcacgggcgacagtcagacgacggcggacgcggtggcgcggcgcctgggcatcaccgaggtcatcgctggcgtgttgccggaggcgaagggcgacgccgtccggaagctccagcaggaggggcgggtggtggccatggcgggagatggcgtcaacgacgcgcccgcgctggcgcaggcggacgtgggcatcgccatgggcaccgggacggacatcgcgatggagagcgcggccgtgacactggtgaagggggaccttcgggccatcgctcgggcacgccgcctgagccagggcacgctgcgcaacatccggcagaacctcttcttcgccttcatctacaacgccgtgggtgtgccggtggcggcgggcgtgctgtaccctgtcttcggtctgctcctcagtcccatcttcgccagtgccgcgatgagcctctcgtcggtgtccgtcatcggcaatgcgctccggctgcggaagctgaagctgtaggtccggttgtgagggaggccgcctgtaccgggctccctccctcgggccgggggcgggcggcccgccgaggcccacccgcgcggcgctgggatgcccacccttgagctcgaacgcaccgcaccctgggagggtggacaccatgaccccagccgaagtgatgaatgccgacagcgacatgcgccagtgcatcgaggcctgcctggcctgtcaccgcatctgcatggagacgctgacgtattgtctgggaatgggtggcaagtatgcggaggccagacacctgcgcttgctgatggactgcgcggaaatctgccagacgagcgcgaacttcatgctgcggggctcggagctacacagccgcacctgcttcgcctgctcggaagtttgcgggcgctgcgcggagtcctgcgcccaaatgggcgaggacgtggtgatgaatgcctgcgcggacatgtgcacccagtgctcggatttgtgctggaagatgggcggcggtgtcatgtcgcagacgcccaacccggaggccgcccagcgcgccgccgaccttcccgcatgagggggcgcccggaagagtccaggcaagccggaacggccctgtcgcggagcccttcactcgccgtcgaggccgattagagtgcgctccatgagctctcgcgaggaggggcgcacctccggtacgcccgctggacatatctccgtcgtccacctgcccaacgcctggttcatcctctgtgcttcgagtgagctgggagacaagcccctggcacgcacgctccagggctcgcccctggtgctcttccgaggtgagggcggcaagcccgcggccctggtggaccgctgcccgcaccgcaacgtgccgctgtcgctgggccgggtgaaggaaggccagctccagtgcggctaccacggctggcgtttcgacggcgcggggcagtgccgcgccatccctggcttcctgggcgagcccggcgcgcgtgctcgctgtgccacggcgcatgccacgcgtgagcaggatggcttcgtctgggtctactccacgccgggcgtcgagcccaccacggagccctaccgcttcccgcttctggaggcgcgcgaatacaccaccgtgcgccgcacgcttcgggcccccggctcgctgcactccacgctggagaacacgctggacgtgccccacaccgcgtacctccatggcgggctgttccgcaccgaggagaagcggaacgaaatcgacgtggtggtgcgccggagcgcggacaaggtggaggccgagtacatcggcgagccgcgtcccagcgggctcgtgggccggctgctcgcgccgggtggcggggtggtacagcacttcgatcgcttcctgatgccctccatcgcccaggtggagtaccgcattggtgacaccagccacatcatggtgacctccgcgatgacgcccgtgtcggactgggacacgctggtgtacgcggtggtgacgttccgtctgccattgccccgctggttggtgcgcgcggcgctcccgctcctcatgcccgtggcgctccactgtagagcac

SEQ ID NO: 1029 - DNA, 12730 bp, Myxococcus xanthus
  unsure (1)..(12730): unsure at all n locations
ggagcccgagcctgctcccgagcccacggtggcgaaggcggagccggcgtccgcgagcagcgaggcgtccccggtggccggggtggtgggtggcgtggtcgncggcgtcgtgggtggaacgcagggcggcatcgtcgggtcgacgggcattggcggcacgggtgacgcgctgacgctcaagcaggtgatgcggccccccacggtcctcaagcaggtcaggccggactacccccggctggcgaagcagcggaacatccagggcgtggtggtggtgcgggtcatcgttggcacggacggccgggtggagcaggagcacacccaggtgatgcgctccgtgcccgccctggacgctgcggcgattgccgccgtgaatcagtggcacttcacgcccgcgctgggccgttcggggcggctggcgcgagtcatgatcgacattccggtgaacttctccctgaagtgagtctggcgcggtgtcgcgccgggttcgctccagttctcctcgcgtgggctccggcccgcgctggagccgtttcatgcgcaccttccgaaacatcctcttctggattcatctcatcgtcggaatcgccaccgggctggtgattgcgatcatgtccttcacgggcgtggtcatcgccttcgagaagcagctcatcgaatgggcggagcgggatgtccggacggtgcagtcgccgtctccaggcgcgccccggctccccgtggaggaactggtcgagcgcgtccgcgctgcgcggacggacggacagccctctggagtgacggtgtatccggagccgacgtcctcggtgctcgtgagcatcggccggggctcggtgacctacgtcaacccctacaccggcgaggtgctggggaatggcgcgacgggcctgcgcggcttcctccaatggaacgtggagctccaccggtggctggccgccggcggtgacaaccgcgcggtgggcaaggcgatcaccggcgcgagcaacgccgtgttcctcttcctggccatctccggcctgtacctgtggtggccgcgcaagtggacgctgcgcgccatgcgaccgtcgctgtggttccggcgtgggctgaagggcaaggcgcgcgactggaactggcacaacgtcatcggcttctggtcgctgccggtgctcatcgtgctcacggcgtcgggcatggtcatctcgtacaagtgggcctccgacctcgtctacacggtgatgggccacgaggctcctgcgcggcaggggccgccgggctcggcgacgatgaaggtgcccgcgcccggggtggagacaccgcgcaagccgatggacgtggtcatcgccgaggcccagaagacgtcacctacctggtcctccgccacgctgcgcctgggcagtggagcgcgtccgggcggtgctcccgcacagggtggtcgtggtccggacgcgaagggcgagcggggcgagaaggggggcgcggcacccgcacagggtggccgtggtccggaggcgaagggcgagcggggcgggaagggcggcgcggacggtgtggacgcggtgacggtcaccctccgcgaggcggatgcgtggccgctgttctcctccaagcaggtgtccctcaaccccttttcgggcgaggtggcgaagcaggagacgtacgcggactacaacagcggccggaagctgcgcacctggctgcgcttcctgcacaccggcgaggcgctggggctcatgggccagttggtggccgccatcgcgtcgctgggcggcgtgttcctcgtctacacgggcttcgcgctgtcgtggcgccggttcttctcccggcgccggacgaacaccgagcctcgggaagaagccgccgcgcagtccgagccggtggcctgacggatttcagccctcctcgtgagcgtgacgggttcgctcgtcattctcccactcacgaggcgggcatttccctttgagtcggaaggtcagctccggtccttgcggacgagcaccttcttgccgcgcagggtggcgttcttcaacgcggcgatgatgcggttggcgtcggactccggcacctccaccagggagaaggcgtcgccaatctggatggcgccaatcttggaggactcgacgcccgcttccccggcgatggcgcccaccaggtcggcggggcgtacgccggcgtgacggccggcgccaatccacaggcgggtgacgtcccacgtcggcgggccaccgcgggccttcgggccgcgctccggccggcctggacgccccgtgggcgctccgaacttgcccgtgcgctcacggcgctcctgcggcggcgcgacgacggggatctccgtctcctccgtgtcgcggccctcgtcctgggcctcatggaggagcttcacggcggcggcggcgatgtccatggcgtcgaactcgctggccaggctctccaccacgttgcggagggagtcgtactcaccggtcaccagcgtctcgcgcagggatgcgcgcagcatctcctgccgcttctcgcgcatgtccgcgacggtgggcacggtggccacttcgatgcgctggccggtgacgcgctcgatgttgcgcagcaaccggtgctcgcggggctccaccagggtgatggccacgccctcgcggccggcgcggcccgtgcggccgatgcggtgcacgtaggcctcgggcgcgttggggacgtcgaagttcaccacgtgggacaggcgggggatgtccaggccgcgcgccgcgacgtcggtggccacgagcaggtcggtgccctgggacttgagctgcttgatgacgcggtctcgctgctcctgcgtcatgccgccatgcagggcgtgggcgcgccagccacggccgttgagggagacggtgaggtcgtccacctccgtgcgcgtgcggcagaagatgatggccgcggtgggcgactccacgtcgagcaggcggcccagggtggcgatcttgaaggcgcgcggcacgacgtaggccgtctgccggacgcggggaatctccccctgttccaccttctcgcgggcgatcttcacgcgcacgggctcgtgcaggtgacgctcggcgatgctggcgatgcgcggcgggagcgtggcggagaagagggccgtctgccggtcctcgggcgtgccggagaggatggcctccaggtcctcggcgaagcccatgtcgagcatctcgtcggcctcgtcgagcacgacgacgcgcacgtcatcgagctgcaacgtgccacggcgcaggtggtccagcgcgcggcccggcgtggcgacgacgacgtccacgccgcgcttgaggacgcggagctgctggccaatgacctggccgccgtacaggggcagcacggagatgccgagcttctggccgtagcggtggatggcctcggagacctgcatggccagctcgcgcgtggggaccagcaccagcgcggacgtggtgttgggccggcacgcgccgggctccacgtggttgagcaggggcagggcgaaggcggccgtcttgccggtgccggtggcggcgatgccgagcaggtccttccccgcgagcagtggcgggagggcggcggcctggatgggggtgggctcctcgtagccgagcgcgctgagcgcctcgacgagcgcgggcttcaagcccagggaatcgaaggtggcctcaacgggggcggggggctggggggctttcacggcccgggcttgtaccaccagcaatggtttggtgcgctcccagaatggggggaggccactccctgaacagttgggcccgtgtttgcacgtcttcacgctgcgtcctgataggtgcccgacgcccggggcctcagtccttccagagcaccttccacgggtgcttgcggaggtccgtcaccagcatgcgcagctcctcgtagagcgtgccgtcctggagcaccgcgcccgcggtgccctcgccggcctcgagcttcgccagcacccggtccgcgcgggccgcgatgctctccaattgtcctgaggccgaggtgaggcgctccagcgcgaccttgacccgcgcgccatcctcgggccccagcgcccccgtcacggccgccagtccgtccagcgtcgtcccggcggacttcgtcagccccggcaggtcgcggcgcacgacggccgctgccgccgaggcatcgtccaacagccgcgcgcccttgcctccaggctggaaggcctcgcgcgcgagccccgcgagctggcgcaagtccttcgaggccgccgccagctcggacgccagcaccttcacgtcgccccggttctccgtcagcaactggtccagcgtccgcgccagccgggagacgttcgccgcgaggccgcggatggcctccgggtcctcctccagcatctgggacagcaggtccacgaagcgagtgagctgctcggccaggacatccagccggggcgcgtccgttccccgcacggccgtgcctgcgggcagccgctccggcgccgagcccgggttcagctccagatagggctctcccaggatgcccaccgtggccaccgtcacgcgcgcgtccttgcgcagcgcgcccacggcctccggcgccaccgcgagctccatcctcacaggcagcgggcgtccctgggcgtcccgccgctcgggttggagctggatgtcctgcacgcggcccacctgcacgccgcccagcttcacgggggcgcccttcaccacgttccccgtgtggccgaagtccaccgccagccccgtctccgagcccagcttcaattcgcccatcagccacagcaacaacagcacgcccacgatggcggccagcaccagggcgcccaccttcagctccaaccgtcgctcatccatccgtcgcgccctccatgaatggcgctgtcagtactcgcagctcgggcgcggaggactccagaaagcccttcggcgtgcccaggtaggcacattgcttgttcgccaccaccagcacccggtccgccagcgccttcaactgccggtagtcgtgggacaccaccatccccccaaggccccgcgccttcagcgacgcgagcgcctcctccacctggcccgccgccttccggtccaggcccgtcgtcggctcgtcgaagaggagatagcgcggcttgagcaccaacgcccgggcgatggccgtccgtttcttcgctccgggccccagctctggtggcagccggtccgcccagtccagaagacccacctgcgccagcgcggcgtccacgtcgtccacggacgccgccgggtccgccagccatacgttctgccggagcgtgcgccagtccaacagcgccgggccctgcaccagatagggcgcctgtcggcgcagcggcaccagctcgcgctcgggcctggagtccacgcgttccccccacagcaccacttcgccggcgtccgggcgcagcaaccccaccgccagccggcacagcacgctcttcccggtgccactggcgcccgcgatgaacgtcagctccttcgtggacacctccgccgtgagccccgcgagcacgcgccggcgtccctcgtcgaacgcgacgtgcacgtcccggaatcgcagggcctcgctgtcgggaaggggcgtcatgcgtggggctcgctcacaggcgcagcagttggaaggccagcgacacggcgaggtcgatgagcaggcatcccaggctcgccgccaccacgccgtcggtggtggcctcacccacggcctcggcgccgccgcgcgccttgaggcccgccaccgccgccgccagcggaatgtagagcccgcagcccgcggccttcaggagtgcggccagcaagtcccagccgtccacgtagcgcggatccatgaaggcccgcccatccacgccgaaggcgaactgcgccacggccgccgcggacagcgtggccgcgatggtgcccaggatgcacagcaggggcacgcccatcacacccgcgaacacccggggcgcgacgaggtccgcgtaggggtcgcccgcggacatctccagggcctccacctgttcgttgacgctcatggtggacagctcggccgcgtgagccgcgcccgcgcgtgaggccgtgagcagcgcggacaccgccgggcccagctcgcggatgagcagctcgaagtacgcgggccccagcaccgccacgttgcccacgaagcgccgtgcctggctgttggcgatggtgacgagcaccgcgccgaagaaggccatgccggacatcaccagccacacgctgcgcccgcccagctcgtggagctgcgccagggactcgcgccagggcacgccgtcccgggtggaggcgcgcaccgtgcgcgccagcatcaccaccggcgctccgaagaacgacagcacgccgttcatcccatccaccccgcgagcaaggacgtgagggcgaagtcgaggacgaagatgggcgcgcaactgcgcaccaccgcgttggccgccgcctggcccacggcgtgtgcgccgcctcgggcggacaggcccacggtggtggacagcagggcgatggccagtccgaagatgcccgtcttcaccacgccgcccaggaggtcgagcggccccaggagctgggagaaggtgccgaagaagacgcgcaccggaaggcccagggcgagcagggcggccacggactcgaagaggatggccaccgcgaaggtgacgccgctgagcgccagcatgctgacctccatggccaccacgcgaggcgcgacgaggatggcgaaggggtccaggccgatgcctctcagcccttcaatctgtccgcccacctgcatcagcgccagctccgccgcgtttcgcgcgccgagccgcgccgacatgatgaggcccagcagcagcgggccgaactcccacagcacgccatagcccgccgcccagccgaggaaggcccgcgcgccgaagcgctggacgtagatgcccgactgcagcaccacgatgatgccggccagcgccgctgtggccagggcgagcggcagggagccgtagccgaattgcaccagcgcacggcccagctcgcggcgctccagtttcggcagcgccagcaccgtgcggcccacgaccaggcccagcgcgccggttccgcggagcgcgtccagcgccgttcgtccgagcctcgtcaggagcgccatggcggcatctcatccgggtgcggactcggcggcggcacggctgtggtcacgccctccgggtggcgcgtcatggcacctcgatgagctcgcgcacttcgcgtcatgccggcacctcgtccggtgcatcctcccactcgggcgcggggggcccgtcatgaaccagccggccgttccgcaggtacagccagcggggcaggggcaggtccatcggagcctccgtcgccacgaccagcagcgtgccaccctgggacacgtccaggagcacccgggccacctgccgcgccgtgcccggatccaacccggcgaacgggtcatccgccagcaccaccgacggacgcgccgccagggcccgcgcgattcccgcgcgcttcttcatgccgccagacaggcgctccggcagtgtacccgccgcgtccgcgagccctaccgcccgcagcacgtcactggcgcgggcccgggcctcggcctccgggacgtggcggcgggtgagtggcgccatgacgttctccagcaccgtcatcgagtcgaacagggcgtccgtctggaacaccatgccgaacgatgcctgctgctcgcgccgctcggcggccgtcagacgcgccgcatcctgcccatcccacagcacgcggccctccgtgggccgcaccaggccggccagggccttcaccagcgtcgtcttccccgcgcccgagcgccccaggaccagtgcctgcgtcccgggcggcagcgcgcagctcacgccggacaggacctgcctcgctccgtaccgcaccgtgaggccgtccgcgcgcaggtccatggtgtccgtccgcccgccgtctcagggccgccagcgcacgagcgcgccgctgtggcccgccacccagacgtcggccgggccggttccgctcagcgcgttcatggggctggacggcgcgaaggcggtgctccaggccgtgccgttgaagaagtggatgttgttcgttccggagctcacggcgtagatggccttgctgccgaaggccaccagtccgcggatgtccgccggggccgaggttggcagggtgatggcgggcttcacgctccacgtcgtgcccgcgcgctccaggaagaggcctttgtcacccacggcgtagacatggctcggtgagagcacctggatgccgaagaggaattcggtcgacccgacgttgcccagggcttccttctgccacgtgccgccgtcctccgtggggccgcgccagaccacggggtggttggtgccgccctgtgcctcggcgcccgcggcgaacagcgtccgcgggctggtgccgtcaatggacttgaggttgtcgttgagccgcgtgagctcctcgggggccgcctgcgtgggggcgccctcctcgtagttccagcggaggatgcggccctggctgtccaccgcgtacagcgccacgctgttgccgctttcgaagcccaccatcccgttgatgctggcgctcccggggccattcacgttgacacacgcgccggtgtcggtcggcagccgggtggtgaacttgcccgcgctgttgcccaggaacacgcggccgctgttcgtcacccaggaggacatccactggcccgggcagtccgccacgggggtgagcgtcccgccatcgacgtgggcgacatggccgtcgcgtcccgcgagccagcccttgttgccagggtacgcagccaccgtttcccagacaatcgaggagggcgtcgcgttcgccgtcgtccaggccacggtgtcgcagcccgccaggtcttcgtccacctgtccgtcacaatcgttgtccagccggtcgcacacctcggtggccgtgttcgacacgaagcgcgagctctcatcacagtccgtgttgtcctccacggcgtgctgcggcgggttggcgcaccagagccccacggaggtgcccgcctggccgtcaccgtcctcgtccacgaaccactcccgcggcgtctcgctgctgacgcaggtcgtcagctcggtgctcgcgcactgcttggacccagcgcagttctgctcggtctggcactgcgtgcccacatcgaacgggtcgttgtcgatgaacccatcgcagttgtcgtccctgccgtcgcagacgagctcggtctgtctggggtggatgttggggttctgatcgttgcagtcaccggcctccaggacatagcccgcgggaggcgtgcaggagaggttgggcagggcggacgggtcgccgaatccatcaccgtccgcgtcgcggtagtaggtcgcgccgccgggggcatccgcttcgccgttgacgcagttgttgtccacgccgtcgcacagctccgtcgcgccggggtggatggccgggtcgtcgtcgttgcaatccgagccagggaaggcgccctcgctggtgacgtagccgtcgtcatccaggtccagggcgcgcaggtcgagctccacggtcgcggtgcccaccgtgggcacctgcgtggtgacctcgtgccgtgccaccacgggcccgttgcaggagcgctcgttggcggtcgcggtgagccgcaggttccggctccagccctcacggcccaggatggccaccgtccgcacgtcgctgcgggcagatggctccatccggatgtcggcggtctcggtgcggctgggttcgtccacgtccgtgacggtcagcgtgagacagcccggacgaaacgtcgcatatgagacgagcacgcggacggccccggcattgggtgggttttcctgcttccggcagccggaaacggagaccaccaccgcaagaacgcaacccatcaggaataaacgcatcggccgagcattcccgggcgcttggtggcgcccgcaatctttctacagtgagctacggaacccaggagaacccgacgccacccatagtctgtcgcgcaggccagcgtccagacgccgaatcgtcatagccccttctctccacctccgtttatatggcgcgccccccccgacgcctgagccatccccgcctgttcatgcatagaccccgtcacgccatcaccgtgcctctctgcgcctggctcgccctgaccgcgtccagtgcttcggggcagcagcccgcgaccgaggggggcgcacccgccgcctccgaatccacgaagggtgccccagcaagtcctccgcccgcggaatcactgtccacggaaggtggtccgctgacgctggaacaggcggtgcagcttgccgcgaagcgtaacgaggtggcgctggccgccgagcagcagtccgaggccgcccgggcccggctggctcgggcccgggccttcttctttccagagctgacgggaacgggcacctacacccggcgtctgaatgaagtgacgcgcgaagtgggtggccagacagtggtcatccagcgcaacaacgccttcaacgccaacttcgtcgcctccctgccgctgttcgacgcgcgcggcatcttcctgtaccgcgcggcgcggagggacggcgatgcggcggagctggaggccgtggaggcgcgccggcagattggcttcgaggccgccaacgccttcctcgccaccctggcccaggagcaggtgtaccgcgccgccgagcagcgcctcgcgttcgcccgccagtcacttcaggacgcatcggcccgcgccaaggcgggtctggccagcagcaacgatgtgacgcgcgcggagctggaggcggccagcgccgaggtgcagatgtccaacgcgcgcaacgccgcgcagaccacgcgcctggagctgggcttcctgctggtgtcttcggtgaagggcaccctggcctcgccggacgtgctgctgtcggacgccagccggccgctgcaggcccacgcctccctggcggatggggccctggaccgccggccggacatcctggccgcgcggctgcgggtggatgcgctggaggagagcgccaaggagccgctcgcccggctgctccccacgctgggcgcgtccgccacctaccgcctcacgaacgaggccggactcgcgggccgcacgggtgacggcttcctgggcgtcaacctcatctggaacttcttcgacggcggcgagcgctatgccgagcgccgtgagcgcgtggccctggcgcgggcggcggagctccaggtccaggccaccacgcgccgggtggacgtggacatcgagcaagcgagggtggcgctggagaatgcccaggccgccctggcacagagcgacctggcggtccgcacggcccggcagaacgcggaggagcaggggattctctaccgtcagggcctgtccacggcgctgacggtggcggacgcctcgctgcggcagttcgaggcggaggtggcgtatgcccagagccggttcgcgctgggcgtggcgctgctggggctgcgggcggcagtcggactcgacccattggggaaggaaccgtgaaggacatgcgacgcgcaggaacgttgggtctggccgtggccgcgctggccctggcgactgactgcaagaaggacgcgcaaagcgcccaaggcggagcagcgccggcaggtcgcggccgagcaaccatccagttccccgttgaggtggctccggtggagtcgcgatacgtgaagtacgtggtgtacacggtggcctccgtgaagcccttcgaaagggtgcagatcaccgcccgcgtgccgggcgccgtgtagtgggtgctcttcaagtaagggcagtcgctataaaggggcgcggtgctcgcggagatcgagtccgcccgcagcgccatcaccgtccggtccgcgaagaccgcgctggcgcgagcccgccccacgctggtgaaggcggaggccggtgagcagcgccgcaccctggtgaaccaggccagccccggtctgctgcccgccgagcagttgcagaccttcgaggcgcgcgcgcgcacgctggagccggacgtggcgccggcgaaggcgctgctggaccaggcgcagctcaaccagcgtgacgcctatgtgcgcgcgcccatggacggcgtgctccagacgcgcacggtgcagacgggccagtacgtgcagcccggcatcgtgttggccacgctgctgcggcgcgagccgttgctgctgcgcttcacggttccggcggcggacgtgtcccgcatccagcccggcatgacggcgcgcttctccgttcgggccgcggagggtggctctttcacggcgaaaatcacacacgtggccgccgccgcggatgatgccagccgcatggtgccggtgacggcggaagtcaccggtgaggacgccgagcggctccgtccgggcgccttcgccacggtggcggtgcccgtggatacgcgcggcggcagtccggtgattccgcagacggcggtgcgcgccagcgaacgcggcttcctggcctacgtggtggagggcaacaaggcgcgtgagcgcgtgctggagctgggcctgcgcaccgcggatggccgcgtggaggtccgtgacggcgtgaagcccggtgagctgctggtggtgcgcggcggtgaggccctgcgcgacggggccaacgtgcgcgtggcggagggacccaaacccaccttcacgggtgagccccggctggagccggaggccgccagcggcggcggaggcgcccggcaatgaacatcaccgaggcgtgcatcaagaagcccgtcctggcgtggatgatcatggcggccaccatcgtcttcggggctgcttta

SEQ ID NO: 1030 - DNA, 10593 bp, Myxococcus xanthus
gcgtgctggcgttgaacaggtcgatgccctccggcgtgagctgtggaatcagcgaggtgtcgttgcccacgtcgctgaggaacttcgacaccgcgtcacggcgctccgaggagaagtcccccaggagctgatcatagagctggtccagcagcgtgggcttccacccgagctggtcatccgcccgcgccagcaggtggccgaagcggaacaccacgcgcagcggcagcctgccgaagcgcagcacgtagacggtgaagagcgacagcagcttgaggatgcgctgtccgaaaaggcccatgaagaacgtggccagcggcgtgcctgcgtgcggggtggacacggacgtcacggtgcgcacgcgcctggcgaagggctccaggtccacgccctccgccacctgcgcgccggggctgacgaacaggcgcgagtccagcccgcccgtcgagtggccgatgaggtggatggggccgtcgtctccggacgccgtctcctgcacggccttcagcaggtccgcggtgcgcgtgcggatggaggccgtggggtgggagaggacgatgatgacctccgcctccacctgcctgcgggccagctcgtccttcagatagtccagggcgtggccgaagtagatgagctcgcccaggttgatgaagccgaagaaaccggggacgaggtagacgcgatgcttgcctggcattgcctccagcatatctgacgcggcgcatgatacccgtggggaatgcatcctccgctcgggggttgacgcgcgccggccgtcaagtccagaaccggcaacccccactcccagtcatgacagaaggacgcccgcacgtggatcgcagactgctcgcactcggcctgcttctgtccctccccgcctcggcggacgagggaatgtggacctatgacgcctttccctccgacacggtgaacaaggcctacggcttcacgcccacgcaggcgtggctggaccacgtccggctcggctcggtgcgactggccggcggctgctccgccagcttcgtgtcgccagagggcctggtgatgaccaatcaccactgcatccgcggctgcatcgaggacctgtcctcgccgaagaaggacctgctggccaagggcttctacgcgtcgagcgccgcgcaggagctgcgctgtccgaaggtggaggccaaccagttggtggagatgacggacgtcaccgcgaagatgaacgcggcgacgaagggcctcaccggcgcggccttcaacaccgcgttgaagaaggagacggccgcggtggaggccgcctgcgccacgtccggagacgtgcgctgtgacgtggtgacgctcttcaacggcggcaagtatcacctgtacaagtaccgtcgcttccaggacgtgcggctcgtcttcgcgcccgagttctccatggccgcctttggcggtgacccggacaacttcaacttcccgcgcttcggcttcgacgcggccttcctgcgtgtgtggcaggacaatgcgcccgcgaagagcccgcacttcctgccgtgggcgaagcagggcgcgaaggagggtgacctcgtcttcgtctccggccacccgggtggcaccgagcgcaaggcgaccgtcgccgagctggagttccagcgcgatgtcaacctgccgtacacgttgctccagctcgccgagctgcgcggcatgttgcgcgagtacgccgggggttcggcggagcgctaccgcaccacgcgctccatgcttcgcggcgtggagaacggcctgaaggcgctgcgcgggcggcaccagtcgctggcggacccggcgctgctggccggcaagcgtcaggacgaggcggcgctgcgccagaaggtggacgccaacgcgcaggtgaaggccgccaccgacggcgcgtgggatgaaatcacccaggcgttggatgcgtaccgccgcatgctgcccgactaccgcatgaaggaggccggggacgcctatccctccgaactcttccgcatggcccggcacctggtgcgcgtggccgaggagaaggagcggcccaacgcggagcggctgcgcgagtacacccagtcccagctccccacgctggagcagcagctcctgcgcgacgcgccggtgacgcccgagctggaccaggcgctgctgaccttcggcctcacccgcgtgcgcgagacgctgggcgcggatgacccctttgtccagcaggtgctcggacgcgaggcgcccgccgacctggcgcgcaccctggtgcgtggcacgaagctgcgggacgtgaaggtgcgcgccgcgctgctcaagggcggcaaggcggcggtggaggcctccaaggacccgatgattctcttcgcgcgcaaggtggacgcggaggcccgcgccgcgcgcaagcgctacgaggacaccgtggaggcggtgctcaagcgcaatggcgagcgcatcgccaaggcgcacctcgcggtgtacggcacctccggttatccggacgccaccttcaccctccgcctcaacccggggcaggtgaagggctgggatgagaatggccgccccgtggccgcgctcaccacctttggcggcgcgtatgagcggcacaccggcaaggagccgtacaagctcccggacacctggctgaaggcgcgcggcaaggtgccgccccagacgccgttcgacgtggccaccaccaacgacatcatcggcggcaactccggctcgcccctggtggaccgcgatgggcgcgtggtggggctcatcttcgatgggaacctgcactcgctggggggccgctatgcctacgtccctgagacgaaccgtgcggtcgccgtgcacggagagggcatcctggcgggcctggagcacgtctacggggccaggcgcgtggtagacgaactgcgcaaggccagcgacgccgcggtcgtgcccgcgaagtagtcgcggttctcaagacctgagaggtcttgtggattggatttgggctttctgaacgccttggccgcagtggccaaggcatgtcagagggagcaggatagaatccggttcaaagctgaaaaccggttactcatggctccctccaaacccaatgacattcccctcggcacggtgctgagggagacctatgagattgcaggcgtcctcggccgaggtggcatggggaccgtcttcctggccaaccacctgcggctgcgcggacggcaggtggccatcaaggtgctgcgccacgacgcgggcatgggggccgaggccttcgtgcgcttccggcgcgaggcggagattgcctcgaagctggggcaccccaacatcgtcgaggtgctcgacttcgacagcctcgaggatggctcgccctacatggtgatggagtgcctgcgcggcatgccgctgtcgcgcaggctgcgcaagggcccaatgacgctggaggaggtgttctcctgcgcgcggcagatgggctcggcgctccaggccgcgcaccgcgcgggcatcgtccaccgcgacctcaagccgggcaacgtgttcctcgtgcccaccgaggtgggcggcgtgatgatggagcacgtgaagttgctcgacttcggcatctccaaggtcatcgactcgcagagcgtgcacacacagggcggcatcctcctgggcacgccgcagtacatggcgcccgagcaggccaccgggaagaacggcgaggtggacccgcgcacggacatcttcgccttcgggtgcctcgtctacgagatgctggcgcgccggcttccgttccgggacaacggcaaccttccggagctcatctaccgcatcgtctatgatccgccggagcccctggaggcgctggtgccggacctgccggaccacgtcatcgcggcggtggagaagtcgctggagaagcgcccggaggaccgcttcccggacgtggccagcttcatcttcgcgctgacgggacgcgcgctccagacgatgggcgaggtgccgatgctcacgccgctgagcacgccgaggctcgcggtggagctggctccggagtcgaagccggagacggtgcccggcaggcgctcgggacgcggcacggaggacgaagacgtcgacgtgaatcctccggacgcgaacccgcccttccgggagtcggagacggtcagcctggccgcgccggcgcccgcggtggccccatcccacgacgccgcgaccatcgccgaggcgatgcccttgccggagatggaggcgcccccgcctcggcccgtcgtcgcgcccgcggacgtcgtgcccgcgcccatcgcccgttcgcccgtggggaggccgccctccgcggcgcctccagggccgagcgcccggaaaccgacgcctcgggacggggctgtggctggggcccaggtgccagacgaaggcgtgtcggcgtctcgggggcccgagaaacccctcgcgcctgctccgttgccgcgcggcgctgacgctgctccacccgtacgtccgccagcagggggcgcgcaggccggtgccgcgtcaccgaaggtggtccccgcgcccatcgcgcgggcgcccgtggcaggcggcccctccgcgccggtcgctgcccggaatgggccgccctcgccaggcgagggcgcggtggggtcgaccgtgttgctgcgctcgaaggcgggcgtggcccagtccgcctcgccaggcgtgctcgcagcgcagccgaagcggaagctgactccgctcacggtggcgatgatggtggcgctcgtcgccgccgtggccttcgccgtgtggccacggccggatccacgcgtggaggcgtccggaaagcacgccgtgcccgctgctggcgcggagtagcgtcctccttacgtggatgcgtcaggcgcgatgaccgagagtgcctcgagttcgaggccgtgctcgggctgaatccagaacgtgcctcgcccctcgggcgaccagccgagccccctggccagcaggatagcctcgcgggcgtcacgtggcagggcagccgagtcgtccgtcatgccgttgcctttcccttcgagattcaccgccagcgtgggaccgaccttccggtcctcctccgtctggaaccaggcgcgaatgcggacgacccggacgccggacacgtagcgccagtccccggcccacgcgtacgccatgccgtcgaccaccagcttccggtgcttcttcttcacggtactgaaccctccagcgctcttcgaatatcagcctgacaggaccgtggggccgtgccctgtcaggactcggaccgaacccgacctgctgagttcgaggcccgacacgcccggacaggacgcaacagggcgttggtgcggcgcgtcagggaatacgtatcctgaagaggactgacacgtcggttcatgtcatgtccaacaccgagcgtatgcgggcacagggagggcaaggggccctcggggggagcctgtcatcgccggtggacccaccgtgtacggccgcgtccccccggggcggacggccgtccagggcccggttccagccgagaggggggctcggctgggaccgggggccctgtgtgatgtagcatcgctgacagtgccggggggaaaggggagatgcgcgatggtggtggaggctccagaacccgggaaactatcggcgattctcttcacgggcattgaaggccctgatgggctctcatggcgtgacgaatcgctccagaacgacatgcgggatgagcatgcgctgctcgtccgtgagttgttgccgcgccatggagggcgtgaggtgaagcggctggaggatggcttcctcctggagttcgaaggcggcccctcggcggtggacttcggtctggaattgcagcgcgtcctggacgcccgcaacggagacgtgtccgccgagcgccgggtcatcttgcgcgtgggtgtccacctgggcatggtggtccaccgagacggtgatgtgtttggagaaggcgtcaacctggccgcgcgcatcgaggcgctggcccgtcccggcacgctctatgtcagcgagacggtggcgcgtcaggtggaaggccgcctggcttcaccgccggttcgcctgggccgtggtgagatgaagaacatccggttgcccgtggccgtctaccgcatcgacccgcccgagcaccgccgccggatgccgctgctgtcgcgcatgcgttccttctgggggcgccggagcgcggcgaactgacgcgcacaagcgcgggcaggcctgggcgagcggcgttatagaggccgccccatgccccagctcacacttgtcgtcggttcgaagaactactcatcctggtccctgcggccctacctcgcgctggcccacacgggacagcccttccaggaggtggtgattccgctggctgttccggacacagaggaccggattgcccggtactcccccagcaagcgcgtgccggtgctccagcacggcgacctgaccatctgggactcgctggccatttgcgagtacctggcggaggccttcccccaggcccagctatggccccaggacatggcggctcgcgcggtggcccgcgccgtcaccgcggagatgcactccggcttcggcgcgctccggcagcacatgaacatgaacctgcgcgcgcgcagcccgggcaagggccgtgcgcccggcgtggcggaggacatcgcccgcgtccaggccctctggaatgactgtcgcgggcgcttcggccagggcgggcccttcctcttcggccgcttctccatcgcggacgccttctacgcgcccgtcgtcacccgcttcgtcacctatgacgtggcgctggacgcggtgagcgcggcctaccgcgacgcggtgctcgcgctgcccgcgctccagaagtggaccgaggaagggcggagcgagcccagcatcccgaagtacgactgagccttccgcccagcgcgctacttgctcgcgggggccggcttcacctcttcgacccgggtggcgccatccttgtccaccgcgagcttcaagtggggcgtgcccttcgcatcatgcaggacgatgctcgccacgccctcctccacgccgatgacgatgcgctccttccagtcgtgccggaaggtgatgttgggcttgccctggataagccccatgcacatcgcctcgtagccttcctcgctgtcgaagcagagggcgttgatgccgatgctgtcgagcatcccgagcccgccgacctcctgcccggacgcattcatgaactggatgccgtaggccttcaccgcgcgcttgaggcccttggggtcgggcatgggcgccgcgatgcggatgcgcgcctgtccgtgctcgtcgacgatgttcagctcacgcacggacagcgacgcggcagcgggggcggtgttcacgctggtgcacgcgccgagcagccccagggtgcagcaagccgcccacatcgacagccgggggaggagggaagaggacatcacgagcagacctttcggaggacgtcgaggagaggacgccaccgtagggagcccgcacaccgccagggccatggcggtgcggtcatttcgtcacgctttggtcatggccgtcagctcagcgcgccgtcgcgcacgcgcgcgaacagcgcgtcgtagcggccttccgcgtagagccgcaccagctccgggtagcggccctggcgcagctcgcgcaggtacgcgtacttcgtggcgtggtaacccgccaccgcccatgccaggcgggaggcctccgcgccgccgcgccacagcgcgcccttcagcagacagtcgcgcgcccaggacgccaggcgctgcacgcccacgggcttgaggccgcgctgctcggcatgggcgcgcagggcccacagcaaggcatagcggtcctccttctgcgcgcggtactccaccgacgtggcgaagcggtgctcgatgaaggcgcggacgcgtccgcccgccagcttcggcagggcctcgtggacaatctgctccggccgccacacggccttgtcccggcgcaccagccgcgcccgccactgcgtgcggtagcggaagcggtgcgtccccagctcagcccagtcgcggcggggcagccggtacacggcctccgtgggcgatgaggtcttccacgcgcgcagtgtctccaccgcctcggggcccagcagctcgtccgagtcgaggaagaagacgtagttacagggcgccagggcgttcaccgcggcctcgcgcgcggcgccgtagcctcgccacgcatggggcacggagcgcgcgcccagcgaacgcaccagctccgccgagccatccgtggccccggagtccagcgccaccacgtcatcgcagagcgccagcagcccgcgcaggcacggctccaacgtgtcccggttgttccggtggaggacgtagccgcccagcttcatagacccagtgccttgagctgcgcgtcgaaggcgtcagcggtggtgaagagccggccttgaatccccacagcctcggcggcctggacgaactcggccaggtcgtcgaagaagacggcctcctccggggcgcagcccacgcccgtcagcgcgagccggaagatgtccggctccggcttcacgtggcccacctcgcagctcatcaccacgctgtcgaagcgctggagcaccggcagcagcggacgcaggtaggcgacgtgcagcgcgttggtgttggacaccagccccaggcgcacccggcccaccagcgactcgatgcgcggcagcacggcatcatgcagcgtgaagtggctgctccacagcggggcgaactccgccatgggcaggtccacgtccagcgcgcgacacacgtcctggcggatgccctccgcgcccagcacgccccggttggcgtccgtccaccccgcgcccgtcagccgccgggccacctccgcggcctccaggcccgcgcgggcgcccagccgggagaagagcagggtgttgtcgtggaagacgaggacgttgcccaggtccagcagcactgccttcacctgcgccatgcatgctccttcaaatgcgataagcgcgggccacgtcctgcatctgctcggacacatcctggagcagcttcgccgcccgggtggtggccgccaggctctcctgggtgtcgttcatcatggaggacaggtccgtgaccgcgctgaaaatctgggcgatgcccgcgttctgctgactcaccgcgccggcaatctgccgcaccgcggtggcgttgtcctggatgatggcggccagctccttcagtcgctcgccggtgccgcgcacctgctccaggccgctctccatatgcgtgtagctctgctccgtcatcttcgcggtggagaggatggcgctgctcaaatcgcccaggatttcgcggacccggtccgtggcctggatggactggtccgccaggctgcgaatctcgcgcgccacgacgccaaagcccttgccgtgctcgccggagcggacggactcgatggcggcgttgagcgccaacatgttggactggtccgccaggtccttcacggtctgggtgattccgccaatctgctgcgtgcgctcgttgagctgggcgatgcgctccgtcatctgctcggcctgggacaggatttcggagaagccgcccaggctgtcccggatggccccttcgcccgcgcgtcccacctcttcggccacggaggcgcgattgagcacgtcctccgccttctccgaggccagcatcgacgtctgcttgatttcctgcgccgtcacctgcgtctgctggagggccgcggcctgacgggccacgttgcgctcctgctgcgtcgacgccgtctgcagctccgccaccgtctcactgagcacgcgcgtgccggtgtgcaggctctgcgccgtctcccgcagctggaacaccagcaggccgaaggcgccggccagctcgcccacctcgtcgttgccggccttcacgtccagcgtctgcgtgaggtcgccctcgctcaccagccgcgtcaccgccgcgcgcagggccagcacgggaccggagatgcggtgcgacagcagccacgcgcccccgacggccagcacgatgaagcctagtgccatcagcagcgccacccggttcacgcgcaccaccggggcgtaggcctccgccgggtccacgcgcgccacgaagtgccagccgtcggccacgtcgcgcacgtccgtgccgttgacggccgtgacggccagcagcgcgtcattgccctgggcgttcgcgccgcgcgagtcgtacagcggcgtgccgtctggccgctggagggtaatcgcgaagctcttcagggcgcgctgatgggcacgggccagcgccggctgcaccaactggtccacgtgcgcccagtcgaaggcggccagcagcacgcccagccggtgcttggagaccgggtccagcaccgggaaggccagcgacagcacgtggccggtgaagatggggtgctcctcggtgatgccctcgctgctggtgcgcccctgctgggcctccgcgaaccaggggctgcgccgcacctcgtcctgccggcgcaggtattcgtcgcgcagggcaggggtgttggcggagatggcgcggccggtgtcgtcgaagacgacgatgccgttgagggtgaggtagcggctctggagcacgccgagcatggcgtcggcgggcgacacgtcacctcgcagcgcggcgcggaccgcggggtcctcggcccctgagagca

SEQ ID NO: 1031 - DNA, 10835 bp, Myxococcus xanthus
gcgcggctgcccgtggtgcgtcctatcccccacaccctgcccaccttgggcaccgtccgcgacggactgctcgacggcctccaccgcgccgtggcacccccgccccatgaagggcccaccgtgccccccctgacgaccccgtctcgggaagcactcaccgcagtgctcgacgcgctccaggccgcgcggccgacggatgtccgggacaccgccgccttcgagcacctgctgcgcacataccgggacctgctcgccgtcgcgcgcgcggaaggcgagcggtgatgctgtacgcgggcatcgcgggctcggtgctcgtgggcatcctgctgggcctgctcggaggtggcggctccatcctcatcgtgccgctgctcatctacgtgctcgacgtcgagcctcggacggccatcgccatgtccctggtggtggtgggcgtcaccagcgccagcagcgccttcctccacgcccgcgcgggccgcgtccgctggcgcaccgcgctcgtgttcggcgcagggggcatgggcggagccttcctcggtggccggctcaatccccacctcgcgcccgacacgctgctgctcctgttcgggagcgtcatggtggccgccgccgtggccatgcttcgccgccgggaagccgggcccgccgccaccagcgtctccccgctccccgcggcccgcgtgctcgcacaaggcatcgcggtgggcgcgttgtcgggactggtgggcgccgggggcggcttcctcatcgtgcccgcgctgtcactggcggggctgcccatgccagtcgccaccgccacgtccctggtggtcatcgcgctccagtgcgccgccggcctggtgggccacctgggccacctggacctgccctgggtgctcaccggcgaagtcctcctggccgcgatgacgggcagcctcgtgggcggaaggctcgcggggcgcgtgtcccccgcgatgctgcgcaagggcttcgccgtgttcgtgctgaccaccgccgccttcctcctgggcgcccagtctcccgcgcccctgcgtgagcgcgtatggacggaggggctgtggctctggagcgtggcgcctcttgccgtgggcattcccgtgacggtgtggcgcctgcgcgtggcccgccagcgtcaggccgcgcaggccctgccccggtgaggcaccgtcacgtggacgccagcggcacggtgaagcggaaggtggagccgtgccccagcacgctctccacccacagacggccgccatgccgctcgacgatgtccccgcagatgtagagccccagccccagcccaccaaagccggagatgggggcgttgcgagcacggaagaagcgctcgaagaggtgctcctgctgatcccgcggaatgccgatgccttcgtcctggacggagacatgggcgtggcggtcctcccgagccacccggacgcgaaccgttcccccactggggctgtacttgaaggcgttctccatcaggttgaccaggacctgcgcgagccggtccgcgtcgcccaggacgaccaggggtgcctccggcgcttcgtactcgacccggtggtgcgcgctggacaggcgcatctcggagacgacgtcatgggccagctcctgcaacacgacgggcccatgcttcagcgtcagccgcccttcctggatgcgcgaggtgtccagcaggtcattcaccaatcccgtcaggcggctcacctgcatcaacgacttgtccacgtgccgggcggaggccccgtccccctcggcgccgtgttgccgcagcatctggaggtgcagcttcagcggcgtgagcggcgtcttcagctcgtgcgcggcgatggacaggaagtcgtcccgcacgcggatggcctcctgggcttcgcgcagcagccgctcgcgctcggcctcggcctgccgctccgccgtcacctcgcggtagctccacacgcggccgatgatggcgccccccatccgctgcggcagcgacttgcgctccaggatgcgcccgtccagcaactccaccgtctccacgtccacctcttcggacggctcgaagcgctcccggattcgcgacgtgaacgactccgggtgtttcacgccgcccgccgcgcgcaccagcacccgctccgcgtcgcggtccaccatcatctcctcggtcagcccccagatgtcgaggaagcgcttgttgaaggccgtgacgcgcttgttcaggtccaccacgatgacgccttccgcaatcgagtcgaacgtggcgcgcagcaccgagttcatgtgcgccaggctctccggcgcgtgccgcgtcagaccgccttcggcgacctgccccatcgaggactcaggaagctggaggcgcgcgcaggctcccaacaatgtcccctgctcatcgaacatgggcaggacgaaggccgtcaggcccggctcctcgtgaacaccggccttgccctggagcgcgggctgcatcgcctgcgcgagccagggcagccgagcgagcacctcggccacggaacgcccttgaaagggctctccctgcggcccggtggcgtgagtcagcgcatcgtccatccagagcacgcgtccgtgcgcgtcgacgatgagcgccgcctggagcgcctgccccaatctcagcagcgccggagcgaagtcgggcccgctcgggtgacgggcctcggcagccccaggcgcgccccatccgctccgtccttcctcatagatgtgggccttcgacatgggcgctcctcggcctcgttggcgggacatttccggcggaaagatgcggcgcccgccaagggcatgaaaggggcccccctgctcggccgccaccgccgaaggggctccgactcccaggccgcttgccatgcgaaagcggtaggcttccgccacatgacgacctctcgcctcgcgatgctgttcctggtgcccgtgctggccacgggctgtgcctccaccgctggcgccacccggccagacgagcccgcgacggaagcggcggcccccgaggccacgcccagcgcgcccagcgcgcccagcgcgccctccggctatggctacagcaagaacgaccccatccacgtgggtggaggtgtcggcggcgaacacgaatacctccagcacctgcgggggccagaggggcagaagatccgctacgagcggggaggaagctgctgcgccttcgagtcggagggcgcgccgttcggcagcggcatgctcgacgtgtacgtcgtcacctacgacgggctggaggagccggtgatgctgtacctcaacatgtatgaacggaaggacccgcgcgcccccgaaggcttccgcctggactgacgcgcgctaggagcagtcctcgatgatgggagcggcgaccagcgggcccgacatccattccgacagacacatcggaccgcgtctcgatgtcgcgctggtccgccgccagcacggggctgacgccgcgaatgcagaccagcaggaatccagacacacgagcgaaggtcttcacagccctgaattgtagcaggcatgcgtctccgccgttgaccgctgccagttccgcacggagattccctgcatgacgctgagagccatgaccgacgtgggcgccgagctgggcctgtctcccgaagacgtgctgccgtggggaacccaccgcgccaaggtgtcgctggacgcgctcggcaagcggggcggccggcagggacgcctggtgctcgtgtccgccatcaaccccacgccgccgggcgaagggaagaccaccatgtccgtggcgctggccatgggcttgcgcaagcgagggcgccgcgcggtggcggccctgcgcgagccgtcactgggccctgtcttcggcgtgaagggcggcggcaccggcggcgggcaggccagcctggagcccgcggccgacatcaacctgcacttcaccggtgacttgcacgccatcaccagcgccaacaacctgctgtccgcgctggtggacaacgccgtcttctacggccagccggtggccctggatgccacgcgcgtgcgctggcggcgcgcgctggacatgaatgaccgcttcctgcgcaacgtcatcgtcggcctgggcggcaaggcgcagggcgtgccacgcgaggaccacttcgacatcaccgccgccagcgaggtcatggccatcctcgcgctcgcggagggcctgaaggacctggaggcgcggctgggacgcgtcatcatcggccacacccgggacggccagccggtgcgcgcgcgcgacgtggacgcggcggcgtccatggtggcgctgctcaaggacgcgctgatgcccaacctcgcccagacacgcgagggcggccccgcgctggtgcacgcgggccccttcgccaacatcgcgcacgggtgcagctccgtgatgggcacgcgcatggggctggcctacgcggatgaagtcatcacggaggcgggcttcggcttcgacctgggcgcggagaagttcctggacatcaagtgccgcggcagcgggctgtggccccggggcgtggtgctggtggtgacgctgcgcgcgctgaagcaccacgggggcgcctcccccgcgcgcgtggccgagccggaccgcgaggccctggttcgcggcttcgcccacctggagaagcacctggagtcggtggccgccttcggcctgccggccgtgctgtgcgtcaaccgcttcccgcaggacaccgagtccgagctggaagagctgcgcgccttcggcaaggcccgcggcgtggagacggccgtgtgtgacggcttctcgcgagggggtgacggctcgctggagctggccgactgcgtgctggagatgctggacggtacggacgccgcgccgccccagccgcgcttcctctacgacgtggcgcagacacccgaggagaaggtggccgccatcgcgcgcaccgtctacggcgcggacgacgtggccttcaccgcgagcgcgaagaaggacctggacgccatccgcgagctgggcggcgccggactgcccgtgtgcatggcgaagacgcacctgtcgctgtcggatgaccccacgaagctggggcggccgcgcggcttcacgctcaccgtgcgcgaggtgcggctgtccgcgggcgcgggcttcatggtggcgctcactggagaaatcctcaccatgcccggcctgccacgcgagcctgccgcccgccgcgtcaccgtccacgacgacgggcgcgtcaccgggctgatgcagggggagtgagccgagccccaagccggggtgccacccaggacggtggcacccgcgcggccccgaggcggcgtcagacgcggaagccggtggacagctcatggagctgtcccagcgacgcgttgatttgcgtcaccgcctgctcggccgtcatcgtggccgtcaccacgtccgccatcatggaggacagcgtggtcatcacctcggtcatctgcgcgatgcccgcgttctgctgggtgacggaggccacaatctggcgcgcggcctgactgctctcctgcaccacggtggtgatttccttcagcgtgttggccgaggcgagcacctgctcgatgccctcctccatcttctcgctgtcgccctcggcgatgcccaccgtctggcggatggcctggttgatttcgagcagaatcttgccgatgcgctgggtgctctgcagcgactggccgctgagcgagcgcatctcccgcgccaccaccgcgaagccccggccctgttccccggcgcgcgccgcttcgatggccgcgttgagcgcgagcacgttggactggtccgccaggtccttcacgctgccgatgatttcaccggcatgcacggcctggtcgctcaggtgcgcgatgctgcccaccagcgcgcccacgcgctggcgaatctgctggaggccctcggcgctcttctcgatggactcctggccggacgcgctgaacgcatccgcctgtcccgccacgcggagcaccatctccgcgcggctggcggccatgctggacgtctgcgcgatttcggcgatggtggtgctcgcctcggtgaggctgcgggactgattggtgaggaagttcacctgctcctggctggcctgcgtcagcgtcttcgccgcgttcgtcaggtccgtcaccaccgtctggatggtggtgggcacgttgcgcagccgggtcaccatgacctggaagccgcgcgccagctcgcccacctcgtcgtgggcgctcacgtcgatggcctgcgtcaggtcgcccttctccgcgatgcgcgtggccacgtgggtcagcttcgccagcggcagcgtcacctcgcggtgcagccagtaggccagccccaccgtcagcgcgatgcacaacagcaccagcacgcacaccgtccaggtggtggcgcggtgcagcccggccacctccgcgtaggaggtcgcgatggcctggccatccgcttccacggccctctccagctcatgggacagcgcggcggccagggactccacgctcgcgagcgcggacgccgccttctcgtccccctccaccgcgaacgtcaccgccgccctggagttcgtccagtacgtggccagggacgacttgagttcatccacccgctggcggttcgcgtccggtacggcccccgccaggtcgagcttcgactggagctcgtccacctccgcgctcagcggctccaaccctcccgccttcgccgccaccgccgccagcacgttgcggtgcaggcccgggaagcggtgcatcacctcacggttcagctcgatggtgggaacctgcgaactgctgatgcgcgcgtacacgccaccggagcgcgcgcccagggcgatgaacgccaccaggatggccaccaggaacaccgcgacaacagccggcaacaacatcatcttctgcttgagcttcagacgcacccgctggcctccccgctaccgtgagcccccttcaacgcctgcgactccacgccgcgcgccgcggccagaatccggctgtggaagagccaccccgttttccaaggcccgctgcaccagcacatgtcgccatccttccgtggactcccgtgggagccacaaacccgtgcggccggtgctcacgccgcgcgtcgtaggatagccaactgtctgcgggctggtaactctcaccacccgtgtcattcagacggacgcggagcgccgtgaaagacgggtaggacccaaccccacctgggcgagcgcatcccaacccatggcccggtttcaccgcgcgctccgggtaggagagcaggccgtcgcttccccggtggcgccccgtatcagcgcacggagcgctggagcgcgggcgcaatctcctgctggcaggtcgcgtcacattccgtgaagcgggtgaggaagtccgccatctgcgcgcagcgcttcgggaagcggctggtgcccgcatcccccatgcacatctcgtggaaggagtcgcgcgtctcctggaagagggaggcccgctgcgcgggagacaacgcgttcagcgcccggttctcccctccctggaggtacagccagacgccgccgagcaacagcagcaccagccccaccagcacggccttccgagtccgcttctcggccggcgaggggcctcgggctcgggagaagacgttctcctcctcatcgtcttcgggcggtgggccgcctgccatcatccccatcaagcgcatacgccccctgttccagcccaaaccggggagcaacgccagcacggagtgcagcggatgtgaggcaaccgccaacaagccgggcggccattgcgtgagctcccgcacgccgcgcgggagtctgaccgcgcgctggcgcggattgctcctaggatgaagtcatggacattggtgagcgccccatgcgggtgctggtggtggacgacgagcggaacatccgccacaccctgcgcgtgtgcctggagggcttcggctgtgaggtccgcgaggcggccacccccgaggccgcgctggccgcgctggcgcaaggccccgccgacctggccttcgtcgacctgcggctcggcacggccagcggaatggagctgttgccgcgcctcctggccgagtcgccccacctggacgtcgtgctcatcaccgcctacgccacgttcgacacggcggtggaggcgatgcgacgcggggcacgggactatctgcccaagcccttcacgcccgcgcagattcgccacgcggtggagaaggcgcggcggcaccaggagctggcatcgcagttggagaacctggaggggcagctttcccaggcggtgccggaggccacgttggagacagcctcgcccgcgatgcacgcggccatcgggctgttgacgcgcgcggcggcgtccgacgcggcggtgctgctgcggggagagagtggcaccggcaagggggtgctcgcccgcgcgctgcattcgatgagtgctcggcggcgccggcctttcgtcaccgtcaactgtcccacgctgtccgagcaactgctggccagcgagctgttcggccacgtgcgcggcgcgttcaccggcgcggtgaaggaccagccaggacgcgtggaggcggcggaagggggcacgctgttcctggatgaaatcgcggagatgagtccggggctccaggcgcaactgctgcgcttcctccaggagaagcagttcgaacggctgggcgagggacgcacgcgcaaggcggacgtgcgggtggtggcggcgacgaatcgggacctggagaaggacgtggccgaggggcgcttccgggaggacctgctctaccggctgaacgtcatcgaggtgaagctgccgtcgctgcgagagcggccggaggacctgctttcgctggcccggcgcttcgtctccttcttcgctcgcgcggcgcagcgcccaccgccggagctgtcgcccgcgacggagaagatgctgttggcctatgggtggccgggcaacgtgcgcgagctgcggaatgcaatggagcgagcgctcatcgtctggcccgcggaggtgctggagccgcaggcgttccccgaccgcatcgccgcggcggggagtccggtgatgaccctgggcgggccgcacacgttggaggacatcgagcgcgagcacgtgctgcgcgtcatggcctcggcgcccacgttggatgaggcagcgcgggtgctgggcatcgacgcgtccacgctgtggcggaagcggaagaagtacgagtcgggcgagggctgagcacgggcctgggagcgcccgtggtgttccacgggagcagagcgggcagggcttctcctcgtgcctggagcggtgattgcgacgtcctgcgagcatgcggagccttggaggacaccgaaccgattccaaggagcacagacgtggacgtgattgacctgttgattcagcagcaccgtgagttggaagcgctgttcgatgcctgtcgcgcggcgaaggacgatgcgagcaagcaagagcttggcatccagctcgcggaggcgctcacgttgcacaccacgattgaagaacgctgggtgtaccccgccgcgcgccgggtggtggaggagaagctgattcaggactccgtcgaggagcacggggagatgacggagctcatcgcccagatgattcgcgcgcgcaacgacccgcagaagctggtggccctgttcggcgaactggagaaggtggtgaaggaccacgtgacgatggaggagcgcgacgtactgcccaagctcggtcagaaggtcaccgagcaggacctgggcatgtcgtgcaaggacatcgtccgcaccgcctccgaggtccgccgcgaggagatgcagaagctccagggtcaggcgaacgcctgaggcctggggttcaacgcacggggacgtaagcggcatgaagacgagggcgcggtgttgccctgaggcacaccgctcctcagcaggcagcggtcagcatgttggtgctgtctggcctccacgcggacttctccgcgaaaattcggacaggggcagtgagtctcttctcctggacctcgtcgaaggacttcacggtgtagttccgctcgtgaagctccaacatcaccatcaagcgaagaagcagctcgaaatgccagctgaactcttcggcgccggtctcccagcgggacacagcctcagagcggacattgatgcgcttcgcgaagtcagcctgtgagaaccccagatgcttgcgcaggaatcgaacttccagcggcgtcagcaggctgttcttcgcggccagggctttcgcaatcgtccggtgcaactccttcaacctcgggatcacgacctctcgttcgttgcacttctcgcaccgacgctcaatcacccccacgaggatgacatcctccagcccactctcgtcgaagtggtagctgtcgagtcgtgtctccaagagctccccaccgcagctctcacacttcatgacttcctccagactgacacgatgaccaactcgtgcgcctcacccgcttcgtcacagcgaaaggccaccgcgagccccattcgtggggtttcgatgacgtaggtccaccgaccatccttctgctccccctcgctgttcacgacgccgccttcgatgatgttctcgatgtccgtggtcgcgagattccgctccttcatgcggtccttcgcgtgctgcttgagaaccaacgagccctcgtccaagaggcgccgggcaaacctgagcgcctcgaaacgcttgaagggttccttgctcaacgccctccactccccccttacgccgcggaccaccgccatttgacttgcggtgaccgcaagattagtaacaacgacgaatcaacgcgcacaagtgatttcccaagcgttcgaagttcttggcttttcacgtgcacagcacgccaaccgtacagaaggccctctgactcaccctctggggtgtcctcgatgctgaacggacgaccttcgcgt

SEQ ID NO: 1032 - DNA, 14809 bp, Myxococcus xanthus
ctctacggcgtgcgccgcatccacctggtgggcgtggcgggcacgggcatgggctccttcgccggcatgctcaaggccgccggctacgacgtcaccggcagcgacgagaatgtctacccgcccatgagcgacatgctccggacgtggggcatccccgccgccacgccgtaccgtccggagaacctggacgcggcgaagccggacctcgtcatcatcggcaatgtcatccgccgcgtgaatcccgaggccaccgccgtgcgcgagcgcggcctcaagcagatgagcttccccgccgcgctgggctcgctcttcctggaccgctcgcactccgtcgtcgtggccggcacccacgggaagacgacgacgtcctcgctcatggcccacgtactggtggcggcgggcaaggacccgtccttcctcgtgggcggcgtcacgcagaactacgcgggcaactaccgcgtggggaaggggccgcacttcgtcgtcgagggcgacgagtacgacaccgcgtactgggacaagggctccaagttcctccactaccggccgcgcaccgccatcctcaccagcgtggagttcgaccacgcggacatcttccgcgacttgccgcactacgaggcgaccttcgagaagttcgtccggctcatcccccaggacgggcagctcgtcgtctgcgccgcctaccccaacgcggtgaagctggcgcgcgagggttgcccggggcgcgtggtgacgtacgtggcgaaggagggcgcggacgcggactacacgccgcgcaacctgtccttcggcccggagggcgcgcgcttcgacgtggtggcgcgcggcgaggtgcagggcacggtgcagctccccatgggcggcgcgcacaacgtggagaacgcgctggccgtcatcgccgcggcgcagggcctggggctcaccttcgacgaaatcgcgcaggggctggccaccttcagcggcgtgaagcgccggcaggagattcgcggcgagccagacggcgtcctggtgattgacgacttcgcgcaccacccgacggcggtgcgggagaccatcgccgccatccaccaccgctacccggagcggcggctgtgggccatcttcgagccgcgctccaacaccagccgccgcaacatccaccaggaggactacgcccacgccttccccggcgcggcccgcgccagcctcaaggtgcccgagcgccacgacaaggtgcccgtgggcgaggaactggacgtgcgcaagctcatcaccgacctccaggcccagggcattcccgccgagggctccacggacgtgcaggccctggtggacctggccgcccgcgaggcccgtcccggcgacgtgctgctggtgatgagcaacggggcctttggtggtttcatcgacaaggtgctcgcggccctcgcggcccgggcgcagaagggagcctgacatgccgcgcctgccattcgccgtcgtcgttggggcgctcgcgctgtccggctgtgcgagcgctcccgccattccgcctctggggccagaggggcaggggacttcgcagcgcagcgggctcaagggctcgcagccgctggacttccaggtgaagcgctatcccggcggcgagccgtatgacctcgcctcggaccggggcagcgtggtggtgctcgacgtgtgggccacctggtgcgagccctgcaaggacgcgcttccctactaccaggacctcgcgaacgagtacgcagcccagggcctgaaggtgtacgcgctcaacatcgacgaggacccgcgcgccatccccgccttcctggcggagacgaaggtgacgctgcccatcctcctggaccagaacgcccaggtggccgagcgcaccctcaaggtgcgggggcatgcccaccacgtatttcatcgaccgcaagggcatggtgcgccacgtccatgaaggcttcgccgaggagttcctcgcgaagtaccagacggagctcgaggcgctgctcgccgagcccaccccgtagaggagagcgtcatgtcccaggattcgcccgacagcctgcgccgcaccgccgaggagggggctcggctcgctggccgcatcctcgcggaccggttcctgggcgagcgcaccatcgagttcaagggtggcatcgacctggtgacggacgcggacaaggcctccgaggaagcgctgctcgccttcatccgcgagcgccaccccgaccacgccatcctcgcggaggagagcggcgccacgcagggcaccgacagcctgcgctggctggtggacccgttggacggcaccaccaactactcgcaccgcgtgccgcacttctgcgtcagcgtggcggtggagggccccggcggcgtgctggctggcgtcgtctatgacccgatgctaaacgagctgttctccgccgcgcgcgggcagggcgccaccctcaacggccgtccgctgcgcgccagcaccgtgtcctcgttggaccgggcgctgctctgcacgggcttcccctacgacgtgcgcgaacgcccggaggggccggtgggcctcttcacccgcctcatcctccacgcgcagggcatgcgccgcacgggcagcgccgccatggacctggcctacgtggccgcgggccgcttcgacggcttcttcgagttcggcttgaagccgtgggacatcgccgcgggctcgctgctggtggaggaggcgggcggcgtcatccgtcacatctccggcgagcccttcgacgtgctgcgcggcgacgtgattgcctccgcgcccgcgctggccccggcgctgctgtccgaggcgaagcgcttcgtggacgggctgcgcgaacagcctccgcgcggctgaggctcaggctagaagaagctctccggcacgaagacgatgtcgccgggctggagcatgaagttcttctcccgccccacgccgatgtcctccacgggaacgcgaatcttgcgctcctgcccgtccaccacgcgcgtcaccagcgtgttgttcttcgccgccagcttggtgaagccgccggccagcgtaatcgcctggacgatggacatctcgttgtccacggggaaggtgcccggcttctgcacctcgccgaagacgaacaccttctgcgagttgtactcgcggatgagcaccgatacctgggggcggcgcacgtagcgcgccaggcagtcccgcagctggtccgccgccgagctgggcgtcgtccccgacagcggcaccttgccgcacagcgggtagtcgatggtgccctcgctggacaagcgccaggtgccggagtgctcgggctcctggaagacgcgcacctccaccacgtctccgggccccagcttgccgccactggagcgcgcggcttccgcctccgcggcgggcgtgggagcgggcggcggcgggcgctgcgacgtgccgaagcaggcgggcagcgtcatcagggacagcacggtgagggcggcgcggaagctggtcatctccaggagggacagacgctcactcagtacgtcacggagaggcgggcgtacccctcgtgccgcgagtagttgaggccgccgccatccaccgaggaggagcggcgacccagcatgtagcctgcagcgcccgtcagccacgggtagaactggtactccgggccgatattcacgccgacgacggtgtcattccggccgccgtcgaagcgcaggaagtccacggcgagcccgccggacaccgtcagcttgccgccgaagagggcgcgcacctcgccgtagccccggttgtccgtgaagaagccgtaggcggccacgggctccagggtgcgcaggtagcccgccttgaagctcagggtggggctgtagaggtaggtgccctccaactgccccaggaaggtgccgccgccggtgctgccgaagttctggccccagcccgccttggccgtgacggccaccttgggggacacgaggcccgccacgccgccgatgacgcgcagtagcgaggcgcccggcgtgctgtcgttgaagtagctgcgcacgtccaggtgggtgtcgagcaccaccgccgtcttcggcaggaagcgccagcggccttccgcgcccactcgcaggttgccgtagtcgaagcgctccacggcggccgggtcgcacacgctttcggtgcagccgacggggctcaccgagctcagcggctggaagaactccaccgcgtaggccacgctgggcgtcagctccagcgcgccgccgccggggcgccacggggccttcgcgcgcgcttcattgaagaggctgagcacgcccacgcccacggccgcggtgcgcgtgcggtccgagcgcgcgaactggttcgacacctccagcgtcagcggagcgtccgggttgaagcgcgcgttgaggtccgccgcgccctccatgcgcgaggccgcgctggagttcttcgtcaccaggcccgtgtacaacacgtagtccaggttggcgcccaggttgaacgccagcgtggacgacggaatctccagccggaagccagggcggaagcgcagcgccacgtcgctcgccaggttggccgataccgggtcgctgttgggctccgagttggaggtgggcgagaagtagcccacgccgctgtccagccgcgtctccaggtcgaagtaggggtgcagccgcccgttacccaccttgaagccgttacccccggtgggaggcgtcgcgatgccctgggcggaggccgtgccgcccagcgcgagcagcgccagagcacccagtcctccccagaatgtcgcgggctgcttcatggctcagaagggcttcccaggtgtgaggcgcatttcctctcacctttcgtgcttgcggccggcggcgtcataacatgcgggtcaggccggaccgaacgtttgttggcggggttatcggacggggctggcgggaggtgggcgcaccaggacgatgtcgggcgtggggggacgggtggggtctcctccggggagattgttgggctcctccacctccacgaagagattttcatcggtgcggaaggcgagctggccaatgcactcctcggcctccgagcggagctgtcccaccttctgccgggcgatcatcaccttggtgaattcgtgctcgctggacgaggactcctggcgggacaccgcctcctggagggacacgtccgcctgctcggagatgcgcagcaggcccttgatttgagtgagcttctcgttggcgcagttgagcttcaccacgtccttggtccgccgggcctcctccaccttccccaacaccgagcgcagcacctcgcgcatgccgctcagtgcctgcgtgctgcgcaccagcttcgccgagtccggcacgtcgctggccttctccagcgccgcggtggcggcgggaggggctggcggcgcggcgggggacgggctttgtgccgtcgccatgccggcggccaggacggcgagcattccgacgttgcgcatgcggctcacgatgccgcagagcgtagaggcaggggtggggggtgtcaaaccaacacgagcgcgatgaaagtggtcaggactgacgggtcagtccttcgtcgcgagacgaacattggcctcgcgcaggcgggcagacaggctcctggcgatattcaccacgataaaggtgaacccatctccatgtgtcctccggaactcgcggaggtcctgcgcgctgagctgaagcaggtccacgtccgtcttcgcgcacacggtggcggagcggaattccttgtcgatgaggcccatctccccgaagaactcgggtggggacagcaccgcgagcggatgcaggccaccctggggctgacggcgcgcgacctccacctggccgcggacgacgacgaagaggctgtcgcccaaatccccttcttcgaagatgacgttcccggccgcgaagtgccgcgcccgcgccagctcggcgaggtggccaagctccgcggaggagagcatctcgaagagcggcgatgcggcgatgacggacagcttctccatggtccccccggggcccgggctgggtgctcccggccgggagcctagcccgccggcgcgaagacgaaggggtaggaaacggctgtctcgtcgtcgggtttgaaggggaacacccagctgcggatggtggtgcggatgcagctgcccaccgcctcgctgcccagggtgttctcctcgatttcgatgtccccggcacggccggacgtcttgatggtgaagcgcaccaccaccttgcccttgaggttggggttccgcttgagctccttctcgtagcagctctggatggcggccttgcgtgcgcgcacgtagcgggccagcgcgtcgcggtccacgtcggcgctttcgatttcgggcgtggcgtcctgcacgcggcccttcaccaccgtctccttcttgtcgcccaggtccaccttgccgccgccctgggtgccaatggcgccgatgtccgtcaccgtgcccgtgccgccgccgcgaggaccgccggaggcgcccacggaggcctcgcgggccacacccacgccgcccgcgcccgccagggcctcggcgatgtcaccgccgccgctggcgccgccgagcacgtccgcgaaggcaccctggccaccgccgctattggagcccagaatcttcagaaggcccttgccggagaccttcttcaccacctccgcgcggcgctgctgggcggcgtcccccgcgggcttgttctccgcgggcgtgtcctccttgggcgcggcatcgggcttgtcgctcttgggcgcttcggcggggccggtgtccgcgggcttgggggcctccaccgggcgctgggggatgatggcgcgcacgaagcggtcatccagttcgtccagctccagctcggccacctgcggcgtctccgaggtgatgatgagggcggcgccggagaagtggaccaggagcgatgcggcgaggatgccgaagaagacgcggtccatcgtcttccaccggctgaccatgacgtccgtgggaagcaccggcttcgcctcgtcgggcggcggcgtgacgaattggaagaagagggtggcgtcacccagctccaccttgccgcgagcgctctccggcaggggaaggacgtgcaggtcgccgcggcgggtggccaggccctgcgcgcgcagggattcgaagtccacgtcggacgagcccaggttgacgcggcccttcatgtccggcgcgatgacgagctggaactgctggttctggttctccagcagggcgaagcgggcgggccggccctcggtggcgggcaggacgatggtgttcttcgcgtcgtggccgatggtgaccgcttcgcggcggacgtggtgctcttcgacgatgcggccgttctggatgacgccgacgcggagcagcttgttctgcgaggtggcggccatgggactagaagggttcctgttccacgctcttctcgaccttgggcacgaagctctcggtgcgactgaggtcgtcgaagctcaggttggagcgctggaggatgtacatggcctggggcttctggatgcgtccttcgacggtgatggcttccaggcggatgactttgcgcggggccttcttcggcgacgtggcgccgctgctggacgaggaggcctgactggcgtcctgggccaggacgggcgcggcggcgagcagcacgatgagggcgaaggcggagcgcatggcggatttactgtgagtcggcggtgagtctacccgagccggtgggcaccggggcagcggacgcaccgtccggtgacggtgccgggctgcttggggcggaggtggtggaaggtgaggcgtcaggcgccgcgacgcgcgtgcccggctccgggttggacaccgaaggggcgggcggtgttccctcgggggggctggcctcggcggctttctgcgcctcggtggcctttcggagctggtccttctgctcgcgctccagtcgccgctcctcgcggtcgatgagcttgcgcgcgtccttcatgtactgggcgatgcgttcgtcgcgtccgccgcgcgcctggtagttgtcgaagtgggtgagggccgtcttgtagcgcttcagcggctccatgcccggcggctccacgtcgaggtagaggatggccaggttgaagtacgcatccgcggcgcgcggcatcagcagcagcacctgctcgtactcggcgcgggcccgcgcgaagttcccctggccccggtgggcgttgcccaggttgaggcgggccgacgcgaagtccggcgcggcgcgcaccgctgcctccagttcggtgacggcggccgcgtagtcctgcgcctcgttgagcatggcgccgaagttgttgcgcgcctccgcgaagtccggccgcagttgcgcggccgtcttgaaggactccaaggcctggggacgcgagtcgagcgccaggtacaccagccccagcccgttgtgcgtggccgcgtctttcggtcgatggcgcgggcgttctccagcaccatgcgcgccagctcgtgcttgccctcgcggtagtagacctgcgccagcacctgcatggcgcgcacgtgccgctcgtcgcccttcagcgcctgcttggcctcggccgaggcggcggcgtggttcttcgcctggagcagggtgatggccagcgcggtgcgcagcgcgaccgagtccggctgggaggacagccgctcgcgcagctcggcttccagcttcgccgtgcggccggtgcggccatacaggcgcgccaggcagtcccacgcggactgctgttcgggggccacgtccagtgccttgcggtaggagcgctccgcgtccgcggtcttccccatccgctcctggacgatgcccaggttcgtccacgcgtagtccagcttcgggtccagctcgaccagggtgcgcagcgccgcttcggccgcggtcagctctccccggcgcgcaatctccaccgcctcgacgaagtcgcgctcggggccgcgcggcgcttccggacgggacaggggcggtgacggcgcctccgtggtggcgcccgcgtccggcggtgtcgtggcggtggagtccgcgtcctcggcggtctcctcgggcgttggccgaggggcggcgggtgtggtggcgcacgcggacagccagaggctggaggccagcaccacggaggtcagcgcgcgggcgcatgaaagacgcgggccaggactcacttcgctccctccccggacaggcgcgggccctcttgctgcgtcgagcgcacggggccggtgatgctgcccaccagcccatccgggtaggtggcgtccgcggcgagcgcctgcttgggctccttgagcaccgggtactccttgggccggaagcggttgagggactccagcgtgcggcgcgtccactcgttggtgaggcggttcttccgtgcctcggccagcgtggcggcgtagctctccacggcggcctcctccagcgcggtggtctgctggaccagcgcgtcctggtagacgaccaccgcctcctcgcccatccgcttcacctccgccgggacgggcgtctcgatgatggtgttggcgaagcgctccagggcgtagccccggcggtagagcgcggccagcgtccactccaactgcttgtacgggtagacgcgcgcgtacgcggtgttgacggacttcacgccgttgcgcttggccgtgaagctgcgctccagcgccttgcccttgccgccaatcttcagcttgtcgaacttctggaactccagctcggccagctggaagcggctgtaggcggcggcatccgcggccagcgggtgcgtgtccggctggagcttgcgtcggtcgaactccgccgcggaccgcgcccaggcgttctgggcgtcgcgcgtgctgcccagcttctggtgggcgtctcccattcgccggtgcgcgtccaccaccagctccacctgtccggactgcgaggcgaacttgcgcacgaactcctgcagcgcgcggacctcgccacgggggttgccctgcttctcgtagatgatggcggcgcggtactgattcttgggcgcgtcctccgccttggggaacaggtccgcgtagcgcatgaaggcggcggcggcctccgggtagcgctgctggccctccaacaggcgcgcggcgttgaacagcgccgcctcccggtccttcgagtccgggtagtccttcaccagcttctggtagctgacgacggccttgtcgaagtcgtaggagttctccgcgttcaccgccacgcggaacagcgccccgccggccagcggggacgacgggtattcgcggtagatgcgctcgtacagcttcagggcggagtcgaagcggcgcgtgttctcatgcgccaccgcggcgttgttgagggccttgtccgcgaactcgtggcggggcgactcgtccaccagctcgatgtacttcgccgcggcctcttcgtacttcgactcggccatgagctggtcggcgagcttgaagcggccggcgagcttgaacttcaccaactgcttgtgcaggtcgctggacgggtcgatgaccttgtcgttgctggccagccgcgcgctgacggactccacgctccgccagtcctcgtcgatgaggaaggtctcgatggtgaggttggtggcgtagcgggccacctcgtggctcgggtatgcctggatgatggtctcgaagcggcggcgcgcctcggggaagtcgtcgtgcgagtagtgcagctccgcggcctggtaggcgatgccgggcgccttctcgccagcgggcagcagggtgacgtaggcgtccgcggcggccaccagcttctgctcggtgggcgcgaaggggcggggcttcacggcctggcccgggggacgctccgtcgagcgcagcgtcttggtctccggcaccgcgcccgcctggatgtccagcgtgagctgcttctgccacgcgagcaccgcgttgagggcggcgtccgggcggtgcttgttggccgcgtccgtgtcgcgcacctcttcgtaggcgcgcgcggcggcggcgaactggaaggcgttgtagaggcactccgcgtaatagaagcgcatgtcgcccgcgctcttcgtccgcgggaagcgctccaggtacgtgccgtacgcgcgggcggcgatgtcgaaggcgctccgggcctgctcgaacttgccctcctgtttgaagaccagggcttgctgatggtggtaggtggcgctgccgtacaggctgcgctcggccagcgcgttggcgcgggcgatggccgccgtgtcgcccttgttcttctcgtaccaggcgccgccgggctggtagaggttggccagggcctcggactcggcgaaggacaggcccagcatgcggtcccgctcgtaggcctggacgatgcgctgctgcaccatgggcgcgtccggcgcgtccggcgccttctgcagcacccggcgataggcctcgatggccggcgcgtgcttcgtctggtcgaagtagacgttgcccagccgctggtacacctcggcctcgtaggggcgcgggccacgctccgcgaagagcgcatccgcccgggcgatgccgccccacgtgtcgtccgccagggagatggccacgtactggagggcttcctcgcgcaggtcgccgccggccgtcgcgtcgcccttcgccacacgctgggcttcgtagaactccaccagcgtcaggaaggacgccaccgctggctcgaagcggtccaggcggtagtacgtccaaccgagcttgtagagcgccttgtcgtagagcgggtgcgaggcgtcgcgcgtggcggcctcgtaggcctgcgcggccttgggcagggcctgcgggtcctcgtagttgtcgaaccagtactcgccgatgcgcacccaggactcggtggcgaagcggctctgcgggtaacgcgcgatgagctgctggtacgcgtggaggctgtcgccgtactggtcctgcttctccaggcagtaggccagcaggtaccaggcgccgtcgttgaggcggtagtccgggaaggtggccagcagcttgcggtagagcgcgatggagggcgcgtagtccacgcgcggctcggtggggaactccgcgtccgggttcttgtcgtgcgcctccagccgctccgcgtagtccttcatcgccagcaggtggtcgtccgacgagcgctcgtaatacagctccgccaggcggaacatcacgtccggcgtgaagcgcggctcggtggggtagcggcgcaggaactcctcgaaccgggcaatggcgtccagccgctcgcggcgctcctgagcctccaggtccttgatgcgcttctcgtaggaggccgccagcgcgccacgcttctgctcgtagcgctgctccaccagctcctgcacctcacggtggaactcgcgcgcctcggactcgtagagctccagcgcgctgctcacctcctggaacagcgcctcctgttcgggcgtgcgtcccatgccctggaggtagggggccgcgggcgcggcgggggcctccgcggcggaggcggggccagccagggcgagcagcgcggcgaggagacgggagcgcatcactccttcacctcggacaggacatcctggaactcggcgtccagctcgcgcagcgcctcgtccttctgcgaggagagcgtctggatggccgtcgtcttgtcctgcttctcgttgaaggccacgtccaccacgcccacgtccgccttgagcaccaggtcgtagaactgctgccgcacgcggcggatgctgtcgtaggcgatgcggcccaccaactgcctggcgtcaccggagacggcggcgacttcggcctcgtagcgctccaggagttgctgctcggccacgaccttctcgcggatgacgcggccccggcgctccagccgctcgcgcaccacgttccgggccgtcgtcacgcgttcgcgcaggccgtccagccggccgcgcacgccgtgggtgcgccgcagcgtggcgaggacctccgcgtccgcccggggctccgcctcgcgcaggatggcgtgctcgcgccgcagggaatcggcataggcgacgcggatggcgcgctcgccggccagggtggtgtccacggcgttgcgctcgtccgccagccgcgcgcgcgtggcggtcagctccgccttgaggtccttcagcgtctggacctcggcctgcaactgcagcaggaactcgcgctcctcgtccggaggcgtctgccggtgcgtccgcgagtcatccacccacttgcgtatcgaagcggcgatggcgttgagcgactgaagctcgaagtcgagccggtaggcctcgcggtccaactcgtccacgcgccgctgcatgcgctcgcggcggtcctccagcgtcttcaacgaggtgggcagcgcggagaagcggcgctccagggcttcacgcgcgtgctgggcctccgtcagccgcgccagctcggcgggcgtgagcacggcctgcatcgcgagcgtctcgacccgcaccagctccgcctccgcttgggtgagggcggtgtcgaccgcgtccgcgcgcgtgttggcttcctgcagctccgggaaggtctccaggccgcgcgtgtccagggcgtggaggatgcgctgggcaatggccgcggcctcgctccggccccggcgaccgctgtcgatgtcctccaccgtccgcaccgcgtccgccacctcgcgctggcgtggtggcgtacttcagcaccagatgcggcagcaccgtgcgcatgtccagcgggccgtccgcgcgcaccagcagccggtcgaagtacgccaccgggtcgctgtgcgagctcagcagcgcgtccacctgctccctggggggccggaaggtgtcgatgacctgggtataggtgtcggtcgcctcgtcgtaccggcgcagcttctggagcaggttgccctggaggatgcggccttcggcggcgagctgcgagtcgggcgccaccagcaggaggatgtcgatggcgttcttcgcctgctggtagtggccccgtcgcacgtggacccaggcggattcgtagagggagtcggggaaggactcgctgtcacgcggcacctggccgtagcggtccagcgcgtcgtcgaagcggcccgtctcgtacagcagccgtcccaatgacatcagcgccagctcgcgcacgcggcgggcttcctcctccggcgtgggcgcggagcggcgaggacccgtcctgcccggagcggcctgtgcggcctgggcagagggcggggtggccaactgttggaagcgggtgatggccgcgggcaggtcaccttcctgcacggacaacacgcccaggtggtaggcggcctggagccggaaggcgccgttgggtgcctgcgccagtggcgtgaaggcggcgcgggcctgggtgatgcggtccgccggagacaggtccgtgcgccggaacagccacttcgcgtggacgtaggcaatctccggggacagctgcccaccggacagcgtgcgggcctgcgccacgtaggcctcgacaccctcgaaataattgaggcggccggccaccgtcaggtagcgcgacagggcctcgcggtagtgcccggaggtcgggggcagggccagcagctcgcgcaggtacagtcgcgcgccaatgtcgttgtgctgctccaggagcgagtccgccaggtagaacagcgcgtccggatagcgcggatgcgggcggaagcgcgggtcgctcaccaggtcatagaagaggacggacgccgccggccagtcgcccagcaggtagtggatttcgccgtcggagaagcggcgccagagggcgtcgtcgtcactgggctcggcgcgctgggtgaactgcgtctccacgaagtggaggttctcctcgacgccgagcagtcctgtctccaccgcatcgagccgcggcgacaggtcgcgcccgggcggcgggggcgcgggcgcctgcgcgggctcggcggaacggacggcctccggccctag

SEQ ID NO: 1033 - DNA, 6758 bp, Myxococcus xanthus
ccgcgggagtgaacctgggcatgacggtctacctcgctcggacgcgaaggccgcgactgctgcgcgagcgcgccgaactcgaggtcgcaccgtgacgccgcgcgtgccattcgatgaagaggccctccgggccgccgtggtgtcgggcgacgccgccgcgcgagaggatgtcatgcgccacctgtacgaggcgctcagcgggaagctgtacgtgctctgccatggaatcacccgggacccgagtgatgcccaggacgccgtccaggagacgttcctctcgattcaacgggccctgccgcagttccggggggatgcgcagctgtcgacgtgggcgtatcgcatcgcggtgcgggccgccgtggccgcgaagacgcggcgcgagcgtcaccgtggcgacgcggtcgacatcgagatggcggaccctcgggcgggtatcgaggagaccttcgagacgcgggagcggaggcgcagactcgaggtggcgatgaggacgctctcgctggagcaccgcaccgtgctgtcgctcttcgccgtggaaggcctgtcacacgcccagattgccagcgtcctcgggattcccgagggcaccgcgtggtcgcgcttgcacctggctcgcaagcggctggcggcggcgctcgaatccaccgccccatagcctggggcgctccatccgcgttgtcgttcaaccccgcggtctcatggccgcggaggggagagggtcatgtccaatgtctatctgaacttcgaggcgtcgcgcttcttcgaggccttggcgctcgtgctggtcctcacgctcacccacggagcgggtgcctgcgcaatagcctgtctgtttttccatggggctgaagcgtaagctgttctgatgaaggtgaactcccggggatacttggcgtcgctcgccgtcatgaccttgagcagcgtggcctgcggtgatgtcgaccctgaagaggccgtgacgatatcgcagggggtctatgggatgacctcctatgtcaatgacgtgtgttcttctgggtgtgagcgcgagccgcggtcgatgaccttgctggtcaagtcactgccccaggacatggacgtggtttccgtgacatcgaacaaggatggcttctacgaagcctcgctggtcctgggggactatcgaatctgcacgacgttcgggcgttgcacggacttctcggtgggcatcaatgaagtggttcgccttgactacgagatgtcggtggggccggggtggtcgaggtagtagcccaccgcgccccgcggaatggggcgctggcttggtggcccacgatgacatcctgagcagagcgcagccgagggccggcggcggcgggtcccttccggctggaccctcggcgtcagccgtgattcatgagtggcttcggtctcgcgctccagcgcctgccgccgcccatgcactccgccgccgagccgacagtcccccgcttctggcccttcatgttcaccctgtttgtcgggtcgttcatgtcggtgctgagctccagcacgatcaccatcgccattcccgagctccagcggcacttcggggcggagctgtcctccgtgcagtggaccctgacgggcttcatgctcgccatgggaacgagcgccccgctcactggctatctgggtggacgcttcagcttcaagtgggtgtacgtggccagcctggtggccttcctcgtggcctccgtgctgtgtggggtggcctgggacacgcgctcactggtggccttccggttcgtccagggggcgttctgtggcgccatcatgccggtgacgatgacgctcatctatcagttgctgccgcgtgaacggcaggcgctggccgcgagcctctggaccctgtcctccatgctcgcccccgccttcggccccacgctggcgggctggctgatgacgctgggcaactggcggtggttgttcttcatgaacgtgccgctgggcctcgccgccgtggcgatggcggtgcgggccgttccctactaccgcctggaggttccgaaggcgttcgacttccccgggctgctcaccgtcatcaccggaacgctggcgctgctgatcgccttgagtcagggacgggcctggggatggacggattcgaagacggtgtcgctggccgtgctggggacggtgtcactcgtctacttcgtcgtccgccaactgaggacgcatgcgccgctgctcgacttgcgggtgctggccaacggccgctacgtggtgacgttgctcatctcgagcatcatcaccatcagcctctattcgggcgcgttcctcatcccgttgttcctccaggaaatccagggtgtgacgccgctgaagacggggttgattcttctcccggcctccctgtccatggcgctcctgatgcccctggtcggacgcatgtacggcaagctcgggccgagcacgctcatgacggcgggcgtcctgttgattgcgggtggcacatatgccttgagccgcctgacgccggacgtctcccacacctacgtgctgatgtggatgctggtccggaacgtgggcatctcgctctccatcatgccggccagcaacgcgggcatggagcagctctcccgggagctgagtggccacgcctcgtctatcagcaactggctgcgaaacgtgttcggggccttctcgattgccatcttcacgtcgctcctctccagcttcgcggcccgggaggcgcaggtgctcgcgcgggaggggatgacggagcgtcgtgacatcgagttgctctcattcgtgacgggcatcaaccaggtgtacctggtggcgactgtcatcgccctggtggccgtgcccttgagtctgatggtccggaagtacgtgagcgggctggaagcctcccggggcgctcgctagcgggcgcggcggctttcacgcacctggggccaccagtcccgagatgtcgcgtgtgattcgcccttcctggatggacgtgtagccgcccacggttccggttacgctgtgctttgcatgaagtacgccttcgttttcgccatggctgccgtgttgattgccttcctggccctgcgactgggcggcgtcgcgtggcttctgttgtggcctggggtgagcttcatcctggtggcactcgcctacgctggactgggcgaacacgctttcggcaagcgcgtggacgggcggatgcagccctgggcaatcatcttgctcctgccttatctcttgctgacatggggcgcctggcatctggttcgatggctgtcgcgagagcgtgcgttcgacgaagtggtgccaggcgttttcattggaagacgcttgttggcgggagagcttcccgacggcatcgtgaccgtgctcgatctgacgtctgagttcgtcgaaccggaaggaattcgtcgcgcgggccggtatgtctccctgcccatccttgatgcttcgattctgcccgtagcgagagtgacccctgtcctgcgtgagctggctgtcggacctgatgcgctctacatccactgtgcgcaagggcatggacgcaccgggatgattgcggccgcgctcctcattgcccgaggtgatgcgttggatgcgtcgaccgcgctctcgatggtgcagcgcgcgcggcccgcggtgcgactctctgcgacgcaatcgcgggcccttgcggagctggccacggcgcttctcgcggcgcggcagggcgctggcgctgctctcccctgagttgaccgatttgacgggcgcaaatccaatggcggtgacggtgccggcgacggcctcggcgctggcggccctgctggtccgcctggcgccgcgtgcccgcgtggcccactgacgcgagtggcgcatgggcgcatcacgtcgcgctttgtgctcccgcgcgtcccagccgctgagcgaagaaggcgaggatttcgtctcgcgccgcgcgagtgggctctccctccgcgtcgatgagatgggccgtcacgacgctgtgggcgcacccgacgacttccgcgaagaaggggggcggcgtcgggttcgcggcggacgtaggcagcactcggggaacgaagcgctttccgagcgcggccgtatatgcctggaatcgctgcgccgtgcagaatcggtctccctcgaaccgataggcgagcaccgtcaggtcgtcacgttcgaggcgctccttcacggcggcaagctcgtcaggcgccagttgaatcgcgccggtgtcgctcaggggcagcgacggctgacacatgacgggagcgagcatcgcgggttcgagcatcatggagagcgcgaagttccccgtgaagcacatcccaatcgcgccgacccccggaccgccacactcctcatgtgcgaggcgtgccagggcacgcagccactgcgtcacggggctcgactcattcgccgcgaacgctcggaactccgcgctcacgcaggcgcgttgcatgatggcacgcccctcctccgcgcgagggtaggcaccgtccctgccgaagagggaaggcatgtagacagtgaagcccgcgtcgcggacccaacgcgcgaagcgggcgacgtgcgggctgatgcctggcatctcggccatgacgatgacggcggggccgtggccggcgacgtagaccgttcgcatggcgtcgttgagggtgaggggccgccgggtgaagtcatcgagagggtcgtcggccgtggagtcaggtgtggatgggcgcatgcctggacgatgcgggaagtccatcctccgcggccagtggcgagattgacaatgaacgggctattcttgccactgtgattacgcatgtggtgttcgatggcgtggcagagggctcgctgggcgtggggctcgatgtggtcgacacggccgcgcgactcgtcgaggcagggctcgcctcggttccccggggtgcccaggtcttgcgtcagcgggtggtgtcgctcgatggtcagccggtgcgctcgggcacgggacgcaccgtctccgtggacggcgcgctgagcctccgaagtgtgaaggctggagacgtgttgctggtccctgggctctccgcggccagcgagcgcgccatcgaacagttgctctctcgggccgatgcggcgcgtggcatcacgttgctcgcgcgtgtggcggcgaagggcgccatggtcgcggcctcgtgctccgcgaccttcgtcctcgcggcgtccggcctcctcgcggggcggagcgcgacgacgacctggtggctcgtcccttcgttcgtgcgtcgcttccccgaggtcgccctccagccggaccggatggttgtcgagagcgacggcgtcctcaccgcgggctcggccttcgcgcatgcggacctggtgctggccatcgtcgcgcgggtcgcgagcccatcactcgcgcacctggtggcccgctacctcgtgctcgacgagcgtgtctcacaggccaggtacatggtgatggagcacctccgcgtctcggacccagcgcttcgtgccgtggagcaattcgtcgccgcgaatctgggccggcaactgacgctcgatgaactcgcccgggccggtgccacctcctcgcgcacgctcgcgcggcgggtgcaggcggggctgggcatgacgccgctcgagttcgtgcagcgggtgcgcgtggctcacgcctcccacctgctcgagacgacccatgcgtcggtcgaagatgtcgctgcccgggtggggtatgccgacaccgctgcgttccgccgcgtgttccggcggtacgtcggagagacgccacgaggaaggcgcggcaactcgcgctcccggcgctcaccgctgaacgcgcgcgattcaccggcgccatgagggctttcgcagagatgtcttgccccagcgcagcggggctggcagcgcaaacgcagacgcccctttgaccttcccgtcaacggtgcgctaatagctgccagacaatgaactcaagaataagcagtatgactggggtatgggcagcggtgcttggcgcgctcttgctcacgggatgcacgaaggatggcacgccggaagccggcacgggggccgcgctgcgggctgtgacctcgccggtgactgtgtcagaggcggtggccatcaccagccaaggcatgacgcagaacggctcggcacatcgcaatcaggtgctgctcggggtgttccagaccgaggactatgaggttcaggccttgttgcgcttcccgcagacgggcgtgccggctggggcggtggttcagagcgcgacgctgcgtttcgcggtggagacctacaccagcgacttctcgattcgaggcgcatatgtgcaggcgccctggaacctgggggccaacggactgggatggcagttccgcgacgatgggctggagtgggaccggctgggggcggccgggcaggggacggacctggtcgccggttcgtcgttcgaggtctccacgtttccgggcacggtgagcgtgcacgacgtgccactcgacgtggcggtggtgcagtcgtgggtcgacgacccgtcgaccaaccagggcgtgatgttggcgaactcgaggattgggaaggtggccaaggtcttcaccagcctggccacccagccggagcgtcggccgctcctcaccattgagtacaccgcgcctgcgccgcgcagcgataccacgcctccgtccgttgcaatcacggcgcccgcggcgggcgcgacggtgcagggcgtggtcggcatcaccgtggacgcgagcgacgacgtcggcgtggtcggcgtgcagctgcgcatcgacggccgtaacctcgactcgacgcagctcgacacccgcctgttcctttagagcaca

SEQ ID NO: 1034 - DNA, 11276 bp, Myxococcus xanthus
caggagcaggctcaaggcggtaggcgtgcgcatactgagggtgatacctcaagacgcggcgcctgccatgcgcgcctgggaccaggccggagcccacgagggagctccggcccggtggggttcaacgactagagcttggctgccgtcgcgctgaaggccgcgcaggcggcgggcaccgcgaagccgttggtgggcgtcgtgccgccggagccgctggacacggcgttggtgcccatgccgaacgcggcgaaggccgtccacaggcggcagacgtcctcgccaccgtgcagggtggtggccgcggtgatgatgccgtcacgcacctgggtgaaggtggggctgcacggcgtgttcttcaggccctgggtgaagtacagcatcatgcgctggttacccgcggtgcccgtggcgtcgtacaggttggcgctgaagccgtggtggttgaccagggcccagtaggcctcccacatgccctgggcgaacacggcacccacgccgtgcggaaccgccatgccgttgatgctggcgtaggtccaggtgttgacggcgctgctggtgctgtagcgctggggacggatgcccacgcccgtggtgggctggttcagggcgtaggtgcccacgccgcggccctgcgcgccggtgtccgtcgccttcgcggtgtagaagagcgacaggaagtcgctgatgccctcgcccggctgctggcggttcgacaagcaggacacgttgctggggccgcccacgaggcggttggagatgccgtggccgtactcgtggacgatgatgccggcgtccaggtctccgtccttgttcggcgtcaccgtgttccagcggtacatctgcatgcgcggccgttggccatccggcggggtcatgaagttggcgttgttcatgccgccgccgtcctgcgcctccgcgcggacgtcgtcgttgccggcgccgccccggccgtagttgttgacctggaagttaccggacgcctcatcgaagccgtactggtactggacgtcgtggatgatgttgttccagtagaacaggttggtgacggccgcggggatgtacgtggacggcgcgcccgtgagggtgatggggaagtcgcagtggatgagcgaggtgcagtcgggctgcacggcgggcggcaggccatcgttgttggtgtcctcgtaggcgtggacgttgttgccgcggagggtggtgtactccgcgccggccgctccgttcgtatcgtgccagccgtagggcgacgccgtggcgttggcggggttggagaccagcacgcgcccatccgctggcggcagcggcgtggtgtggttggggctctccaccggcatgggatagacgcggtaggcatcatcggccgccacccagtcgaagcgggtccagacctcgcccgtggacgcgtccaccgtgacgtcgtaggcgtggtcggtgtccagggtgtggacctggaagcgccacaccagccgggcctcgcctcggcggaccggcagcaccgccagctccgcgtcgatgggctcggtggacaggccttccaccgccacgcgcgtgcgctgacgcgcgccgggctcggccttcagggactgcggcgccgcggagaggcggacgcccaggtgcttcgccacgcccaccaccgcgtccgcggcgctcaggcgcggcgtggtgccagcgagcgaggactccagggccgggaggaagtcgctgtgcacgctgagcacgcggccgtcgcggtccacgttgatctgaagctggccgttgtagacgggcaggccccggtacgtctggcgcaggtacaggttggtggtgccgctcaccttcgaatagacgcggtccgtcacctcgaggttcgccaggtcgttgagccccagcccgagcgcgtcccggtgcttctggacgaagtccaggccaatggccatcgggtccccgctgcgcggatcggagagcgcacccaccggattggtgagcgagcgcaccaggccgttggactcgtcgaactccaccatcagttccggcacggcctgccgcagcgcggcctggctggacgtctgggcagacgagatgccaaaccgtgcctgcgcgttgtaggcatctcgcgcatcgtaattacgaacgccttcctctgaatggactgccattgcagcggaacccgagagggttcccacgagaaacaccgcatgaaaaaggcgccttcggtaaggacctgaggacatgtcgtgctcctgcactgcgggttgaccgcgctcctctgggagctacggtgctggagcggcagaaatcacactttgagtgaaaatagcaaatcaccaactaatctggaattctgcggttttgtgcaacggatttgcacagtcccgcagtatgacaagcaatgacgctgttgcgtcttttgaatgtcaatcatccaacgctgcgcggtgagcaggaattggccgcgggagcaggcgcgacagcagcgctctcacggagcgcacggggtgggcgccgggctcggggatgcgcgccgtcaacagggccgcgcccaggcgggccaccgaggacagcacgaagagcgcgtgcaggttcacccagacgtggccgcccagggtgaactgggtgggcagggcggcggcgatggcgcctcccagcgcggccgcggcggtataggccaggccgccggcggtggcgaaggccgccaggtagaaggggcggttcttccggggggcgacggtcaggggcagctcgaagatggccagaccgtgaccgctccacagcgccccggcgaggacgacgtcgaagagcaggggccacagcgtccccgcggaaggcagcagccacagggcggggatggcggcgatgcccagtgagcacgccatcaacacgggctgggcgccgcagcggtcaatcacgcggccccagagtggcgccgccaggatgcgcacgcccgccaccgacgcggcatgcagcgccatgatgacgaaggtcatctggaggttctggaggctgtgtagcgcgaagaagggcgcggacacccccaccgccgcgttccaggccacctggtaggtgagcacccggcgcgcgttgtcatccttgaatgggaccagcgcgcccttgagatccaggggcggggtggtgcccgggggcgccgggtcgtgctgcgaggccatgaacagggtggtgacgatgcccatgacgcacgcccccaacgcgagcaggggcagggccacgcccacgccgtccgtggggcgcagccggtccatcaggaggcccgcgccgagggaggcgagtgtgcccgccagcgtggtgagcgcggtgcggcgtccgaagaagcggccccggacggcgcggggcaccagttcccccatccacgccacccaggcgttgttgcccaccacgctcaacgcggcggagacgccggcaaccgtcagcagcaggcgctgctgggattcgaagggcaggcccagccagggcagcaccgccagggggaacatcaccacgcgggacagacacaccgcggtgagggccacgcgccggtggccgaagaggcccgtcagccaggccgcggggaactgcacgaactgcgcgaagaagggcagggccgtcatcacgccgacgaggaagggccccagcttcagcgcgatggcccaggcggtgagcaccgtcgcgcccgcgcacgcggtgaagacctccgagaacatgccctccaccacggagacgcccagcgttcggcgcaaccgtccgtgatgggggcggaccctcggtccgggcccgtccgcgggcggtgcccccaggagcggtgccgacgagccgggcagggacgcgccggggcggaacagcggaaccgcggaagcaagggaggcgaagctgaagctgcggaggaactgtcgacgggaggctgcgcgggtcacaggtccgctctctgtcgcacgctccgctgggccctctcaatccacccccggtgggccccagggtgctcggtcgctctccgggcgggagcggcgcggctgtcccacatgctccggcacccgttcacgtctggctgctgggcagcgctggaatcaggtgcagttcaagcggtcttgaactatatgaacgaacgaggagacggcgcactatggatctggctcgggagctgacggattttctgggggcggtggagcagcggcttggcagcaccctggtggatggcgatgccggtccggacgtgaagggcgacacgctgatggaggcggcccgccacctgtgcctgggcagcggcagcaagcgcgcgcgccccatgctggcgcggctgttcggcggcgcggtgggcgttccggcggagcggctggtggacgtggccgtggccgcggagctcatccattccgccagcctgctgcacgacgacgtggtggacgcgggcatgttccgccggggccggcccacggtgaacgcgcgctggggcaacatcgtcgcggtgatgagcggcgacctcatcctgtccacgggcctgttccagctgtcccaactggacgcgcggctgacgcgcagcgcgctgtcggtcgtctccgagatgacccgcgccgccatcgccgaggtggaggctcgcggcgacctggacctgccgctcaatcggctgcgcttcatcgccgagggtaagacgggctcgctgttcggctggtgtggcaacgcggcggcgacgctggcggagcaccccgaggcggtggagcgtttcgacggcttcgggcgtcacctgggcgtggcgttccagattgccgacgacattcgcgacatcctgggcacggacgtaggcaagccgcgttacgcggacgtgcactcgcgcacgccgtccatgcccatcctcctggcggtggccaaggatgagtcgctgcggcgcaagctgaaggacgcgtgggcgttttcggcgatcacgccagatcgcacgaaggagattggcgcggccatcgaggccacgggcgccgtggatgcctcgatggcgcggatgaacgtcgaaatcgaggcggcgctcgacaagctgggccacttcgccaaggagcccgcgggcgcggagctggtgagctgggcgcggaagctgtcggccggcatcgccgaacaagtccaggggcgcgctgcatgaaaggctacctgtggacggggggacccgggagccctgcctcggaggcgccgccagcggatggccggctggcgccctgggaagccatcgcggtggacgcggtgggcaatgtcattgagttctgggggttcaagcgcaaccagggacgggtctgggccctgctgtacctgcgcggtgagcccctgacggcgggagaaatcgagcgcgagctggacctgtccaagggcggggtctccatgctgctgcgcgacctggagcgctggggcgtcatccagcgcgtgcgcctgccccaggacaccgtctggcgttacggcgcggagaacgacctggtccggatggtgacgcacgtcatcgaggagcgggaggcgggcttcgtcgcgcgcattcgcgccgacctggcggaggcccggcggctggcggagacccagtcggggcttccaccggaccggcttcagcgactggagaagatggccacgctggccgagcacgtggagcgcgcgctgcggctgttcatcaagacgtcccggctggatgtgtccggtgtgctgtccgtcttccgggacgaggccactggggcgcgccggggctcgaagtagtctcagtcaaaggggcggacatggattcgcactatgatcaggtgatgaaggcgcgtgcgggcgcggacccgtcggccacgcgcctgtacttcgcgtactcgaccatcctggaccgcgccgcgttcgaggagtggcggtcccagcacagctacgacttcttcgagctgcccgaagggcggctggccgaggccgtggatgtggatctggtctatgacttcccgtcgcgctggtggggtgggcgcgtcgcggggctgacggattccgcgggccagaaggtgtacggccgcctgttcgagattcgcggccaggactggcccatcatccagcacaaggaaggcttcgtgacgagcatgtgcgtggagcggccggtgcgcgtgcgcgtggatgggcaggagctggaggccacggcgttcgtcacgaatccgcggcgtacgtcggcggacggcccggtcagcacccgtttcgtggacgcgctggtgcgcggtgcccaggccgcgggcctgccagcggcctacgtggagcggctgaagcgcggcgagtagcccgcgaggacgttccgtaagtcctcggacaaaacccagcgaggtgccttccctcctcgctgggagtgcacagcttgggcggcgcgtatgttcttcttcttctcgaaccggctcggctgtatcggcagcatcctggtgtcgatcgccctgagcgcggtgctctacttcctgttcatgcgctgaggcccagcccctgggctcggctcacggattgccgtgccacaggtcgtccgagtcctcggagtccagtggatggatggtgatctcgcgcccatccttgtcgggcgtgctgcgcaccgcctccgtttcgtccggcgttcgaggtgcccgctcagagaagttgtcgttttgaaggtggcgctgacgctgctcactggtcccgccgtacccttcaatgatcctcttcttcgtcatccccgtcctcctggtgagtcgatcgcccagaagtaggctggggtcggatggaggagggagcaagcggcgtcgcctgctcgcccggtgtgcgggcgatgtgtcggagccttgtggggcagtgcctacatgcacgaaccatcaggtatttttaggacggcatgagaccgtcgttcctacatgaacatcagggcagggagcccaacgtggctgatcgggacagatttcctgtctgtatgttcagtgggtcatgcggtgttcggccaggccatgcctacatgaacgaactatcaggcattctcggcctcatcatcgcggcgccgctgtgagcggggcttcggtcgcgcgccgggttcggtcgctctcggattgctgatgacgcgttcagtggggcgaggaccctcgattgtgtcaatgcccacatggtcgcgtgttcagtgtcgtgcggaactctgatcgcggcctgcttgctgatgatatgttcagtaatttggatggcgccgtggatgtaagcgcctacatgatagcacgttcagttgtgttgcatggttgaacgccgtttttgactgactggatgttcagtgaaatttggcaccccgtgtgtcgagtctatgggcctgatcggtcggtgcctggcaggttcccgttcactgactggatgttgagtgatttcaacatgttttgatatgtgtttgtgaatgatttgtctgtgattgctggttgtctttggggcgggggcaggggcgtccgcggtgatgctgcggcgaacgcctctgtgtcgaggcattgactcagcccggcgtgaaccacaacacggacaacgggggcagggtgagggtggccgaagccggctggccatcccagcccgtgggctcggtgtgaatctggcccatgttgcccaggttggagccgccgtactgctcggcgtccgtgttgagcaactccacgtagcggccctggaacgggaagcccacgcggtagttctcacgcaccgttggcgacaggttggcgatacacaccacatgccgtcctggctgacgcgcgcgccgcacgaacgcgaacacgttgtacgcggccgagtccggctggagccactggaagcccatgggctcgccatccgcgtcgtgaagcgcgggcatgtcccggtagatgcggttcaggtccgagaccagttgaaggatgccgtggtgccccgggtcgtgcgtcaggtgccagtccaggctcttgtcgtggttccactcggcgggctggccgaactcgccgcccatgaagacgagcttcttgcccgggtgcgcccacatccacgcgaacagggcgcgcaggttggcgcgcttctgccacgggtcgcccggcatgcgcccgtacaggctgcccttgccgtgcaccacctcgtcatggctcagcggcagcatgaactgctcgctgaacgcgtacagcaggccgaaggtgagctggttgtggtggtactgccggtagatggggtccttggagaagtacgacagcgtgtcgtgcatccaccccatgttccacttgtagtcgaaccccaggccgccttcggacaccggcgcggacaccttgggccaggccgtggactcctcggcgatgacgacgacgcccgggtgcttgcggtggaccgtttcgttcagctcgcgcaggaaatggatggcctcttcgttctcccggccgccccagcggttgggaatccactcgccctgcttgcggctgtagtcgaggtagagcatcgacgccaccgcgtccacgcgcagtccgtcgatgtggtactcctcgatccagaacaacgcgttggcgatgaggaagttgcgcacctcattgcggccgaagttgaagaccagcgtgccccagtccggctgcgcgcccttgcgcgggtcggcatgctcatacagggccgtgccgtcgaactgtcccagggcgtgcaggtcgcgcgggaagtgtccgggcacccagtccacgagcaccccgatgccttcctggtgcatgtggtcgatgaagaagcgcaggtcatccgggtggccgaagcgcgccgtgggagcgtagtagccgccaacctggtagccccaggagccaccgtaggggtgctcggccacggggagcagctcgatgtgggtgaagccggtgaacttgatgtactcggccagcgccggggccagctcccggtacgtcatgggccggtcgccgtcttccaccacccggcgccaactgcccaggtggacctcgtacacgctccacggttggtgatggacgtcccgccgctgggcgcgttgctccagccacgccgcgtcgccccaggtgtagcgcgccaggtcgtgcaccacggaggccgtggcgggggggacctcggtacggaaggcgaacgggtccgccttgaggacgttgggcccgccctggccggggcgaatctcgaacttgtaccgggtgccttcgcccacctcggggacgaagagctcccagatgccggaggagcccatgcggcgcatggagtgcagccggccgtcccagccgttgaagtcaccgaccacggacacgcccgccgccgtgggggcccacaccgcgaacgaggtgccgcgcacgccgtggtggtgcagcaggtgcgcgcccatgcgctcccagaggcgctcgtggcggccttcaccggcgtagtacaggtccatctcccccagggtggggaggaagctgtacgggtcgcgaagcgtgaagacgcgcttgccggggtactccacttccagcaaatagttgaacgtctggtccttgccgttgatgcgggcctcgtagacgccgcccggccggtgcgtcatcgcgacgcgaccgccggattccggcagcacgtggatggccacggcgtccgggcggaaggcgcgaatcaccacgccatccccatccgggtggatacccaggacagcgtgcggctccgggtgcctcagttccacgacgcgttgaagctccgcgtcgacctgggccttgtcgggctgggcttcctcacttggatgcctccatacgcaagagggcctggagggggatgcgcacccagtccggcccgttctgcatttcgtatcgcacttcgtagaggagtttctccagctcgaaagcacgcagcatcacgtcgaaggtgtcttcgtccgagggcaggaagggcgcgccgcgcgtcacctgccggtagccttccacgaaggcgtcgcgcatggtgctgatgcgctcgtggggcgtgccaccctccagcgccaccgtcgcctccgcgtagtcgaacgagcggatcatccccgccacgtcgcgcagcgcgctgtacttctcccggcgggcggtgaaggagcgcgcgggctcgccttcgaagtcgaagatgatccactggttgttggcgcgcagcacctgccccaggtggagatctccgtggatgcgaatcttctgaccggagggcggcacctgcgccaggcgcttcgcgtgctcgatgaggtcctcgcgccggttctccagttccgggttctgccggctggcgtccgccagcgtcacgcccagctccccgacgatggaggcgctccagcgttggagatcctcttgcaacagcggctccggagtgaaggccgggtcttcttcggtcgccgaggcgaacgccaggtggagctcgcccaggcgtgtgcccaggtcacgcatctccgactggaagcgcggacccacggcgcgctcctggcgcagccggtccagcgtgtacttccagccgtccgtcgcgtccggcacgaagcggtgggccaccgcgagcgtcgcgcccgccgccccttccagatgcagcgcgcccaacagcgtgggcgtggcgcggaacgatgtcttggtcgcgaggaagcggcctacctcatgctctggattcacgccggcttccagcttgcggatgatcttcaggatgaccttctcacccagcaccaccgaggtgttgctctgctccacctgcagccgccgcacctccggtgacgcggggagcgcgagcaagccgtcctgaccgccaatccactcgccttgcacgcggccggacgcggacgccacctggcctccggttcggatgaggtcgaagaggccgcgcaggcattcatcgctctccagcgcgtctcgcacgccttcggtggagggatggacaggcagcaggtagcgctccgggctgcccagttcgtagatgacctccaccacggcgaggctgaacgagcagccgcccgattcgacggcggcgtggtccatcaccgtgacgtgcttgatgggccaggccttgccgctgaaccagcgctggtgcttgaggtaatcagggagcttggtcaagtcgagggtcgtcattcgaggctcctcacctgctggggcctgtccagccggaaccacagaaacatgaaggggcccatggagagctgatacggcagctcactcacccgcgggaagggggtttctccaatcagctccaccggcacggcgccttcccactcgcgcatgtcgagcaccgcgggctgggcaaagcgcgacaggttgcacaccaccagaaccgtctggccctcccattcacggatgaaggccagcaccttgcgattgtccgtctggaggaagcgcaggttccccagcgagaagacagggtagcgctggcggatgcgaatcatccgc

SEQ ID NO: 1035 - DNA, 12286 bp, Myxococcus xanthus
  unsure (1)..(12286): unsure at all n locations
cccgtgaacagctggtgcgctgctgcctggaagacatcgccatgggcaagctgcacgggctcaccattggcctggacatctgctccacgctgcacatggacgtgtcactggacgacctggactggtgcatcgagcgcatcatgccggcgaatccggcgtacctcatgtcgctgcccacgaagaacgacccgatgctgggctacctcaccaccgggttccaggaccacgtccgcatccgcgagcagttcggctacaaggtggatgaccggatgtgggccttcttccagcgcctgggcgtcatcgacgcggagggcaagcccactcgccacttcggtgacccggtctgggtctatctccagtacctgcgcgcgaagggcgacagccggccggaggcggacatccgggcggacgcggagcagcaactgtcggcgattcgtgcgcgcggcgtgcccatggcgcgtgggcacggcacgcacccgtgggacctggaacccgcgctggacgcggagttgcgccgcgtctacgtggactcgaagaagagcctgtggacggagctgacgcccgccttcatcaccgccgtgccggagggcgtgcggctggtgtcgaagtcgcaagaccggacggagtacatcctccacccggagacgggcgagcagctcgacgcctcgtccctggaggcggtgcgcgcgatgagggcacgccatgcgggacggtatgacgtgcagttgatggtgtccgacgggctcaacgcactggccatcatggacgagggacagctcgcgccctatctggagacactgcgcgcggcgctgattgccgccgggtaccagcctgctccagagcatctggtgctcacgtccggtcgcgtgcgcgcggggtaccgcgtgggcgaagcgctgtacgcgggcatggaggacgcggcccggcaccggggcctcatccacgtcattggcgaacggcccggcaccggccaccacaccttctccgcgtacatcaccgcgccttccggagccgtctggtcccagcccggcaaggtggaccacaacatcacccgcgtggtgtccggcgtcgcgctcacggcgtatgcgccctcactggctgcgccggagacagtgcggctgcttcaacaactggcgccccggggcggatgacgtccaggggcgacgacggggggcagacgctccgccccgggcaatggccactcacaccggctgtgagccattgaccgccgcgacgtgccgtcagtcgtggatgcagtcccaccatcgagcgcccgtcgattcatcgaccgagggacgcccgatggcggggtacggcgtgggtcaatccacgaccgccgtggcttcaatctcgacgaggacgcccggctcgaagagcacggagacaccaatcagcgaggctggcgccggcacgatgttcaactccttggagacctgctcgatgccggccaggaagtccggcatccgctcgtgcttccagtcgaccacgtaaatcgtcagccgaacgacgtcgttgaacgtcgcaccggccgccgcgagagcgatggcgacgttgcggtaggcctgcgcgacctgcccagccagatctcctcgtgcgacgagctgcccatccgcgtcgtacgcgacctgccctgcgatgtgcacctgcctgctgccggtggcgaccgccaccttccggtacacgtcgggcttcatcattccttcggggttcatcagggtgacaggcatgggtgctctccaatgagtgaggttgaggaaaggagcgattgccggacgcgtataccgagcccactgacgaacggcgttccccactccagcgacaggagggctacaatcaagagcccgccatgaaacgcgcccatctggatgagatcttcgccttcatggccgtcgtggacgcgggcagtttcgtcagcggtggccgagccatcgggctgacgcgctcggcggctggcaaggccctggcccggctggaatcccgcctgggggtgcgtctgctcaatcgcacgacgcgccacctgagtctcaccgacgatggccgtgtcttccatgagcattgccaacaagtcctggcggctttggatgatgcggaagccagcgttggagaccacacgggcacgccccggggcgtcttgcgaatcaccgtgcccgacgcattcggcagactgcatgtcctgcccgtgctgaagaaatatctgcagacctggcccgacgtgcaggtggaggtgagcttcaccgatcgcgtcgcggacatcatcgaggagggttacgacctggccgtgcgcatcaatgtcaccagcaccgatacgcgactggtgtcccggctcgtggcgcaacatcgggtgttcgtctgcgccgccccctcgtacctggccgcgcgcggcgaaccccagacattggaggagctcgcgacgcatgattgcctgctcttcagtagccgggcgcgacgacagcgctggcgactgcgcccgaagggcggcgcctatgtgaccgtggagggtcaaagccgcctacggctcgacagcggcgaggccatccgggacgcggctgtcgcgggactgggcatcgcctttcttcccagctttctggtcgacgaagacctggcgcgtggacgcctcaaggcgctgctgccgtcatgcgagacggaggtcgtccggatcatggcgttctacccgagcaaacgtcacctgccagccaaggtgcggcgcttcatcgacctgttggtcgagcaatagcgcgcgaaggcgccccccgcggtggctcaggtatccgtgaggcggaggacctccaagcgccccgggcgcgagaagtaccgagcgtgctgagtcttgcgaatgcggcaggagaccaaatctcctgccgccaattcgcgagcctgtcccggctccgccgggacatagactcgaatcgtcgagccctcgatgccccttgagagattggcgaagccctcgacggcctgcacgtgtgtgacggtgagctcgagaagaccatggtgtagaacgtcactctgctgacgccatgagaggacttgccccctcacatcggcccagttctcctgaatctgcaccataagcgtcatccctcgaggccagcaccgcgtgctcactcaggccagtcattgacaagttgctgcaggacgtctctggttttctgtgccctgttgacttcaacacgagccgtcattgtcatcccggaagggctgatgtcggaaatggacacgcaactgtcacgcccggaatacgaacgggagctcggatgggtgttgaaatcaaagcgagcattaccagagcgacctgggaatggatccccgtcgtcgccccggttgacggcacggtccaagtcctccaaggcatccgcctgaaccaagcgaactctgggatggacttcgttcgtattgtccggaatggactcatccacgtgatacacgagcagtcccgaacccggcaggaatctgtcgtactggttctgctggcggttctcgaccaggaagtactcggagcccggcaccccgttcttccaaagcctgtgcaccgagtgctccgtcttgacgtcagcgaagttcacgctcttgttggcggtgtagttgacgatggagacccatccctgcctggccttgcaccaagcggatggatgggccgggacatcgcctttgttgttccagcttccacccgccatcaagcaccagttcccgagcccttccgaggagccatccgcgtcgtacaggtccggccagccgaacacgaggtgcccgatttcatggcaacagacgccaatcttcgcatcctccgggatggtcaaatacccgaagatcttcgccccctgcgcattgtgttccccgccgacaagaacccacttgtgcgaccagatgtcaccagcgctgccggtctgctccgcgccaccgcctgagtggaccacgatgaacgcgtcgacgaagccgtttccatcgttgtcgtagggcgcgaagtccacgctggccgcggcttcggcggcatgcctcgccatggtccgcgcgttgggctccggattgtcagtgcccgaaccgttcccagcgtactgggccagcttgcaaggcatgcgatacggaccgacgacctgccccacgatgtcgacgagcccatgactggcctcctcgaaatattcccgcacacttcctgtctggatcttcccttgtgagaagaacaggtcctcgaattcctgccggcttcgattcatgggcctgtcttcgaagtcgacgaggacgacgatgacgcgcacttgcccccgaagtggctggcgctcaagggcgaagctgcggacccgattcggcccggtccccagcgggaaatacgagcctgggatgatgaggccgtcgttcaaccccatggcgtgcgtctcacgaaggagaagccgtcggccaaagaggttctccgatacggcctggataccctggaaacgctccttcatcctgctccggagttctggacttggaggaacgcggcaaagccgctcgataggtgaatgctcgctgcacatgtcccacccctttcgccaggcctgacacccagacacctcttgtccgactgtctcatcctggctcctgtctgagctgcacagtcagtgccagaaccttctccgcgagggggctgtcttcgaagcaacccctggttcgaaccagcggacgacatggaccgcgcaaagggctgcccactgaactgtcgttgcactcggactcatcaagggggcctgcgaaaagggatgaagagagaagatgtttgggacgactgccggcctgggagccacgccccctcacctgcccagtgcggcgcagaagcagcgcgacctcgacgtattcggctttttcgcgaccaagcgcctgctgggcggcgcccaaacgctcgtggcgcatgtcagacgctccgagtagggtggtgctcagtcacgccaccatgaatcccgccgagaaagccgccctcttcctcgagcgcctccgggaagcccatccggatgcgcgctacgaactcaactggtccacgcctttcgagctgctcgtcgccaccatcctggccgcgcagtgcaccgacgagcgcgtcaaccgcgtcaccgccacggtcttccccaagtacccggggccacaggccttcgccgacgcggacaccgccgcgctggaggaggacctcaagcccaccggcttcttcaagcagaagacgaagtccgtgcaggccatgagccgcgcgctcctcgacaagttcggcggtgaggtcccccacaccatcgacgaactggtgacgctcccgggcgtggcgcggaagacggccaacgtcgtcctcaacaccgccttcaatctcccctccggcatcatcgtcgacacccacgtggcgcgcgtcagccagcgcctgggcctgacgaagaaagacaaacccgaggcgattgaagaagacctgatgaagctggtgccccaggagcagtggaccttcttcggccccgccaccgtcctccatgggcgttacacctgcaccgcaaagaagccgaaatgcgacgactgcatcgtgaaggatgtgtgcccgcgtatcggcgtgtaaccaaatccctgtccgcctgtgggatatgaatgtcttttcgcgtacgctcctgggacgcgaaaagacgcgcatcaaaagcggaggaattcgcaatcgaggtggctgtatgacgttgttcaaccatcatgcccaccgccccttcctccgatgcctccgcaccgcgctccgaagcccgtccggtcgaggcaggtgagcgcctggagctgctcgacgcgctgcgtggcttcgcgctcttcggcattctcatctccaacgtgcagatgtggttcagcggcagggtgttcccgtcccgggaacaattcgaggcgtccatcgccagtgcctcgctcctggacaccatcacccggtatgccttcgaggtgctggtctccgggaagttcatcaccctcttcgccttcctcttcggcctgggtttcgcggtgcagctcggccgggtcgaggcgcgaggtggcggcttcgtcccgctctacgtgaggcggctgacagtcttgctggtggtgggggtcctgcacctgttcctgctctggtacggcgacatcctctcctcctatgcgctgatgggcttctgcctgctgctcctgcgtcggcgttctgagcgaacgctgctcatcatcgcggcggtgctcgtcctggtgtggccgctgctcatgagcctcctctggcggctgccgcaactcctggcggactcacccgaggccggtgccgcggtcatggccgcggcccgcgagaagacctccgccatccacgcgcggatgctgacggccatcaccgggggaagctggtgggacgtgacaaagacgagcgccgggttctaccgcgatgagttcttcacgatgatgctggccggactgctgacctgtctgggccgcttcgcgctcgggctctgggcgggacggcgcggcatcttccaggacgtcccctcgcacctgggtttctttcgccgcctgcttggctgggggctggtgtccgcggtggtgggctccgtaccaggcgtggtggtgacggtgctcatgcagaagaaggtgctcacgccggagacgatgcccgtgtggctgcccctggtgctggcgccgctgcgcaacctggcacaggtggggctcgccggcgtgtatctggcgggcatcaccctgctcttccagcgcgccacctggcagcgggcgctgggactgctcgcgcccgcgggacgcatggcgctgacgaactacctgtcgcagacggtcatcagcctgctcatcttctacggctatggcctgggacaggtgggcaagcggggccccttcgcttgtgtcgtcatctgcgtgggcgtcttctgcgtccaggtgctgtggagccacctgtggctgtcacgcttccgcttcggtccggtggagtgggcgtggcgctctttgacgtacgggaaggctcaggccatgcggcgcgccgcgtccgacacgcccgcccccctgacggcgtgacgggttcgacctggcgacgtcaattcgtgaccgccgggtgaggagcggcaacgcgcacccggaaaccgaagccaatccaaagatggaaggcgcgctcgcggagggtttcgctccccgaaccgttgagcaggcgtacatccagcttgtcgtactggccacctgtaccgacgacgaagagcccggcccagaagttcccgccgaaattcctgtcgaacccagcctgcagcgtgacgtcaggccctgagtaggtgacttccgccgcgggcaccgagaccgagctcgtatcgtagccgagtgccacccccgaccagaggtcgatgggtcccgatgggttccagtgatagttcccctggaggccgaagcgcaggttgctgcctttgcacgtccgctcagcggagcaacgaatgcgcatctgcgcatgagagaactgggcccagggcccgacctcgacgcgcgaggcgatccggatggtgggctccacgatggcggcgaagagccccttgtaaatctcatacaagtagagcggctcggcggcgccgtccatgcgcccgcctggcatgaggtagccccctcgcgcggagatggcgagccagcgaggaaagcccgggtcccgcgcctcctccacctccgcgaaggccggccaagacaccaggaaagacagcaagaccagtgtcctcgcggtgggacgagagagcgtttgcatgggcacgcgttcggttattacagtcgctcgaccgccgtcaatccaaggcttcccagtgccccgaaatcgctccgacaacctcccgcccctgctcgcgctggtggccgttggcctcttcgccgcctgtggtggcccctccgccgaagaggacgcacgcgtctgtgccgacgtggaatgcagcgcgggacgctgcgtcgccgaaaacagcgcccccgtctgccgttgcagcgcctgggagcaggccgcgggcctcacctgcgccatcgtcggttaccggcagcccgacgaccatggtgacaccccggagaccgccacggcgttggccccctcggtggaattccaagagggcatcatcaacccgcccttccgagcgaaggcggaccgggatgtcttcgccatgcccaccgcggcaggccatggctatcgcatgttcgtccgggccggcaccctggcccccgtggacgtgcgcctcgtggaggcctcggggcgtgaggtgaggacgcggaccgtcacgacgtctgaaggcacccgggtggagttcgtctccacggaggaggcccctcgattcatcaccgtggccgctccgggaggaagcggtgcgtcggggacgtatgcctaccgattggaggacctgggccgggatgcgcacggcgatacgctcgccacggcaacgccgctcgcgctgacgaacacccccttcccgctcgcgatcgagttccaggacgacgcggatgtcttcaccttccgcaccgagccgaaccagggcttccggttctcctgcgagggcgagaacgtctcggtgcacctcatggatggcgagggcgccccggtgaatggcggggcgacgaggaactcgtcacgcgtcagcgcgggccagctgagcccggtcgcgaacacctggttcgtccgggtctacagcagttccgacgcggccttggccacccagtgccagttggacgacctgggccaggatgaccacgccaatgcgctccagggggcgactccgctgacggcgggcctccccgtggccgtacgactccacggccccaacgacgtggacgtcttctccttcttcgccaccgcgggacacatctacgacatccgcttccaccccgccgtctatgagcggcgcttcaggctcacggacgcggacggcaagacgctggcggagactcagtggaaccgaatcgtccatgaagcagcgtcgacagggacgtactacgtgcacctgctgccgaattcatcctgggggagcgacatcgaggtgcgggtcgacgacctggggacggatgaccatggggctaccccccaaacggccaccctcgctgacgtgggggaaaccgtcaccggactcatccacaagcaggcggacctggacgccatctcggttccgctcgacgcggatgtgttctaccggctgtcctgcacccgggcatgtacgctgacgacgcgcacttccggcgcccccctctacatgatgaatatcgaggacggcttgtggcacgtccatacgccggcttcggggctcgtcacgttcatcgtcagctcgaggtccattccctacgacttcacgttcaagttggaccaggcaagcaccgatgaccacggcgacgacgccgaacacgccacaccgcaggtcgttcccgtgaacgcggccggcgtcttcgagttgggctcggacgtggacgtcctttccttcgagttggaggcgggccggacctacgtcgtgcgcggcagcagaacgaccatccggatccttgatccccttggcgcgcaggtcgccctggcgtacgagagggaaacggggaaccagaccttcacagccccatcgtccgggacgcatgtcgcggagctcaagtctgagaatccctacctgccgcgtgagacggcctggagtttctccctgcgcgagcagtgagcacattccccgccgccgcacaacagcgggcggaggccacaacgtgcgctaccgcaccggactcaagggccgcctgagcgctgaattcaaggaaatgcgggcccgcctcctgcccgaccgccaagtacgctacgcgttttgagccggactccgtttcatggacgtgacgtgggcggcccggcctgtggcagactctgccgacaatgtgggattggacccgccaactggcggagtggtcgcgggacgatgttccgttcgccgtggcgaccgtgacggtgtgtcagggaagtacccccgccaagcctggcgcgaagctgctcgtccgcgcggacgggacgttccacggcaccgtgggcggtggccacctggagcaactcgtcctcgcggacgcccgcgcctgcctggagaaaggggaaccccgtgcgtaccggtatccgctgggctcgaagctcggccaatgctgtggcggcgtggtggacgtcttcatggagccggtgaaccacggcccgcgcctgtatctcttcggcgccggccacgtgggtcaggccctgtgccgcacgttggacggcacccccttccaggtccacctcgtcgacgagcgccccgaatgggtccacggcgagcgcatcnccgcctcggtcatccgccacgaggagccgtgggacgtcttcgcctcgcgcgctgtctgggacgcgcgccgcacgtacatcgcggtgatgacgcaccggcatgacctggaccaggacatcatcgccttcgccttggagaagcccgcgcgctacgtgggcctcattggaagcaacaccaagtgggcccgcttccgtcagcgcctggaggcccggggcgcgacggcggcgcagttggcccgcgtgcgctgccccatcgggctggagattggcggcaagtcgccccaggaagtcgcggtgagcatcgccgccggactccttcagctccatcaccagggcgcagacaccgaaactaccgccgaggccccgccctcggagacgccccgcatgcgcgggggctcgtcaggagaatgagcaatatgttcgagttccagctcaatggcgcgacggtccgcgtcgatggcgtctcccccaacaccacgctgctcgacttcctgcgtgcccgcggcctcactggcaccaagcagggctgcgccgagggcgactgcggcgcgtgcaccgtggccctggtggaccgggacgcccagggcaaccggtgcctgcgcgccttcaacgcctgcatcgccctggtgcccatggtggccggccgtgagctggtgacggtggaaggcgtgggcagctgcgagaagccccacccggtgcagcaggccatggtgaagcactacggttcgcagtgtggcttctgcacgccgggcttcatcgtctccatggcggaggcgtactcccgaaaggatgtctgtaccccgtcagccgtggcggaccagctctgtggcaacctctgtcgctgcaccggctaccgccccattcgcgacgcgatgatggaggcgctggcccagcgcgacgaaggaccgtcgcctgccacggcgatcccctccgcgccgctcggaggtcccgccgagcccctgtccccgctgcgctacgaggccggtggacagaccttcctgcgccccacgtcgtgggaggagttgctcgacctgcgcgcgaagcacccggaggcccacctggtggcgggcgccactgaattgggcgtggacatcaccaagaagtcccgccgctaccccttcctcatctccaccgagggcgtggagtccctgcgcgcggtccgccgtggggaggatggctggtacgtgggcggcgccgcctcactggtggcgctggaagaggccttgggtgacgagctgcccgaggtgaagaagatgctcaacgtcttcgcctcccggcagattcgccagcgcgccacgctggcgggcaacctggtgaccgcgtcgcccattggcgacatggcgccggtgttgctcgccctggatgcctcgctcgtcctgggctcggtgcggggcgagcgcacggtggcgttgtccgacttcttcctcgcctaccggaagacggcgctccaatcggacgaggtcgtccgccacatcctcatcccccacgctgccgtgcccgagggcggccggcggctctccgactccttcaaggtgtccaagcggcgcgagctggacatcagcatcgtcgccgcgggcttccgcgtggagctggacgcgggcggattggtgaagctggcgcgcctgggctacggcggcgtcgcggccacgccggtgcgggcgcgccgcgcggaggcggtgctcaccgggcagccctggacggccgagacggtggcgcgcgtgctgcccgtgctcgcggaggaaatcacgcccatcagcgacctgcgcggcagcgcggagtaccggcggggactggtggcgggcctgctgaagaagttcttctccggctcgcacagcccggccctggacgccgcgccgggcttcgacgcgggtgaggtgcaggcccccgaggacgcaggacgcgcgctgctgcacgagagcgcgctgggccacgtgacgggcagggcgaggtacgtggacgacatggcgcagaagcgggccatgctggatgtctggccggtgtgctgcgcccatgcgcacgcccgca

SEQ ID NO: 1036 - DNA, 12950 bp, Myxococcus xanthus
  unsure (1)..(12950): unsure at all n locations
ctgcgtgaggccatcccgatctcgcaggtcgatgaacaccgcgccgccgtggtctcggcggttgtgcacccagccgaagaggacgacttcctcgccgacgttggtcgcggtgagctgaccgcaagtgtgggtacgcttgacctcggagatgaacgggactgccatggcaccgcctgctggattcgaagggggaaaaggcgaagcaccatacggatcgcggaaacgacgcgtcaaggagtccgagcgccccgggtacgtctcaaaccgtcggaatcagtgcggattccgggttccaaagccgcccgcgaggtcccggcgcaccggctggccggccgccgtgctcgcgaatgtgacggccggggggaatacacgttccgggcggtccggagtagaacggcggcatgctccgaacagtcatcgcctcgaccgccgcgctcggactggccgccggctgtgcgcccgattcgaccgcgcccgtcaaggtcagtgccctggtgctctccagcaatggccagtacgtcccccaggaggtggagctgaagaccatctccgacatcgtcggcctcaagggcacggtggccgacctccagggaggcgcgcgcatcgtcatcgactcccaggacccggacctgaacaacgccaccacgccggagggctacgccaacgcgctgctcaagaacgccggccgtgacgtcagcgccaactacatctcccagggcggcgtcctctggccggcggacttccacacctggaacatggtgacggcgtactacagcatggagcgcgcctacgattacttccgcgtcgtgggcaacatccccgcggcggacttcaaggaccccgtcaccacgtactacttcccggagttcgtgctcgcggacgtggacaaggacccgctgagcgacaacgccatgtacttctccgtgctggagtcgttcctgatgctgcccttcgacaagctccagcgcgccccgctggccatcaacgccggcatcatcgcccacgaatacgcgcaccgcgtcttcaacctgaaggcctacaacggccagcagttcccggaggcgctctcgctgtggcagcaagccggcgccagcccgggcgccaacatcctcaagtccttcgacgaggggctggcggactaccacgcgtacggctccacctgccagacgacccagggcggcaagggctgtgacacgcgcttcttctccacgtccttccacggcaacctgtacgggcaagtcaccgaggaccgggacctggcccgcgtggaccgctgcatggacgcgtccctgctgaaccagttgtacaaccagaacctgagcgcgttcagcggcaacgagtaccgggtgggcacgctgctcgccagcgcgctctaccaggccggcgaggccaccggtcaacgcgacgtgctgctgcgcgccatcgtcgcctcgtacaacgacgagagcacgacgacgcccgggctctaccagttggcgcgcgccacgctggcggaccagtcccgcttcaccctggccgtggccgccagcgccatcatcacccacatcaccgacctgcgcctgaaggaggccgtctgcaacgagctgatggaccacctccagattccgcgcgagcagctcgtcggcaacgaccccaacatgtgcccgcccagcgccgcgggtggcaccacctgcccccgcctggacctgtgagcatgaggactgcttccgtgaagacgtggctcttgcgttgcgccctgggcagcctcgccctgtccgcccccgccctggcccaggacgaggacgacccctacgcctacccggacgaggagcccgccaacgacgcctccgacgcctatgaccgtgtccgccccaaggtcgacgaggcggacgacttccgccgcgtctccgagcaggagtacgacgacggcgaggacggcttcaagcccctctccgggctcgacgacccgaacctgggcgtggccgtggagttcatcaccggcgccctcttcctggacagcccgcgcggccgggccgcggagacgcgcctgggcctgggcgtgcgcgccacgtgggagtacggccgcatcctcgacaacgagtcgcttcgcgaggccctctgggccgacgtgcgctggacgttcggcggcaccagcgacggcaccgacttcatccggggcaagacgcacttccactacttcaccattgccccggcctatgagctgaagctcggcaagtccgacttcggcttcttcgcccaggcaggtggcggcatcgcgtacacgtcgtcgaccatcaccatcgacacggtggagacgaaggtgagcggcagcaagccgctgcttcagtacggcgtgggcttccgcggccggccccggctgacctcctccggtaacttccgcctcgccttccggctggaggccatgggctaccgccggggctaccacaacgacttcttcctgggcggcagcctcggcaccgccttctgaagtcgccttcaatggccgctcgccgcgctgcatccggcgggcggccatgaagttttttccactgtctctcctcttcgcccggaccccctccttgcgacttcaaggagttgggactggcacgccatgtgctcctatttccaccgggacgggaacctgggttcccctgggggctgggaggcgagcgatgaagaacgcgcagggacaaggacagcacttggaccccgtatgtgggaagaccttggacacacccgagggccgtcccaccgccgagtacaagaagcgccgttacttcttctgctcggagcggtgccgccatgccttcgaaaggcaggcggagcgcttccgcttcaacgaactggcccgcgtcggcgcgctgatgacgccgggccgcgtccgctggggcatcgcctgagcgtcacggccgctaggcggccacgcgcaggtccttgagccgcagagacagcttgcgctggcctcggaacgtgtcgaagccggcctgaaacgccaggtccaccgggccatccaccagcgtggcccggtccgccatgttgaagccgatggcgtccagctccggtgcgtccgccagggcgagcttgagatggccgctgcccgtgccggacttgggctgcagcacgcgcgggcgagccacttgccggcgcagcaccagcacgggctccggattgccctgcccgaaggggcccagccgctggagcgactcaacggcatgagcgtccaactcgttgggattcaccaccgcgtccacgcggcaccgggggatgaggtcctccggcgtgaggcgctggtaggcaatcttctcaaaggcctcccggaaggcgggcagccgctccgcgtcgatggtgagcccggcggcgtgcttgtgaccgccgaagcgcgtcagcagctccgcgcagccactgagcgcgtcatgaaggtggaaggcctcgatgctgcgcgccgagcccttccccacgccgtncttcacccccaccatgacggtgggccggtagaagcgctccaccacgcgcgaggcgacgatgccgatgacgcccgggtgccagccttcgtcgtacagcaccaggccgcgcgcgtccttcagcgactccgcctgggccagcgcctgcgtgaggatgctgctctcgatgccctggcgctccgcgttggccctgtccaacaccgcggccagtgagcgcgccgtctccggtgactccgagcacagcagctgaagtcccagcgaggcgtcatgcagccggcccgccgcgttgatgcgggggccccaggcggaaacccacctgacccgcggtgacggaggcgtccgggtccatgcccgccacttccttcaaggcccgcacgcccggccggcggcccgcgctcagctcctggaggccatgcgtcaccaggatgcggttggcgccggtgagcggcaccacgtccgccaccgtggccagcgccaccaggtccatcatggaccggaggttgggctccttccgggtggcgaagaagccctcgtcgcgcaggcgcttgcggatgcccatgcagaagttgaaggccacgcccgcggcgcacagcgccttcgtcgggtactcgcagccaggctggtgcgggttgagcaccgccaccgcgggcggcagcgtgggcggcacggtgtggtggtccaccaccagcacgtccaggcccagctccttggcgcgggtgatttccgccaccgaggtgatgccgcagtccagcgtcaccagcacccgcgtgccctccgcggcgatgcgctccaccgcgccgacgttgaggccgtagccttcgtccagccggtgggggatgtacgtcgcgggcggcgcgcccagctccttcatgaagaggtacagcagcgacgtggagcagacgccgtccacgtcgtagtcaccgtagagcgtcaccttctcccgcgaacgaatcgcccggatgatgcggtccaccgctcccggcatccccttcatgcggaacgggtccggcaggtccgccaaccggtccgacaggaacgccgacgcggactcgggggtgcggtagccacggtgcaggagcaccttcgccgcgagcgggtgcagtgacaactcccccgcgagggacgccacttcctgctcgaccacatctggaagcaaccaccgcacgctcgacactcctcctcgccttctccgaggggagttggcgggatgaattggctacgaaagcgacagtacctcagacgtctgaccaggacagtccaaccttgagcccgacacttcccctcctacacaggcgttcaggcagacgcacgtctggtggctcgctgattcacgcacggtcggtcgccggtgagcaggttcaaacgcacacctgaaaacagtgaggtcgagcatgcatccaagaggcacccgggccgccacgctggccctggcattcgccacgctgggcaccgcgggttcggcggccgcgcaggagcggcgcgacggaaagcgcggtgacctgaatgtgttcctccgcggcggcgtgggcgactacaccggaggcctgggcgacctgacgagcacgggcccggcctggggtgtgacgctcaacatccagcccaccaccttcctcggcttcgaagtgggctacgaaggctcacgcaacggcctcaccgacagccgcttgctggagcagccctcgctcgtccggcagggcggtagcgcgctggtgaaggtgtcaccgcccttcctcaccaccgtccggcccttcgtcggcgcgggcctgggcgtctcccatatgaacgtccgcggcccggtggaggacctctaccagtcggacacgatgccggaggtccccctggcagcgggcgtggagttcaaccgcggcgcgctcacggcgggcatccggaccacgtaccgcgtcctcctcagcgaaggctgggcggacagggccgtggaggacacccacggcggcctgctggacgcctcgctcacgctgggcgcgcgcttctgacaggcccctgaaacacccagggccctgcttcccgtgaaggaagagggccctgtcggtgtccatcgcacgaggccttcctcaacggaaggaaggcctcaggtgcgggtggctcacgcggcgttcggctgctggtggtccacgttgccgctggcgcgcagacgggcgtccttcgccgcggcgcgctcgtccagccagatggtcagcgggctggcgatgtagatggtcgagtacacaccgaccacgatgcccaccagcatcgccatggcgaagtcgaagatttcgcccacgccgaagatgagcagaccgatgagcgacagcgccgtggtgccggacgtgaggatggtgcggcccagcgtgtcgttgatggcgatgttgatgacctccgcgaagggcttgcccttgtacttggccatgtcctcgcggatgcggtcgtagatgacgatggtgtcgttgacggagtagccgaccaccgtcagcagcgccgcgatggccgtcaggttgaactcgcgccggctcaccaggtagtagcccgccaccatgatgacgtcatggaccatggacaagagcgcgcccggaccgaacttgaagtcgaaccggaacgccacgtagatgaggatggcgaccatcgagtacagcagcgccatgatgccgcggttgcgcagctgcttgcccacctgtggaccgacgtagtccacgcggcgctgctcgaagtccggcttctccagtccggcgttgagcgcggcgaacacgcggtccgccatgccgctggccaccacctggtagtcgtagcccgtgccgccctgggcctcgcccaggtcacgcacttcctgcacgccgatgcccgccgactccaccgccttcttgacggcgtcggagtccatgggctgcgccgcgcggaagcggatgatgccgttgggcagatccgagtagacgttgcgcacgccccccagcgcctccagggcctccttgcccttggcaccgctctcctcgttgagctgcgtgacgccgcccatgcggagcaggaaggtgttctcctccgccgcgccgatgttctgcacgctgacgtctggcaggccgcccttgtccgcgcgctcacggacctcctcggcggtgatggggtggtcgaacttcacctccaccaccgtgccacctgcgaagtccacgccgaagttgaagccgaaggcggcgatgccgacgatgatcgccaggttcagcagcgtggagataaacagcgcgggcttgcgcttgctgatgaagtcgatgttcgtcttgttcttgaaaatctgcatgacggttcccggactccggccggtcagacggagacgaccttcgcgttacgaccgtggacgaagtaggtcatgatgactcgcgtcaccgtgatggacgtgaacagcgacgccagcaggccgatgatgagcgtggtggcgaagcctcgcaccggtccggttcccgtgaagaacaggatgaaggcggagatgagcgccgtcacgtgcgagtcgaagatggtccagaaggcccggtcgtagccctggtccaccgccgcccgggccgacttgccatgccccagctcctcgcggatgcgctcgttgatgagcacgttggcatccaccgccacccccagcgtcagcacgaagccggcgatgcccggcagcgtcagcgtggcgttgaagaaggccagtcccgccaggatgagcaggccgttgagcaccagcgcgaggtccgcgatgaggccggaggccctgtagtagatggccatgaagaggatgaccaggcccaggcccagcaccgccgccatgccacccttccggatgagctcgtcacccaggctggcgccaacctgacgaatctcacccaccgtcacaggggcaggcagcgcgccggccttgagcaccagcgccagcgtctgggcctcgcccagccactcctcgaaggtgcggccacccatgcggcccatggtgatgcgggccgaaccgccgctgatcttctcgttgatgttcggcgccgtctggacgttctcgtccagcacgatggccatgcggcggcccacgccctgctcggtcagccgctcgaactcgcgcgcgcccgcggggtcgaaggagatgttcacctccggctcgttgagctggctgatgttcgcgtccgcgctcgccaggctctcgccggtcagcggcacgttcttgtccagcaggtaggagcggtacgaggtgcactcgttcttcttcaccgggttggcgatgcactcggtgagcaccacccggttctccggcaccttgtccttcgtgtactcggtgatggcctcacgcgtgggggcctggagctgcgggaagccgccctccgtcgtcagcgtgatttcgctgccagccggcggcggggtggcctggagcagctgcgcgaagaactgcgggttggagtcatccaccatccggaactcgagctgcgcggtggtccccaccagctccttcgcctgctccgggttgctgcggcccggcagcgaaatctggatggagtcggcgcccagcttgcgcacatccacttccgccacgccccacttgtcgatgcggcggcggatgacgagcatcgcctggtccaccgcttcggtccggaagacgttggcctgactctcgtcctgcaccagcgtcagcgaggcgccgctgcggctgacttccttgaagtcagtgaaggtggccaggacctccttctggatggcgtccatggtccccgggtccttcgccgtcagggtgacctcgagcttctccgggtccgtgtccgccgacacctcgcccagcttcttgtcattgacgtaattgacaatctgctgcgcgcggcgctcggtccgcttctggagcgccgtcttggtgtccacccgcatcaccatgtggatgccgccctggaggtccagccccaggttcaggcggtacttcgcgggaggcgcccaggcgggcatccgctcctcgagcacggccaggttgttgcgctgctcccggtcgagaacgacgagcgagtagtaggtcgggatgaggaaccagatgcagcccagcgtcaccgcgacgatgagtccgaacttccaccaccagccgcggtccatcacttctcctccttcttctctccggccgccgtcgcgggggccgcgggcgtgccttccgccaccgcgcccttggcgctgacggccgtcttgagcacgcggatgcgcacgccgctggagacctccagcgtcacggtgcgctcatccacgagatggatcttcccgaggatgcccccggaagtgacgacctcatcacccttcttcagcgcggagaggagcgcacggtgctccttcaactgcttctgctgcgggcggatcatcacgaagtacatgatgcccaccaggatgaccaggaagcccagggtgcccaggggattgccaccaccggcctgcgccagaatcagaaagctctcagccacacactgcctcgtcggttgaggaaagcttgggatggaaggcccccgattttgttcgaggaaaccatccgaaagggggccctcttagcaaggggggcccatgtgagcaagtgaacgcgggaagccgggcaatccatccgcccggtcagcgaccgcgggtccgttcggcctcctgcgccttggcacgggcacggaattcccgggcaaaagtggcgaaccggtcctctgccaccgcgcgccggacttctgccatcagtcccaggaagtagtggaggttgtgaatcgtgttgagccgcatggccaacagttcctgggcggcgaagaggtgccggaggtaggccctgctgaaattgcggcaggtgtagcaggagcaagcagggtccaccggccggttgtccctggcgtaggccgcgttccggatgacgaccttgccctccgaggtgaagagcaggccgttgcgcgcgcaccgggtgggcaggacgcagtcgaacatgtccaccccgtgctccacgcaggtgaccaggtccacgggcgtgcccacgcccatcaggtagcgcggcttgtcgcggggcagcaggggcgcggagtaggccacgccgtcatgcatggcctccggagcctcgcccacggagtagccgcccagcgcgtagccgggcaggtccaccgcgcacacctcctcggcgtggcgcttgcgcaaatcctcgtgcaggccgccctggacgatgccgaagagcgacgagcgctcccggctccaggccttcacgcaccggtgcagccagcgggtggtgcgggccagcgacgcctccaggtaggccctgttctcggtggagggcgggcactcgtcgaaggccatgatgacgtcggcgcccagcgtctcctggatgtcgatggagcgctcgggcgtgaggaagtgccgcgagccgtccaggtgcgactggaaggcggcgccctcctcggtgattttgcgcttctcggacaggctgaacacctggaacccgccgctgtcggtgagcatgggccggttccacgacacgaagcggtgcaggccgcccatctcccccaccagcgcttcgccggggcgcagcatcaggtggtaggtgttgccgaggatgatctgcgcgtccagcgtgagcaggtcgtccggccccacgcccttgacgctgcccacggtgcccacgggcatgaagatgggtgtctccacggggccgtgcggcgtgtgcagacgcccccggcgggccttcgttcccgacgtgtcctcgtgaaggagctcgaagcggaccatccccggctccacgcgggtatcgcccttgccacctgactgcttcgcttcctgctgctcgcccatggcgttcactccgacaccagcatggcgtcgccgtaactgaagaatcggtagcccgcgcggaccgcctccgcgtaggcctccagcgtgcgctcgcgtccgagcagcgcgctcaccagcaccaccagcgtcgaacgcggcaggtggaagttggtgagcagcaggtccacctgacggaaggcgaacccgggacggatgaagagggtcgtctcgccggggcccgcgcgcagccgccccgtctccgggtcggtggcggactccagggtgcgcaccacggtggtccccaccgccaccacgcgccggccttccgcgcgcgccgcgttgatggccttcgcagtggcctccgggacggtgtagcgctccgggtgcatgtggtgcttgtccaggtcgtcctcacgcaccggcaggaaggtgcctggccccacgtccagcgtcaccagcgcccggtgcacgccacgcgcagccagggcggccagggtctcctgggtgaagtgcaggcccgcggtgggcgcggccacggctccggaggcgcgtgcgtacacggtctggtagcgctccgcgtccgcggcgtccggctcccgggtgatgtagggcggcagcggcaggcggcccgccgcgtccaacagcgcggccagcgaggcgcccgggggtgcgtggaaccgcacgcggtactcccctcctcccagcgcctcctggatttcggcctccaggccgctggcgaacatcacgcgctgcccgggcttgagccccttggaggcctgccccagacagacccagtcgagcgactcgggggccgccccgagcgccgccgaggtcagcgtgttctgggcggccgggcgcacgacgagcagctccacgcggccaccagtgccggccttctggcccagcagacgcgcgggaatgacgcgggcgtcgttgaggacgagcaggtctccggggcgcaggagctcctggaggtcggcgaaccggcggtgcgaccaggtgccgctggagcggctgatggtcatcaagcgcgacgcgtcccgctcggccaggggagcctgggcgatctgggattcgggcagcgcgaagtcgtaatcagagagacgggacgacacgggggtggcgcttgtagcagcccccacgccgtcgcggaaagcgcgccggacgcgggaggcgtcagtagagctgctgcagctcggccccggggtagtagtgggagaggatctcccggtactcccggcctttgtcggcgagcgccttggcgccccactgacacaggcccgccccgtggccatagccgcgaccggtgaacacgtaaccgcgctcggtgcgttccacctcgaagtccaggctcttgagccgggtgtagccaagcttgcggcgcaactccacgccgtccatggaggcgccgtccgccagggtgacgcgcgtcacccggcgcgtccgcgtgcgggccgccaccttgagcccctgggccgggtggcggagcgccgccttgatgtccgcgtcggagagcgtcgccgtccaccggctggcggggagctttccgcaggggcagtcgacgggctggaggtacggcaggtcgcgctgcaaggcatcgagccccgactccgtccggccgccacaggaggcatggaagtacgcctcgatgggcgccagctcgtacgtgagcacctgtccccgcgtggcctcgacggcggccttggtgcgagggtcctcgcggttgacgccgccatagacttgatggagcacgctgctgcccaggtggaacgcgttgctgtaggcatccagcttcttctggagcgcatacgtccgggcagccaccgcctgggccttgagggcctccgggggaaacgacacgggcatctcgctgcccagcacggcggcgaggtagtcctccaagggaatgacgttgatgagctgcagcccactgcggtgcaggcgcaccaccacatcgccgcggacctgcgccgcgcccgccttgagcggctcggtgccaggcgcggccgaggcctccgacatgccagcgcggaagcggacggagtcgccctccacgggcgtgccgttgacctcgatgcggccccccttgcggcggacgttcgcctgtcccgaggtgatgggggcgaaagtggcctcctcgctgtcgggaccggaggccagcccccggccgctgatgcgcacctcactgcccgcgtcctcgatggagatgcgcagggtctccacggcgagcacgcccgaagggaccagcaggagcaggatgagtgcaacaggtcgcaacatggccccgaagtgtagaggcgtgggtgctcgcctcaagaaaacgtccggcggatgggagaggatggctcacccgtgacgtcaccttcgcgccctgccttccccacggccttcatcaccgccctgcgcgagttggagccccgtcccgccgcgatgctcaccctccggttggtggagggccgctcgcgcgaagcctgcgcgacgcattacggcatccccgcccaagccttctccgtgctgctgctgagggccgccatcgcactggccctgcaccgaggcgcccccgcccgcgagcccgccagtgagaacgaggaagccgcctgggcacggatgctcgcggacgcgctcgagcgccaggacgcgaagttccccgccgcgctggctccggtcgtggagacgtgccgagagctccagacgctggcgccccaggtcgccacgggcttggaaacggcggagcgggaggcccgcgcgtcgccc

SEQ ID NO: 1037 - DNA, 11854 bp, Myxococcus xanthus
ttcgcagagggaatggcgaaggtccacgctttcgccgcggatggcgtcgcagggggatagggcacagtgttcatcgacttcgagggaattgacggaagcggcaagacgacgctctccaacctgctggccgcgaagctgaagcggctgggctaccgggtggcgcatgcgcgggagggcggcgagctgcaggcgcccgcggcgcggcgcatccgggagctgacgcgagactcccggctgctggagatgtctccacgcacggagttcttcctcaacctggcgcgggacgcccaacaactggatgaagtggtggcgcccgcgctgtcccggggcgaggtgtgcatcaccgaccgctacctgtactcacaactggcgctcagcggtggaggccgcgggctgcccatggacgagctgcgacccgcgtgcgagctggcctcgcagggcctgtggccggacctggtcatcctggtggacgtggatccggacctcgcccggctgcgcaagcgcctgggcaagctccaaagcaagcgcgtcagtgatggggacagccggaagggactggtgggcgcgggcctggcggtgcgcgtgcgcgagtccttcctggagatggcgcggaaggatccgcagcggtggatcatcctggagaacaacgacgtccctctgcgcgtgttggagcagcggctggtggacgccgtcgtcgcccggctggaggggcgcgagcagcaggtgcagcgcatcgtcccggcgccggcccggccacggaatgccagccccaccacgctcgagaacctggaagagcgattcttccagacgctggacaccgtggagcagcgcgaaccggcgctcgcggtgtggatgttgagcggaatcccgggcctggccgcgcaccagaagcgcctggccttcgcggagcgcttcccgggcctcaccgcgcgcggcatggcgggcctggctgacgtaccggccatgggcctgcgcgaggtgctggcggacctggcgcccgcggaggtggccttcagcctcacgggccgcatggactcgcgcgcggccatgttgcggcagcggctgtacgcgcaggcccccacggaggtgctggcgagcctcaagaacgatggctcgaccccggcgtgggccctgcgcgagcgcgccatgcgggacgggcggctggcggacgtgctcgcggggctcgccggccaggactgcgaggagtcctggttggtgcgcgaggcgggcatgcagcgcaagctgttctcggaggtggcgagcagcctcaccagtgtcccgggggcgcgggcggatgcgctgcgcgaagtcctgctgccgcatgaccggctggcggtgctgcgcagcaccctgggcctggacacaccggtggcccgaggcctgcgagaggccctggcgggcaaggcgctgaagctggtgctccgctcgctgacgggcctggacaccgaggaagcctggacgctgcgcgagcgcggcgcgccgcaaacgaaggaggcgctggattcggtggacggcatggatggcacgcgggcctggaagctgcgtgtggaccatctgggccggtggcccaccaccgcgctgtcctccttgaagggactgcccatggggccgcacgcgcaggcgctcatcgagcgtgtgctggcggaacagccagaccggctgccggtgctgcgcaacgcctacgccgtagcggcgaccgcacgggcgctcgcgcagcagcccgcgcgcacggtccgcgtgggcacctctccccgaatggaagcctaggtcaccgccatggacgcatcattctcagccctgttcgagggcgcgaaagcggagctcagcgcgctgtccgtcaccgcgattctgccgcggatgctggccgcggcgctcattggcaccctgctgtcgctgcggccctggcgcctgctcatgaagcgggcgctgcccaaggtggacatgattcaggcgcaggtgctgctgtgcgcggcggcggcggtcatcaccgccgtcatcggtgacagcctggcgaaggccttcgggctggtgggcctgggcggcttcgttcggttccgctcgggactcaaggacccgcgtgacgcggccatcctcttcctgatgattggcctgggcatggcgtgcggccacggcagcctggggcttgcctccgtcgggacggtgttcgtgatggtcctgctcttcgtgctggattgcttcaaccgcgaagaggcgcacgccactgcgaagcagcggctggtgctgtcggcgcagtcggatgacctggtgggcgcggaggccacgctgcgccgggtcctgggtgagcggaacgtcatggtgaagagctgcgcgctcgacttcgacgggcggcggctggagttggaagtcgaggagccggagccgggctccctcgccgcggcgctgggccgcacggagggagcggccctgcgaggcttgcggtggacggcggtgaattcgagaagcgcacgggaggagcggatatgaggcgcagctgggtggccgtgttcgcggcggggtggttggtggcgtgtggcggcaacagcctgcccgcgggagattcacaggacccgacacccggcggcggactgccgggagagccggtgcagccgggaggaccagatgatcagggcaacggagaggagcccaccgggtcgcagtcgctgtggccgctgaccgcgggcagcacctggacctacgacatccaggaccccgtcgagggcaacttccagaagcaggtgacggtggtgggccccggcgaagtccctgaccagccgggcatcaacgccgtccaggtgcacagccgccaggaccgcgtgcgcaacggcaccctctatgaggagtattcgtggcaggtggagctcaccaacgggctcgtcgtgcgtctgcgcgaggacgactaccgcaatggccagcaggtccgctccaccacctggtctcccgccacggtgaagtccgtggcgagcgttccggacgccctgccctggacgtacaagagcgacgtgctcgagcacatcaccctgggcgacggctcgaaggaccagaaggacccgacgtacatctggaaggtgctcgaatccggcgtgacggtgacgacgcgagctggaaccttcaccaacgcggtcaagattcagcgcgacaaggtcaacaacaacggcgaggtgaagccagacaagacgcgcttctactggctcgtcccgggcatcggaaaggtgcgtgaggaaggcgaacgcaccgaggacctggcggcctacgacatcaagccttgatgcctgaccggagaggtggcggatacacggggccctgccccaccgtctcctactccgagagggggcaggatgaaggtcagcggttgaacggttgcgcctctatcccgaacttgttcgggaggaggccgcatgcaccggaagaccccctttcaccttgccccctgggcggccgcactgatgctgctggccagcaccgcgagtgcggggacgctgtatcgagacccttatctgcagaaggtgggaccggacacggcgacgatcgccttccggctcgccgccaactgccaggcggaggtgcgctacggcgaaggagcagccaaccagtcggctgtctcccaggacggcgggaagttgcacgcggtggtgttgaccgggctgaagccaggcaccgagtacacgtacgaggtgtcggcctgtggcctgcgcacgcagctcaatcgattccgcaccgcgccggtgccggggacccgcagcgtgcacttcgtggcggtgggcgactttggcacgggcggctcgaaccagaagaaggtcgccgcggccatggtcaagcggcaggcggggctgttcgtcgcgctgggggacaacgcctacgccggtggcaccgaggcggaaatccagaacaacctcttcgtgcccatggaggccctgctggcccaggtgccgttcttcgcggcgctcggcaaccatgagtacgtgacgaaccaggggcagccctacctggacaacctctacctgcccaccaacaaccccgagggcacggagcgctactactcgttcgactggggccacgtgcacttcgtggcgctcgactccaactgcgccgtgggactggcgtcggcggaccgttgcacgcgggatgcgcagaaggcgtggctggagcgggacctcgcggggtcgacgcagccgtggaagattgtcttcttccaccacccgccctggtccagtggcgagcacggctcgcagctcgccatgcgccgccacttcggccccatcatggagaagtacggcgtggacctggtgctcaccgggcacgaccacaactacgagcgcagcaaacccatgaagggtgacgccgtcgccgggtccggcgaaaagggcatcccctacctcgtggtgggcggcggcggcgcgacgctgaggaagctccccggcagcaagccggactggagcgtcatccgcgacaaccaggcctatggcttcctcgacgtgacagtggtcgacggcacgctcaccgcgcagttgctcggggtgaacggagaccccgtggaccgcttcacgctgcagaaggagctgcctccgcaggagcagcttcccgagggtgcgatgacgctcgtcgtggagggcgagcggggcgtggccccccaccgcgccttcttccgggccacgccgtccctcgaggccgccacggtgacctgggatttcggcgacggcggcacggccgagggcgaggccgccgagcacgtcttcgccattcccgggcagtacacggtgacggccaccgccacccagggcacggtgaagcagacggccaccgccctggtccaggtggcggagactcccggtgaggagccccagacgccggatgacggcacgacggacccgggctcaccggagccccgccctgggcttccggactctcccggccccccggatgacggcatgagcagctcgaacggtggctgcaccgcgggccccaccgccaccctcctcccggcggccctggccctgctggccgcgggtctgctccaccggcgccgcaagtagggcctccccgcccaaggcccccccgcgccctcctcctgacgtcacacggcggaggggcgggcgtccgccagggcggatttgctttccgcgcttgtcaacccggcccgaggaatgcaaagccgcattccgtcatggccacccaacgcaagtcccgcccgcactcgcggtcggccccgaagaagtccggcgctccgtccgggaagaagccctccccctccgagcggcccgagcggcccctgcgagaagacctggtccttcaggcctgcctggaggcgtacggctcggtccggcacgagggccgcatggccgaccgcgcgctggacttcaccctgcgccgcaaggccaacctctactccaacgagcgccgcgccgtggccgagcgcgtctacggcctgctgcgccgccagcggacggtggacttcctgctgtcccgcgcccacccacgcttcgacagcctggagacctcgcgccaggacgtgctccgcctggccgcctcacgcgtcctctacggcgagccccacggcctggtggcccgccagtccgcgctggcgcccccggatgcgcaagccctgggtgcccttcccgaagccgccgccgccctggaggccctgcccgcccgcgagcgcttccccatcgccgcgtcgctgccggacttcctcgccgaccgcttcctccagacgttcggccgggacgccgctcgcgccgcggaggcgatgaacgagcgcgccccgctggtcgcccgcgccaacctcctcaagggggaccgcgacgcgctggcgcagcggctgaaagcggagaccgtggacgtcaagcccacgccgctgtcgcccatgggcctggtgctggagacgcgcatcaacgccttctccctggagagcttccgcgaaggcatgctggagctccaggacgagggcagccagttgctcggcatgctggtggacgcgccgcccacgcgcgtggtggatgcgtgcgcgggtgccggcggcaagacgctgcagctcgccgcgcagatgaagaaccggggtgacttgcacgccctggacatcgatgagcgccgcatggaggacctgaagaagcgcgcgcgccgcgcgggtgtgcacaacgtgcgcgcccagctcatcccccacgagggcccggaggccgacgccgcgctgacgcccctcaagggcaaggcggaccgggtgctggtggacgcgccgtgcagcggcaccggcaccttccgccgcaagcctgacgcgcgctaccgcctcacgccggaggatttggagatgcacgtgggccggcagaaggccctgctggcgcgcttcgccacgctggtgaagcccggtggccggctcatctacggcacgtgcagcgtgctgcgggaggagaacgagaacgtggtggaggacttcctcgcgaagcaccccgagttcacggtgaagccggtggcggagctgctgggggcggagctggccgagaaggtcggccccggccccttcctccggctggcgcctcacacccacgggaccgacggattcttcggcgccgtcctcgtccgcgcgaagtaacctgcggccggggggagagagacactgctcatgcaccgtgccgtccgctaccgcgtctccatgccccggccgcatacgcacctgctggaggtggaagcctcctttccaggaggcgccagcgtgctggacgccgtgatgccggtgtggacgcccggcagctacatggtgcgggagttcgcgcggcaggtgcaggacatgacggcccatgcgccggacggaacgctccttccggtgcggcgcgcggacaagcgcacctggcgggtggacgcgaagggcgtggccgtcacgctgcgctaccgcgtctatgccaacgagctgacggtgcgcaccaaccacctggacggctcacacgcctacttcaacggcgccgccacgttcctctacacggaggacacgcgcgggctggagcaccacgtcacggtggacgcgccctccggctggcggaccttctgcgcgctgggccaacgcgcgaacaccttcgtcgcccaggactacgacgagttggtggacagccccttcgaggtcggtccccacacgccgctcaccttcagtgtggagggcgtgccacacgaagtcgtggtgtggggcgacacggtgcaggacccggagcggctgtgcgcggacctgaagcgcatctgcgaatgccaggcccgcgtgttcggcggcctgcccatgccgcgctacctcatcctgctgtacctgacggaccggggccgaggcggcctggagcacaaggccagcaccgcgctgttgttcccccgcgtcggactttccaccaaccgcggctgggaggacctgctcaccctggtggcgcacgagtacttccacctgtggttcatcaagcgggtgaagccgcgcgcgctggtgcccttcgactacgcgaaggagaactacacctcgctgctgtgggccttcgagggctccacggcgtactacgacaacctcttcgtgcggcgcgccgggctgatgtccgcgcagcgctacctcacgcgcctgggcgaaacactcaccgcgctgcatgccacgccggggcggcgcgtgcagacgctggcggaggcgtcgctggtgagctgggtgaagcactaccgcccggacgagaactcgcccaacagcgccatctcctactacctcaagggcgaggtcgtctccgcgctgctcgacctggagatccgccgcgccaccggtgacgcccgtggcctggatgacgtcgtgcgcgtcttgtggcagcgctacagcgacggctccggcgttcccgaggacggcgtcgaagccgtggccagcgaggtggccggcgtggacctgacgcccttcttcgaccgggcgctacgcaccacgcagccgctggactactccgtcttctcccacgtgggcctggagctgaacttccgtccgcgcgaggccgccagcgacaagggaggcacgccgccgcgaaaccgggcgggggaagggaagcccaagggctggctgggcgtcaccacgcggggcagtggcaccgtggcggtggtgatggatggctcgcccgcacaggacgcggggctctacgtggaggacgacctggtcgcgctgaatggctggaaggtggacggcgccaccctgctgtcccgctgcgaggagcggaggcccggcgagacggtgcggctcacggtgttccgccgcgaccggctgctcgaaatcccggtggtgctggggacgaagcccgcggaggcggcgtggctgtcccgcgtggagcgccccaccgacgcccagaaggccgcctatcaggcgtggctcggaagcccctgggaagagtcccctgggcagtcgtaggcttgggggccatgagcccctcatcgcccaacatcattccaccggatgcgcccctgccccgctgccagcggcatcggaccaccgtggccgggtggcgttgcgagaggtgcaacgaaacgctctgccccgactgcgtggtgggccggcgggcccagacggtggagctggtggcgtgcgagcgctgcggcgacgtggcgcagaccctgctcacctcccgcagccgggtgtccgtggcgcagcggctcaagggcgcgtggcgctacgtcttcaccccgtccggctcgcaggtcatcgtggcggtcagcgtcttcctggcggcgctccggtggctggtggagctggccatctccttctcggccctcatcccgctgaccatttacggaggcgtcttctggggcaccttcttcacgctcgcgcgggattcggcgcgcggcgagacggcgctgcgctcgcccgactaccgcgactacttccatgacgcggtcctccccggcctccgcggcgtggtgaccttcgccgtcgtctggatgcccgcgttcctctacgtcaccgtggtgcgcccgctcctccaagaggggcgttcggcgctcggcgcgtggattcggggcctggacacccccgggctgctgacagtggatccggtgctgatcggcctgctgctgctcggcgtcctctggctgcccgcggcgctcctcatcaccgccgcgcgccagccactgctgaccttgttcgacgtgcccggaacccttcgcatcgtccgccgcctgggccgggactacacgctggtcgcgggaacgctggtgggcctgggcgtcctccacctcatgacgcacggggtggcgttgctgctgcgcatgctggacctcttcgtcatctcacgcgtactggccgaagccgtcacgctggtcatcccattcaccgccgcgcacgtggtggggctgctgctgtacacgcggggcgatgcgctggggtatggcctcgagcaagactacctgacccctgtgctgggcgacgcacaaccgagccgcatggcgccgcccctgcgcgatgccggtcccattcccttcaccggagcggcggccagggccatcgagacgggaagctccaacgacgacaccctggaggcgctggcggccgcggtgaacgcccgcgatgttccactcgcgatgtcgctgtatgccacggtgcggcagcaaccgcggctgcgtgtgcccccagagcaccacctgttcgtcggacaggccgcggccgtggaaggaaatttcccactggcggtagcggcgttggaatccgcggcagacacggcgcccgatgagcccaccgcgccccgtgcgttggtacttctggcgcgtgtgttgggtgaacggatgcacgacgcgccgcgcgcggaagaagtctaccgctacgtgctccaccgttacccagacacggcagcggcacgcttcgcgagtgaacgcgtgtctccgacttccgactgatacagacgttgccgcgctcgcacgccagcatcacccttcacggcatggttcgcgcacgctggttttcgtggctcatcggtttcggtctcttcgcggcatgtgaccaggcgcctcgcatggagcgcgcggtggacgactgccaggcggagcaggtgtcgttgaaggtggaggtgctgtcggcggagggcgcgcgcgtgcgcggggcgacagtcaccggcaccaacgtgacctccaacgtgagcatcaccggcgtgacagacgaccagggcgtcagcaccgccatcaacgaatcgctcgcgcccagcgcggtgcgagtcgtggccaccgcgggcgccaaggtgtccgacgcccagcaggtggaatgggtgtgtgacacctgcaactgccagccagagccggccaccctccaacttcagctcaatccgtaggacccgcgccgcgcgacgctgagacaaccgctgtttcatggattcatctgaatgaacgcgagggaggttgtgctccacccgccccatggagtacggctggtgacatgcgtgacgctcgtcagccttccccgcgtctggcctcccctgcttccaggggggccctccagtcggcttcctccgagcacggggccgcggggatgtgttgccgcggtgtgcgcgttccccgcgcaaggggtcctgtcagcccacgttccaggtaggtccgggccctcatcatgtccgcagacacggtggaacagttgcttcagtgcgcgctgtccgagctgaccgcgcgcttcgtcacccaggccacccccgtccccaccggcttgctggaggcgttggacgcggacccgcgcgcgggcgctcatgcgctcgcccggcgcatccgttcgcgccaggagaagaaccgcgcggagggccagcgcatgcgcaagctgctccgtttcgagacggagctctgggagcagggccacacgcacatcgcgggtgtggacgaggcgggcatggcgcccctggcggggcccgtcgtggccgccgcggccgtgctgcccaagggtttccggctcaaggggctggatgactcgaagaagattctcgacgccgagaagcgcgagtcgctggccgaggccatcaagcgcgacgcggtggcatgggccgtgggccgcgcggaggtggaggaaatcgaccgcatcaacatctaccacgcgggcctgctggccatgcgccgcgcggtggaggggctgtcggtgaagccggaccacctgctggtggatgctcgcacggtgccggagtgctcggtgccgcagaagggcatcatcaagggggacgcactgtctctcagcatcgcagcggcctccatcctggcgaagacgacgcgcgaccgttggatggcggagctggatgaccagtacccgggttatgggctcgccgcgcacaagggctacccgacgccgcaccacctgcaggtgctgcgtgaaaagggcgtgctgcccatccaccgacgcagcttcgcgccggtgcgcgaggccctgggcctgccgaccggctcaccgccttccgccctccaggcggagctgttccccgaggccccttcccgaacaggggtgaagtcatgagcgccgaccgggacatcgacgagtggatggccgcgcgaggcatcaccctgcccgaggcccgcgctcgcacccgcgcggtgctggaggaagtgggcctcacccgccccggccgccagcgcatgagcgagcccaagctgctcaaggcggcggagctgctggcggggcgcttcttctccgtgtgcgcggacggcgcgtgcctcaaggtcgcgcaggccagcgggcgtgagccgatgcgtatcgagccacggctgcactgtgagcgctgtggcggctcggccaaccgccgcgcggaggtggccttcgtggaggcctgccagcgctacggcgtgcgccgcgtggtggtggtgggtggctctccggccgtgcgcgaggagctggaggccaagctgggccaccagattgact

SEQ ID NO: 1038 - DNA, 11706 bp, Myxococcus xanthus
cccctggagggacagacgtccgtgtcctggacctcgtcgacgcgggtcccgtgctcccacaggatgaagactgctctatttccgcttctggacgcgggtgatgaagctgttggggctgagccccgtggatgagcccgtcaagcgcctcatcacccagggcatcgtcaacgggccggatggccggaagatgtccaagcgctggggcaacgtggtggcgcctgcctccatcgtccagaagtacggcgcggacacggcgcgggcctacgtgttgttcgcgggcccgccagagcgggacttcgactggtccgatgagcaggtggagggcgtgtaccgcttcctcaagcgcgtctgggcgctggccgccacgcaccaggcggcggccgcgggtgccacccatgacgggccctacgagggcaaggcgctggagatcctccgcgccgcccacaagacgctgaagcgggtgggggaggccatcgagcgcctgtccttcaacacggccatcgccggcatcatggaaggcctcaacgcgctctacgcactggggacacctgaaacggccgcggagaaggccgccatggcggaggccgtgcggttgctggcggttgtgctcacgccgttcacgccgcacatcgcggacgaaatcgcggaggcctatggcagcaaggacttcaccgtcgcgcagtcctggccggagttcgatccggcgctggtggtggacgacgtcatcccctacgccgtgcaggtgaacggcaagctgcgcgcggagattcgcgtggcggcggacgcggcggaggcggatgttcgcgccgcggcagaagcggacgaaaaggtccaggtggccctggcggggaagacgctgcgcaagttcgtcttcgtccccaagcgcctcgtgaacttcgtcgcgacctgagcggggatccgggtgccggccgaggtcctcgtcatgtgtggtgcatgtgggcggccccaacccgcgggccgcccgcggtgcattgcctgcgaggccgtgcttcccgaagcgccccttcccgggggcccggcaccgggggagccgttcttcgtcgcggacctgggcggagggcgcatgctttccggccaggggacgcggctcttctatcaaccgcacccgtcggtcatggtgcctcccgtggagttggactcgctgcgggaggcgcggctggagtcgcgctacttccgggaggcgctggcgttgaccgtcttcgccttgctgggcctgtgggcgcagcccgtcgcgctgaaggtgctggggttgggcatggcggcgctgggcggcctgctggcgttgacgtgccgttcacacgggctcgtcctggtgcctcggcagggggcgcaggtgcgctggcccctggggttggcgcggcggggctctccccgggacacgcggctgttggcggcgtggacgtcgttgtcggaggccctgcgggtgcgcggcgtggctgtcgacggcgagtcgtcaccgctgccgcctccaccgacacaagacggtggccctctgtcttgacgggccgatcgggccgggtagggtgccgcgcatgtcgcgaccctgcgctgtcggaccccggcgtcttcgcattggcgtggtggtgggaatgtgggtagccgcgggctgtggctaccgcctggcgcctcgcggagatggtctcccggctggcgtgacgtccctctgcgcgcccgtcttcctcaacgctacgcccgagcccacgctggaaacagtcttcacgcgcttcctacggcaggagctgatccgcgtgggccggctgggcagcgcggagtcctgcgacgggcgcatggagggcacggtgctgtcggtggcgaacacgcccacgaccgttgtcggcaagagcaccagcccgggcttcttcttccgcgtctccgctcgggcgcagctccgcgtggtgaaggacggacaggtcctcaagcagacggaggttttcggctcggaggactatgtgctgggaagcggagacatcctggaggcggaggcgaaccggcaggtcgcgctcgagcgcctcgcggaggtcttgatgcgggatggctacgaccggctcgcgggtgcctggtgaggaggcaagagcctcctcccggcagcctgcacgaatgaagcagggccacgcgaggtggccccgaggcttcgactaggcctgcgcgcgggcggccttggtggcggccttcgcgagacgcgagatgcggcgggaagcggtgcgcttgtgcagcacgcccttggtggcggccttgctcagcgccttggcggccgacttgatggcgtccgtcatcttcgccccatccttgctgccgagcgcctcgcgggcggacttgacggcggtcttcacctcaccgcgcacggtgacgttgcgcgcacggcgcttcagggactgacggtgacgcttctctgcggacttggtgttggccaagagaaatctccagcggtaatggcaggctaaaagaggggccgtccttactgcgacgcctcgcaggcgtcaaggcgggtgtgggcctccagccgggatttccgggctctggacgccccgccgagggcacctgcgaggaaaatcactctaccgaagtcgtatattcccacaccagccccgcgggatcttgaaaggtgagccggccggcctggtgctggatcagccgactccccggaatctccgcgaggatgccggggagtcgctccaccgccgccagggagggggccgtcaggctcagccgcaggcccgttgtgggcgtccctgccgcttcgaaggcgatcaggatgcccccgtcctcatagcgggcctgatccgccgccggagcccgtcgggtgatccaccccagccgcggagccaggacgtcccagaaggcgcgctgcgcgggaagatccgccacgcccagcctcagcgtggtgacgggcgcgcgcggaacccacgtcggagatggcagggccttttcgcgcgccttggcctcctgccagtgacgctccatgtgttccagggtggcgtcccccagggcgacaccctcggcgcggagggcggactcgatgtgctggaagcgggcggtgaagcggcggatggccatccgcagcgcgtcctcggcgggggctccgacgaagcgcgcgaggttggcgagcgagaacagcacgtcccccagctcgtgctcgatggcatcccgatcattcgcggcgatggcctcgtccagctcccccaactcctccgtcagcttggcgcgcacgctggcgacgtccggccagtcgaagccgatgcggctggccttctccgtgagccgctcggcgcgcatcagcgccggggcggcgacggggacgccgtccagcaccgagccctcccggcccgtcttgcgcttcttctccgcggccttcagcttggcccagttgtccaggacctgctcggcgccttccattcgctggccgttgccgaagacatggggatgccggctgaccagcttgtcgccaatggccttcgccacgtcagccagggagaactctccaagctccgaggcgagctgggcgtggaagacaatctggaaaagcaggtctcccagctcttcgcagaaggtccgccaggagccaccgtaggcgacccggtccatctcctccaagacctcgaaggcctcttccaggaggtagggccgcagcgagcgcaggtcttgttcgcgatcccacgggcagccgccttcagcgcgcagcttccgcatgatgtcgaccagtcgctccagctccgccccgggggtcagcgtcgtgtccgccatgcacgttcctgtagcacgcacgggtctggtgctgtccggcaaacgcggcaggtgggcagccaggctggcgttcgttttcgcgcttggccctgggtcgcctacaatccactctctggatgatccgcctgccgcttcttgccctccttctcagtggcttcacgcttctggtgcccgtcgtggcgtccgcgcagctggaagcccccacgcgccttcccgaggtggatccgggccccatggagcccgacctgcgggatgagtccatggatccggtggatgacgccgcctacgcggaggacgtgccggaagaagacgtccccgccgcggaggatgcctccaccgaggacgccgacggcgcgcccagggggcccgtgcgcaatgtcagggccgccgaatcggtccccgccaatggccggactcccgcggcggccagtcctccgccggtcgctgaacccacggtcatcacccccaggccggtgacgctgagtccggtgctggcgccgcgggtgacggatgcggacctggaggccctctggaaccggtggcggcaggcccgcgcgacgaatgatcgagacgccgcggcggcgtccctcaaggaactgcggacattgcgcgtcgagctggccgccacggacctggagcccctgagcgtgggcttcctccgcgaagcggccgtgcgtcgccgcgcgggggacatggccggcgcggtgcggttggcggaggtggcggtcgagctgtcgccggggctgccctacgcgcgcttcgagctcgcggagctctacgccttggagaagccgggcgacgtgtcccgcacgttggggcaggtgcggcaggcactggcgacactggcgcaggatgcccgctatcgtcggcccgcgttggcggacctgggcgccctggtgctgctggcctggggggccaccgcggtgctgctgatgggcttgttcttcctacggaagctccgttacgcgctgcatgacttccaccatctgctgccgcgagtcgtctcccggtggcagtccctggtcctggggctgctgctcttgagcctgccgtgggtgctggggctgggcgtgctgcccgcgctgctggtgatgctggccaccgtgtctctctatctctcgcgcacggagcggatcgtggcggcggtgctggtggcgggcgtggggctctttccgctggcggcggggcaactcgcgcgtgtcacggcgttcgcgggcacgccggccgaggacgtgtacctcctggagcggggcggcctgtccgccgaggaggcgcgggcgcgcgtactggcgcggatggagtcccgctcggcgacgttcgcggaggtgctgtcgctggcgtacttcgaatcccggcgcggcttgctgaaagaggcgaggactcacttcaaggccgcctcggcgctgaagagctcggatgcgcgcctgcttacgcgcttcggcaacaccctggtcgcgctgggagacgcggagggtgcggcactgctctacgtgcaggcctcgcagtcggcgccggacctggcggctccgcactacaacctggcgcaggtggtccgccgcagggcgaagacgctgccggactcggaggtcggcaaggagctggatcgcgccgccacggccatggcctcggcgcaggcgctggatggaacgctgctggtccgggacccgccgccggaggaccggctgctcctcaacctgctgctgctggccccgcaactggcggaatccgactggcttccgctcgcggatggcacgggggcggggcgccaggtggagacgcaggtgtcgcgctggctgctcccagggcttcctcccgggcccatggcctccgcgggggccgcggcgctggcggtgctgctggccctgtggggcttcttgggggaccgcttgaaggcggccaaggtgtgtgagcgctgtggccgcgcggtgtgcgtgcgctgcgacccggagctgggcatcggcagcaagcaatgtggccagtgcgtcaacgtcttctcccgccgggggctggtgccgcagcagctgagggcgcgaaagcagctccaggtggaccggcatcaggcctggacgggccgcgtggcgtacagcctgggcgcggtgctagcgggagcggggcacgtggcctcgggtgtgccggtccgcggcgcgctgtatgcgttcggtttcctcttcgcgctggccgcggtgctcctgcaccagggcctggtgcgagggccctacggtgaagcccccctctacctcaagctcgcgcccgcggcgttgctgctgctgggggtccacctgctgtcgttgcgcggtctacgccgtctgcggcggggggagtgaacggcgatgtccctgcaaggcaccctgaaggactttggtattggcgacatcctgcagctcatcgggcagcagcagaagacgggcacgctccacgtccgcgccaaggaccaggaagtgcgcatcggcttcaacgatggccacatcatcaaggcggagagcgtcacccggaagcgcaaggagctcatcggcgccatgctggtgcgctcggagctcatcaccgagacgcagctcgaggcggccctggagacgcagcgccggacgctcaagcggctgggggacgtgctcgtctccagccaggccctcaccgccgagcgcttccaggcgatgatgcagcttcaggccacggagaccctctaccgtctcttcacctggaagtcgggcacctacgaattcatccaggagccggtggagccggacgcggaagccatccatccgttgcgcgccgagacggtgctcatggagggcttccggatggtggatgagtggccggtcatccggcagaaaatccaccgcgacgacctggtcttcgagcgcatcaaggccctgcctcagccgcgcggagaagagggtggggagctgggcgccatcggtccttcggagcggcgcatctacgatgagctctcgcccgggagggatttgcgcaagctggtggatatctcctgcctgggcgagttcgagacgtgcaaggcgctctacaacctggtgaagggcgagtacgtccggccgatactcccggagggcgccccggcccccgtttctggggaccagcgcctgcttgcgcgcgtggcgggtccgttggggcgcctcgtcgccaccgtgggggtgctagcggcggtggtgctggtggttccccgggccttgcgcccggaccacgaagcgggcgttgccgcggtatttgcggactcagcggcccaacgtcatgtttcccaggcccagcgcgtccgcatcgaggccgcgctcgaggtgtttcgcctggaacgcggtgagctgcccgaacgtctggattctttggtgcaggctggactgttgaaaccgggcgaactgaaatacccgtggcgggaagagtactattaccggcggttggccgctcggcagttcattctcctgccacccttgcgctagtcctgacacaaagtcgtctttcgcggccctgggggcggcgttacgttggtgtcagccgtagcgacatagaccgaggaagaatccgcattgcgaaatcccgccacgttggaagcgcccgaagtgcttaccgcctccgccaaggtggacgttcgtgacaacgcgaccgccctggccctctgcggcaaccagaacgaaaacctcaagttgatggagcggcgcctcggagtccgggtgggacaacgcggcaccgagttccatctctccggcccgtccgacgccgtcgccttctccgtccgcctcctggagaacctggaggagatgatccgcgccggccgtcccgtctaccgggaggacgtggagcagggcatcaaggtgctcggccgcggcgcggagtccttgcaggaggtcatgctgggcccggtgctcaagagctccggcaaccggcagatctcccccaagagcatcaaccagaagcgctacgtggacgccatccgctcccacgacatcgtcttcggcatcggccccgcgggcacgggcaagacgtacctcgccatggccatggcggtcgccttcctccaggagcgcaaggtcaagcgcatcatcctggcgcgccccgcggtggaggcgggtgagaagctgggcttcctgccaggagacctgcaggagaaggtgaatccctacctgcggccgctctacgacgcgctgcacgacatgatggcggccgagcgcgccgcgcagctgctggagcagggcgtggtggaagtggccccgctggccttcatgcgtggccgcacgctcaacgacgcgttcgtcatcctggacgaagcccagaacacgacggtggaacagatgaagatgttcctcacgcgcctgggctacaacagcaaggccgtcatcaccggtgacgtgacgcaggtggacctgcccacggggaagatgtccgggttgaaccatgcgcgcgcggtgctgaagaacatcgacggcattcacttcgcggagttctcggaggtggacgtcgttcgccaccccctggtccaggaagtcatccgcgcctacgaccgggcggacgtcgcccagcgcgaagcccaggcggcccgggaagcagcaaccgctgccgcccatgcgcccgccgcgacgccggccaccgccaccgagcccgttgccgtcgagtgacggtgccaatacctacttgcgcccacccgagcgtaccctgccgggcgggcgtactccatcccacccttgtgaatattcccaggcgctgcgtccttgaaggatccgcgacgccttatctagggtgaggacccccatggccgaaccggaaacgcagccccctgggcgcagtccactggacgcgctcgccgaacgcctcggactggacaacggcgtctgggggcggcgcgccatccaggtccttctcctgctcgccgtctccattggcgcgggcttcgtcatctcaccaggtctctacagtcagcagattccggcgctggcggaggagaacctcggcaagccgttccgagccagctcgcccgccggcttcaaggccgcgcgggactacgagatcgtccaccgcgccatgacgcagcagcggcgccaggaagcgcgcgcggccgtcaaaccggtgtacgacctgaaccccgccgtcctggggcagctgcggtcgacggtaagttccgccttcgcgtccatgcggctgcatctggacgagctcacggaggcgcagtccgattcggaacccgaggagcgcgaaacgccccgccggcgcaagcccgcagcgtccccggagatgctggagctggagcgcagcacccgcgagaagatgcgggcggagctccaggagcgcttcttcggcaagcgcgacgccgtgctggaggccgaggacttccaggcgctctatgccacccgcttctcgcaggaggcggagacggccacgctgctggtactggagcgggcgtatcgctccgagcgcggcgcgatccatgtggcgggctctcgggaggagctggcgcgggaggcgcatcagggcctcaccgtccgcgacgtggtgaacaaggccgaggagtccctgtcggggggctccacccaggtggtggacgtccccgaggcgcaccaggagatggagcgcttcgcctcggtgcccggtaacctgatgccggacgcgccgggcgttcagcgccgcgccatcctccggctggcccagcggctggttcggccgaacctcaccatcaacatcgcggagtcggacgcgcgccggaaccaggcggcccaggcggtgaaggacgccgtcatctccatcaagaagggccagcgcgtcattggcgacggtgagctggtcaatgagtcgcacctggtcatcctgcgcggcatgcgcgcggagacggaccggctggacctggtccagctccaggtgggcggcacgggcctggtgggccttctcatcgtctcgacgtacttcttctgccgcgccgcgttccggcgcttccgtcccacgcgcaaggacggcgtactgctgggactgctgctgctgggcctattgggcctgctgcaaatctgggtgtccatcgcggacgcggtgcaggaccgctacaccgcgctgcccatcgaggccttctattacgccttcccggtggcggccggcgccatgctggtgcgcttcatcctcacgcaggagctggcgctcttcttcgcgctcgtcttcgcctgtctcaccggagtgatgctgggcaactcgctggccttcggcgtcttcacgctggtgggttcgctggtggcggccgaccgcatcgtgaaggcgaaggaccgcgtgggcatcttccgcgcgggtctggtgacgggcgcggtgaatctggtggcggtgctcttcctcttcctcgtggaaggcaagggcctgtcggccgacaccctcatcaccgcggtgagcgccttcgcgggctcttcgctggcggtgccggtgatggtgatggcgctcacgccactcatcgaggccaccttcggctacgcgtcagacatcaagctgctggagctggccaacctgaaccacccggcgctcaaggagctcatcgtccaggcgcccggcacgtaccaccactccatcatcatcggctcgctggtggagaacgcggcggagacgattggggccaacccgctgctggcgcgctcgtgtgcgtactaccacgacatcggcaagggccggaatccgctctacttcggggagaaccagaagggtgagaaccgccatgacgcgctcgcgccggcgatgagcgccggcatgatcaatccccacctgaccgacgtgctggagatggcccgtcagtaccggctgcacaacctggtggaggatgcgatttcgaactacctcggcacgcgcacgggggggtacttctaccacaaggacttgaaggagcaggaggtcaaggaaggtgctccgcccatcgacgagagcatctaccgctacccggggccgaagccgcagttccgcgaggcggcgctggtgatgatcgccgacgcggtggaggcctccacgcgctccatgacggaccccaccacgcccaagctcctcgcgcaggtgcagaagatcatcaacctcatcttctccgagggtcagctcgacgagtgtgacctgacgctgaaggacctcaacctcatctcgcagtccttcctgcacacgctcgagggtatctaccacacgcgtccggcctacccggcgggcgccgtgggtgggggcaaggcgccgccgttggtggtggcgggcgcggtgcctcggcccgcggaaggcaaggacaaggcgcggaccgcggggggcacatgagcggagcacgaaggggcaatggcgtgagattgcgcaaggggaagctgattccccgtgacgacggcaagcgcatcgaggagttcgtgggcgcggccaccaccagcacggactccgcgtccgtcgcgcggatgctggcgccccccgggtggtcggagcccgcgcagcgccccgaattcgatgaggtcgtcatcgtcctcacgggcgagctgaccatcgtggtggaggggcggcgcgagcgcatctccgcgggcgaggtcggactggtgccgcgcggcaagcgcgtggtgtaccgcaacgacggccagggggcgtgtgactactggtcggtgtgcgcgcccgcgttccgcccggagctggcgcacatggagacgcccaagcctcgcgtgcaggagaaccacgtcaccatccaggtggcgcatggccagggccgggacttcgcgcgcctgctgaccacctgggccagggcgtacctggtgcagctcgagctatccggcgtggagctgtccctgtccctggtggacgaccgggccatccgccggctcaaccgcacctggcgcaagaaggacaaggcgacggacgtgctgagcttccccgcgggcgacctgcccaagggcacgcctggaccgcgcccgctgggggacgtggtcatctccctggacacggcgaaacgccaggccaaagaagtcggcc

SEQ ID NO: 1039 - DNA, 11282 bp, Myxococcus xanthus
  unsure (1)..(11282): unsure at all n locations
acggttatggccaccaaccacgccggcaccgcgcgcacgcaggccaccagctacgcgcagattccgccggtgcccttcaaggtggtgctcaccagcgacaccgacggcgtctacaccgacctgcacctgtacgagcccaccgacgccagtgccaaggacggcaccctggacgtgcggaagatggcgcacgtgtactgggccgacaccgcgagcccctccggtggcaccttcttcctcaactcgcagggcggcgacttcgaccagcccgcgtatggcccgtacctctacatccaccgctcgccgcccaagggcgtgtacctggtggccaccaactactggcccagcggtgacaaggcccacaccgtggccacgctgaacctgtcgctcttcgaaggcacgccgaacgagatccgccgcatggtgcgcatccccctggctacgccgggcaccacccgcgtgctggcctgggtgaacgtgctcggggatgggcaggccgaggtgttcgtgccttcgcaggacccgcgtccgaagcacgccgcatggccgaagaacctggatgaggccctcaaggcgctccagtccaatgaggatggcggcggcgaaggcgagtactgacgcgtctgtcgaccggggtctccacgtccatgcgccgcgttcttcccgtgctcctgctgctccatgcgcccgcgcctgtggcgaacggaacggtcggggtgcggccgctcgtgtcggcgccgtcggcatcggacgtgacgtcgcacgacgcggaggcatccacgacgcccgagacgcgcgacgtgctgctccgccggttggtggcgcgcgtggcgctggcccaggtccgcaagcaggacgccgcgtggcatccggaccagcgtgactgcgcgggcctcatccgcttcgccttccgttccgcgtacaagcaggtcgccgcggagcgcctgtccacgccgctgtggcgtgacggccggggccgcccatccgacttcgcggacgcggaggtgctgctccagcagagcttccagctcctgggccgtgacgacgccacccgcgagtcgctgcgcaccggcgacgtgctcgcctttcgccaggagcaggacgcgggccccatcttccatctgatgctggtggtgcgcccggaggaccgggcccatgcgcccgcgcgcgtcgtctaccacccgggggagaagggcgccgcagtgcgcaccggcgtcctccaccacctggtcaccgaggcgccgctggagtggcgcccggtgccgcagaacgcttccttcctcggcttcttccgtttcaaggagtggatgtcatgacgtctcccaagagtggcccgcccaaggcgctgctcatcggcgtggttaccgtcctcgtgggcggtgccgtggccggagccttcttcctgggccggcgcagcgggcagtccggcgacggcggtggcacggtcacgaacctgctcggcggcgagcgcaagggcccgcccagcgcgggcgccggcgtggaaggcatgcccgagcccgcgatgacggcgctggaggtgcccggtacggccgcgccctccgccctctgggtggacgtgcaccacccgggcaaggtgcgggacgcgctggcggccaacgtgtggctgcgcgatcagctccagaagccgctgggccagggcttcattggtgcgtgggccgccttcttcggctccaccggcgaggacctccaggcgggcttcaagggcgcggtgctggacctcttcgcggggcagttgttggacgcgcccttccgcgtgacgtggttcgccggtgacgcgcgctccagcacgccggccttcatcctccccaagccgggccgcgccgcgacgtccgcgtacgaggcgctggacggcgtggccagccgcggcggcatgacggcgccgcactgcccgggcggcggctcggaaggcaccttcgagatgaagcgctggctggtggcggaacagacgctgtgggcgggccggctcaaggacaggctggtgctcgcgcgccacccggtggcggtgctccatggcctgtgcgcggagctgccggcgctgaaggcgaaggacggcgtggacgtggagctgggttacgacgcggaggcctatggccgcgaggtgcagctcttgtcgagcgtggtggggctggccccgggcacgcggctccagttcggcgtggaggcgggacggctggtgggccggggcatcgcgggcgagctgctggacggccccgcgcgcctggacgccgcgcccctgtccgacgacctgctgaagctggtgccggaggacacgccggtgctgctggccttccagctcaagctgccggagtcgttggaccccgagacgctcaaggcgtactgggagaagggcggcggcaagggtcccacgcgcacgcgtcaggtggcgctggtgtggacgccgcgcggtgatgcgaagctgcccgtggagctggccgtgctgtggggccgcaccgacgacgcggccgcgctggagggcctgttctccggtggctacaaccggctggtgcgcggcacccactgcaaccacgtggtgctggcgtccaacgacgcggagctggagcgcctgcgcaaggcgtgcgcgggtcagcagcccaacatgctcaacgccgcgggcccggtggtggcggggctgcgcgcgcccacctcggtggctttcggggtgaacacgggccggctgctcagcgggctcaccatggatggatacctgtccgagttccgggtcagccgcaacgcgcccatgccgagcgcggcgcccccggaaatcgaagcggcgcggagcgacctggagtcgctgccgtacctgggcctgcgcggcaccgtgcagggcgattcgctggttcctggaggtttcgggtcatgaagtgcctcatccgactggcggctctgtccgcgctcatgctgtccggcgtggccctggccaagccgctctacatcaccgtcccgcgctcctatggcacccaggagccggtggcggtggacgtcgccttcgaggacaagggccccgtcgagctgcgcgtcctcaagccggagaacctggacgccttcatccgcgcccagggtgatttgcgtcgcgcgtaccagacgccgcccacgctgaagaacccgggccgcgcgctcagccgtggcttcaacgcggtccgcacgccgggcatgttcctgctcgacacgctcagcccggccttccgcgacgaggtgggagaggtgctgccccgtgcgccgcaagcgtcgggctcgggcgagccgctggcgaaggtagccgaggggccggagcgcctggtgggcgtgccgcccggcttcacggtgacgcgcagccagtggctgaacctggacctgggcggcgccgagcgggacttcaacgtccccggcttcaacgccagtggctccagcggcttccaggagcgccgcgtcacgctggcgccgctgcccgcgggcacctacgtgctccagttggtgcagggccgcgtggagggacaggtggtgctggtcgtcagtgacttgacggtgcagctcaagcagacggatggccaggtgctgctgcgcgtggcgggccgggaccagaagccgcgcgagggcgccgaggtgcaggtgtacctgcccaagggcaagggccccgccggcaagacgaacgcgaagggcgaggtgacgctggaggtgtcggagccgcgcgtcatcgccacggcgacggcaggtggggacacggccatcgtcgacacggacttctactccgcgctggcggtggcgccggacgtgttcatctacagcgaccggcccatctacaagccgggccacgaggtgaagttccgcggtgtggtgcgccagccggacaccttcctggcgcgcctcttcacgccgaagaagcgccaggtgcaggtgaagctcgtctcgcaggagggccgcgcgctcaccacgcgcgccgcggtggacgagttcggcgccttccacggcacgctgaaggtgccggacgacctgggcaccggcgtgctgcgcgtggaggcggaggtggacgggcacccacaccagggcgaggcccgcgtgcaggactacgtgaagccgacgttctacctggagatggagcccgcgtcggagacggtggtgcctggccagacgctgcgcgcgaaggtgcgcgcccgccgctatgccggtggcacgcccgacgccacgaagtacgaggtgttcctctaccgcagcctgctggacgcgcccgcctgggtggatgacgcgggcaagggcggccagggcagcgacgtgacgtacggcagcgcctccaccacggagggcaagctgagtgtgccggagcggctgtactcctccgtggaggcgcgcggcgcgtatgaggacccgtggtccagcgccagcgccttcgacgccaacggcgaggctgaaatcgaggtggccgtgccggcgctggccgcgggcgaggagcggctgccgtaccggtactcgctcaccgtgcgcgcgcgcgatgaccaggagaccttcgccaacgccacgtccgccttcttcctgtcgaaggtggaggtgctgggcctggcgcgctactccgacgcggtggtggccaagagcggcgacgcgacgctggcgattcgcgccaccacgctgtcgggcaagccctacggcgtgacgcagggcgaggtggagttcgtgctgcgcaaggcggatggctcggagaagagcctgggcaagcgctccttctccacggcggcggatggcacgcaccgcgagaaggtccccacctcggacgtgggcagcgtgctggcgcgcgtggtggtgaaggacaagaacggtgagacgtggcagggcgaggagtcgctgctcgtcatcggcggcgcggacgagccggtggcgcgcgtgcccaacctgacgctggcctcgctgtccgggacgctggcgccgggcgacaccgcgaagctggtggcgctgatgccggatagctggggttcgggtggccgtgatgcgggcccggtgtgggtgacgctgtcgggcgcgtcgctctacgacacgcaggtggtggagctgacgggccgcacgctggtgcacagcttcaacgtggagaagcgcttcggcagcgcggtgtacgcgtccgtcgcgtaccccacggccacgggccgctgggaggagcgcacggtggccttccgggtgattccgcgcgagcgcaccctcacggtggagctgcagccccgccgcgcggaggccacgccgctcaccgagcagagcatcgacgtgcgcgtggtggaccacgagggccgcggcgtggtggcgcagctctccgtgggcgtggtggacaaggccgtctacgccatccagagcgagttccggcccagggtgctggacttcttctacccgccggcgcgcaacaacgtgtccaacttcttctcgtcggagttccagggctacggctacggcgaggcgctggcgcggaagatggcggggctgccggaccacgccttcgcctccatcaagccgcccagccgccagacgaaggacctggagcgcgacaccgcgcactgggacccggcggtggtgacggaccgggatggccgcgccacggtgcgcttcacgctgccctccaaccagacgctgtgggtggtgacggcggtggcggcggacacctccggccgctttggcgagggcacctccgagttcgccacgcgcggcggcctcaacctctacgccgcgctgccgcagttcctccgtgaaggcgacgaggcggtcgcttcggtgcgcctgtcggcgggggagaagtcgccggccagccagctactggacgtgaagctggcgtcgctgggcgcgctgaaagcggaccagttcgagcacaaggtggagctggcgaaaggcggtgagcaggtggtgccgctgacgctgaaggcctcgtccacgggcgccgcgcagctcaccgtgaatgtggcgggcggcaaggactcgctgagggacctcaagcgcttcgatgtgggcccagcggcggtggaggacgtggtgaaggtgagcgcctggggcggcggcgcgctggaggtgcccgcgcctcaggaagcgacgctggcgcgcgtggagctggtgctccagccgtccatcgtcgacgcggcgctgtccaacgtgcgcgagctgctcacgtacccctacggctgcctggagcagttggtgtccaccaccgtgcccaacgtggcggtgtaccaggtgctccagaaggcgggcgcgctggcgaagctggacacggacacgcaggcgctgctggcggaggcgcgcagccgctccgtgcagggcaccgcgcgcatcctcgacatgtcggtgaagggtggcggcttcacctggttcggtggctatgagacgccgagcctgccgcagacgctcatcgcgctggatggtctggcctacgcggccgaggcggggctggtggaccgcgccgacccgcgcctggtggagagcgcccgctggctggaggcgcaggagggcctgccgcccgagtacgaggccacgcgcgcctacgtgctggcgcggctggagggctccaagcaggccgcgcgcgtgcgtgcgctggtgcagggcgcggagggcggggacttgtatccgctggccctggcggtgctggccgcggagaaggccggcgtcatcaaggagcccgcgctccagactcaaatcaacgcgctggtcgcgcgcagcgcgcagggctacgccacgctggccgcccttgggccgggccagtcgctggagcagtcggaggccttcttccgcttcccgctgcggcgcgtgggcatgacggccatcgccgcgcatgcgggctcgttcggcacattggacatcacccgcgcgcgccgncgcatnctggagctgctgtcagagccggacctgtccaccttcgaccggagcaccacgctgctgcactcgctgtggctgctggagcgcgacgcgaaagcgatgcagggcatgaaggcgcccgaggtgaagggcgtgaagacgccggtgaagttcgccccgcgcggcctgggcctggtggcggtgctggcgccgggcacgcgcaccgtggacgtgggcggcttcgacggcgtggccacgctgcgcgccaccacgcgcacgccgctgtccgccgtgcagccgaaggcggagggcatgtccatccagcgcgcctactacgtgctgcgcgagagcgggaaggtgcggctgggcgcgggcgacaccgtgtcccagggcgaggaggtctacgtggagctgacgctggacgcgcgcggcgacaaccgcgtgcgctcggcgtactacgtggtggaggacgcggtgcccgcgggcttcgtgccgctccaggaggacaaggccttccgtgggccgccgcactcgctgccgctggtgcccgaggcgctcaagcgccgcgtgctcaacccggagcgggcgacgttcttcttcgaggagccggcctggtggagcgacagcccgcgcaccgtgggctacgtgctgcgcgcgcagttcgccggcaccttctccgcgccgcccgcgcacatcgaggacatgtacgccgccagcatccacgggcggacggccgcggactcgctgaaggtggtgccctccaagaagcacctgggcgacctgtagtccatggggttggccgtcgcggtggccgtgctgctggcggccacccccaccttcgtcactcgcggcgacgtgacgcccgaggccgggctgcgccgcgaggccgaggccgcctggacggcgctggaggcgcgttacgtccaggaggccggaggcgcgccggcgaagcccccggcctccatcgtcctccagaagggcgcggcgctgtcgccccagcgcaacggccaggggcgcccggggctggtggagcttcggcagaacacgccgggcatgctggatgagcggctgcggctggcgcttcggcacgagctggcacaccagttcctgtggtgggcgtgtccccagtccagcgaggaccgcctcttccacgaagccttctccgtggcggtgagtggcgagctgccctcgtggaaggaggggccctatctgtcgttgtcccgcgcggcgtcggtgttggccggggcgccggaggtggacacgcccagggcccgccgcgcgctggcgcggctgctgaacgagtccccgggcttttcgccggcgctgtcgcgcaggcttcggcagtgccaggacggcgcgcggtgggcgtcgccgctgtccatcgacgagctggcgggcgtgggcgtgcgcgaggcccggcccgcgacggtggtggtgagccgccattcgggagaggtgttgctgtcggagggcgacgtgcggcgcgcgctgccgtacggctcggtgctcaagcccttcctgtacgcggcgggcgcggagcacccgacgctgccaccgcgcccgggcgtaccggagtgggtctgcggcgcgggggtgccggcgaaggtggacgcgcgcaccgcgctgctgcgttcgtgcaacggctactacctggactgggaggcgcggggttcggcgccccgggccttcggcgcgtggggaccggtgctggcctcggtgggactgacgggcctgccggaggacatggcggaggcgacggggcttcgctccacgctggccgtatcgccctggggcgtggcgcaggcgtaccggctgctggcggaggctcggccggatgtggtggcgctgctggcggacaatgccgcgcgcggcacgctggcggagctgcccgcgtcggagtcactggtgggcgtggcgacgaagacgggcaccgtgcgcgatgcggcgagccggccccagttcggttggattgccgccgtggacccggatttggtggcggtggtggtgcggcccggcgccatgccccgccagttcgcggaggaagtgcccaaggcgctggcgcgcgcgcgcaagcaggcgggcctggaggcggcgcgcgtgcaggtgctggggctgcttccaccgggggacgtcgaggcgcggtgctccggcgcgggtttcgcactggtggagggtgtgccgcgcgcgggcgaggaggcctggacacccctggcatccctcacccagcgtggcgcggccgtgtgtctgggcgcgccctggcgcgtgcgctttcccggaggcccgggcgagggccgtgactatgcgggcgtcttcatcacctccgagccgccgccgtaccggccgccgccgggcgttcccaccacccccagcgccatgaaggcgcggcgcggctccgacttcgtcttccgcaccacgcgcctgcaatacgcggcgggcgtggtgtccgccgaggacgtgacgctgacgggcgaggctcgcgtggcgctggcgcgggtggtggcccacaacgagcaacatggccacagccgtcacccggggcggcccgtctgtgacaccacgcactgtcaggccttccgcggcaccgtgcgcgtgcggtccgaggatgcgaaggccctgggactggcgccgctgaagtggcgcaagtggctgaccttctcccagggcggggaggagccctggcggcaggcgcggccccgcgcggaggtggagcgcctgttggggcgcgggctggtgtcgctgcacttcaaggcggggcgggtgcactacctgcgcgcggagacggacggtgacgcgacgttcgacaccgcgcgctcggtgccgtgtgacttgctgcgctccggtttgaagctgccgtcgtgccctcgcaccgcgtcattcaatggcgaatcactgatgttcgagggccgtggccgaggccatggcgagggcttggatgtcgaagccgccaaggccgcgggttcgggcagcgacgtgatactcgatgacgcatacggacagtgaagagagacaagaaaatttcgatgcgtctgtctggttaatctgtttaaatctgaattgcatgaaattgtgtcagggccgggcgtagagtggctctgcccgtccttcccggcgggcccctcatcgttaggagtggtcgcccatgcgcatcacccgtaccgcctctcgcagaaagctgttcggcgcgctgctgtgtaccctctctgtcgcggcctgcggcccggcgcccgaaggagagccctccggtgagaagtcccccgagatgggttcgcaggagaatcccgttgtctatggcacggaccaccgcacggacgtctatgcctatccggcgtccgcgctgcggacccgggccgagaagtccaccgtggcgttgatgaatccgtcggacttcaacgcctccaatcccaacaatgtcaccttcaatgccagcacgctgcagagcgcctacaacctctgctccacgcagcgcttcctgaatgacccgacgccggccttctgctcgggtacgctcatcgatgatgacctggtgctcaccgcggggcactgcatcaccagcgcgtccgcctgcgccaacacgcgcttcgtcttcaacttctaccgcacgtcggcgacgacgctgcagacggtgaccacggccgacatcttctcctgccagtccatcgtcgcgcgccagcagggcacggtgggcggccgcaacctggacttcgccgtcgtccggctggaccgtcccgccacgccgcgcttcgagccggcgcccgtccgtccgggcaacaccgccctgccgctgaacacgggcgtgtccgtgattggttccggcagcggcatcccgttcaagattgacgacggcggctgggtgcgagacgcccgcgccggcacgctggactacttcgtcgccaacaccgacaccttcggtggcaactcgggctcgggcgtgtatgagaacaacaacgtcaccgtggccggcatcctggtccggggcgtgacggactacgtcagccagggcggctgcaacgtcgtgaaccagtgcaccgacacgggctgcggtggcgagtccatcacctacgtgcgtcccgccatcgacgcgtactgcgccgtcgcgggcagcatgcgcctgtgcggcaccaccgagccgcctcctccgccgccggtcaagaccttcaccttcaacgtgaccaacaccaacagcgcgcagcagaacaccaccaacgtcagcgtgacgctggcggctggccagacgctgtccttcggcacctgctcgctgccgcaggccgcgggcacgggcgacacctacctgcgcctgttcaacacggcgacgaacacccaggtggcggccaacgacgactcctgcagcctgctgtcctacgtgtccttcaccgcgccctcggcgggcacgtaccagatgcgcgtcggctgctactccagcggcagctgcagcggcacggtggcctactccatccagtagcaccgctttgacgtga

SEQ ID NO: 1040 - DNA, 11254 bp, Myxococcus xanthus
gacatctcgagcgacagccagtgggaatggcccgcgccggtgaacgacagggcaaccaatcgctctcccacgcgtcgtgcagccgccagcagagcgtctgggtgcgcgggtgcgggcggctcgcggaacggatagcgagggcggtcgccagggcttgccgccaaccggacccggccgagcgcgcttcgcagcaagccgagctgccgctcgtggtcatccggcgacagccccgtcaagcgccgccgcgcccgctccaggccggagtcgtcgaagaagtcgggcaggtggcggcccgcgcctgaccacaggtccttcgagccgggcagggcggtgaaacgggggatgtcgccgcgctgcaattcctcatgctcgaaagggatgagggccgccaggtatgggcgctccttcacggccagccagaggtggtcgaagaagcgctgccggtccagcgcgtcccccattgcatggggatgcatgctctcgtgcagcagggcgtcgtagctggctgtgccgcgaaagagcacacgcacgggcgcgtgctcaaaagccgcgagcggccctccaggggcgagcagcgcatcccggtgctcggcgagcagccggtacagggctgagaacccctgcgcgagcgcgtccgcttgcgccgtcacggagacgtcctgtccttccatgcgaggacggttcgccgcgccaggaatctccatccgccgccgctcgaagcggagctggtccgtgccatgcgccgtcgcgaccaggtagcccagtggtgtgagctggccctcgccggcgcccagggcgctgaagtccacctccgttccgtctttcgcgcgccaggcgggttgcggcaacagcccgctcttgagcaccgtaccgttcagcaccgcaccgggttgcttctccacgtcccggatggaggcggcgagcgtgtggggatggaagagcgtctccaggtccaccaggacggggtgctcgcccaccgcgatgaggttctcgtaatggatgtcggtgacgtccagcgcgtagagcagtgcgacgagggcgccttgccgcagatggaagcgccgcacttcctcggccgactggcagggcgcggcctccacgtactccatccacccgtagccgtccgaggagaggacctccaccgtgcgcaacggaggcgtgaggccgcgtgcgttcagccaggagaggagttgctggaagacggcctccgccgtgagcgggcgcggcttgtacacgagccgcagtcccgaggcgaagcggagcaggaagacggtgcgtacacctcggtgcgggtctgacagaccgccttgggcctccaccagcaggccgggaggaacgccgccgtggaagcggtgccacagcgccgcggcgtcccgggccagtcgctgcatcagctccacgcccgtggcttcccacgcggtgacgtactccacgggcttgcccgcgcgagcaccgggtagcggggcgaggatgtcgagcgccacgtcgcgtcgccggaggtgctgggcgaagtccaggaagcgcgcttcgggcgtgtctccctggagtcgtccttcgagctgagcgatgcgcagctccaccgcgagcgtccgtcccagcaagggcatcaacatccgagggagcggcgcgagcaacatgcgggccgtgtgctctggctcgaacggcgcttcgggcgtgtcacgcaggcaggtgtccagggcggagacgagccgcgcgtgtgccgcgtggacgagtggctcgaccaggccgagcagggccgcgcccggtggcgtgggctccggccaggagaagggcggcgatatctccgacgcgtaagcctgctcgatgacgcgttgccacggcggaggcgcgcccatgcgtgcatgcagcgcctccgctggttctcccaggagggtgtgcagctccgcttccgtcagccccgaggcacgcaggcgctcggcccagagcgaatcccgcgtgaggggttcttgtttgcgccagcgctccagcctgcgccgcgcgcgtgcctcatccaccgcgtccggagtgccgcgcatccggagcgatggcagccgctcttccagggcatggcccagcacccaatgagacgtcacgccttctccaatccaggcagcggcctggggtgtccgagtcgtcctgcggcgtgtctgtgagagggcttccaatcgctatcgttgcattgccgccggttcggatgccagggggcctggacgggcggggtggggatgacaggctctgcccaccatggacgtgacgccactcgccgtcgcgctgcgttgcgaactgcggcacactgggccaatgcttcggctgcgccgcatgctcatcctcatcctggccaccttcggatcgctctacctcgtgttgtgtgtggtggtgttcgcgctgcaacgctccttgctctacccggctcccaagggcacgccgccgctggcggaaagtgacggcttcagccgcctcccgttggagggcggcctgtacgtggatctgttccacctgccggcgcctccgggcgcgcccacggtggtgcacttccacggcaacggggaggaggtgctgacgcagatgggcctgggcagcttgatgcaagcgcgggggttgggcttcctcaccgtcgagtacccgggctatggcgcgtcaccggggcatcccacggaggaaggcatctacgccgcggcggaagcggcgctcgcctggctgcgcgcgaagggtgtgagcgccgagcagacggtgctcagtggccgcagcctggggacgggcgtcgcggtggagatggcgcggcgcgggcacggttcgcgggtcatgctcgtgagtccgtacacgtccatcccggacatcggggccacggcctttccctttctgcccgtccgcctgttggcccgggaccggtatgacaccgcgtccaaggccgccgccgtgaagctgcccgtgctcatcatccacagcgaggaggacacgctcatccccgtggacatggggcgccggctggacacgctcttcccccaggccgtcgtggagacagtggctgtagcggggcacaacgatgtcctcgaagaccccggaaaggtctacagacatcggatggcgtcattcgcactgggagaaccctgagcggcggagtcgggtggatttgacgctgtctgtctggcttcaatgtcgacacatggcgacatggcgccgcaccggggcggtgtcgaagggaccgggcgcacggccccatgagcgcttggacaggaccgcgctctggcttgctcgaggccgccgcgactcctacgctccctgccgccggcgcattccttgtgccggcgtccaccgggagcccgccgcatgtccaaccctacctcgcccgtcatcggcatcattggtggcagtggcctgtaccagatggatggcctgacggacgtcgaatggaagaaggtgacgtcccccttcggtgagccttcggacgagctgtgcttcggcacgctcggagggcaccgcgtcgtcttcctgccgcgtcacgggcgaggccaccggctggcgccgacggacatcaacttccgcgcgaacatcgacgcgctcaagcgcagcggggtgacggacctgctgtcgttgtccgccgtgggtggcctgcgcgaggaatacccaccgggcaccttcgtcgtcgtggaccagttcatcgaccggaccttcgcccgggacaagagcttcttcggcacggggctggtggcgcacgtctccatggcgaagccggtgtgctcgcggctggggaacgcggtgatttccgcgtgcgagggcctgggcgtcgtcgcgcgccggggcggcacgtacctggccatggaggggccgcaattctcctccagcgcggagagccacatgtaccggagctggggctgtgacgtcatcggcatgacgaacatgccggaggccaagctcgcgagggaggcggagctctgttacgcgacggtggccatggtcaccgacttcgactgctggcatccggaccatgacgccgtcacggtggaccaggttgtctccgtgctgctgggcaacgcgggcaaggcgaagggactggtgaagaacgtggtgccgctgctcgggtcgcatactggcccctgtgcacagggctgccacagggcgctggaccacgccatcatcaccgcgcccccggcctgggacgccgccatggtggagaagctgtccgcggtcgcgggccgggtgctgcgccgatgaaggtccatggcaagccgatgcgctccatctggctggcgccggacgcgcaggccgcggaggccattgaccagacgcggctgccgcatgcgctcgtcagcgtgcggctgacgacgctggatgaagccgctcatgccatccggagcatgctggtgcgcggcgcgcccctcatcggtgccaccgcggcctatggcgtctggctggctttgcgcgcggatgcctcggacggcgcgttggagcacgcgctcgcggtgctgcggggcacgcgccccaccgccgtgaatctgcactgggccctggatgacatgcgtcagctcctggcgccgctgcctcccgctgaacgggtggctgccgcgcttcgccgcgcggaggccatcagcgacgaagacgtggccatcaaccgcgccatcggtgcgcacggcctgaagctcctggaggacgcctggatgcgcaaggggcgccagggccgtctggaggtgctcacgcactgcaacgccggctggttggccacggtggacttcggcaccgcgctctcgcccatctaccaggcgcacgacgcgggcatccccgtgcacgtctgggtggacgagacgcgccctcgcaaccagggcgcgcagctcacggcctgggagctggggcagcacggcgtcccgcacaccgtcatcgcggacaacgtggggggccacctgatgcagcacgggcaggtggacctgtgcatcgtcggcacggaccgcaccacggcccagggcgacgtggcgaacaagattggcacctacctcaaggcactggcggcgaaggacaacggcgtgcccttctacgtggcgctgccctcgcccaccatcgactggacgctgcgggatggggtgcgtgagattccgattgaacaacgcgacggcacggagctgagcgacgtcaccggacggttggcgtcgggcgaggtggccacggtgcggattacgccggaggggagccccgcggcgaactacgctttcgacgtgacgcccgcgaggctggtgacggcgctcatcaccgagcgcggcgtgtgcccggcttcgcacgacgggctgctgtcgctcttcccggagcggcgcgggagggcggaatgagcggtgcgtgcgagcacctcgccctgcgcgagtcgatgattgccaccgcccggcggatgaatgcgtccgcgctcaaccagggcacttccggcaacctgagcgtccgggtgaaggccggcttcctgctgacgcccaccggcatggactacgactcgctggtgccggaggacctggtcctcatgcgcttcgacggcagccacgaggggcgccggagtccgtcctcggagtggcagctccaccgggacatcctggccgccaggctggaggtgggcgcggtgctgcatgcgcactccatgttctgcaccacgctggcgtgcctgcaccgggacattcccgccttccactacatggtgtccgcagcgggtggcacggacgtgcgctgcgcgccctatgccacgttcggcacggcggagctcgcggcccacgtgctggccgcgctggaggggcgcaaggcctgcctgatggcgaaccacggcatggtggcggtgggcagggacttggcggcggccttcaagctggccgtcgaagtggagacgctggccgccatgtactggcgggcgctccaggtgggtgaaccggtgctcctggacggcgcggagatggcgcgcgtcctggagaagttcaagacgtacggccagcagccgacgcccccgtcgcgcgaagcgtgaggaccgtcacctctgtcggaacgccgatgcggaagggcagccagtgccccgttccgccggacacgtagagctggtggtcgccctggcggtagcggcccagcatgtacttgaagacgaaccacaaggccgggacgcccaggaaggccacctgtccgccgtgggtgtggccggccagcgtcagccgggcgccgcgctcggccgcgagcgggaagaagtccggatggtgcgtcaggcagagcaccacctcttcgggcgccacgtcgcggaagccggcctccgcggactgctgcatgcgctccgccttcacgcggtgactgcggccggacatggggtagtccacgcccaccacacgcacgcgctggccggcgtgctcgaaggcatgggacgtgtccaccagcaggcgaacggggccgcctcgcgcctccacgtcggcgtaggcctggcggatggcctccaggccgcgccagtgctcgtggttgcccaggatggcgagcattccgtgacgggccttgcactccgacagcgccgccatggtgccgtcgagctggtccaggtcgtcgataaggtcccccgtcatcacctggaggtccaccttggcgtcgttcatcgcccgcacggcgtcttgcaggtactgggtgtcgatgaacgtgccgacgtggacgtccgtaatctggccgatgcggaacccgtccatcgccggagacaggccggggaggtggatgtcgacctcgcggacggagaactgcgtgtagccgttggcgagccccaccgagctcgtcccggccgccagcagcggcaccgcgcggccggcgttcgtcagcaggttgcggcgcgccatgttcaccggcggggcggggttggcctcgggcgcggtgaggggcggctcctggcgggcgggccggtccagccacctgcgcagcaggaggaagggcgcgccggcgaggacaatcatgatgatggcgacggaccagcccacggagaagacgcgcagggccgcatcccccacgggaagctgcgcgtgccgtccggccaccgcggagtagagccacgccaccagggacaggaaggtccccagcgcgaaggcacccaggcgccactttcggagcaggccgggccacagcgaccggagcacggcccaggcgctgacgttgaagacgaggaggaacagcagcctgcccattgacggtgctcccttggcgtgaaggggaacagtcatagccggggcgggcgacatgcgccgcaggaagtggctggggcttgaagggagtgttccgtccccggcccctcagccccggctgggactggccatcctcaggtgagcgtggagcgtctccgtgcgcaggtagaggaactgggcatcgccaaaggccagggcgtcgccgtcgttgagcatccggtcctggtccggccccagcgaggaggcgttgacccaggtgccattcatggaaccctggtcgcgcaccgagcagtcaccggcctgggcgtgccaccgcaggatcgcgtggagcttggacacggacgggtcgggtaccaccagggagcagccttcgatgcgtcccacggagaactcctctccctccgtctccggcctgaggaagtggacctccagggcatcgaacccgcgcagcatcacgaacagccggtccacgagccgtgtccggtgggccatgcccacggtgcgtgcctcgccgagccgcatggccacctgttggaagacgggctcgggaggttgttggaccagcacgacgcggccggatgcttcgaggaaagcctccagggttgccagggcgaacgggcgcagttgcttgacggacggcatggtgcccgcaccttagaccgcgtcgcgcgaagttggcgctggaccgcgcccatcccccatggagtgtccaccgccggtcgggagccgcgccgtcccgccgctccatgacgcgcgcgacctttcttgggggaaatacgtccgctttcatcgcgccggggcaactgaaccccttccgcgaagccctccaggagcgacgacatgacgatgcggatgaagcggtatggcgctggactgttgacggcgtggttgctggcggtggctcccgcctgcggcgactcggatgaaggcgcgccaccggacgcgggattgcccgacgcgggcgacagtgggattccggatgcgggtgacagcggcacacccgatgcgggtgaggagctgcctccgctgctggtgcccgcgggctgcaacccgctggcctccgagcatgactgcctcctgccatacccctccgactacttcctcgaggaggatgcggcgctgccgtccggccaccgggttcggctctccgaggcggcgaagctgaaggcacccgacggcgccgcgttcgacttcacggacctccacccggcggacggttactctcatggcacgcaggtgctcgcgctctttccggacggtgtggatgacgcgcgcctgccgtcggtgacgagccccaccgccgcgacgaacgggaacacggtgttcctcgacgcggagcgcggtgagggcgtgctccacttcgcggagctggaccccagggctccggacgacgcgcgccgcgccttgctgctgcggcccgtggtgcggctgcgcaacacggcccgctacatcatcgccctgcgcgggctgacggcgaaggacggcacgcccgtgccggtgcccgagggcttccggcgcatccgggatggccagacggcgggagacccgctgctggcacccctggccgccaggtacgaagcggacatcttcccggcgctggaggccgcgggtgtgccgcgcgcggagctccagctcgcgtgggacttcaccaccgagtcgcaagagggcgtcacgcaggacatgctccaggtgcgccgcctggcgatggaggcgctggaggccacgccccccgccgtcacggtggcagacgtgcgggatgacgtggacgccaacgtcgcccggcgcatcaccggcaccttgcgggtcccgctcttcctggagagcgaccagcccggtgcgctgctggcccgtgacgaggaaggccgtgtgcggcgcaatggcgacgcggaggtgcctttcacgctccagattcctcgcagcgtctgggggcagtccgtggcgccggtgcgcttgctccagtacggccacggcttcttcggccggcaggcggaggcggatggttccttcgtccggcccttcatccaggccacgcggatggtggtgctgacggtggactggtggggcatgtcgcagacggacgcgccgggcgtgctccaggcgatggcgggcaaccctggccagacgatgcgcttcaccgaccgcgtccaccagggcatggtgaatcagctcgccgtgacgtacgcggctcggacgaccttgggggcgttgaccgagctgcaggacgacggcgtgcgcgtctttgacccggagcagacgtacttctacggcatcagccagggccacatcctgggcggcacgtacgtcgcgctgtcgccgcacgtctcacgggccgtgttcagcgtgggcggggcggacttctcgctgatgatgttccgcgcccggcccttcggcatgttcctggatgcgattgcccagacggtgccggacgcgctcgaccagcagaagttcgcggcgctgacgcagacgtccttcgaccgcatcgacccgctcacctatgcgccgcacgtgctcggcgacctgtatcccggagcgcccgcgtcgcgccgggtgctggtgcagtacggcctgggggatgcgcaggtgcccaacgtggccaccgagctgcatgcccgcgccatgggattgacgcagcaactgcccgccacctggcgcgtgccgatgctgcccgcggaggaggggacggtggagggctcggcgctggtgcagttcgacttcgggctgccgtcgccgctgcccggcacagtggcggacctgccggccgccgacaatgccgttcacgaaggcgtgcgccgggacgacgacggacgggagcaggtggaccggttccttcggccaaacggacaggtggaggtcacctgcgacggcatctgcttgggtggcaactaatgagcttcagcttgttgagttaagggacaggccggcgtgagcgaagtaggcgcgcagggtggcgggacgatgctggagccgccgaaactccctgcgcgcctgccgacgcaattcgtcgatgcttccaggcagagcgttgagcagcgccttcttgacgctcgcattccgcagctgcccgcagttgccgcccctgcagatggtgcctcctcctcgcccgaggccgccgctgcggggagccggccggattcggcttcaccccgcatgaggagagcctcgtcctggaggcgttcgtggaccggctcggactccgggacgtgacgctggtcatgcaggactggggcgggcccatcggcatcgggctcgcggagcgccctccctcgcggacaagccgacgctcatcttctgggcgctcgaggacgtgggctttccccagcgcgacagggagcggtgggagcaggccttcccgaatcacaggagcgtcgagttccccggcgtgggccacttcttcttcgaggacaccacggacgacgtcatctcggagattcgcgcgttcatgtcctccgccggccccggggttcgcgtgggaggggctccgcgctgacggccggggcccacgccgctacggcccctgcgtccaacgagaacgcagcccgcgtcccttcacgacgcagcgccctccggccgatgcgcctccgcccctggagccggcccccgccggaatggcgtcccggttgcatttgcacggacgcactggcctcgcatcgccgcgcccgacaggaatggatggaatgccccccttcatcatccgcacgcaacagggcctcaccctccagcacgcaagcgaagcgcggttccgaagggagatggtggagcacctgcggacccacttcccggagcggaccaccgggctggaagcacgcgagctggatgcgcacgtcgagcgcgcactccaggccgcccgcgactatgggctcgcgagccggcgggagctgtgccgcttcctcaacctgtgtggcctccatggctgggacttcgaccggcggccgcgcaacgcctggatgaaggccatgctcacggccccggacgtgacggcccccggcgcccggctggaccggctggtggagcactccctccaccggctggagttggagtcccaccgcacccggctcgagggcgagttcggccttcaccgtagagaacgaaggagc

SEQ ID NO: 1041 - DNA, 11812 bp, Myxococcus xanthus
  unsure (1)..(11812): unsure at all n locations
ctcatgcggtacgccagcgtgcccttgtcgagcgagagattccgcagcgtcgcgtcgttggtgccgtccttcttctcgggcggcttgacgccaccgaacaggcacgacacgccggtcaccttcttcgcgatcgccttcttgtaggccgggcgctcgcacatgctggtgatcccattgatggccgcctcacagtaggagccatagctcgagttcgcccaggcctccggcttgaagttctggaagtcggtcttgacggtgagcttggtgccacacttctcgttcgcggcagccaaagcctcggagatcttctcctcgaacgacgccttcgcctcctcctgcgcgggcttgagatcctcctcggcgaaggcagacgtcgacagcagggccacggtagcgaacacgagcttcgaattcatgcgatgtttctccaggaaagaacggccatcgcgagtttcaaactgccctggtttttacgcaagggtatcaacggaatagaagccctttagcgggggacggcggcgctacggcgtccgcttcaggccatagagaccgtgctcgcgcgcataggcaatggcgcgcgcgggcaccaggtccgacggagcctcgccgcgcgcgagcaggtcgcgaatcagcgtcgacgacacctccgccagcggcggccccaatgtgttcggcgccgggtaccccgcgcggttgagcaccatcacccgcgacagctcctcgatgcggtggaagtccttccaatgcggaaggtcgcgcaggatgtcgctgccgatgatgatcgaccagcggatgtccggatgccgcgccaccagcagggtcagcgtgtccaccgtgcggccggagagtcccggctcctgctcgatccggcttgtcttcagccagcccgatgtctccgcgcacagcgcatcacacatggcgacgcgatgctcgaagggctccatctgcttgccgaacgggtgctgccaggacggcatcagccacacctcgtccacgtcctgggtagcatggacgtacgtggcggccatgaggtgccccacatggggcgggttgaacgagcctccgaggagcgcgacctgcacggcgggcctcacgtcacttgagggacaacttcggggacttcttctccaggacgatgacctggggctccactatcgagtgcccatccaggcggaacgcggagaagcgcaggttccggtccaccttgtccaggagcgcgcacgtctgttcggcggcgcccaccagtcgccccggcgtcaggaagtagcgcgggccaatctgaaccaccttgggctccggctccttgccgtggacgaagagcagcgcgttgagcaggtcatcccgcgtcaaatcgttcttgtcgtgcaccacgcagcacagcgtgtcccccatcaggtccatgaccttgttgttgatggaggggtctctgtactggagcgattcgcgctcgggcacgcggatgaagcgctccatgacgagccggcggtcgtcctccgacgccacgtccgccggagcctccgcgcgtgacggcgtgcgaggcagcgcgtcctggctgcccagccagttcgtcacgtccgccaggaagtccgcgtccgagtactcacgcccgccccggctcttctgccgccgccacagcacccattcatccaggtccgtgtagcgcgcgcccacgaagagaaaacgccgcgcccccttggagcgcagcagctcgtaggccgcgtcgaaggcttcgaggtccccatggctgtcggagaagacgccgatcacgcctcaagcgtatagcaggtaggacgtcctgtgacgtgcgaacgtttccgtctgagcggagaacccctccagcaaccgctccagcggccaccccgcttcgatgcctcggcgcacctggtccgtcccgcagagcaggtcgaaggccggcacgtcctcgacgaactcgtaggcatccgcgcgccaatcgaacgagcccgggccaatgtcatgcagcgtctggaagatggcgacgccggtgcgcaggggctggaaggcctcccggtccgtcacgtggatgaaggcgccgttgcaggactgccccgtgtacttgtcgaacgtcggcgtgaagcccacggcccggaaggcgaccccgggcagctcctccttcgccagccgcgccagcaactggtccgtgtccacccacggcgccccgaactgctcgaaggggcggcaggtgccacggccctccgagacgttggtgccctcgcccagacacatgcccgggtacaccagcgcggtgtcggcggtgggcatgttgggcgacggcgagatgaagggcagccccgtctccgaccagaactggccgcggcgccagccttcgcacggcaccaccgtcagctcgcagccgaagccctcctggacgttgaagaggctggccaattcccccgccgtcatgccgtggcggttgggcagcgcgtacaggcccacgaaggagcggaagccctcccccaccaggttgccttccatcgccacgccgttgagcgggttcggccggtccagcacgtagaagggcacacgggccttcgccgcggccttcatggccagcgccatggtgtagacgtaggtgtagtagcggctgcccacgtcctggatgtcgaagacgagcgcgtccagcccctggagtgactcctgccggggcgacagcgattcgaaggtggagccgtagaggctgtacaccggcacgccggtgcggcggtccttcgcctcgtccacggcgaccatgtactgcgcctcaccccggatgccgtgctccggaccgaagagcgcagccagcgtgacgccgtccgcgcccgacagcaggtccgccaggtggcggaagcgagcatccacgctggtgggattcacgatggcgcccacgcgcttgcccttcaacgcggagaagccctgctccacccacacgtccagtcccgtcttcaccttcgtcacggcgttcccttcctcagccagcctcgagggccggcacatcaacgctccttgaagcccttgagcgcgctttccgcggccaccttcgagtcgcacttggaaatgccgaacaggcccgtccgcaccccgtcatcgggcccaccgtcggacttcaggtcctccagggcgctcaccgcccgcttcaactggagccggcctaccgtggacgcggcatccgagcgcacgtcgcatcgcgcatgcgacagcatctcgatgaggcggtcctccgcggcgcggctgccggccttcacggccgtggcgtagaccttcagcgcgtcatcgggcttgcccgtcgcttccgtcagacggcccagcaggaagttgcgccgcccggagtcctcctccttcatgatgagggtccggacgtccttggccagcgcggtccgctcctcctccggcgcccgctccaccgccttgatggcgcgcaccgtctcgtcgccactgaacgccagcatcgcgacgcccgcgagcacgacggccgcgcccacgcccaccagcgcgcggtgcttctggacctgcggcggaagcgtcgccatgccgcgcgaaaagagcgaaccgcccaccgtgcgcgcctgccgcccgagctccgcggcctgctggcccagcaccgtggcacccgcggccgcgcgttggctgatgaccgcggcgcccgcagcggcccgctgccccagcacggacaggtccacctgcgcccccggtgacgaagcctccgacacgcgggacagggccaggttcccgaagggcggcatcgattcggagcccggcgtctcggcgatggcgctgggcgcgggagcctccacgcggtacggcgcccggggcacgtggaagacgcgaatcttccccgggatgcccttcagctcgtaggcgcccacttccttggaaggcacctcggccttgttcatcgccaggtagacggcctcggtgaagtacacctcgcccgcctcggcgatgccctccacccgggcggcgatgttgacgggctcgccgaagatgtcgttcccgtccagccgcacctcgcctacgttgatggccacgcggacgtgaatctgctccgacacctccaccgtccggttgtggtgccacagccgatcctggatggcgatgccgctgagcaccgcctgggtgggcgattcgaaggtgacgaggtacgcgtcaccgatggacttgacgatgcgcccgccaaacgccttgaacagcggcgccagcagggcctcgtggacctggagcaggcgctggttctcctccagcgtctgccggctggtccgctcggtgaagcccttgatgtcggtgaagacgatggcgaggttggcggtcttcaaagcccgcgcagtgtatgcgccaccgtcgatggtgcaatcgcaactgcgtaccaaatgaccgctcgctgtcagcgacgtgatggtttgaggtcacgcattcgccgcttcggaggggcttccagcgccgcgcggacccgctccgcgagctggggccgccccgtgcgcgtgtagaagtcggcgagccgccggaggaccagcggactggccggctggaagcctcgcgccgccagcagctccttctccgcgtccagcaggcgctcctgcttctccagcacctccgccagctggaggcgcacctgcacccactccggcttcagccgcgccaggtaacgcaggtgcaactccgacttgagcaggtcccccatgtccagccagagcgtcccgagccggaagcgggcctcctcgtaggaggcgcgcagttgcacggcctgctcgtacgcctggacggcctgccggcggtcatcccgctcctcccacaacaaaccccgcaggtaccaggcgcggggattattgggagcctgctggagcgcggcgttcaggtgggactccgcctgctccagcgcgcctcccgtcttcagcagcagccgggccatctccaaccggggcagctcccacgcgggttgagcccggaccagggcctccagcgcggccagggcgcccacatcattcccatccgcttccagggccagggcctccgggagcgaaaccaccgtccgtgacgaggccggagtcagggcagaaggctccgctgcgtcagtcgcgcccgccagcaaagccaccaggatgacccacctcatgtgcggctgatagcagagccgacccgggcgcctcaatagatcctcttgacggccgaacggccgcgcatgaaacccatgaccgtgcagatatcgcaaagaacgctggaagacctgngcttcgcggatgtgctccgcgcgttggcgcaacgctgccggacggagcccggcagggagcgggtgctcgcccggccgttcctggccacccccgaggccgtggcggaggccctcgcgctcgtcgccgagacccgctcgttgtcccaggagcagttctccctccccttgggtggcgtgacggacctgcgtacgcccatcggccatgcggccaagggcggcatgctggagccccgccagctcatcgactcggcgcagctcctgttcgccttcgtccgcacccgcgaggcactggacgaacgccgggcccgcgtcccccggctggtggagattgcccgccggatgccatcgctggagccgctggctcgccgcatcgaccagtgtttcgaaccggacggtgagatctccgaccgtgccagcccggagctgcgcgaagcccgggaccgcgcacgtgggctccatcgccgcatcaagtcgcggctcgaggagatgctccacgatgagaccttcctccccaagctgcgggagaactactacacgatccgcaacgggcgttacgtggtgccggtggtggccaactaccgctcggaagtggacggcatcgtccacaacgccagccagacgggccagacgctcttcatggagcctcaggccatggtgggcctgggcaacgacctcgccatcgcccagtcggaggtgaccgaggaggagcgcaaggtgctccaggccctgagcgaccagctcggccgggagtcggagcgcatcctggagggcctggacgccgtggcggagctggacgaggccgaatccgtggccatcctctccgcggacctgggcgccagcatgccggccttcgagaacgtcacggaaatgcagctgcggcagctgcgccacccgcgcctggtgctcaagggcgccgaggtggtggccaacgacgtgacgctcacgggcgatgcgaaggccctggtcgtctcaggccccaacgcgggcggcaagacggtgacgctgacgggcgtgggcctctgcgcgctgatgctccgcgccggcctgccgattccggtggccgaaggctctcggatgccgctgtaccgctccgtccactccaccgtgggtgacgcgcaggacctggagcagggcctgtccacgttcagcgcgcacgtggtgatgctgcgagacatcatcggcgccgtgggcgagggctcattggtcctcatcgacgaaatcgccgcggacaccgacccgcgcgagggcgcggcaatcgccatcgccgtgctggaggagctgatgtccaagggcgtggtggtactcgtcaccacgcacctggaggagctgaaggcgctggcgcacatggacccgcgcttcctcaacgcgcgcgtgggcttcgactcgaagcgcatggcccccacctaccggctccagattggcgccgcgggccagtcgtcggccatcgagatggcggcgcgcgtgggcctgccccagaacgtgtgcgagcgcgcccgggagctgtccgtcagtgccggcggtccgctcaccaaggcgctggcggcggccgaggaggaacggcgcaagctctacgaggagctggaacgcgcccgcgtggcggcccaggaggccgaggcgctccgggccgacctggagaagcagaagcagtccttcgagcgcgagcgccgcgcccggatgatgcagttcaacgacgacgtacacgcggcgagcgagcacgcggcggcggaagttcagaagctgctgacgaagcttcgagccgagcagaacgagaaggccctcgccgaggcccggcagcaactccagcagcgcgcggatgaggcgctgaagcgcgcccaggccgccaaggcggagctgttccaggtggaagcacctggcccggccaacctgaaggtgggcgcctgggtgcaccactcggggctgaaccgcgatgtggaaatcctggagctggcggacaaccacgcggtggtgtccgcgggtggcgcgctgaagatgcgcgtgcccatcacggagctgtcgggcgcgcgcacgcgcaagccgcagcaggcgaagttcccagagcggcagaagcaggatgcggcgctcaagcgcgcggcctccgcggccccctccgaggtggaggccacccatttccgctgcgacgtgcgcggcatgcgcgcggacgacgcgctggcggagctggagtcgttcctggaccgcggcatgcgcagcggagaagacgccgcgctcgtcatccatggccatggcacgggggcgctcaagcaggccatccgtgactacctggccgcgtctccgtacatccgcatgtaccggccgggtgaaggccacgaaggcggcgacggggtgaccgtggtcgccctgcgcgcctgaccgcacccgcgatacggactgaagcatccagggccggaggtggctggaaacggctgcctccggcccttcgtctgtcaggccagcccgcgcgactgccagcggagccgcggtgtccacgagttggagcttgaagcattggagctgcatcggcgccagcgcatgtcaggcgcggcgacggaactggtggcctagcttcgagacacgtcgcgaccaaacacctggcggatgcgctccagatccgccggtgtgacatggagcagcgagtgcttgggcgacaccaccgcgagcacgtatccgccgagcacccaggcacgggcgcgatactgggcgaagttgcggaagaggcagccgtagcctcccgcgacatgcccctcgaaggcgtcgacctccaagacctcgaacggagcggtgagcccgcagcgcagggccttggagagcgcttccttcatggtccagatgacgttcgccgccagctcgccgccgccgggcgcgtgacggaccatggccagttcgcgctgcggcatcacggattcgaagacgtccgtccgttcaggagagagctgctcgacgtcgacgccaacgatgtgctccggcccacacgcaaccgctgccgccaccgagcgcgcgtggctgagagagaccacgggcgaatcccctcccgcgcccttgaccaccggatgttcgaagacgccgggcgcgatttcgaccgcgtgcatcggtacctggatgccgagcccgccgagggcgcgtttggctgcgtagcgccccaagaagaacccgagccgccgcgagtccgcgcgaaagccctccagtcgaacccgctcattcggatggagcagtgccagttgcgcatcgttgatggccgcagcggactcctgatggacacaggcgagcaccgccggcaccggcacaccgtggcgcaccatgccgagcgacaccgtcgcggaggactccagtccgagcgggtcgtgatggtcagagccggtcatggcgctggattctgtgtcaacccgcccaggacctcaatcacagccgagcccctggcgcagggtgaaatcacggcagtgtcgtcagatacccggctcacgcggaaagccgtcagttggcgcacaccgcgaacgtcccgacgcctttctccgaggccaccatgcattgggtcgtccagcacaacctgttcaacgagccgggcttccacacgctgatgggcgtgctgcggcgcggcgagattccgcacaccgtcgtgaaggtcatcccgttcgatggcggtgtcgagccgactgtcgacgtcgacgggcccgtcatcgtgatgggctccctcagcctgacacgttacgcgaagcggagaggctggacgccgggcgcgttcctcaacgacaacttcgacttccggatctggcgcgagaaactgggccaccacctgctcaacgccgatgcccaggtccaccgcttcggggacgttccaccgagggagggccccttcttcatccgcccctgcctggacgacaagtccttctccggcatggtgaccacgtgggacgacttcaacgcgtggcgggcgagcgccctcgcattgggcgaaggcgccacggtcgatgccgacacctgggtggccgtcagcccgctgaaacacatccagcgtgagtaccgcatggtcgtcgtcgacggacgtgtcgtcactggcagccggtacaagctcggggaccgcgttgcgtcgtctcccgaggtcgagcccgacgtgcgcgacttcgcccaggccatggccgacacctggacgccagaccgggcctacgtcctggacgtcttcatgcacgacggcggcctgtacgtcggggagctcaacaatctcaacgcggcgggattctacgcctacgacgtcgcgaagatggtggacgccatcgaagcaatgccctggtagctcggtccgggcatcgctccgcgcgtgtcgcggctcaggacacgcgctggtgctccgcgagcacgtcgtccagagcctgggcctgcagcttcacgtcgggatccgagtccgacagggccttcgcggtgtgaacgcgagcacgcgcggcgtccgacttcgccagggccatggccatgaagaggtgcgcccgcgtgtcctcggggtgagcctccaacacaggcgtgaggacctgtaccgcccgtacgtcctcttcccgctccagcagtgccatggccaggtcgtgcgccgggcccggctccgacggtgcccgagcatgggcgtgctccagcagttccacggagcgtacgcgctcacccgccagatccaacacgcgagacaatccgtgcatcaccgccacgtctccgggggacttgcgcagcgcctcttccagcagacggcgggcttcgcccacatcccctgcgtccaaccgggccattccgtcgcgataaaggtccgttcccactgagctctcctggcaccacgcggtgcgtcggtcatttccacgcaacttcaagtctacaaactgcgacaaactgagaggaagctttccccccggacttcatcatgctcgttcgcaacgcccccgtctcggcccgccgcccggcgaactccccctcggagtcgcccgccgcggagaagcccaacgccgccgcggctcccgcggccatccaccagaaggactcgttcagcaacacgacgacggcgctccagcgcacggcgaaggtgggtgcggcgcccgcgggcgaccacggcaagctgatgatggagtacctgaccggcgcccgccctcctccggcggacttcgagaaggtcatcggctacaagccctacgccatccagacgccgcacggtcagcggatgcaggacccgctgggctacgcctccgtcccgctgaagatcggcccggacaaggagttcgaccccgcggccaagacgcacgactacggctacgacctgctgcgctacttcgacaagaagggcacgccgctcggcccggatgcacgcaaggccgccgacgccctcttccgcaaggacatgttcgactacgcgaacgaccagaagggcgcgctgaaccgcttcaagtaccgctcctgggcgcagatctacgccaccgcggtggagctgaactcgaagcggcagggcaacggccctccgtgaaccccgtgtaggttgccggggcgtgcggcgcggagtcgcttctccgcgccgctcgatgcgctcagggcgactcgtagcgccgcagcttgtcgtacagcgtccgcaaaccaatccccagccgctgcgcggcacgcttgcggttccccgcctcgtccgcgatggcctgctcaatggcccgtcgctccagctcctccagcgtcaggctgggaagccggcccccctccgagacgggcgcatccaccacgggccccgccgcgcccgttggatccagccacaggtgccgaggctccaccaccggcccatccgcgaggatggcggcccgctcgagcgcattgcgcagctcgcggacgttgcccggccaggtgaacgcctccagccgcgccacggcctccggtgacacgcgcaagcctggacgacccagctcgtctccgatgcggcgcagcagcagctccgacaacggccgcaggtcctcgcgccgctcgcgcagggacggcagccggatggggaacacggccagccggtggtagaggtcctcgcggaactcaccgcgcgccatcatcgccttgagatcgcggttggtggccgccacccagcgcacgtcggcttccagggtccgcgtaccgcccacgcgttcgaagcggcgttcttggaggacgcgcagcagcttggcctggagctcggccttcagctcgccgacctcgtccaagaagaaggtgcctccctgcgccagctcgatgcggccgcgccgctgggccaccgcgccggtgaacgcgcccttctcgtgtccgaagagctcgctctccaggagcgtctccgtcagcgccgcgcagttaacggccacgaaaggcccgtccgcgcgctcactccactggtgcagggcccgcgcggtcacctccttgccggtcccgctctcccccaccagcagcaccgtggcctgcgtgggcgacaccttccgcagcgcttccaccaccgggtgcatggcgggagcaccccagctcagctccacctcgcccgccgactgccgcgcctcggtcttccagttgagcagcgcgcgccgctccagggcccgcgccaccgtcaggcgcagttcggcggggctgcccacccgtttgagc

SEQ ID NO: 1042 - DNA, 8793 bp, Myxococcus xanthus
gcttcgcgccgcccgggcccaggccctccaggacccccgcgtgcaggtgcaggtgcttgtgcacgtccacatgcgtggccggcaggcccagcaggcccgcgagccgtgcgagctgggcgaaggactccgcctccaccgcgtccgccggcaggctgcccgcgcgcgcctccacgaagccgccgtcctcgccgagcaactcgcgcgggaagccgctccacacgggcgcgccccgggcgaggttgaggtgcaggccgatggagaggccccgggcttcgcgcgcggcggcctcggagaagggcgtgttcaccatgaaggtggccgacgagacgacgccctcgcgcatggagcggaggatgccgcgcgtgacggccgggtcgtagcccaggtcgtcggcgttgatgatgagggcgcgtgacggcatggcggggttctcctcgcggtgggctcagggccgggggcgtgcctggaagaacttccacgcttcccgcgtggcgtccaggtggggtgtgccgccgtgattgaagtccgtgaagccgggccaggtgtgctggccgccctgcaccgtgcacagggacgcggtggcggactccgggctgcacccggtggcggcggtgcaggtgctgtcgccctgctggtacgtctccacggtgggacccgtacagccgttgcgctcggcccagcggcgcacggactcctcggcggacgggtaggcgccgccgaagatgcccaggttgttgccaccctggtagcggatgaccgggtcggcggtgccgtgcatgtgcagcaccggcacggggcgcgacgggttgcagggcgtggcgccctccatgcccgccacgggggcgatggcggcgaagcggctcgcgcgccggcaggccagttggtacgagaagaagccaccgttggacaagcccgtggcgaaggtccggcgcgtgtccacgcacacgcgcgtgtccaggtccgccagcaacgtgtccacgaagcccacgtcatcgaccttggccgtccaggcggggccgcagcacgcgcccgcgttccacccccggtaggggccgtcagtcccctggtgattgatttcggaggtgctgaggccccggggatacacggcgaggaagccctctgtgtcggccagcgtggacaggcgcgtcagcccctccatctccacctcgttggagccgagtccatggaaggccaccacggcagcggtgggccgggtggcgtcgtagcccggggggacgtggacgcggtagttgcgggtgcgcccgtcgtgctccaccgtccagtcgtaggtgccgggccctaccgtgaggccggtgcaggccgtgcgctccggcaccgtgggttcctcaaccgtgggagggacgatgccggcatcccccgtgggccgacgggaagtgtccgaggacgagcacgccgtggcaccagcgagcaggactccgagggcgaggcgagttctgcgaaaacgcatggcctcgaagttaatgggccggagccgtgacgcacgaagtgtcggcgtcatttcaccgcgacgcactccgcggccagggcctccgcgcgcgtcgggaagcgctcggacaaggcgcgcttcacctcggtgacccccgccgtgttgccggtgtgggcgtggagctggcaacgggaggccagcgctcgtgggtcctcgggagagagccggtccgcttcgacgtaggcacgctcggcgcccgcggtgtcgccttgccggaagagcacggcccccaggtagtagtgcgccacggcgagcttgggcgccttccgaatcgcgcgcttgagcagggtggcggcctcgtccacgcgctgctgtcggaagcgcacgaagcccagctcggcgaggctcgcggcgtcatcgtgggagcgtgtccacgcggagagcacgctggcggcctcatccagccggccactctgcgagagcagcaggccgtagcggggcgtcacctccgaggagccgggcttccgggcgtggaccgtggccagcgcggccagcgcgcccgggatgtccccctgacgctcgcgcagctcggccagcgccagcggtgggcggaggtccttgggggccagcgcggtggcctcctcgagggcgcgctcggctcgcttgcccagtcgcaactccgtggcggcgcgcgcggcgatgaggtgcgcttcgatgtccttgggaaagcgcgcgacgaagccatccgccagggccagggcctgcgcgtgcgcgccggcttccagcagcagcgcgcccgcccggctcagctcctccgcgcttgctcggtcatccgacgccagtccctccagggcagccgccttcgcatccgccgtggaggcggactccgcccgggccaggcgttcggcggggggcgctgcgggacgcgtgaggaaccacgtcgcgcccgcgcccactgcacccagcgcgagcacgcccgcgatgagcgggaccatgcgcgagcgtcgcctgctcggggcgtgctcatcctgggcggtggaggcggccgtgcccgtgggtgccttccgcgtggcgcccgccaccgtcgccgcgtcggggttcgtggtccgggagacctggggccacgcggtgggcgcgtcgaccacgcccaggatgggccgggtgtggggcgccggcgtacttccatgggacgggtccgcgagccgcgcgcgccgcagggccagtcgcttggggtcgcggtccggagggaagagcgaatccacgtaggcggccaactgctcaggcgtggccatctccgctgcgccaccaatcgactcgatggcggcgatgaagtcttccaggctgtcgaagcgcgcggccggctctcgggccagcgcggtgaggcacaccagctccagcgcggtgggtacggacgggtcgaaggcagtgggcggcttggggcgtccctccgcgatgcggcccagcacctcgtcggcggacagtccggtgaagggccggcggccacagagctgctcgtagagcatgacgcccgcggcgaacaggtcggcgcggtggtccaccggcttgccggcaatcatctccggcgacatgtagaagaacttgcccttgaggatgccgggctccgtgcccgagcccagcgcgtccgccttggcgatgccgaagtcgatgaccttcaccgcgccattcacacccacgtggatgttgtcgggcgtgaagtcgcggtggacgatgcgcagcggccggcccgcttcatccacggcgcggtgcgccgcgtccaggccccggcaggcctccaccagcacgcgcagggtgatgcccagcggcacgcggtgtccgtgctcggcggcctcctgacgcagctcggcgaacgaacgtccctccagcaactccatggcgatgaagggctcggtgccctccatgcccagctcgatgatggtgacgacgttggggtgtcgcacctgcgcggtgatgcgggcctcgttgaggaacatctgcaccacgcgccggtccgaggcgaggtgcggcatcaaccgcttcaccgcgaccgagggcccacggctgccgtcgtcctcgatgcggcggcccaggtacacctccgccatgccgcctgtcgcgattcgcgcggacagtcggtagcgacccacctgataggggttctgctccggctccaaagtgcgcgcagtctacgtgtaggcgcccgtccgcgcacagtgttgtagccattacggcgggtgggggtcctctacctccccgctcgcgcgagggagcgagaatgttaacgtccgtcctgtctcatgggcctggcgggaggtggcccagacacacgcacgcgctgcggccggagggatggttgggcacagtcctcaagggtggttacgtcgtcgaactggagccagcgctggtcgagcgcgtggacttgcgcatcgaaggagagcgaatcgtcgcccgtgggccggacctgacgccgggcccggatgacgaagtcgtggcgctgtcgggcaagctcgtcttcccggggctggtgagcgcgcaccaccgcctgtacgcggtgctgggccgtggcatgccgcgcccgccgctggagacctaccaggaaatcctcgagcaggtggcctggccgtacgagaacgcgctcgacctggacgccgtgcaggtggcgggctgtgccggagggctggaggcacttcagtgcggcaccaccaccgtgtgcgatttgcactcctcgcccaaggcgatttcgggctcgctggtgcggctggcgcgcgggctccatgaggtgggcgtgcgcggcgtgctcgcctacgcggtgtcggatcgccagggggcgctcgggcgcgaggaggggctggaggagacggtcagcttcgcgaagaaggcgaaggggcgcttccggggacaggtgggcgcggcgccgtgcttcacgatcgggccggatgcgctgtcaggcctggcggaggcgctgaaggcgctgggtgatggcggcctgcacctgccgctggcggaggacccgctcgatgagcgcctgtccaacgagaactacggtgcctcgccggtttcgcggttgctggaggcgggcctgctgtcgcccaagagccaactggcgcacgtgggccacctggactgggcggacctggcgcaggtgattgccaccggtgcgtggctggtgcacacgccgcgcgccaaccaggggctggaggtggggtacgcgccggcactgaagttcggggcccgggccacgctgggcgcggatggcgtgtcggcggacctgttcgcggaggcgcaggcggcgtacctgcgctcacgtgaggcggggcagcccatcgatgtgctgcgctacctggccaacgggcaccgcatggcgtcgcagattttcgacgcatcggtggggcccatgcgcgagggctcgctcgccgacctgctcatcctggactacctgccggccacgccgctgacggcggagaacctggcctggcacgtggtgttcggcctgggcagccggcacgtggaggcggtgatggtggatggcgtgtggcgcatgtgggcgcgccggccgctgtcggtgagcccctccgtggtggcggagcaggcgcgcgaggccgcgtcggcggtgtgggcgcggatggcggaggcggcgaagaagtagcccgcctctgccttgtccgggggcgggatgtcctgtctagtcccgcccatgctcgtgccattgctcgttgcgggattcttcagcggtgccattccccaggccggagagacggcgccggacttcacggcgaaggactccgcggggaacgtctacacgttgtcggagatggtgaagaggggccccgtcatcctggccttcttccccaaggccttcacgggcggctgcacccgcgagctcaaggcgtaccgggaccgttacgcggacgtggagaaggcgcaggggcaggtgttggccatcagcatggatgacgcggagtcgctcacgcgcttcaaggccgaactgaaggcgccgttcccgttcatccccgaccctgaagggaaggtcgtctccgcctatgacgtgaagatgccgctgctgtcggtgccgaagcggtacacgttcgtcgtgggggagggcctgaagattctcaaggtcgagtccggcaacgacgccatcaacccgcacggagcgattgtcgcgtgcccgctgcgcaagccggccggcgcggacgcgaagacgccggattcgggcacgaagtagccgcgcaaggcacgtggctaccgtctctgagcgggcgccacgcgctgccggctgtcgaagacctgcgcggggcaaccatcgatgaaggtgtcctcgaaggcgccccccgtgtactcgtcgatgaccctgcgccagaaggcgatggccgggcggttgcgcggcagttgggacagctcccagatgccggggaagaggtcgaacacggccctggccgcgagccggcccaggccgatgcgccgctcgtttcgcaggatgaagaactcgctcatccggaagtcgcgtccaggcgtcatgtaggagaagggggactgtcccacgaaggcgaagcccacgacgcggccctcccagcgcagcagcagggggtggacctcgggggcgggaatcagccacgtgggcaggaagtccggccgccagcgcccctgttcgtccatggcgtagtcgacgccgaactcgctcaggtcgtggaggtagagcgggtagaggtttcgaagcagtgtgtgctcggacggagtcgctcggagaatctccatggagggcctctcgtgttcccagcatgacccttcgggcgtccgtcggccaggggggctcggagggtatctgctgagccttgcggacggatgaggaggggcctggatgggtcctcgtctctccatccatcgggtgtcatgcagggaaggggcgcggtggggcaatcctcccatggaggcgctcggcctacgttgccctccacgagtccggggctctgcgggggaaccatgaacagtcagcggatgcgcatggcgagtggaatggacggccaggagacccatgccccaccccacgagggcaggcatgcgcacggccatgacgccacgtcgaaccgggcggtgcggcgggtgctgatgacagccgacgccgtgggcgacgtctggacgtacgcgctggagctgacccgggcgctcgcgccgcacggggtggaggtgacgctggcgaccatgggggcgccgctcaccagcgcgcagtgggcggaggcgcggggcattcccaatctcaccgtggaggaagggcgcttccggttggagtggatggaagacccgtgggacgacgtgcgctcggcgggcgactggctgctcgcgctggagcgccgcgtgcgtccggacgtggtgcacctcaatggctacgtgcacggggcgctgccgtggctgcaccggcccctggtggtggggcacgcatgccgcctgtcgtggtggcgggcggtgaagggcgaggacgcgcccgcatgccatgcgcgctatcgcgaggccgtcaccgcgggcctcggctccgcgggccgggtggtgacgccgagccgggacctgctcgactccctccagatgcactatggcccgctgaccgccgcggaggtcatcccccatgggcggcgcgcggaccgggtgccacctcgctcggagcgggagcccttcatcctcggcgtgggcagtccgtgggacgccgcgaagaatctcaccgtgctggacgccgccgcgccccgcctgggttggccggtgcggctcgcgggagacgcgcgccatccctccgagcggaaggcggagccgcgccacctccagtggatggggcacctggagccgcatgtcctggcggcgtggatgtcgcgcgcatccatcttcgtgctgccggcccgatacgcgccctttggcctcaccgcgctggaggcggccctgtccggctgcgcgctggtgctgggcgacattccggcgctgcgcgaggtgtggggagatggggccgcgtgcttcgtgcccccggacgacgtggatgccctggtggagacgctggagcggctgcgcgaggacaccgggctgcgcacccggctggccttgcgcgcgcgggcgtgggcgctgacgtacacgccccggcggatggccagccgctacctctccgcctacgccagcctcgtgggcacgcagggggtgctgtctccagcgggcacccccacgcactgagcgggtggggcgtcagctcgcctcggtggggctgaccgggtagttgcccgacgcgtgggcctgggcatgctgcgcgaagaggaacctgcgcaccgcggcgcgggtgagcagcccgcaggtggggctgcccaccgggacactgacgggcagggcatccacgtcctcctggtccatgacgtggagggcatgggacaggttcgcgtcgggggagagcgcaggcagcttgcgcgccaggtcactggccaccagcagcgggtatacggattcgtcgcgccacacttcgcgcagttgctccacctgcacggtgccgtagatgcggcccacggtgtccaggacgggcagggtgcccgcctcggaggtgagcagcaggtccgtcagcgcccgcagcggcgtgcccgcgggcacgggtgtcaggtgggccatcagcgagcggacgggggtggcctccagcaggtccgtgtcgctctggaccttcggcgtcttccgctcggtgaggtagtggcagagcgccgaggcgatggtgcacgtcaccatcagcggcaggatgatgtcgtggttcccgctcagctcgtacagcatcatcatgcccgtgagcgggccgcgggtgagcgccgccaccgcgccgcccatgcccaccagggcatatgcgccactggggccggtgctctccgggaagaagaagtgcaccagggtgccgaaggcgccgcccgccatggcgccaatgagcgccgccgggaagaatgtcccgcccgagccacccgagccgatggtgagggccgtggccaccagcttcagcagacacgcggtgatgaggaacaggaagggcagccgtcccagcgcggccaggttgatgtagtcgtgcccgctgccccagacggtggggctggcgaaggccaggatgccggtgcaaagaccgcccagtcccgcgcgcagcggcagcggcttgctgcccagccacgaggacagccggtccttcccatggccatggaagtagtgctccacgccgtgcagcaactgcacgaaggtgaaggcgagcagcccacaggcgatgcccaggcccgcgtaggccagcacctcgccgccgctgaccagctcgtagggaacgtgccggagcatggcggactcacccatgacaccctggctca

SEQ ID NO: 1043 - DNA, 9574 bp, Myxococcus xanthus
  unsure (1)..(9574): unsure at all n locations
gggcgtaggccagccttaggttctgcatgcccttggggttccacgaggcttggaggaagagcgagcgaaggaagacgcgcagcagcacgccgaagggcagcgcggccgggggcgcgctcatcggccctccaggaggatgacgcacacgaccgacgccgtcaccaccgccgcgcccagccccgcgaagagcggcgcgcgccgcgcgtggctgccctgcgccgcgatggccgccgccacggacgccatggccggccaggcccacgccagcccgcgcaccaccacggggggcagcgcctggagcagcggttcgatgaagaagcccagcagcgcgcagagcgcggtgagcgagccgtacacggcgaagtggggccacatgccccacaggttctgccgcatggcgcgggtgatgttccccgcctccgcggaggccagcgccacccgggccagccgcgccgtgtagccctccagcagccggtcacccttgcggcccacgcgtcccaggccgatgaagagcagcacggcgagcgaccagatggccggcgtggagcccgcgcccgtggccgcggacaacgtggccgcggcggcgctggtgccggtggccgccagggtgtcgttctccggcagcgcggcccccaggttggcggtgcccaggaagaacagctccaggagcatgccaatggccagacccgatgccacgtcatcaagcagtgcgcccatgaccgtggcggcgaccaggggccgggacatcatggcctggaggaacgccttgcgttccaatgccaccagtccgccccacagtcccgcaagcgccacctgggtccagacgacgctcacgcgctcacccggccttcgcccaccgctcgcggaggtccggcaggtccacgggcttctcggcgggcaccgcgcgggccgccacccggacgccctggtcggccaactgctggagcgtcgtcagctcggcctctgccaggaagacggacggggagacctgcctgcggccggtgccgaagtggacgttgcccagattcagctcatccatggccagcccgtgcgcatgcgcgaagggcaccgaggcgacatccctcagcaacaccagggtgcgcacaccgtccttggacagggcggcgaagtccacctgggacaggggcagaatctgcacctcgatggcgctctggacggccagggccatggcggcgcggatgagagggctggaagccgcctcgtcatccgccacgaccacccgggagactttgaggaacgggagccaggcctcgacgacctgaccatggatgaggcggttgtcgacgcggaccagggtgatcacggcagtctcgaatcgccgacccgcgcgggtccgtcaagttcgcggctgctgtgcctcgcgaagcagggcggatgcgcaggtgatgttgcgctggccgtgggaagccagctggttggccatctccggtagcgacaactgctccgaacggagcgagttcgccttcagcagcatgggcaggttgacgccagcaaggacctccacattcattcgctgacacatcatcagcgactccttacagggcgtacctccgaagaggtcggccaggatgatgacacccgcaccctcatccacgcgggcgattgcttgcttcatcttcgcccggatgtcctcgacaggagtcccaggctcgatgttacaggctgccaccgcgggaagctctcccacgatctgctccgcggtggagaccagctcctccgccagacgtccgtgcgctgcgacgacgaggccgaccatgtccgctcctgaccaaccccccgaagctgcgtcctacgcctgaaccgtgcggcgcgcaactccggcgaaagtttccgccctgacctctgacctaagctgcctcttcccgcctcgaaagctaagacgaccacagcgatggtgcccgaaatttcgggtccggccgcgcacagggctgtcgcctgccggacgggggagcgacaccgcttccccacactttatgagatgcgctggcaacttccagggtgcgtcgcgaaggacgcccatcattaggcgccgtatcaaccgctcgagaggcaagcaggcatccagaggtcgtctttgacgcccgtttcagcacggcggattacttgtggggatgcggcgggccagatgggatgagcccggcgttgaacgcaccggccagactccggggcgacgcgaggacgtcatggccaagacgaagctgctgaagcaaggcgatgcggtaccggacatcaccctcaccggcgcaggtgggcaatcggtgcggctgcgagacctggtgggtcagaaggtattggtcgtctacttctatccgaaggacgactcgcccggttgcacggcgcaggcctgtggactgagggaccagtacgaggacttcgtcgccgcgggcgcggaggtggtgggcatcagcggtgattcggtgggctcgcacgagggcttcgcggcgaagcaccggctgcccttcaagctgctcagcgacgcgcgcggcgaggcgcgtgaggccttcggcgtgtcctcgtcgttcctgggcctgctgcccggacgggtgaccttcgtggtggaccgttcgggcatcgtccgcgacagcttcgagtcgcagattcgcgtcggcgagcacgtacggcgcgcgctcgagttggtgcgcgcgctggcgcaggaaggtggcgcgccggcctccgccgcgaagtagcgggcggaggggcacgcgaggtggctccgggccccagtgccccggagcaccgccgcggctagcgctgcaggacggtcggaatctccgcgagcggcgggaagccccagcgcgcgcgctcctcgtccgtgacgttggggtccaccgggtggagcgtcatctccttcgattccgggttgaagcggtactgggtgccgaagcgctgcggaaggttggcgttcatcagccagcggtcccaggccgccgcggccagccacaggccgcgggggtggccccgcttcgcggcctccgcgcccatctgccttgccatggcgtagtcctccggcgtgttgccgtgctggaagatgaaccccgcggacaggaagtccgcgccttccttcaacgcgccttcggccagcagggccttcacgcgctcgcgccgctgcgcatcccgctcggcgacccgcttccacgcgtccaccccatcgagcggcctctgacggtcactctggtcctccacgaagagcgtcttcagctctgaactcgaggtgggatgggggtccgggagcgtggtgatgcgctccacctgcgcgaggtacaccggctcctcgcgcagcggctccaggtccgagtcctgcatcaaccaccccacgtcccggaagcccaactccacggattgggacaacctgcgcagcgcgacgtccttccgtccgagccgggccgccgaacacgccgcggagtacgcggcgttcgggtcccgattccccgcgtccagggcctcttcatagagcgccagcgcttccgcgaacttctcttctcgcgacaacgcgtccgccttgcgtacctgcatccagccgggcatcggcgcggcgggcggctccatgtggggcagccccgcggcgggcgtgggtgtcgcgggggcttcagcgggcggcgtggccgcgggggcctcggcgggcggcgcggattcgggagcggaggccggcgcatgggcacacgccgccatcagcaagcagacaagggaggagatgagcgttcgcatggcccgcatcctagggggcccgcacggcgctccgatacgcttcgtacgggtgccagcaccgcacgcgtgaatcccacgcgcggacggacgcggctgaccgcgtgcgtcaccacgtgatttcacttgggcgaaagcgccggcgctcccagagggatggacgcgggaagcacgtctccgccgtgcgaggacgcgcgttggcccaggccttgctcaatgtctttctgtctcgcgatacacgcgaggcggaaggagcgccgtcatgatgttccccgatgagaactttttcgacgaagtggtgctcaacatgggcctgctgatagccctgaaggtggtgggcgtggtgatgctgctcgtcacctatgcccacccgtcgtgatgtggcggcacaccgcttccgtgcgcagggattgcgccgcggaggacggccacggcttcgtcacgcagaacaccgggctgcgcgcgttccgggcgcgttatcgtgggcccatgttcaactcttccggtaggcggtggggcatcgcggcgctgtccctgggaatgctgggcagcgcgtgcgcggcgcggcaggacgccgcgccatccgctgaagcggctcaggagaccccggccatggcaacgaccttgacgtgcacgctgagcggcccggcgcgggtgcgcgcgggcgaacccgtggagctggtgttcgagctcagcaatcccacggtgcaatccctgcgcgtgctcggctggcacacgccgctggagggcgtacgcaacaaaatcttcgacgtgtcccgtgacggtgactcgctcgagtaccgggggcccatggcgaagcgcgggccgcccacggccgacagctacgtcgccctctcccccggcacgtccgtcgaaggcagggtggacatcgctcgcttctatgacttgcaggcgccgggaacgtaccgcatcgcgttccggggcccgctgatggacgtcgcccgggaaggcgaaccggtgcccgctccgaatggcggattccgcccggcggaagtgccgtgccccgtggtggaggtcaccgtcacgccctgacggccaggacacgagcctcgcgcggaccgcgcttccgcgcgggggcgcgccgtcagcccgccaccaacatggcgcgctgccgcgcggggcggatgcgagcggtggcacccgcgccgaagcggaggaagtcctcctccacgccgtcgctgaagatgacgccctccgacgccattcgcgactccagcaccagctcgcgctcctccgtcacgtcgcccatcaccagactggcgcccgagtgacggctggcgaagggttcgcgcaccacgaaaatcagctgcgggtcctcccagcccaggcgcacgggcgcgcacggcaccccacccgcgtgggccgtcacgcctcgcgccaggttgaagatggaggacagccacccggtggcgcccgcacccgtggacaccaccacgccgctggaggactgggactcctcctggtccccggtgcgcagccggtagcgcgcggacacgtgggagcgcgccccgatgaacaagtcattgaaggccagcagccgctgcccgtcatccagccgcgcctccgccaacgtcacgcgcttgaaggccgccttgccctccaacacgcgccgcaccgccccgcgcgcccccgaaaccgaatggggcaacagcacgccgtcgaagcgctccgggtccggattcacgcccaccagcggctgctcccccacgtacttcgccacgttcgccaccagcccgtcctgccccgcgacgaccaccacctccttgccggtgaagaggaaggtgggcaccaggctccggtccacctgctgcaccggcagcccgaaggacagcgactcccgcagcgagtccacgttgcaccggtaggtttcgtcctcgcgggtgaactcatcgaagtcctgccccgcgtgctccacgtagaacttcgcctgcttcttggtgttgaagcgctccaccaggcccgccatgcgcgtgcggcgggtgacgagcacgattttctcgtacatggtcccctccccggcctcagcgctcgcggcccgccgcgcccaccagcgagtgcaggaggtccggcgacacgttcagctcgccgatgcgctgcgcgttctccgccatctcccggaaggccagggcgatgttgagcgccgggtccccgccactggccgacgtggccatcagcgtcttccagtccaccccgcgcacgggggccagcgtcttctccagcgcgtacgcgcgggcatccgcggcctgccgctcgttgtcgctccagcgcgtcatcaactcggcgcgctgctcctccacggcgatgtccgcggccatcttcgcctcgcgaatctgccgctgccgcgcctccaccgccaactccgtggccagctcgctctccttgatgcgccgctcctgctccaccgcggcgttgcggcgcgcgtagatggcttcatccgcgttgcgttgcagcgcctcgcgcgcctcggcctccagcgcccgcgccatctccggcgccggcttcaccgacagcagcgagaaggccatgacctccacccccagcgccttcaccggctccgccacggccagggccgcgagcacctgctgctcgatggcgtccgagcgcaccagcacctcgcgcagcgtcagcccctgcaccaccgagcgcgcccgcacctgcgcaacctgcaccagccgctcctcgagcttctccgggtcgtccgagtggtagcgccccgtggggcccaaggagtagtccagcaacgatgcaagccggcgcgggtcggtgacgcgccacgtgagctgcccttgcagcgtcaccgcctggaagtcccgtgtgacttcgttgaagacgaagggcacgtccgcgctggacagcggcaccgacaccagcgtcgccgacggcttccagtagaagaacgagagccccgccccctcccggaccacctttcccgcctcgaactgcatcacgtacgtcgtcggtgccgccttcatgtagccgatgaccatgggccctccgcccctcttcgtgtcttcaagacacatagttagtgtccaatggacacgaattcaagtcaatgtgcggaagcgcgaggtgcggacccgcggatgtccggtgccgaatcacggttcatccgcgcggcgacacaaagcacacaggtctcatggacgaatgcgccggtcgtgcgcagggtggcgggagccccggatctggcgccagtgatgccgggccaagaggaaaggtgcatcgtggcgacacacgaatggcatccggttgcagcgagattttcgcgcaccgaccattccgccgccgcacgcagtccctacctttccggggcactttgggagagcgcatgcggatcgcggtgatttcggacctacatctcgggcggcgtgatgccgccgaccacttcgggcacgacgactccggcttcctgcggttcctccgtttcttggaaggcaacttcgagcgcatcgtgctgctcggggacatcttcgaaacgctcaccccgcgcacgccagggcggaaggtggccgagctgctggcggcccgcgcggcgcacccggaaatcgtccggcgcttcgagctgccgcgctaccactacatccacggcaaccacgacctggtggcgggcaccgtgctgggggcgcccgaccagatgattctggaggcggacggcgtgcggatgctgttcacccacggacaccaccacgactggatgattcgcaaggcgcgcctgctgtcggaggcggcggtgtgggccggggcgtggctgcggcggatgcggatgcgggcgatgttccgctggttccaggcgctggacttgaaaatcaccaacgcgctgccggacccggcgcggtgcaccttccagcgctgggccatggcgcgggccaacgcgcatcacgcggacgtcgtcgtcaccggccacacccacctgggcctgcgggtggagcacggcagcaagctgttcctcaacagcggcacgtgctcggaggggcagttctccttcctcagcctggacacccgggccgcgagctactcgctgcacaccacctggtagccgcgggaccgcgggcgggcaggaaggcggcagggagcccggtccgccgcttcttcctcccccataccgcgggcaagggaagtaacattggcgaatgttcaggcggctcaccgaggcgctccgcgtcctgacgcgacgctccccgataagcggccccggccccacgccgggtgccccccggcagatgctcctctcagacgtggccgctgacgggcggccccggacgaagaagccggccgcgcgccgctcaccgccacgcaccacccggctggcgcgctacttcgacctccacgacgacttccgcatccccggccggcccgagctgagcgacccggtggcggtggatgtccgccggaagctggactccgtctggctcttcacctccggcgcccgggtgcggagcgtgggcaagctgcgcctggcggtgacgccgcccggactgccgctggacttctcgctcgcgggcgcggggctcacccccgtcgtctccgcgcgggtggcctctgtcttccgggagctggcccccgatgacgtgcagttgctgcccgtggaggtggaggaccgcgacgagccccacttcatcctcgtcgccacccggctggtgcgctgcatcgacgaccgggcctgcgaggaggtcatccactacaccgccgaggacggactccccgagcgcgtggggcactaccgcaacgtccgcggactccgggtcgatcccacgaagacgaacggcgcccgggtgttccgcacctggggctggccggtgagcctcatcgtgtccgagggcatcaaggaggccctggagcatgccggcatcgccggcgcgcgcttcgccgaggtgacgaagccgccgcgcaagccccgccggaagaagacagccgccaagaagtcccggcccaagcgccgctgagcccacgccgcctccagccccgcggttgcaacagagttgccacctggctggaaacttgtggggtaggggcactgacaatatcttcctcgttttccagcaaatacctggggacgacgttggacaacgaggacagctctttcggtaagtaccggcttgtccagcagctggcgaccggtgggatggcccagctctatctggcctccatcgacggccccgacgggttctccaagtcctgcgtcatcaagcgcgtcctgccggagtacgccagcctggagtcgttcagccgcatgttcgcggacgaggcgaaggtcgccgcgctgctgacgcacccgaacatcgtgcaggtcttcgacttcgggcgggtggacggccagtactacctggccatggagtggattcagggccactcgttggaccggctgctgcggcaggccctccggagcggccgggtggtagggactcgcgtggcggtggacgtggggctcgcggtggcggacgcgctcgcgtacgcgcacgcgaagacgctgccggatggaacgcccctcatgctggtgcaccgcgacgtcacgccgggcaacgtgctggtgtcgcgcgacggcatcatcaagctggcggacttcggcatcgtgaagagcgccgtcaacgcggagcgcaccgtcgccggggtggtgaagggcaagtacccgtacatgtccccggagcagatcaccagccaggagctggaccaccgctccgacctgtattcgctgggcatcgtgctctacgaggccgccaccgggcgccgcctgttcaagcgcgacacgctggaggccaccatcatggccgcgtcccaggcgaacgtgcccgcgccgtccgaggggacgcccgnctttccccgcggagct

SEQ ID NO: 1044 - DNA, 10505 bp, Myxococcus xanthus
cttcaattggaacctcgtgaacgcgctgttcgccggcgagacacggacggcgatgagcgcgctcagccgcctcatctactccatcgtgggtctgtcgggcgtcgcgctggcactcaccttccctgggaagaagagcctgggagccaccacgaccaccacgccgaggacggacatggggattcaccgcagaaccgaagtgcgtccctgactcaggcgggcccgcggttctcacgggcccctgagtccacctcgggtgatacgttcggcgacctacaacgcagcggctccgcctcgacccatccatcccgggcggggccgccgcacgagaaagtcgtcgccatgtctggaatcaccgatgccgagttccttcaggacgccttcatccaggagggcgtcagcccggcgccgggagtggtcatcgcggcctgcaccgtgggcgatgacgaggacgcgcccaagaaccgcgtaggcgtccggcacgacggtgaatggctggagttcagcctctccaatgaggccatcctgtcggtggacgccactccgggcggagaggcctacgtcctgggagagaacggcaccgtcgtccgcttcgactggaagacgcccaagacgcgggatgaactccgtgcatcgcgcaagctcttcaccaacggggcggtccacgacaagggcccgctgcgccgccttcgcgtgctcggcggagacgtgctctgcgccggctccgtgggccaggtgtactggctgcgcgacgaaagcttcgaaccccttccgccactgacggtggacggagaagccgtcaccatcgaagacctcgccggcaacagccgcgaggacttcatcgcggtggcctccgatggatacgccgcccacttcaatggaagcacgtggcaggtactgccgctgccgatccacaccgaactgaccgccatctgcaagctggaacagggctacgccatctgcgggaagagcggagctgtgatgacgggcagcggagacgaatggagcgacctcacgcccttcgacggggaccgtgactactggggcatcgcgagccaccaggggacgctctacgtcgcgcatctcgccggcatcgaccatgcgtccggccaggcgctgcgccccctgggactcccgaaaggagcgccgttgcagttcaccgtgctgcggggcgcctccgacggcgtctggtcgttcgcggaccacaccatcgggcggattcacgacgggcagtggcacacgcttaccagcgggccccgctccccctaatcaccacaacagcccgccaagaggagcgcttgcgacccggaggcatttggcgcaggaaggtccctgcccgtgattgtccgtcctcgcctcagctcgcttcggctcctcttcgtcgtgcgcgggaccatcctcccgcgcgtcctgccccacgtcctgggcatcgcggcactctccgcgctcgtcgtctgggcgtaccggcaaggctatctggatctgcagatctcctcgccggcgccgctgtccctgctgggcatcgcgctctccatcttcctcgggttccggaacaacgcctgctacgaccggtggtgggaggcccggaagcactggggcgcgctcatcattgaactgcgttcattctcccatgaggccatcgcgctcctgggggacgacagcagcggagcgaaggaggcggcgcgcaggttggcgaggcggaacatcgccttcgcccacgcgatggtcgcgcacctgcgcgggaacgacgcccgggaggacatcagccgcctgctgccggagccggaggcctcgcgcgtactggccagccagaaccgccccaacgccctgcttcgggagcacgaccgggagctggccacgctcctccgggagaagcatctcaccgacatcacctggagcgagctgcggacgcacgtccatggcttgatgaacgtgctctccgcgtgtgagcgcatccgcttcacgcccctgcccttcacgtacacggtgctgctgcaccgcaccgcctacctgttctgcctgctgctgccctttggtctcgcggaggcgctgggctggttcacgccctggctcgcggcgatgattgcctacaccttcttcgggctcgaccggctgagcgacgaactggaggagcccttcggcacggagcccaacgacctctccttgctggcgatggcgcgcagcgtggagatgaacctgatggaggcgctgggcgaaccgcagcccgagccgctgaagccccgcgacttcgtcctcccatgacgggcccgcgccacgcttccatcacatcgggtggaactgctcgatggtgatttcctccaccagggcatcctggggggcgccgaagctggtgagcgtggtgtaccagtgcgtcgtcgcgccatcgcgggtgaaggtcaagggcaccagcacggagccggcgttggcgggccgcagcgcggtcaacgcctcgacacctggctgcgccaggacatgggctaggactgatgccacgggtgagcgggggccccgcatgcgagcgccctcccgcagccggtggagcagatacccggcaatctcctcccagttgccaatggccgagcgcacgggcccgggcacgaagacgaggtccatcaggttgacctgtccgagcgcctcacgcggctgccccatcatcgcgagcgcgcctgcattcgcctcgagcaccgtcgaggacgaatccaccacgatggcgggatacggctcatgcgacgcgaggatgagtcccgcggcccgccggacctccgccagctccgcgctgtgccagccgcgctcgccgaactgaggcgcgaaccccgccgccaccagcagggcgttgcggtctctcaaccccagccccaaggcctccgccagccgcagcaccagttcctgactggccccggagcggcccgactccagaaatgacaggtggcgcgccgatacctgcgcctccagcgacagggccaactggctcttgccgcgcagcgttctccattccttgagcaggggtccaatcatcgccgtgtccctttccgagcccagactgccccaggccgtgacgcgggacgatgaccttcgaggtaattgagaacattccctgccaggaacactgtgctcccgttcccagccacccggagagcccagatgatgacgcacgtgcttcgcaatccccgcttcgtctaccgcttcgacgccgccgcctcactcctcatgggcgtggccttgttgctccttgcccccaccctcacccagctcgcgggctggcgcctgccgtccaccttcctgttcggcgtgggcctcttcctgctgccgtggtcggccttcaacctctgggtcgggctcaagcagcccgtcctgggagcagccctggtgcatctcctggtggacgccgcatgggtggtgggcagcgtgctgctcgtcgtcatgcacgcccaggagctcacgcccctggggaccgcgctgctcgctgggcaggccttcgccgtggcgggcgtgctggcgctcaaggccgtgggtctcacgtcgcttcgcacggcggcgtgagcaccgcggcggcgcgtcagcccgtgatgaccttgagggcgggcttcccgtcctcgtgtgtggcggcgtctggagacggcgactcgtcacgcaccgtcttggacaattccaggctccgggtcaccagcgccttcagcgcccagacctggggcaccgattcgatgaagacgcggctggtgcccaaacccgcgggcgccgcctccacctcgaagcccgcggcaatggcacgggcctcgtccaccggcacccaggtgacgatgctcttgcgcttgccattgctgaagaaccgggcgaaccacttcgtgggccgcttgaaggacacgttgaagtaggacgccgtgtcccggtagaggatgtcctcggcggcggcaccgttcttgacgcagatgtcccgcaccacgccgaagaactccagttccgtctcggtggtctcaacggcggcgcggcccttctcatcgggcgcggcacggccatcggcctcgaagggcctggccgaatccggcttcaccacgttggcgccctcctgcgccaccgcgggctccgcgccctcgttgagccgctggatgcgctccttgagcttgttcaagaagtcgtcgcccatgacccgcagcagcgtcggctcgatggcttccttcgcgacgtccgcgagccgctccatcaccgcggtggtccgctttcccttgtagatgtcctccgtgagccacttgaggaaggcttcgtgctcaccgggcgctttcagggcggacgcgagcttgtcgatcatcccctgccggtagcggctgttctccgcgtccgtaatcagcgtcgtcgcgttgaaggcttcacggctgaacttggacaggaacttggccaccttcacccagtccgacttcgtgtcctccagggagaacgtgaagaagggctccgggtccatgacgttggggttctccaagtccccgaagaagaggtagtggcacccgtcggtgatgatgccgaagtggagctccggcaactgcgccaggtagcgcgccagttgctgcgcgcgggacttgaggtccgtgcccaagggcttggtttcgatgacgatgagcggcttggtgcccgtctggtcgaagatggcgaagtccatccggtccggcagcttcttgccgtccccctggacgaagtccgccgcgtattccaggcggacctcccgaggaacgctcgggtcgtagccgaggctccggatgaacgggacgaccagcgcgatcttcgcggtctcctcgttggagatgaatgccttgttgtcctgatagcgcttgaccagctccagcaaatgattcgcgtccatggcatatccccctgcccgggaatgcaagacatccgggcgcgtcacagagtctaacggcgatgccgcattcgcagccatcccccccaggggtgagtgaggcccgaccctgtcacgccgcgaccgcttcgaggaacgcgcgcacggctggccgccccaacgttcccgacgaggcgctccgtgcgcatcctccatccatggacgtcgaggtgaccgccgcgctgagcgtgcgggacggagtcgagttcgcggtccggcacctcgtcgtgctcatggggtttgtcctcgggctcgccgtcgacgtgagcgccgtgaagcacgccatgcggctgcctgcctacgcgcgaggccttcccctcatcctgttgggcgtcccgctgctcgccctgctcgtggtgaacctcctgcccctgcctcccatcgccgccggcatcctgctgttgatggccgtcagccctggcgtgcccagcgtcgcggtcgcggcctaccggcagcgcggcgacttgagcctcacggtggcgctgtccctcaccctgtccctggccgccatcgtgtgcctgccgctctcactccggttgctcagcgagttcttccccgccgtgttcaaggcccccaccaccgtccagctccttgagcgggtcatgctgcccttcctcgtgccgctcgcggcgggctgggcactgcgcgcctggcggccgatgctggccaggcgactgctgcgtcccatgctgtggctcttcaaggccgtgttcgtcgtcgccatcctgctcctgctgttcatcagcggcccgaggctgcgcgacgtggacggatggatggtgctgggcatgttggtgatgaccctgggctccgcgatattgggacacgtggcgggagcgccccggcccgaggacaggaccgcgctcgcgctcgcggcggtcttcggcaatccctccatcgcgctggccgtcgcgacggccagctaccaggacttgcggctgacgcccttcctggccgtctatctggtgctgcgcacgctggcgctgctcccctacctgctctggaacaagcaccacctccggcacggagtgccccaccctggccggacctaacagccctggagcgtcgcccgcttcgaggcggccagcagcagccgctgctccgccgccgcaatcacccgctgcgtcgcgagcaccgccgccgggtccacggagatggacgtaatccccgcgcgcaccaggtgctccgcgaagtccggccggttcgacggcgcctgtccacacagcgaggacgtcaggcccgcttcctcgcacccacgaatgatgtcgccaatggcggccagcaccgcggcgtccgcttcgtcgaacagctcggcgcacgactcggagtcccggtccacgcccagcatgagctgcgtcaaatcattcgagccgatggacacgccatcaatcccacacttcgcataatcgtggaggcgatagacgatggaaggcacctccgccatcacccacgtcttcaaaccccgctgccgccccagcggactgcgggcgatgagctccagacacgcctccagctcccagagcgtgcgcacgaagggcagcatcacctggagattgggcgtctgctcccggacccgcgcgagcacctccagctccaggttgaacacgtcgggctcgcgcaagtaccggtaggcgccccggaagccaatcatcgggttggactcctcgggctcgaactcagcgccgccttccagtccgcgaaactcgttcgtccggaagtccgtcgtccggtagaccacggggcgcggatggaaggctcgcgtcgtctggagcagggcccccgccatgcgctccacgaactcacccctccgaccctccgcaatcagcttgcgtggatgcacaccccccagggcctccgtgagcatgaactcggcgcgcagcagacccacaccctccaccggaagcgccgcggcctcgcgagcctgcgcgggcagggccaggttgacgtagaggcgcgtggccagcaccggggccgttcccaccgtggatgcggtggcaggcacctccaccgcccgtggacgtggcgcctcctgtccctcccggacttctcccatcgagccatccaccgtcaccgcctcgctgtctcgcagcgtgcgtgtggcggtgcgtgtgcccaccacgcagggttttcgcagctcccggctgacgatggcggcgtggcacgtcatgccgccccggtccgtgacaatggcggcggcccgccgcatggtggggacccagtccggcgacgtcatctcagccaccagcacctcgcccggctggagttgccgtccctcggccggtgacgccagcacccgcacgcggccggccgccacaccgggcgacgcacccagtccctgcaccagcgccttgcccgcgtggccttcctctggcggtggcacggcggactttcccaacgtggtaatcgggcgcgtctgcaccaggaacaaacgtccgcgctcctccgcccactcgatgtcctgcggcgcaccgtagtgctgctccacccgcaatcccaaccgcgccaactccagcaccgccacgtcgctcagcacgcgctcgtgggcctgttccggactcagtgtctcgcgctgcgtgtgtccttcggcattgcgcaccaggcggacactcttgtcgcccacccggacctcgcgcacgcaaggctccttcttggagacactgtacgtatccggctccacctgcccgcccaccacgacttctcccagcccccaggccgcctcgatgacgatgcggccggtgtctcccgaagacgggtccgcggtgaacatgacgcccgcgcgagccgcatccaccatggcctgaaccaccacggcgatggcgggttcctcggtgagcccttccgctttgcggtaggccaccacacgctcaccgtaggccgaagcccaacacgcccggagcgcgtccatcaaagcgtcctcgcccaacacgtgggtgaaggactcgtgcatgcccgcgaaggacgtggccgccgagtcctccgaggtcgccgaggaacgcaccgccacggcccggtccgcgcccaactgctgatacgcctccaggatggcggcgcgcagccgctccgggacgggcgcgctccgcacgtgctcacggagctgctgcgtgacctgggtcagtgacgaagggtcatccgggtccacctgcgcccagagcgcttgaagccgggcacgcaccggcgccatggcctcctggaaggcggtggcggtgatgacgaagcccggcggaacaggcagccccgcccgcgtcatctcgcccaggttcgcgcccttgccccccgccagcgcgacgtcctcgcgggacagctcgctgaaccagagcagacgaggcgcggcggacaccgccagatgctcggcttgccgtggcttctccgtgtccggtgagacgttcatggtaccgccccctgaagcaaacgcctgactgcgcggacgctgcgcaccggcgctcgcgcatgaggtcatcatccccgcgtgaagcgggcgcgactcaccgaggacgatgcggctggtgcgaggtgatgacatccatccgggcccggagcgcgcgggcccgagccgccgttacggccacatgcgcccaagcatgcgctcggcatgaactccaccgccgcatcttcacgcccgcgcggatgacgccctccgacaccgtgccgagacttcccgggtggacacccacgaaccaccgggagggagcatgcgagccaatgtctttcaggctgtgaaccgcttcggcatcgaagaggtggagcgtccacgcgcgggagccggcgaggcggtcatccggatgacgatgaccactgtctgcggcacggacctgcacatcgtccgtggcgagtacccggttcgcccggggctcgtcatcggtcacgagcccgtgggtgtcatcgaggagcttggtcccggcgtgacggactaccgcccggggcagcgtgtcctcgtgggcgcaatcaccccgtgtggacaatgcagggcctgcctgtccagtcacctctcgcagtgcggccacggcgcgggctatgaggccctgggaggctggcgcatgggcaacacccaggatggcgcccaggccgagtacatccgcattcccgccgcgcaggccaacctcgcgcccattccagatgggctcaccgacgagcaggtcatcctcctgtcggacatcgcctccacgggcttcagcggcgcagaggcaggcagcgtgcgcatcggcgatgccgtggtcgtcttcgcgcaggggcccatcggcctgtgcgcctccattggcgcgcggttgatgggcgcctcgctcgtggtcggcgtggacggcgatgaggcgcggatgaagatggcgcagaggatgggcgtggacgtggtgctcgaccaccgtcagcaggacgtcgtagccgaggtgaaacggctcacgggcggcggcgccgacgtggccatcgaggcgctgggcacccagcagactttcgagagcgcgctgcgctgcctgcggcccgcgggcacgctgtccagcctgggtgtgtactcgggcaagctccagttgccctacgacgcgttctccgccggcctgggggactaccgcatcgtcaccaccctgtgcccaggaggcaaggagcgcatgcgccgcctcatggacctggtgcaccacaagcgcgtcgacctgtcgccgctcatcacccatcgcttcaagctcgcggacatccaggaggcctacgccctcttcggcgagcgccgtgacggcgtcttcaaggtggccatccaaccgtgagccacgccccaccccgtggggcagccgcgcgaaggtgaatcctacagacgtggtgagtctcacactggctgcggtggaagccggcgaggaggaagcgctcgccgatgacgtgagccgcatggccaaacaaggcttgtcctccggtggctatcctgatgcgctgagcgtgtgaggtgacgtctcatgagtgacgcagccagcagcgacgcaaccccagtacaggatgcagcgcccgggtccacaccttccgcgctccccggacgcgcatcacttcaagacgcgatgctgcggggccctctgctgaagcccctgctccagctcgccgtgcccaccacgctggtcctgattgcccagtcgttggtgggcgtggcggagaactggtacgcgagcttcctgggcacggaggcgctggcgggcgtctccctcgtctttcccgtcgtgatgttgatgacgatgatgtccaacggaggcattggcagcggcgtggcctccgcggtggcgcgagccctgggcgcgaaccggcgggaggatgcgaatgccctggtctggcatgccgtggtgctggcgttggccattggccttgtcttcagcgtcctcgcctggatgaccggccccgcgctgtacacggcgctgggtggacgggcgggcgcgttggacgccgcgctccagtattcgaactacgtgttcgcgggctcgattcccttctggctggtgaacctgctcgcggcggcgctgcgcggcgcgggcgaagtgcgcgtcccggcgctggtgaccctggtgggcgccgctgtcttcctcgtcgtgacgccgggggtcatcttcggcttcggcccggtgcccccgatggggctggcgggcgcttggctcgcgatgacgtt

SEQ ID NO: 1045 - DNA, 11695 bp, Myxococcus xanthus
gctctacagcaagaccagccgattctccgagcaatcaaagcatgggacaaccacacatccgatgacttaatatccattctcacgcacacaaacagcagacacaccgtcgaggagttcatatcctgcctgattagccccaaccaactcacccgcctcctctccgaggtaatcaggcttgaaagtaaactccctgccacaacatggactgcctcacagccagagagcatggtctccgtctggcgagcaatgcacaaacaagcccccccgggcgacgaacttaccgccacaatacggcagctcgtcattcaaatagcaccgagcaacctaccactcacccatgcactaattcacttcttcgcccaacatgattccggagtcccctcactcctgtccgacacggccatatccgaaatcaaccagcaattccattcaatcctctcaaccaagttccccccaaccaacgcacaggcactaacacaggccatcaacggcgggaatgaacacacgcttttcttgtgcagttggggactcgacagagtaagatcaggacaattgcagggcactccatttgacggctggcacacattctcaaacacaattctaactgccaccgaaacagagccggaaatcctaatccctcagatcctcccattcatcaccacccactcgcgagagatggttcgagaggccaacactcctcgctggagaggagtcattcgattcaatcaagaggccgcagaatcactattcgacatcaaaagactatacaaaatcatcacccagcatcaatcatcaatcagggccgaccatgagtctcgaccagcattggagatcgttcttgaagcagctcacctccatatcggccccaaatagatcatcctcagaggccagcactttcgacctccgtcagcactttccgtcaaactcattgacacccagacaatgagtatcgaggcgacaagtcctcaggacacggagcgctggctgtgcgcggggctgtgcctgattcggcacgaggacctcacggccgacgcgttgacctcggccgtgccgtggctcctcgccacgctcgcggagtcgcctgccctgcccccacccgcgttcatcgcggacctcggccggctcgtcgcgggggttccgctcgcgccctccgcgcccgttcccgatacccagcctcggctgcgcgcggcggtgcgcgcgtatgacgaccacgtgctggcgcgcctggccgcggagccccacctggaggcggtctccaccgccctcgcgcggttgcccgagacgctccggccgtgaggtgtcaccttactcgtcgcgcgcgtgctgtcccgcatgggcttcaccgcgggaagcccggtgagccccgccctggcccggcgcgtcctggagcgtccgcccacggagttgctccaggcgggctacacggccctgcgcgaatcaggaaccagcgccgcgctggaccggatgaccgaaggctacgaagccctggcgagcgcggcccggcgcgcccatgccctgctcggcgacgcggagtccttcacgctggagaacctggaacacctccagggcaaggcgcagcggatggctttggagcaggcagtggaggcggcggaggccctgtcgcgaaccctgccgcccaagctccgcgcccgtccggtgagcaccgcaccgctccccatggcgttggaggacgaggccgccttcccacaaggtggattctcctccgtgtccaacgtgggcagcctggagaacctcgtcacatccgagctggtctacatggaggacgagcccaaccttgacctcttcgacgtgcgctatgtggagggcgaactcctctactacacgcgcgacgagagcatctccgttcgccgccggcgcgtcatcaccttcgtcctgccgccggacctcgtggatgcgcgcgtgaaggacgcgggggtccgctggcagcgcgtcgtggtgtcgatgggcctgctgctctgcctcgtgcggcggctctccctctggctcggcagcgaggaactccacttccgagccgtcttcctgcacgcccatgacggcgctgtccccctggaggctgaacgcggcctctgcgagctgctgctgcgcgagtggcgcgcccgtggcacggcggaggtcctcaccgcctccacgctcgacgaggtcctgacggatgcggaagcgcgtgcgaagcgcgcgcgggtggacctggtgctgctcgacgcaagtagtcaagtcgagaggatgtctcatcccggcgcctcccgcgtcgagcggcacgtgctcgacctcagcggcccctcccctcgcgtgcgaaccatccgagacaagcgagaagacctggattctcgaaagtcggaagcgccgatgggcgccgccctcaacaacgacccttgggaagcctgggttggcgtaacgcttgagcttgcgcaagggcttctctagcgtccgtttcacaacgcgccccacccggcgcaacggacgaaggacgggccatgccgcggtacgagttcaaggaaggcagctccagcaagttctgggaaatcaacctctccggcagcagcttcactgcgcggtggggccgcatcggcaccgacggccaggagaagacccagaccttcggctctcccgccgaggcccagaaggagcacgacaagctcgtccgcgagaaggagaagaagggctacgtcctggccgacaagagcgacgatgacgattccgaaggcggtgggggtgaagagcctgcatccaatccggaactcgaggccgccatcctcaaggacccggacaacgtggacgcgtacctcgtctacagcgactggctccagggccagggcgacccgcgcggcgagctcatcgccatccagcacgcggcctcccaggccagcggcacggaggccagcgacctgaagcgcaaggccaccgcgcacatcaagaagtaccagacgctgctgctcggcgagctggcggccggggtgaagtcggaggagctgtccctggagtggcacctgggcttcatccgctccgcgcgcgtgggccagaaggaatacgactctgacttcaacgtcccggagatggctggggcgctgctcaagcacccctccgcgcgcttcatccgcggactcaccatcggcatggcgagcttcgacggtgagaacgaatacggtgagaccgtccaggcgctcgtcgaggccgggggctcgaagacgattcaggagctcttcatcggtgacttcgagtacccggacgacaccgagatttcctggacgcacctgaccgacatctccgccctgctcaaggtgctgcccgacctgcgcaagctgcggctgcgcggcggtgagttggagctgggcgccatcgacctgcccgagctgcgcgagttcacggtggagacgggcggcctgccgctggcggccgtcaagtccatcgccaacgcgaagtggccgaagctggagcgcctggaggtgtggttcggcagcgacaactacggcgcggaaggcggcgtggaggacatccagcccatcctcgacggcaagggcctgccgaacctcaagcagttgggcctgcgcaactccgagttcacggacgcgctcgcccaggcgctgcccaccgcgaaggtgctcccgcagctggagacgctggacatctccatgggcaccctgtccgacgagggcgcgcgcgccttggcggacaaggcggcggccttcgcccacctcaagcagctcgacgtcacggagaacacgctgacggacgaaggccagtcgctgctgcccaaggcgattccccacgccaacgtgggcaaccagcgcgactacgaagaggagtaccgctactccgcggtgggcgagtagcgtcgcggcgcactccagggggtcacaccatgccgcgcttcgagtacaccgaaggcacttcgagcaagttctgggaaatcgaacggaaggacaccgtcgtcaccacccgctggggccgcatcggcacggagggccaggagaagacccagaagttcaagcagacgtatgaagcgctgcaggcgtaccagaagcaggtcctggagaagacgaagaaggggtacacgcgcatcaagccgaaggacacggcgcccgcggccaagacgaacccggagctggaggccgccatcctccaggctccggagtctgacgacggctacctcgtctacgccgattggctccagggccagggcgacccgcgcggcgagctgatggccctccagcacgcgcagcgacaggcccagggcgcggagtcctccagcctcaagcggaaggtcgcggccctgtacaagaagcaccagggaacactgctgggcgtgggcctcacgtcgatgctcggcgagaaagccctgacgctggagtggcacctgggcttcatccgtggcgcgcgcgtcgcggcgccggggttcgactcggacgccgacttcgacgtcgtcgaaacactgacgatgctgctccgcagcccctccgcgcggttcctccaggagctgacgcttggcctgccggacaacgacggtgacaacgagtacggcgacctcatcaaggtcgtcaccaggctggcgccgaagacgcttcagcggctgttcatcggtgacttcgtcttcccggacgagtcggagatctcctgggtcaagctggggaacctcgcgcccctgctcaaggccctgccccacctcaccaccttgaggctgcggggcggagaggtgcgcctggggccggtggagctgccggagctgcgtcgcttcacgatggagtcgggcggacttcctcggcccgcggtgcagtccatcgccagtgcgaagtggccgaagctggagcagttggaagtctggttcggcagcgaggagtacggcggacggagccgcccgagtgacatccagtccatcctcgacgccacggggctgccgaacctgaagcacctgggactgtgcaacgcggccttctccgacgagctcgcgaccgtgttgccgaaagccaaggtgctgaagcagttggagtcgctggacttgtcgaagggcacgctgatggacaccgacgcggaggtcctggcggcgaacgcggcggtgttcaagcacctcaagaagctagatgtgtcgcagaaccagctcacgcgaaagggcgtaaagctgctggcctcgttgtgcccggacgtggcggcagggaaccagcgcgacatctacgacgatgacgaaggcggccgatacgtcgcggtaggcgagtagtccggcttcatgggcgcgcctccgttcatcctcatcggcaacccggagaaccggcgcgtcacgctgttccaggacgccctcgccaggcaggggcttccctccgcgcacgtcgtgccctggcgcgagctgctggcgtcgccgggcctcctggcgaacctgccggactcggaggcgctcgtccgcatcgactccacgggcgagaactgggacgtggagaaggccctgctcaagcggggctacgcggacgccgtgggccagggctgctccgtcctgacgccggagcaggtagaccgcctgcccgtggaccgcggccgcattctcagcccccggcagcaccacctgggcttcctgcgagtcctggcggagctggagtccatcttcgcggcgcatccccgctggcacatcctccagaagccctccgccatcgctgacctcttcgacaagcgcatcacctcccgccgctacgccgccctcggcgtgccggttcccgagccgctggacggtgtcacggacgtggaatcactccgcgaacggatgcgggaagacgactgccgcgaggtgttcgtgaaggtgtcgtgtggctcctccgcgtcgtgcctcgccatctaccggcgggggcgctcggcggacacgctgaccaccaccatcgaagtggcgaagacgggctggtacaactcgctgaaggtccgccgcatcgaggccccagcacaggtagatgaaatcctcacgtatctgctgggcgagggctcacaggtggagcgctcgattcccaaggcccggctgggtggcgactacttcgactgccgggtgctgatggtccgaggcgaaccagccttcacggtggtgcggcagagcatgcggcccatcaccaacctgcacctgggcggctggcggggcgacttggacgacttccacgtggccgtgccccccaatgagctcgcgaatgccatgcagagctgccgcacggtagcgcgggcccatgactgcctgcacgttggcatcgacctcatgtacgaggagcacttcaccgggcaccgggtgctggaggccaacgccttcggcgatttgctccccaacctccgccgtgacgggctcaccgtgtacgagtgggagattcaagaagccctgcgtcagcttccgtgacggacacaccctacggtggccccccaagcccggccttccacaggggcgtggccgggacgcgctccaggattccagagccgaagacgcggtccaactccaggtactccagatggacgtacccgatatggcacccacaggtctgcttcgcgcacggccggggtctcagcgcggagtcgaagtccggcgcgtagatgttgccaatcgcctcctcgatgaagtggcaacgccgcgccgtgccctctccatccacggagatgaccgactccccgcctcggcacgcgcggcccaggctcgggtggcgcgtgttgttcaccgggaagagcgggtccaaccgcgtgaagcgcgccacgtcttccgccgtgtacggctcctcctgcccgtccttcaccgcgttgatccacaggtaggtgtccgcgggaagctcggcacgcagggcctccgcctcttccgtgaagcgaaggaaccccaccacgcccacgctgtgccgcacgcccagctcggtcagcttcgcgcactgggccacgaagcggtgccgcttggtccactccgggtggtacgtggcccagatgcccagtttgtccgcgcgcaccccggccacccaatccaacttgcaggacaggttcgtctggatggccaaccgctccacatgcggcagatgcgacaggcgcgccagcgcctcttgataccagggccagatgagcgcctcgccccacggcgtgaagaacaccgacaccgtgtcctgcgtacgcgcctccacccacgcaacgaagcgctccaggtccgcgcggtccttggccagctcctcgtcggtgtgcttccacttgccgaaggggcagtactcgcatccgtagttgcagctcgacagcgggcctcgatagagcacggtgagcttcatcgccaggcgtactccttcatcatcgcctgcacctggtcggagtgcagccaggggccaatcatgtcggagcgctccacgcccgccgcggtgagctgcaccaccccaccattcttccgcgccagtccgtgcgcctccagctcctccagctccgggaagtcctccagcgcgtcggagcagaagcgctgccggtagacggcaagatccacgccatccgccagcagcgacagcagcatgtaacggcgccgccgctccgcggagtccaggcggaagccgtagcccacctcgccgaacgacgcctcggaccgctcgctgtacgacgagatgatggagcgaacctcgcgagagcccaccgcgtattccgacgagtaatgcacctggcccgtgtacgagcgcgccccgcagcccaaccccaccatgccgtcctcctggcagcgatacaccggaccgcccgcgtccggcgcatggcgcgcacggaacatccgcatggagacctgcgtgtagccctccgacaggaggaagtcgcggcccacgcgatacagcgagaggcgcaggtcgtcccacgcccgcgccttcttgcccaggaaggtcagtggccggacgtagagcgggtagagataaatctcctccggcgagtaacgaagcgccgtgcgcagcgagtagaggaagctctcctccgtctgcccctccatgccgtagatgaggtccaggttcagcgtggggaagcccgtggagcggatgaggtccagcgcggcctccacctgcgccgtcttctggggccgcttcaccgcggccacctccgcctcgatgaagctctggatgcccatgctcacccggtccgtgccgcgcgagcgcagcacctggagcttctgcgcgtccaccgtctccggagacacctccacggacacggggatgttcttcatgtcggcgcccatgacgccttcggccatgtcgaacacggtgttcaaccccgccacgtccagcagcgtcggcgtgccgccgccaatggcggcccgggcgaagctcgccgtccccagcgcctccttcacccgcttcgtctcgcgcaccagcgcgcccaggtacccgtccaccacgtcctgcttcggcccggcggcggtgaagagattgcagaagccgcagcgcatctcgcagaagggcacgtggatgtagaggaacagcgcgtcgcgccgctcctccgcccagacggactccaacgggagcgcgggcgtgaagggccggtaggccgtcttgtgagggtagccgtagaggtacgccacgtagggcgacccttcgagcatctgctccagacgcgtcatggtgcggtttctcgaggtagcaggagttcagcgtagggcaccgtccacaccacggggtgggccagacgatggccggtgaagccgtcctcgccgtaggtggtgccatggtccgagcagacgatgcagaaggcggggccccggcgccgcaaggcggcgaacaacggagggagctgcgagtccacgtacgccaatgccgcggcgtgcgactcgcgcgagtcctgggtggcgccgggcacatagtgccggttcggttggtgcagcgccgacacgttgatgaagaggaagacgcgctgctcacgcggcaacgcctccagccgctggacggccagcgtcacctggtgctcggtggatcgagggtccgtcacgcccagctcggggctccagtggctctccgcgaagagcccggggagcacgttgcccagcggattgcgcttgttgaagaagcccacgccaccaatgcagatggtgtggtacccgcgccccgccagcccggtgacgaggtccggcgcgtccagcacgcaggtgtccgaggccgtcgtctcgctgccctcgaagcgcatcgagaacaaccggggatgcagccccggcgtcgcgggcgtgggcaggaagcccgcgaagaaggcgtggtgcgccgcgtacgtgaagctcgcgggagagtgccgctgctcccaccggcctccgggcagcagcgcggagaggttcggcgtgcgcccctgggccgcgagcgcctcggcgacgtcgtagcgcagggtgtccagggtgatgaagagcaggtcgtgcgtgccgatcacggcgttcatgtccatcgcgtgagcactccggcgatgtcgtcgatgcgcgatggaatgcactccaccgtgaacatgggcggaggcagcgcggagggccacggccggccgtgagacacccagcaagtggccatccccagccgcgcggcgcccacgacgtcccgcgccgggtcgtcgcccacgtgcagcacctcttccggcgaacgtccgacgtgggccagcgcggcctcgaagatgcgggcatccggcttcgaagcgcccacctcgccggagagaaagacatccggcagtacctccgcgagccccgcgcgggccagcttcgtgcgctgcacccgcgccgagccattggacactaccgccaccggccggcagcgggccacggaggccacccaatcgcagacgcccgcgtcctcctggacgagcagaggcaggcgcgacgccatgtcctcccagagcgcgtctggagtgaggcccaggcatgggaacgccttcgtcacctgctggcagaacgcgctccgggacgcgccgccacgctcatccaccgcgtgcatccacgccacggcttcggcacgccgagcctcggggagcaacgacaggtaacgggagacgagcgtgtccacgtagcgcgagaaggcgcccgcgcggtcaatcagcgtgtcatccaagtcgaagaagacggcccggggccgcatccgagcactccttcccgaggcgaggatacgccgccccggctgcgtcgaacagcgacaacgcagtggagcgaccgcgtccaggcggattcgccgggcccctgcccccgtacctgcccgttggaaggcgggggactcggagattcccggcgaagcagcgggcgttcagggggacaggtgcgcctcgcggtcgaacgcctccaacgcccaaacgacctcctcctgcgaatccgtgagcatgaggtagcgcgcgtagtcgtagccctgcgcgagctggtgcaccagcgggtacacgggccgggtgcgcgtccagaactcggtgcccaggaagatcatggggctgatgacgcccaccgagttgtagtggttctggcacgcgtcctggaacacctcctggatggtgcccgcgctgccgggcgagtagatgatgccgcccttggcgacggtcagcaggccgtcttcccgcacgctgttggcgaagtacttcgcgatatgcgtggcgaaggggttgggcggttcgtgcccgtagtgccacgtggggatgcccaggctggtgcagtacggcaggtcgtcctcgcccaggggaaatgccctgcgaacgtcgaaggcgcgcgagagccactcgcggtcggtgtagctgggcgcctgcgcgagcagggccagtcccgcgtccagctccgcctccgtgcgccgcgcgaaccacacgcccacgtgcgtggcctccatggcgcctggaccaccgccgctgaccatgaagaagccacggcgcgccagctcgcgcgccagggaagccaccgcgcgatagtccggctggccgcgcttcatggagtggccgcccatgatggccaccaccttgcgcacgcccccggaccggtacagcaatccttgcatggcctccgtgaccgagtggtcgtggagccgctgcgccagcgtctccagcagcgtgggaggactgccgcgcccgttcgccgcccagtgcgcgtagatgcgcgcatccggtgtgtccgcgtaggactccggctgagccgggtcgaagccggcgtacagttcctccggcgtgtacagcgcgccacggtagggctgatagggcacgccggagatgggcgggaacaccatggccccatgctccacggtggccttcagcgcatccttctccagctcacagcccaggaagacggcgcccacgagcttggcggaggccagttcctgggtgtaccgccggagatccagcccttggatgatgacgttggcgaacccgacacccgccgagaggtgccgctcgaatgcctcgatggtcccgatttcgatcacgcatgaacaatttcacgcctcgcggccctgtgggtagcgaggagtgcagctcaaggcgaatgtgcattttcgcgggcccatcggcccctgacgctcagcgccgcgcctccagcacccgcaggcacgcctccgcctgaagcaactccaggcgggctcccgcggcggacgcatctctcgccgcgagctggagctgacgtccggcttcatcccactcgcccaactgcaactgggcccgccccagcacgcaccggagcaacgattggaggcgccggtcctccaacatggacgccaactggagccctcgcagcgcgtctcttgagagcacacga

SEQ ID NO: 1046 - DNA, 11301 bp, Myxococcus xanthus
acgctgcgcacaccatccttcagaacggggagaactatcaactcgtcgcgacggatgcatttgaggaggtcgtgagcgatctgtatgacgggttcttgagcgcggaggaccggcggaacgtcaagcccccagatcggggagtcatcccgcctctggtgaagtgggggagccctcaattcgggccttatacgtggccggtggatgtaacgaggtccgtcctggggatgggcgctggtatcgtgagccttcctcccgcgcatgccagggtggggctgctggcgtggtctgcgatcggtcatgaggtgggagggcacgacatcctgcatgccgatgatggattgccggaggagcttgccattgctgtgaatgagcacttgcaagcgggaaagctcgcttcattgggtcactactggagtgaacgcatcgacgaaacagcgtccgatgtcctcggcattctcaacatggggccggccgcgggcatcgggctcattggctactttcgagggttgaatctcgcattccgtggagagggaagactgcgtaacggtgggcgcgcttcggatccccatcccgcgggtatccttcgggggttcctggcggcctacgttgttgcgcgcctgcgcttcgaccacgcggcggagtggtctcaggtgattctcaatgaggtgagaatggatgtggtgcctgaggagctggtgctggcaggaaagaaggtggaccccgaggatgcgcggagatccgccgagctggttgcggaggtgattgtttccagcaagctgaacgctcttgaagggcactcactgggctccatccagacctggcgcaatagcgacgaggagaaggtgcaggagatgcggcgccttcttgtgtccggccttggggctcttcctgatgctgtgaccgaaggcatctacgccgcgcacctcgtggcggcgggtgtcaccgccgcgctggccgcggaggcggacgtccggcgaatcttcgaccgaatgattcggctgctgaagcagatgcacgatcggaacccgtcctgggggccgctcttcatccggcaccgcagcgacgttgcgccgcactttctctatccatacccacgccatcgggtgtgattgagcacgcaaagcaaagtgccggaatgtctgatgcggtaagctgtctcaccggggcatcgtcactgccgccggtgagcagcctccacttcatggtttccgcgcattgagtgatggcgcccactgctcaatgcaagcgcagggtcctgtgtctcgcagcacacaaacggcgccacgccactccccgcatggccggggagtggccaagagtggggccatgaggatgctgcctgtctgcatgggagtcctggtctgtgggtgcgcggcgcacggcgtgggggagcggccagacgccgtcaccgccgcgtccatggatggccgcgaggtgctgcgcttcgagggcatgtgtgacgcctccggcgcggtggcgctcggcggcagcctgttcgtcgtgggcgacgatgaggacaacatcctccgtgtctacgacgcgcgccggggcggtccacccgtgcagagcgtggacctgtccccggacctggagctgcccgcggcgaagaagaagcccccggaggcggacatcgaggcagccaccgggctgggctcgctgtccttctggctgacgtcccacggccgcaagagctccgggaagaaggcgcccagccggctgcgcttcttcgccaccaaggagacggacgcggggccccggctggtgggccggccgtacacgcaactcctggatgacatgctcgcggcgccccaactggcgcgcttcgggctggacggggcggagacgaaggcgcccaaggcaccgggtgggctcaacatcgagggcatgacggccatggcggatggacgcaccatcctcgtgggcttccgcagccccgtgcccgacgggaaggcgctgctggtgccgctgctcaatccggttgcgttggtggaagagggcgctcgggcccagttgggcgagcccgtgcaactggacctgggcggcttgggcatccgttcgctgtcctggtggcgcggccgctacgtcatcatcagcggtggcacggcgggagagggcacctcgcggctgttcacctggcgcggcggtgaggacgccccggtcgccgtggaatcggtggacctggcgggcctgaacccggaggccttcttcacgccggaggacaccgaggaaatcctgctgctcagcgacgacggcgccgcgcccgtggacggcgttgagtgcaagcggctgaaggacccgtcgcgcaagcgcttccggggcgtctgggtgcggctgccagaatcgccgtgaggcggcgtgtgcgtccgtccgccgcgcttggggtaggctgcgcgtccatatgcagctggccattccgcatgctccccggcaggtccgactgacgcaggtgcccggcgccgtggggcgcgtggtacgaggcgtcctcctgggactggtggccgtggcgttcctgggcaccggcgccggctgggctggacgctacttcgtcgaagagcagggcttcgccgcgcgggcggaggaagtggaggggctggtggtggcctcccgccttccccccctggacgcccgggatggcgcggaagccaccctggaggtgctctacaccttcgcggaggcggagcactccgtgtccggcatccggaccttcgcggagtacgccgagggcctggggcggggcgctcgggtgacactgctggtggaccccgcgatgccggaccggccgcgcgaggccggcttcgcccgctcccgcgcgatgcgcgtggggctgctcccctggggcatcggactgggcgtgctggtggccgtggggtacttcgcgtgggagatgcggcgcctgtggcgctcggaggtggaccccctccggctgggcgcgctggtgtggctgacgccggacgggcccctgctggaggcccggagcgaggtgtcctttccggcccactatttccggcaggacgtgaagcacgcggttcgcgcccgggtccggccggggcgggcgcccgtgcgcaacggggagaaggtgctggccgcggtggtgccccggcagcctgggtgggcgcgcgtcatcgaccaggacctcgcgggggtgctggggtggctgcgctgagacagatggtaggggccgaaaatttgccggggaggtggggctgtgtgacacacgcctgtagctcgcgcccacccggaggaaccccatgcactcgcgcctcgtcatcgtgctgcccgtgctgctgctgctcgtcccgagcgcggtgggggccgccaagcgagacgaggccgaggaggcctatcagggtgctcgcaaggtctactacgcgctgaaggacgacgcggcccggcgcaagctgcgtcatcactggctgaacgtggtggcgcgcttcgagtccgtggccgcgcgcttcccgaagtcggaccgcgcgccggatgccctgttcacggcggcggagatgctccaggagctgagccgcatctccttcgtggaggacgacctcaaggcctccatcaccgactacaccaagctgctggagggctacccgaagcaccggctgtcggatgacggtgcgctggcgctcgcgaagattcacgtccaccggctggaccagccggagtccgcgcgcaaggtcctgacggagacgctggccgtcaacagcaagggtgaccgggctcgggagatgcgggagctgctggcctcgctgccgtcgcccaaggccccgccgccgccccctcgcaaggccgcgcctgtcgtggcgaagagtgattcctccgcgtcgggcaagacgagcaccgctggcaaagcgaccgccatggccgactccggcaagagctccgcgtcggtggatgcctccgccaagggctccgtgtcgagcaaggccgtcgcttcggcggagacgtccgcgtccgggaagggctccgccccggacgatacctccagcgcgggcaccagcgacacgtccaaggccgttgcctcgaccgacacgtccaaggacgcgcagccggcgccggccgtggaggcgtcggggcccgcggagcggccttcgtccagcctggtggccgccatcgagaagatggcgcgcgagccgtcgcccaggattccccagaaggagccgagcgcgcccgtgaaggaggacgcgcgcgaaggcagcctggacgcggccgtcgccgccgccatggcctcgaagcccgctgccgcggagccgccgcgtcccatcacccgtccggtggacgacaaggtggcgcaggcccggctgaaggccgtggccaagcagtcgcgcagcatggagctgacgctggcggagcagctcggcctgaaggtgcggcgcgtggtcatcgatcccggccacggcggtcacgacacgggcgccatcggcaagggggggacgcgcgagaaggacgtggcgctgtccatctccctcaagctggcggaggagctgcgtgagaagggcctggaggtggtgctcacccgcgacgatgaccggttcatccgcctggaggaccgcgccaagtacgccaacgccgagcacggtgacctgttcatctccgtccactgcaacgccgcggagaagcgcacgctgcgtggcatcgagacgtacaccctcaacacgtcggcggaccgctactccatccgcctggccgcgcgggagaacgcgtcctcggagaagggcatcagcgacctccagttcatcctggccgacctggccaccaaggcgaacacggaggagtcgacgcggctcgccacccaggtgcagcgcagcctcgtggggggcctctcccgcaagtacaagggcatccgcgacctgggccacaaggaagcgctcttctatgtgttgttgggcgtgaagatgccggccatcctggtggagacttcgttcctctccaatccagacgaagaggcacgtctcaagtccaatgtctaccagaccgaggtcgccaaggcgattgcccatggcgtggaggagttcctcggagaccgccgccgcgtggcgaaggtggactgagcgcgtccggcgcttcgccagaagtgggtagcaaggacggacgcgctgggtagttcagttccgttcggctggggaacgcgcgtgtcaccgggtagacgccgccggacaccctcgcgcttctcgttccagggatgggtagagccttgcccagcgtgggcaatgaacttacgccccctgggcacatcctgtcacacgatgccacatgccaaggacctggcgcggaccgcgaagcctgtccgtccctccctgaagggctcccctcagggacatgtgtgcgtttcgctttaaaaacaaacaagaggctatttccacgtattgcctggaagcgcacgcgaggcattggtgcgacatgcgctgaagggaggggtgcgccggaccgctcagcgggcggcgagcgggttgcaatgccctgacgcagccggaatcaaccggccgctcgatggagcacgcaactcaaatgaacgcaatcaagactaccgttgccgctgtcaccgctgccgcgtctctcgtcgccttctcgtccgctgaggccgccaccgccaccgccaacctgaacgtcaccgccaacgtcggtggctcctgcgccattggctccggcggcggcggcggaacgctgaacttcggcacgtacgatcccatcatcgtcaactccgcgctgggcatcgacctgttcggcacgggcacgctgagcgtgcagtgcaccctgctcggcaccgcggtcatcaccctgggccagggcctgcacccggcctcgggctcgacggacgcggccccgcagcgccggatgcgcaacacggcgtcggcggactaccttgcgtacggcctgaaccaggacgtcacccgcctcatcgggtggggtaacaccgcgggctccggcctgccgttcctgggcacgggcctgcccgtccccgtgctggtctacggcacggttccgcgcggtcagaacgttccctctggcacgtacaacgacaccgtcgtcgccaccatcaccttctgattcggggcgataacacatgcgtaaccgtcttctgtcttggactggcggcctgatgtgttcggctgccttggaatggatggccatggggaccgtgagcgcggctgagctcgatgtcagtccggttcggcttgaattggattcaagcgcccgtggcgtggtgatgaacgtgaggaacaagagcagcgaatccacacgcttccaagcctctgtctattcatgggttcaggacgaagaagggcgcatgtcgctcgcgccgactcaggatttgttcttcttcccgtccatgttgacgttggagcccggggagtcccgccccatccgggtggggagctcctcggctccacaggataccgaacgctccttccgaatcgtcgtggaggagcttcccccgctgcaaccgtccaccccgacaacggggttgaatgtcctcacccgaatctcagtgcctgtctttgtcgcgcccaagaagaagaccgttcaaggccagatcgcggaagccgtgctgcgcgagtcgaagttccacgtccgggtgcagaacccgggcacggtgaacttcttcatccggaaccttcgggtccgggggctcgacgccaagggcaagcggctggtcgagaaagaggaacccggctggtacgtcctggcgggcgacgcgcaggtgtatgccatggagatcgcgggcaaggtctgccgcaaggtccgcacggtggaagtggagatggagaccgaccagggcgtgctccgtcagacctcccccgtggagtctcccgctccctgcgctcgctgaccgacgcaccatggccccctcccggcttgcaataacccgcgcgccctcatgcacggtgctggcgttatccttgtcgttgggggccctgtcggcggccgcgcaagaccccgtggccgccaacccctccgcgccgccgatgcccatcgtcgcggacttcaccttgaacggcgtgccccgcggcgccacgtttcccatgctgcgcggcagcgacgtgctgctccccgcggccacgctcgaggcccatggcgtggacctggtggcgctcgggggccgccaggaagtcatcgaaggaaagacatacatcgccgcgcggtccctggagcccgaagggcgctgcaccctgaacgagcggaccgtcagcctgtcgtgcgagctgcccgcgtccgccttcggacagacgcgcatcaacctcgggccgcaggcgccgtcggactactccgtccgcggcagccccagcggcttcatcaactacgcggcccacgcccgcaacacctcgctgaccttctttggagaggccggcgcgtcggtggggcggggcctgttgacgacgcaggcgcgatggcggcccggctccgtgcccctgcgggggctcacgcagttgtcgttggacttccccaagcacatggtgcgcgccatcgcgggtgagtccacgggatttggcggcgtgctgggtggcggcgcggtggtggccggcttccacctcatgcgcactttcgagctgaatccgtacttcgtgcgcaacccgatgcaggacttcgcgggtgacgtcgccacgccgtccacgttggaggtctacgtcaacaaccacctggtgaagcgcaccgagctcccgcccggccccttccggctggagaacctcacggtgccccggggcgagggcaacacgcgctacgtcatccgggacgcgttcggtcgggcgagcgaggtgaacacgtcctactatctcagcgggcagcagctctctccgggcgtggtcgactaccggctttccgcgggcatcgagcgggagtccgtcaatctctacaacttcgacttcggccggcccctgctcctgggcaacttccgcatgggcctcacttcgtggctgacgccgggcgtgcggttggagctggcgcccaacgtcgtcagcaccggcgccatgcagctcatccagttgcctttcggccaattggagctgtcacaggccatcagccgcagtgagcggcgaacggggctggcggcgggcatcgtgtacgggctccagcgccgctgggtgggtggctccgtcttcggacggggcatgaacgcgtcctacacgcacaccagcctcaagctggatgacgaccacccgaccctggagacgggcggctcgttgttcctggcgttgggggagagtgtcagcgtgggcgggcaggcgatgctgtcacgctaccagcgggacgggtggacgacgtggctgggcgccaccacctccgcgcggctgaccgactggtcgacgttgtccttctccgcaagccgcagcaactccgaacgaggcggctccgccatcgaggggatggtgtacctgaacgccatcttcgattcccgcaccacgggcacggtggggcactcccaggcgctgcgcgggaaaggcaccacatcggtggacatcgcgcgctcggtgcccatggagggcggcctgggctaccaggtgcagggccgggtgggggcggtggaccaggcgatggcgcgcgccgacttcgactccaacgtgggccgcgtcagcgcgggcgcggagtgggtcgaaggacggatggcgggcatggccgaggtcgccggcggcctggtgctgattggcggacgcgtgcgtcccacgcgcgcggtggaccagggctacgcgctggttcgcgtgaagggcgtggaaggcgtgggcgtgcggctcaacaaccacgaaatcgggcgcacggacgccagcggcgagctggtggtgacgcggctccaggcctacaacgccaaccggctctcgctggcggaccatcaggtgccgctggacgtctacatcccctccacggagcaggtggtggccacgtaccagcgaggcggcgtggtgctggacttcaagacgcagacgatccgcgcctaccggggcaaggtgaccatcgactcggcggaggacacgcgctggctgtcctacggtgagattcgcgccgagaaggacggagagaagtggagttcgcccattgggtggaatggtgagttcgaactggtgggcctgcccgaagggcgtctgccggcgacagtcgtctaccccaagggccgttgcgcgacctcgctggaggttccatccctcgagggcaaggtcattgacctgggaaccgtgaggtgtgtccatgacgaggcgaaatagggcggccgcgttcgcggtggctggcgtatgcgggttgctgccaggactcgcgggtgccgtctgccagatacgcagcacgataggggtgagcttcggcacctacctcaccaccgacctgctgccccgggactccgccgggagcatcacctaccggtgtgaagggcagatcacccccatcaccatcgacttcagcgccggtggctccggcacccccctggcgcgcagcatggcggggccgggcgcccagcgcttggaatacaacctctacgtggacgcgacgcgcctcatcgtctgggggaacggcacgtcgggcacggggcgctatgggcccgtcgtccccttgttcggcgtggaggtgacggtgcccatcttcgggcgcatgctggccggacaggccatccccgcggggggcctatgcggacaccgtggtgattacggtgcctttctgagggcccggtccctctgtccctggagcaccgccagcaggtgtccgccctgaacggagacagtgagcgcgggcaccacctcctccacggtgccggcgcgcggggcccgcaccaccgtctccatcttcatcgcctcgagggtgacgaggggcgcgcccgcctccacggcgtctcccgatttggcatgaagggcgatgacggtgcccggcatgctcgccgcgacgtggctgggattggcgcggtccgcctgacgccgcgtctccacggtggcggcgcggctgcggtccctcacgtgcacggtgcgggtgtgcccgttgagggcgaagtagacggtgcgcacgccctcttcatccggctcgcccaccgcggacaggctgatgaccagcgtcttgcccggctccaggtccacccagacctcctgtcccacctccatgccgtagaagtagttcggggtgtcgaggatggacacgtcctcgtagcgccccaggtcttccaggtagccggcgatgacgcgcggatagagcgcgctggagatggcgtccacgcgggtgagcgcatgtcctgtcttcgcggagagctcccgctggagcgcgtccaggtccagcggcggcaggctggcggagggccgtccctccacgcggggcaggcccttgagcacggcggcgcgcaggtcctcggggaagccgttgggcggctggcccagctcacctcggaagtagcccaccacgctggtggggaagtccaggcgcggcgcctgttcaatcagcctctggcgcgtgagcgaggccgcctccgccagcgtggaggcgcgcaccgtgaggtcgttcttgagcaggaagatggcgaagtcgccgaccatcttcgacgacggcgtcaccttcgggatgtcgcccaccaggacgttcacgagcgcgaaggcgtccttcacgtcgttccaccggcccagcaggcccagttccgccacctgcggccggaggttggaatactggccgccaggaatctcgtggtagtacacctcgctggtggtgctcttgaggccggcctcgaagggggcgtagtactcgcgcacgtcctcccagtagttggccagcggctgaaggcgcgcgttggccaggcccgtctcacgggggtggccgcgcagggcgctgaccagcgcgttgaggctgggctggctcgtcaggcccgccatgctgcccagggccacgtccaccacgtgcacgccctgctcgatggcttccaggtagctggcgatgccattgccggaggtgtcgtgcatgtgcaggtggatgggcaggcgcgtcacctcgcgcagacgccgcaccagcatggccgccgcgcgcgggcgcaagaggcccgccatgtccttgatgcagaggaagtgcgcgccggagtcttcaatccgcttcgcgaggtccgcgtaatagtccagcgtgtacttcgtgcgcttggggttggcgacgtcgcccgtgtagcagatggacacctccgccaccttgcccgtcgtcagcacgcggcgggtggagacctccatgctgcccagatcattgaggctgtcgaagatgcggaacacgtccacccccgcctcggccgcctcgtcgatgaaggcctccaccacgttgtccgggtagctggtgtagcccacggcgttggccccttagagc

SEQ ID NO: 1047 - DNA, 13332 bp, Myxococcus xanthus
tgccaggtcaccatgacggtggcatcgcggtcgttgcagtcatgaccggtgggccactgggcatagcccggaggaagcgccgcgccgctgcaggtcacgccctgttcgggcaccgtgtcgccgtcaccgtccgagtcccggtgggcataggagcgccactgccaccgcgtggcgtcctccggcgcgcagtcaacggagtccagcgcgtagccgggaggcgccgtgcggcccgtgcaccgcatgacggggtcaccactgccgaagccgtctccgtccacatccgcgtagacggtgcgcttctgccaccatgcggcgttcgtgtcgtcgcagtccaggccgcgcgcctccagggcgtagccggcgggaagtgtcatgccggagcagacccggccttcctcgggcacggtgaagccgtcgccgtccgcgtcccggtgggtgtagtcgcgccacgtcgagcgcgcgcggtcgtcgggtgcgcagtcgccgtcgaccgccgcgtagccccggggcaggtccttgcccgcgcagtgggagatgggctcgccgttgccgatgccgtcgaagtccgcgtctggccagagctgggtggaggcggcgaagcggggggcgttgtcgtcgcagtccggcgcgccgggttgctcgcggtagccctcgagcgtgtctcccacgcaggccgtcacggggccctcgccggtggcgccgtcgttgtcctggtccgggtagagcccggcctgctcccgccagcgggtcgcgtcgcccggagcgcagtcgccgctctgctggctccagccctccgggagttgctcgccagcgcagacctcgcgcagcgcgccagcgcccacgccgtcgcggtcatcgtccgcgtgaccttccaggatccgccaccggttcgcatcgccgggagcgcagtccgccgcgtccgcgaccccatccccgtccgcgtcctcttccgtggggctcgcgcccggcgaacaccccgcgaggaggcccaccacggtcagcgtcaacgccagccacgtctgtcgattcgtccccatgtgcgccgtttgttccatccgcgtgtggacctaggggacgcgggccagcttgcaggcgaactggatgtaattgttgggatggtcttccacggacatcgtgagcaggtacgcgccgggttttgacatcgcaagcagggccatccggtcgcagcggctcgccagtgtctgaaggctctcctgcgcgccgtgtgaaagaacgatcttgaaggtgacagtccgaggctctgcttcgccttggagcacgcccgtgacgtcgatgcggccatcgagccggatgctgtagtcgtccacggtcgtgaagacatagggccggccccttggcgcatcctccgccatcgcggcgggcgccgcgaacagcgccgcgagcagggggagggccaggatgcgccgggacagggacttcgacataaggggttcctcgcggagggactgaaaacgggcggattccgccatgcgcccacgccctatacgccctccattcgattccttggcggattcggcgcgtcacggcgcgaacgccaccgtccaacgccccccgtgctgcaccttgtcacagccgtccggctgcaatacgcctagaggcatgtccaccgccgcgctccccgccgacttcctccaggccatcaccgagggcttccccgccgactttctcacccgggagccaggggagctccaggagtacggccgcgattggacgcgcgtctatgcgcccgcccccgccgccgtggcgcttccccggacgacggacgaggtcgcccggctgctggccctgtgtcaccagcatcacatcgccgtggtgccctccggcggtcgcaccgggctggccggcggcgcggtggcggcccggggcgagctggtcctgtccctccagcgcatgacgcgcatggggccggtggacctgctcggcaacacggtgcgcgtgcaggcgggcgcggtgacggaggccgtccaccaccactgcgcggagcacggcctcacctggccggtggacttcgcctccaagggctccagcacggtgggcggcaacatcgccaccaacgcgggcggggtgaaggtcatccgctacggcctcacgcgccagtgggtgctggggctccaggtcgtcaccgcccagggggaagtgctggagctcaatggcgcgctggagaagaacaacaccggcacggacctgcgccagctcttcatcggcagcgagggcaccctgggcgtcatcaccgaggccaccctcaagctcacccagctccccggcaagcaggacgtgttcctcttcgcggtgccggacgtggcggccgtgctgcggctgttccgcgacgcgcgccggcagaacgccttcagcatctccgcctacgagttcttcaccgacaggtgcatggcccgcctgggccgccaccgcaagctgcgcccgcccttcgagacccccagcgagtgctacgtgctgctggaggcggaggcgaaggacgccgccgcggtggagggctggctgggctcgctgttcgagcgcgagctggtgacggacggcgtccaggcgcagggcgcggcgcaggcggccgagctgtgggcgctgcgcgagggcatcagcgagagcctctccgccaccggcctgccgcacaagaacgacatctccctgccggtggcggggctggaggccttctgcgcggagctggaggccctcttcagcgcgcgctacccgggctgggaaatctgcctcttcggccacatcggcgacggcaacctgcacgtcaacgtgatgaagccggacgccatggacaaggcggagttcctggcccacacgaagcaggcggaccccaccatgttcgcgctggtgcagaagcacggcgggagcatctccgccgagcacggcgtcggcctgctgaagaaggactacctgggctactcacgcgcgccggcggagctggccctgctgcgcaccctcaagcgggcgctggaccctcgaggcatcctcaacccgggcaaggtcgtggatgcctgagggcgccggacgtcaggacaggatgcgcgtcttgatgtccgtctccagcccggcgatggcctcgcacaccggggtggacacgtcctggtccaggtccatcagcaggtagccgatgttggcgtccgtgctgagcacctgggcgtggatgttggcgttgaggtcggagacgatgcggttgatgtcgcgcagcacgcccgggatgttgcggtgcacgttgaggatgcggtgcgtgcccgggatgagcggcgcctcgatgttcgggaagttgaccgcgcccgtgctggcgcccgccttgaagtacttcagcaggctggtggccacctccttgccgatggaggcctgcgcctcttccgtggacccgccgatgtgcggcgtgaggaccacgttgggcaggccctggagcgcggtgacgaagccgtccgagttgctctccggctcctccgggtagacgtccaccgcggcgccgcccaggtgctgggactggagcgcccgcgccagcgcgtcgatgtccaccaccgtgcctcggctggcgttgatgaggcaggcgcccttcttcatctgggcaatctgctcggcgcccatcatcatgtgcgtggtgggcagcgcgggcacgtggagggtgacgaagtcggaagcgccgagcagctcctccagggtgacggctggctgcgcgttgcccagcggcagcttggtcatcacgtcgaagtagaggacgcgcatgcccagcgcctcggcgatgacgcccagctgcgagccgatgtggccatagccgatgatgcccagcgtcttgccgcgcacctcatggctgccggtggccaccttgcgccactggcccgcgtggacctcctggctgcgctcgaagagctgccgcgtcaggacgatgacttccgcaatcaccatctccgccacgctgcgcgtgttgctgaagggcgcgttgaagacggggatgccgtgcgtgttggcggacgtcaggtccacctggttggtgccgatgcagaaggccccaatggccagcaggttctccgcgtgctccagcgccgcgagcggcaccgtcgtcttgctgcggatgcccagcaggtgcacccccttcagccgctccgccagttcgtccggcttgagggcggacgagacgcgctccacctggaagccctcggcggccagcatctcccccgcggacgggtggatgttctccagcagcagggctcggaaggggccgtcactgctgatggcgcgcgtcggagagggcgggaactggggagggctcatggcgccttgcgttagacctggggctccggactgtcaagggtggggtggggctcgcttgaggtccatgcgtcattgcgcggggaagcgcggctcgtagaactccttggagtcccacttgacgtcatggaactccgcctcgcccgccttggtcttcgcgacgcagcggacgatgttgtccttagtgaacaggcagggctcggcgtgggggtggcccgtcgccgcggtctggaacgcgcggtggatgaattggggctcgagcttgcccagggccaggatgcggtagaactcctggctgaagggcagggcctgggaggtctggtagcggctgcggaacgcgatgacgtagggcgtgccatggttgatgaagagccgggcgaagtgatgctcccagccaatcaggcacgagctgaagaaggcgagcagccggggcggcttcttgccgcgcttgaaggcctgctcgatggcctcgtaggtgaactcgacgtcgcggctgctgtcgttgtcgtccacggtccactggatgacgcttctcagcgtgtggtcggggctcaagaggctccagcccagcttcggcatgatgagtgactctttcgcccactgggtgagcgcgaccgggtcgaagccggtttccacgcagagctcctcctccttggccgccagtccctccaccttggactggtcattcctgcaccacgtcgggtagcggggataggccatgtccatggacgcgaggcgcatggcgtgcttcgagcagcgcacgttcccgtgggtgacgtggtggtagatgtcgcagtcgccgagctggttcacccaggtgtcgaagttcgcgtcccggtcgaagaagcgctcacggaacggaccccgtgaggccagggcgaaggcgttgctcacgtgccccagctcgacgttccactgcagcccggggtccgcgcggtcgtaatagaagagggtgctgagctggtcgacaggcgcggccgggtcgagcgccaggatgtcatcgtgggtgatgtcccagccccgcagcttgaggttgcacttgccgcagaagtgcgggtccaagcggtccggcgcattatgcgggaactgcggccgcttctgctcccagtcggggtagctcatcatgcagttgtggtcgagcgggtcgtggtgctggggaaccacgcccgaggaggcctcgtggtgggtcaaccagaagcagtggcccacctcgtgggtgaagacgaagtcggggttcgcatccacgctctggtcgatgatgcccagcaggtcgccgttgccgttggaggtcgtgggcacctctccggcgtccgacgtctcgagcgcgtccacgatgtcgtccgacagtttgtattcgagcatgacgatgccgccgcagggcgcatcccccgtgcggagtctgtcggagatgcgcgagagcaggaatccgccggcgctgcggacgttcgccgtgctgaccagctcgttgaacatgtcgctgacgaaaaaccagatgttgttcttctggttggcgctgagttccacgtcagggcggagccgcacgacggggctggcgtcatgcacgtgcgtggtgtccagcaggccaacgacgctggcgacggacggcttgacgtgcgtccggatgtgggtgaaccagtccgagtagtccgtgtcgttgatgacctgggagatgcgccggtactgcgtgtgggagaagtcgacctccaggtaggcctccgcgtagcggtcccggcacttctgcggcaggttcccgtggttgcgcagcggccagcttacgatgccgaagacctccacccggcgccagacgacgatgggcttcgtctcgtactggcagacggggttggcggcctcaagctgcatggcattgccgcggcccgcgtagctgagccgcgcgcgcacctggtatcggtcgccggcaatcagtgacggttggaggtagatgcccgagcggcccacgcggttcggatgcgcggcgccgtccgtgaatgcggggacccagagcttcttggccctggcgtcctccgtgggcgttgcgtagggggcataggactggggctcccgccagaaggggttgcggaagttgccgtcctgggtgcggatgccgccgtaggccacggggcagttcgtgccaccgtcgcccgcgaggtcgacgaagtcgctgccgaggacgcggttgacgtaggcccgggttcccaggtgcaggtcgtgattcaagggcaggtgcgacacgtcctcgcccggctcgagcgcggaccagtccacccgcaccgcgcccacggcctggggggcggcgacgcggcttccatcatggcccttgaggtagatgaccgcttcgagcggcacgagcgggcggttgagcttgccggcctcgctcctcgtcttgttgtgcagcgtgctccagtcgatggcggcattgccccggttggaaggaatctgccgcatgaactcgtcggtctggttggcgaggtcctcgtcgaagcccacggcctccacgtagacccgcagcggcgctccattccctcctggaatcgcggtgccttccgggacggggttgctctggtcgtcgaccagcgtcggccgtgcgccatgggcgtgccccagcgcgccgtccagcgcgttctcgaaatcgtcgttcgtgggcgcggggatgattcgcaggtcgccgtggttgcgacggaagcgctccttggccttgtccagcaggtccggggtggccgccgcgcgtgccggagggccggcgtagtacccgagctggttgagcttgtggcagatgctggcggcggtgccccggacgaacacctcgccggtggccagccaggggccgcggacgacctccacggaatggtagaggacgttgacccgcgcggtggtgggaggcgggagcggcagctccctcgcttcttcctccgggagggattcatcgcgccgggactcgcagggcgccacgctgcccagctcggtgttgggcaggtcctcgggctggcgcaggtcctcgcgcgcatcctcttcgatgacggcttcgacccggagcgtgtagggcgccctcagcggcgtggcgaagggttcctggacggcgtcattgcccacgttcagcgcgcccgaccaggtgatggccgcagggccgccgcggcaatcgagcgcgtccgagcggtacacgagggcatccgcgtagtcgcgcacctccaactggacggagacgagccgcccttcatccggcgggtcgtaggtgacggcgagcgtctcctgggaaggagcgaagtgcgtccagtcgcagcgcagggggaggtagggcatggtcagggcacggtaggggagcgcccgcgacggggccgcaggtaatggcgctcaatccagtccatcttccgggaaggcgtgaggtacggccgcgcgagcacggcctggggccaggcatgggccgggtccgtgtcgaagtgctcgcccaggcagagctggcaggcgatgaagcgggccacgtcccagcgtgcggtgatgccatgccgggccgcggcgtcgatgccgcgctcggcccgtgcgcgcagctcccgctccttcaggtccgcgctctcccgggggagctgcgtcctcaggaagcgcaccacgctgctcacgtaggtgccgcgtatcgaggtgtcgaggcacgccatctgttcgggtcgaatcctcaggaccacgcacgctccgggaccgaacggccgaatgtgtgaattttaacgcgcgacggggagggccttcaaccgcgagcgggtggccagatgcgacagcggggcggccactccgtgaagagtgacgcgccccgcggtgcccacctcgtcggtggaacgtgactactgaacggtccagcccaccgtgccgctgcagctggtgttgccgtagcagcccgcgcggatctgatacgtgccgcccgcgcccgccggcaccgtgtaggtggcgtgggagagcgagccgcagccggcgccgtcgtcgttgaacttcacctgcgtgccggcggcgttgtacaggcggatgaacgagtcgcccgtgccggaggcgcccgtcacgttgcaggtgccgaaggagaggctctggccggccgtgagggtgacgttctcgttggtggtgttctgccgcgcgctgtcggagttgaccgagctgtagttgaacgtgccggagttggccggcggcgtcgccgtgccaatggtccacgccaccgtgccgctgcagctggtgttgccgtagcagcccgcgatgatttcgtagttcccagccgcgccggccgtgaaagtcacgttggagccgcggcccgtggcgcagccgtcatcgttggaggcgacctcgatgccgctggggccattgacgcgcagccacgtgtcgccggtggcgctggcgcccgtcaggccgcaggtgcccacggtgatgctctggccggcggtgagctccaccgtgtggcgggtggtgttcacggtggcgttctgggtgttgctggccgtgaagtcgaaggacgtcggcggcggcggcgtggtgttgcacagccggacgctggtgttggtggcgcagaacgcctcgatggccgggcggatgtaggtgatgtcttcgccgctgcacccggtctccgcgcactggttcacgacgcggcagctgccctggtagacgtagtccgtcgtaccgcgcaccaggatgccggcgatggtgtggctcgacatgtcgtagacggccgaaccggagttgccgccgaaggtgtcggtggtggcgacgaagtagtccagcgtgctggcgcggccgttgcggacgctgccgcccgagtcaatcttgagcgggatgccgctgcccgagccgatgacggccacgttggcgcccaccgccatggcggcgttgcccgggcggatgggcgcgggcgtgaagcgcggcgccgccgaacggtccaggcggatgatggcgtagtccagcgtgcggccgctggaggtgttatcccgccgcacgacaatctccttgcagctgaagatgtcctgcgtggtcatcgtctgcaccgagttcgcgtcaggccggtagaagttgaaggcccacttgaaatccctgcagtcggccgcggtttccacgcagtggccggcggtcaggaggaggtcatcgtcgatgagcgtgcccgagcagtacccgggcgacgggtcgtcgatgaagcgctggcccgcgcagaggttgacgtattcgcccagggtggggctgtcgaagacgacgttgttggggtccgagtcgtcaatctcgtacgggtcgaccatgacggcgctggcctgcatggcgtactgccgcagggtggcgtcggggtgcgcgtacacgtccatccggtcgtcgttgccatagacgacgggctgctcggtggagccgctgccggcgggctcgccctcctgggccggtccacaggccgcgacggagaaggtacacaacagcgcgccgagcagcttcctgcgggcgtcggtccgggggatacgcatgagacaaccactcctacgggagatgtgaggcccagccccgtcgggggcgggccgccgcaatatatgtgaaaaaaggcgttcctgctgtctgctggcggacagttcgcgtgcgcctcagtccgcgtcggggtcgcgcagccactggagggcttccccccgcgtctcgaaggtgcgggtggggatgctcagcatggcgcgcttcgtcatccgccaggcctggagtccggagggggcgtcactgacgacccgggcggagcgcttcatgccgtggagctgggcgaaggcgttgaggctggccatggccgtcaccacgtcgctgggcatcacccggagctgggactggtccaccagggcggaccactcaccggccaggtcgttgatggccttcttcacgtcggccaggtactcggccaggtccgcggtagtgacttgcgggggatagacaacctcgaggatgcggtcctgcgagtgaacggtgatctggaatggcatgacggtgacgggctccggacgggcgcgccatcctagccgcaggcggtgacacgtctagagcgggagggcggatggggcgccctggcggcaccttcccggccctgtccggaagggcagggaatgtcagacccacctggtactgacgtccctgccgctgctccggtaccggcgcgccgaaggggcgcgccggcggctgcacccggcaagggggtttcatgaacacgaagttgtacgtcctgggcgcggtgctgggcgccgccccgggcctgctgccggtggtgtcggcgccgccggtggcgtccacgcaggagtcgcgtcaggactcgcgcgggacttctcgaaagggccggggaggcccggcgaagggcgcatccgctcccgtccatccggcgggcgtgacgccacctccagaggcgaaggacgcgctggagacccagggggcggtccccgacgaaggccgcacgaggggtggaggccagagcaaggctccacgccatccgtgcgaggccatcaccatcatccaggtgccctgcgatgccgagcaggaggcctgcgagtacacgtactggcactgccccgaggtcgtgaatccgctccgggcgtgagtgactgcagcagcaaggagcgcacgggcggccggttccgcccgtgcgctcttttttcgcgacgtgtcggccgttcgcttttctccggtggcgcgtgtccgtcttgcttgacaccccggattctccgtcggaaaagcccggacacacgaggcggcccggctattttcctcagaggccgccggggagcccggcattgaagctcgcgacgctcaaggacggaacccgtgacggccgcctcatcgtcgtcaagcgggacaacacggcctatgcgctggccaccaacgtggcgctcacgctgcaagccgcgctggacgactgggagacgaaggaaccccaactgcgcgcgctggacgcccagttggaggcgggcacggtgcagagccgcccgctggacgtcagcgccctgcacgcgcccctgccgcgcgcctacgaatgggtggacggcagcgcgtacctcaatcacgtcatcctggtgcgcaaggcgcgcggcgccgagcccccggagacgttgaagacggacccgctggtgtaccagggcggctccggggacttcctggcgcccaccgccgacatccccctggccgacgaggcctggggcctggatttcgaaggcgaggtctgcgccatcctgggcgacacgccccagggcacgaaggcggagaacgcggcgccgcacgtcaagctgctgatgctggccaatgacgtgtccctgcgcaacctcatccccaacgagctggccaagggcttcgacttcttccagagcaagccggccacggccttcagccccttcgcggtgacgccggacgaactgggcgcggcctggcacgacgggcgcatccacctgcggctgcgctcggtgctcaacgggcagcaggtgggcgacacggacgcgggtccggagatgcacttctccttcttcgacctcatccagcacctgtgcaagacgcgcagctacacggcgggcaccatcctggggagcggcaccgtgtccaacgcggaccgcgagcgcggcatctcctgcctcgccgagcgccggatgattgagacgattgagcagggcgcgcccaagacgcccttcatgaagccgggcgacaccatcgacatcgagatgacggacgccgagggccgtagcgtgttcggccgcatctcgcagaaggtggtgaaggttccatgaagggccttcggctctacagctactggcgctcgtccgcgtcctggcgggtgcgcatcggcctgcacctgaaggggctggagttcgagtacgtgccggtgcacctggtgaaggacggcggcgagcagaacagcgccgcgtaccgggcggtcaatcccatgcgcacgctgcccacgctggagtggacggaggcggatggcacggtgcgccggttgtcccagtcgctgccggtgctggagtacctggaggagcgcttcccggcgcccgcgctgctgcccgctgacgcgttcctccgggcgaaggcccggatgctggcggagatggtgaactccggcatccagcccctgcagaacctgtccgtgatgcagcacgtcaagcagtcgctgaacgcggacgacaaggcgtggtcggcctactggaacacgcggggcttggaggccctggaggcggcggtgcagtccacgatggggcgcttctgcgtcggggatgcggtgtcgctcgcggacgtgtgcctggtgccgcagctctatggtgcgcgccgcttcggcgtggacctggcgccataccccacgctgctgcgcatcgaagccgagtgccaggcgctgcccgccttccaggccgcccaggccgaccggcagccggacgcggttcccgcctgagtccggtgtggcggccgcgcctgtcgtgggcgcggccgtcgtaagcacgccgcgggacactcgattcccatgcgtccctcctcgtccccgcagggtggccttccgtcgtctcccgcttcgccagtggaccgcgccaccgcgctgcgggagctggcggggttgttcctccggctggggacgttcgccttcggcggaccggcggctcacatcgcgatgatggaggacgaggtggtgcgccgccgcggctggctgtcgcgcgaggagttcgtggacctgctcggcgccacgaacctgattccggggcccaactccacggagctggccatccatatcggccatcggcgcgcgggctggcccggcctgctggtggcgggcgcgtgcttcatcctccccgccttcttcatggtcgcggtcatcgcctgggcgtacacgcgattcggcacgctgccgaaggtggacgccgtgttgcacggcgtgaaggccgtcatcatcgccgtggtggcccaggcgctctgggggttgctacgcaccgtcgtgcggacaccgctggccgccagcgtgggagcggctgccgtggcggcggctttcatgggcggcaatgagctgctcctgctgctcctgtcggggctcgccctgctcccgtggcgcgcatg

SEQ ID NO: 1048 - DNA, 12865 bp, Myxococcus xanthus
aaaggcggacgtggccaagggcttcgtcctggacggctttccgcgcacgccgggccaggcggacgcgttggacaagatgctggggcgcctgggcaagcagctgagcgccgtcatctcgctcgaggtgccgcacgcgaagctggtggagcgcggctccggccggcgggtctgcccggtggacggcagcgtctaccacgtctaccagagcccgccgaagcgggcggggtactgtgacaagtgcaataccgggcttgtccagcgcccggatgatatgcccgaggtcatcgagaagcgccttcagaagtacgactcggagacggcgccgctgaaggccttctatgagaagaagggtctgctcaagagcgtggacggcgtgggcacgcccgagggcatctacgaggagatcaaggccgctgcgggcaaggcctgatccatctggcgggtggggtgccggcctggctggtacctcctcgccggttcgtcgcttcagcaacggagcttgcttcgtgtggacagggggagctctggcctggggggatctggactcccgtaggggatgggcgcattttcaccgcgccgggagagcactcgctccaggtgtggaccttgacggggggctcacagattgagttgatttttccatgactgcgggtgaagtagcccgctgttatgtggggttagtaggaaaccaagttttgcagtcgcgcgacgcttgccacttgcggaccaaagtgctatcccgccgcgcttccaagaggttcgtggtccggggaagagagtctgacgcttgccgaaggatgattccatcgaagtcgaggggaccgtgatggagcccctcccgaacgcgatgttccgcgtggtgctggacaacggccacaaggtgctcgcgcacatctcgggcaagatgaggatgcacttcatccgcatcctcccgggtgacaaggtgaaggtcgaactgtctccgtacgacctgacgcgcgggcggatcacgtaccgggcgaagtagtagggtgtacccgcctgggaatggcgggccgcccgttgggcttttctttagctgaggaaggaagttcgctccaatgaaggtacgggcgtccgtcaagaagatctgcgacaagtgcaagattgttcgccgtaagggaatcgtgcgcatcatttgcgcctccaacccccggcacaagcagcgccagggctaacggccaagcggccgttggcttcagaccaactccacttaagaaggaagaccgaagatggctcgtatcgccggcatcgatctgccgcccaacaagcgcgcggtgatctcgctccagtacatctacgggatcggcaacaagtccgcgcaagacatcattgctgcggcgggcatcgatcccacgacccggaccaaggacctcaccgaggagcaggcccgcaagatccgcgagatcatcgaggccagctacaaggtggagggcgacctccggcgcgaagtcaccatgaacatcaagcggctgatggacctgggttgctaccggggtcttcgtcaccgcaagggcctgccggttcgtggccagcggacccacaccaacgcgcgtacccgcaagggtccgaagcggggcatcgtccgggcgaagccggcagctccggcccggtaaacgcagcgctggcccgtaaggtgccggcgtcgatcccctcctcccaggagcagcaattcacatggctgacgagatcaatacttcggctgcggcgtccacgggcgccgagggcgaggcccctgccgcgaagaagtcgaagcgcaagggcaagaagaacatcctcaacggcgtggtccacatccagtccacgttcaacaacaccatcatcacgatcacggacgtgtccgggaacgtgatctcctggtcgtccgccggggcgcgtggcttcaagggaagccgcaagtccaccccgttcgcggcgcaggtggccgctggcgacgccgcggcgaaggcgatggagcacggcctgaagaacgtgtccgtgttcgtgaagggcccaggcgcgggccgcgagtcggcgctgcgcgcgctggccgccgccggtctgaagatcaacctcatccgcgacgtgacgcccatcccgcacaacggatgccgtcagcccaagcgtcgccgcgtctaaccccttcgtcagggctgcccttacaccctggtgtgggggcggctccagatcacctctaaggacctctcaatggctcgttacactgccagcgcctgccgtatctgccggcgcgaaaacctgaagatgtacctcaagggcgaccgttgctacacggacaagtgcgccattgagcgccgcccctatcccccgggtcagcacggccagggccgcgtgaagttctccggctacggcgtgcagctgcgcgagaagcagaaggtcaagcgcatgtacggcctgctagagaaccagttccgcggctactaccaccgcgcgtccgccgccaagggcaagacgggcgacaacctcctgcagcagctggagcttcgtctggacaacgtggtgttccgcatgggcttcgcggacacgcgcaacgaggcgcgccagctggtgcgtcacggtcacttccaggtgaacggccgcaaggtgaacatcccctcgttcgccgtgaagccgggcaccgcggtggaggtggtggagaagagccgcaaggtgctccgcatctccgaggcgctggagacggtggaccgccgtggcattccgcagtggatctccctggacaagaaggcgttcaagggcacggtcaccacggttccgaaccgtgaggatctgacgatgcccatctccgagcagctcatcgtcgagctctactcgaagtaagcacgctggatgtcgcagtggacgccctggccgacgaggccggggcgtcttgctttcaagcagtcgcagtccccgcgtgcgcatcctcccgccaggccggtgggtaagtcggtggtgcggcacgaaccgaggagcggtacaccatggctgatacgttcgttgcgaagaactggcgtgacctgatcaagccccgtcgcatggaggtggatcaggacagcgccacccccacttacggtaagttcgtcgcggagccgctcgagcgcggtttcggtacgacgctgggcaactcgctccgccgggtgctgctgtcgtcgctgcagggcgccgccatcaccaccgtcaagattgaaggcgtggaccatgagttcacgaccatccccgaggtgtccgaggacgtcacggacgtcgtgctgaacctgaaggaagtcctccttcggatgcacacgaacgagacgaagacgctccgcatcgaggcggagggccccaaggaggtcaaggccggtgacatcatcaccgacccggacaccgagatcctcaacccgggccaccacatctgcaccatctccgagggcggcaagctccgcatggagctgacctgccgccgcggccgtggttacacgccggccaacgtgaacaaggtcgccggttcgcccatcggcaccatccccatcgactcgctgttctcgcccatccgcaaggtgaactaccaggtcaccaacgcgcgcgtcggtcaggtcacggacttcgacaagctgtcgctcgaggtctggacggacggctccgtgtctccacaggacgcggtggcgtacgcggcgaagatcatcaaggagcagctcaccgtcttcgtgaacttcgacgagacggaggagcccgtcgtcgccgaggcgccgaaggaagaggcgaagctgaacgagaacctgttccgctcggtggatgagctcgagctgtcggtccgctcggcgaactgcctgcagcaggcgaacatcaagtccattggcgacctcgtgcagcgcaccgaggccgagatgctcaagacgaagaacttcggccgcaagtctctgaaggagatcaaggagatcctcgcggagatgggcttgtcgctgggcatgaagctggagaactggccgccgaagcaggcgccggctcccgcgcagccgaaggcgtagtagggttcacgcagggcctccccacgtggccgcggtacggcggtcagcggcgcgaggggagggggctgggacgtcttccggtccgaatgacagtggcgggcctcgtgccgggtccgcccatcccacccggtacctgatacggccggagtggtggagtcctcaccaggactccggagcacgacgatgcgccataaggtcggacagaggaagcttcaccgcagcacgagccaccggctcgcgatgctcaacaacatggtgacctcgctgctggagcaccaggccatccgcaccacgcttcccaaggccaaggaggcccggaagatcgcggagcggatcatcaccctgggcaagcgtggcggcctcgccaacgttcgcctggcggctcgtacggtcaaggaccgcgacgtgctgcagaaggtgttcggcgagtacaaggaccggtacgccagccgtcccggtggctacacccgcatcgttcggctcggcttccgccggggcgacgccgcggagatggccctcctggagctcgtggaccggccggagaaggccgctcccgtcgacaccgaggcggctgcgcctgcggaagagacgaaggcggagtagtccggtacggactgcatacctggccccttcgcgagaaggggctgggagcaacgcgagggcgcgcttccgagaggaagggcgcccttcgtgtttccacggcggactactgctgcggcttgtgaatgcgctcccaggcggcgttgaggtccgctgtgaggtccgcgctgtcatcccggctgcgcatctggatggactggaagcggaggtccgcgggcgcggcgccgctggagcccatcaactgcttgggggtgatggtgatgaactcacctggggccaccgtcagcaccgccgcctggtactgaccgttgacggtgagggtgacgtcgtaccagggctccttgctctcgttccagatggtgaccgagggccggtccaacctgtcactgagcaccaggcgcgcgtccatgtcccccttgcgcaccgtactgcccgggcacgcaatggccaggctcgtcaccgtcatcaccagccagccggcgatgatggacgccttgtatttgaagaagcggtcgctccgtcggaaatccgcgaccagctccttgaggatggagacgccattgaggaggtggttcgacgcatctcccgccaggcgtttccccagcgggccgtctggcttgtccttcacgagcggctcggcgcgcgcggcggacatcacccgcaggttggactggctgggtgcgcgcggcatgccggggctcgtcggcgtgcgcggctgagagccagacggagacgccgcccgaggaggctgcgttccaggctgggagggcttgcgaccgtcgctcatcggacaacgagtgtagagggctgggcctgtggatggctactgtgccttgagttgctgaagcgcgcgtgacgccaccgcgttttcaggctgggtctccagcaccttcatcagccaacgctcggcctcgctggccgcagtcttccgcgcctcggggcgcgaggccttcatcgcctgctcggtgtagagcaaccccagccgcaggctgaactccatgttctccgggtccttttcgaccacgcggcgcagctcgcgctcggcggcggcgaagtcaccttccagttggtacacgagcgccagcttgcctcgcatagccacggcttccggtgccagtgcggtggccacggtgaaggactcgcgggcggccgtgaggtccctgcgctccaggtggatgtcacccaggtggaaccacgcggtctccagcagcggatggagcgccacggctttctcgaaggagactcgggccgcgtcggggcgctggcgcgccaggtagagctcgcccagatagaagtggttcttgccgtcgcggggggcgcgttcgatggcctgcttgaactcatccaccgcgcgacccgcgtcatccaggcgttggtaggccaggcccagcagggcgtgcaccaccgccacgtccgggtagtcgagcaggatctcctcgaaggcgaggatggcgtgttggggcgcatccaggtccttcagatagcgcatgccttcttccagcttggcctcggcggccttcgggaagccggagaacggatccgcgatctgctccatcaatgcccgcgcggtggtgacgtcggccgccgtgggctggccccgcaccaccgtgcccagggcttccacggctccgggcgcgtctcccgtgcggtgcagcgccttggccaacggcaggcgccaggcggtgcgggctggctccaacgccgtggcgcgtcgcaggggcccgagcgcctccgtgtactgttcggactccaactgcgcgagccccagccggtagtggaactccgcggtgtccggtgccagggtggcggcgcgctcgaaggcggcgacgctgggcgcccccgcgtcgcgagcgcgtgagaagagggcgaggcccagcatgtactggtcgaccgcgcgctcacccgccgcgattcgcttctggagctccgcgatccacgcgtccgtctgccccgccttcacgtaggcctcggtgagcgagcgcgccacgtccaggtcgtccggcgtctgccggtgcaggtccgtcagcagcctcagggccttcgtgggctgatgctcgtccaggtaggcccgcgcctgggagagcggatcagtggggcgcgccttggcggagttggaggaggtggtgctgcaaccagtcaggaggcccacgccgagtaccgcggcgcgaatccagggacgggaacggaggtggcgaatggtcatctcggagaggcgtctcagggggaggagagggctcgggcgcgcgcgtctctgacgccctcggcgcccgcggcggccacggcgtcatccacgtcgccgcccttgcccccgagggacaggctgtccgcgatgatgacggcgcggacggctcgggccagcccttcgcggtcgttctcggccaacgtggtcgtgtcgatgggcttgccaatcttcacgcggatgggaccgggggtgatgttccaggtggacttgggcatcaggtcgccggagccctcgatggtgacggggcagacggggacgcgggccttcagcgccagggcgaaggggcccttcttgaagggcaggacgcggccgtccgtcgagcgggtgccttccggatacaggaagatgctggtgccgccgcgaatcttggccgctgccgcgttgagcgaggcgatggccttggagcggttggaccggttgatgaaaacgtggcctgcgagcgcgaggtaccagccgataaggggcacccacttgagctgcgtcttggcgacgtagcggaaagggatggggacggccaggaagtgcgccgggatgtcgatggtggactggtggttggccacgtagatggtgggccgattcgggtccacgttctcctggccgatgacttccagcttcgcgccccctgcccacagcagcacgggcgaccagagctcgcgcgccacccagacggagcgcgatgggttgagcgtgagcagcatcgccaagatggcaagggggaaacagaagagcgtccagacgcccgccacgaaaatgcaaaagagcttgcgcatccctcagcccgcctcctgggggccgatgttcagggccggaaggtgcccgggcccgcgggcttgcccgccgaagctccctggccagacggtcaggcggcgactcccacgagggaggacggcggcacctgtcacgcgttggacgggacgacgggggggcatgcacttcttctaccacgtcctacctacacgttgtttctggtgcgcgccgctcggcggggttacaagcaggggtggtgtggccaggaaaaagttcatcgccatcgcgggcaacatcggcgccggaaagacggagctgacgtccttcctctgccggaagtacgggttgacgccctccttcgaacccaacgaccagaacccctatctggcggacttctacaaggacatgaagacgtgggcgttccgctcacagctcttcttcttgacgcacaagttccgcctgcaccgggagctggagcgcacctcggggacggtgcttcaggaccgcaccctctatgaggacgcggagattttcgccaagaacctccaccggcagcggctcatcgacaagcgggactggaagacgtactgcgagctgtacgagacgatttcggagtcgttgcggccccccgacctgatgatctacctccgctgcccagtgcagacgattcgtgagcgcatccgcatccgtggccgggccatggagcgggacatccccacccgctacctgcagcgcctcaatgccctctatgaggagtggttcgagggctaccgcctgtcgccggtgctcgtgcttcccacggacaagctcgactatttgaccaacctggtggaccgcgtggacctcttccggcagatcgagaagcacctgtgatggaggtctacctgctggcgacggagcaggagggcccggctcccctcgatgcactgcgcacgtccttcgcgaacgatgaggtggagttcaccccggacgcggacggcgagggtttcaccctgcgggcggacggctccgaggtgctggtgcgtctgacgcggggctccgagggactgccgcgcttccgcaaggaggtgttcagcggcagcccggatgccttcgagcggctggggcgcgccaaggcctactaccacctgtccgtggagccgggcggggcgcagcccacgctgcctgttttcgaggccctgtgggccgtgcgcacgctgctggagcacgtgcagggcgtgctggtggacctcaccgccttcaagctccacgagcccgacgacgtggcggaaatcacggagctggacttcgacatccgcgaccatgtccacctccatcccgtggaggcgacggagggggacacgcccctgtgggtgcactcgcacgggatggagaagttcggggcccggcccctggaaatcttccacctggccgagaaggacctgctggccgtggagagcttccttcacgagctgtgcaccgacctggcctttggacaggggccggcgctgcgcacccaggtgggtaccagcgaggggcaggtcttcacgctcgtgccctcggaagaggcccgcgccaacctgctgggcgtccccctggacaccttcgagggccatgaggggctcttcctcaccgtggtgtccccgctgggccggcacaacacgtcccagctcctggagccctaccgtgagcgcttcgagaaggagccggaggagcagacccaggccatgcggcgggaggcccaactggtgctcccgtccttcctggcgcgcttccagcgcaagggcctgatggagccgctcaccttcctggtgcgtgctcctttcgatacccatcccgaagggaacaccgtcacggagaacctgtggctggaggtcatgggccgggacgagggctccgtggtgggcaagctcgttgatggcgcggtgcatacaaccgagtggcgcaagggtgcccacgtagaggtcgcggagacccaggtcaatgcgctggccatcagccgggaaggccgggcgttggacgagcgggaactccgtgaactcctgaacgccgaacggccgatgtagcaagcggcgccgggggccttgcccagccatcgcggggcgctaggctccgcgccccatgcccgccctcctgctgctcaccggtccttccgcggggcgtcgtcacgacgtgctcgcggaggcgacgattggccgcagtccctcgtgtgaaatcccgctggatgaccatcaggtctcccgcaagcacgcgctgatttccgttctcgacgggcaggcgcgcatccgcgacttgcgctcgcgcaacgggacgttcgtcaacggcgagcgcctcgtggatgaggtggtgctcaagcccggtgaccaggtgcgcgtgggcgtgacgacggccctcttcgagccgcccccggtgaccctggtggccgatgggccggagaagatggggcaggtgcccatcgaggaagtgctgcctcacgtgggcgcggcggcggcgatgtactcggcgggcatcgccctgctgggcgcgacgagtggcgccctggtgctgcggcgcctggcggatgaggtcgcgcacgcactcaatgccgaccgcgcggccgcgctgctgggcagcagtgatggcttgctcaccgcggcggtggcgggcgcggaggcgctgacgatgccgcgcgcgctggcgcaggccgcgctggagcgcaaggagttggtccagacggatgacgtcctctgcgcgcccctggtcgcctcaggcggcatgcccttcggcgtgctgtacgtgacgcgggcggagccgaagttcagtgagggcgagggccagttgctcgcggcgctgggacggttggggggcgaggcctacaccaccgtgcgctcccgcgtggatgcggagccgcccgtggccgcgctctccgggacgtcccggccgctgcgggccttgctggagctggcgcgccgggtggccgccagcgccgcgccggtggtgattcatggcgagccgggcgtgggcaaggcgctgctggctcgcttcgtccatgcgcgttcgcctcgggccctggggcctttcatcgtggtggactgccgggagccggccgatgccgtggaggaggcgctgttcggcagggccagcgcgcccgggcagccgcctgtcgtatccgcgctgctgcgcgcggatgggggctcgctggtgctgctccacgtggagtcgctcgcgcggcctgcttcggagcggctggcgagggccctggcgcgccgttcagcgcccgcgcggcaaggcggcgaggagcccgtggacgttcgggtgctggccaccgcgcccgcgtcggtgtcgttgctggcggcgcgcggcgacgtggaggcctcgttggctcgggcgctgtcgggcttcgagttggacgccccgcccatccgcgagcggcgcgcggacgtgctgccgctgctggagcagttcgcggcgcgcgcggcccgccggattcgcaaggagccaccgacgctcagtcccgaggcccggcggctgctgacggagtacgggtggccgcagaacctgcgggagctggagctggtgggggagcgcctgggcctgctgtacgcggcgagccgagtgggcgcgctgcaactgcccccggagttccaggagggcggcgacgagggcgcgaagacgttgcagggacgcgtggcccggctggagcgcgatgccatcgccgaggccctgcgcgaggcgtcgggaaagaaggtccgcgccgcggcgctgctcggcatcagccggcccacgctggacaagaagattgaggagtacgggctcgcggtggagcgggggcgccgggagtgagtcaggccccggcgcctacgacttccgccggctgagcagcacgccggagaggacgagccccgctccgagcacctgcatccaggtgggctgctctccacgcacggcccacgccgtgagggcggccaccacggggatgcccgtgttgtagagccccgcgcggctgctgcccaccttctgcacggtgcggccccaggtgaagtacgcgagcaccagcggcaccagcgccgagtacacgacgcccgcccaggcgccggcgcggatgttctcggtctccagccgcagcagctcgggcacgcccacgagcaccacgcccggtgcgcccgtgagcatgctgatggcggtgatgcgcagcgcggacacctccggacccacggtgcggatgcccaccgtgtagatggcccagcagaggctcgcgccgacgatgagcccgtcgccaatcaaggacgctccatgttcggacgcgccgcgtccccccagcaccagcagcatccccaccacgcccagcgccagtgccgcgatgagcgggcgggtgagccgatccacgccgaacacggcgccaagcgtggccaccagcaccggcgtcaccgctgtcagcatcccgctgttcgccaccgaggtgttcgccaagccgacgatgaagcacacctggtacacggtgttgcccaccagcccgagccccagcagcttgaggaacaccgggcgcggaagcggcttccagccttcgacgccgaggagcagcgcgcccatggccaacgccgcgatggtgaagcgcagcgacatgaaggccaggggagggagcgtctccatcgcctccttcaccactgtgtagttggtgccccaggcaatcacgacgccgacgatggccaggtcggacgcggagatgccgcgtgagggggcgggcacaacggcggtggtgggcgtggacacggcggcaggggaataggcccgaggggtcgcgcgcgcaagccgacgtttggagccgggcatgctaaacgccagggcatggacctacgcttttcggaagaggtgcgccgcgcgctctagtccggccaaccgctggtggccctggagacgagtgtcgtggcccagggccttccgtatcgggacaacctggccgcgggcccgggcgtgtgaggaggccattcgtcgcgctggcgcggttcccgccgccaccgccatcatcgacgggcagttgtgcgtcgggctggaggagccggagatgcgccggctggcggagggcaaggaacgcctgctcaaggtggcgtctcgggacttcgccgtcgccatggccacgcgcgccacgggaggcaccaccgtgagcgccacgtgtgagatggccgccgccgcgggcattcgtgtcttctccaccggtggtattgggggcgtgcaccgcggggcgtcggagcacttcgacatctcccaggacatcgccgcgctggcgcgcttccccgtcgccgtggtgtgcgcgggcgccaag

SEQ ID NO: 1049 - DNA, 10182 bp, Myxococcus xanthus
ccctctgaggccagtgggttggcccctcgtccgtgggccgttcggagggccggcggcgtgcgcctcgcgtggcggtgctagcgcacgttgatggtggtgcccgtgctggcctgccgtccgtcctcgctggtggcggtgatggaggcggcgacgggcacgcgggtcatgccgcggtcggtgtcgatgtagggctccacgaacgtctggtccgcggggatggtgaccgtgggcatgctgatgcggcgggtgggcgattccagggcgacggtgacggggccggtgaagccctccgcccgcgtcacggtgatgcgcaccttctcgttctgaccggcgaacaggtccaactggcgcggctcgatggtgacggagaagtccggctgggccacgggcggcggaaggatgacgaggaagatgttggcgctggccgcgaacgtctccgtggcgttggtggccatcagctgggcgcgcatcatgccccgggcctgcgtgtcctgcgccaccgagtaggtggcggtcgcggtgacgctgggctcgccttcgggcaggacgatttccggcgtgagcgtcacgccctcgggcgcattctggaggttgatgcggaacgcgctctggtcgtcgccctcgcgccgcacggtgatgtccaccggaaggctctcgcccggaatggcggtgagggtgtcggggaggtcaaaggcgatgcggaagaagggcccgtcgctgccgcaggacaaagcgagcgcgctgccgacgaggaacaggccccggaaaagggaccggcggagggatggggtcatgttcttgaatctcctggtgcgtgccagcatccgtccaccgtggcacccgggcaagccgctccagagcaggcgggctcagcggaacagcgcacgggccacttcataggtgcccacgtgcgcatcaatcgtggcggacaggggtttcgcgtagccgccgcccagggtgagcaccgcggggatgccccgttggcgtgcggcctcgagcaccagcctgtcgcgcgctctcagtccggcgtgagtgagggacagccgtcccagcgcgtcttccgtgagcgggtccacgcccgcctggaagaagaggatgcaggcgcccgcgctgtcgagcacctcgggcaggtgcagggcgagcgcgtccaggtatgccgcgtctcccgtgccgtctggcaggcccacgtcgaggtgggagggctgcttgcggaaggggaagttgttttctccgtgcatggagaaggtgaagacggagtcgtcgccggtgaagacggcggcggtgccgttgccctggtggacgtccaggtccaccaccacggcccggcggatgtcacgcgaggcctggagcacgcggatggccaccgcgatgtcattgaagacgcagaagccctcgccgtggtccggaaagccgtggtgcgtgccgccggagaggttgccgccgatgccgtcctggagcgccgcgcgggcggcgtcgagggtgcccgccaccgcggcggagaagcgccgcatcagctcgggggaccaggggaagccgaggcgccgttgctcggcgtcggtgagggtgccctgggacagcgcgtcgaggtagcggggcgtgtggacgcgcgcgaggtcctggcgtgggcagggcgtggattcggtgagggattccggggtgagcacgccccgctccaggagcgcctcgcgcagcagccggtacttctccatggggaagcggtggccgggaggcaacgggacttcgtagctgtccgaatggaagacgcgcacgcggaaggtgccctaactccagggccgggcgggtgcaaccggcggcgcgtgtgagaaatcgaccgggggcgtagacccaggggcgaagtcattcgtttcgaacctcgccgtcgtccttccccttggagaacgccatggaccgcaagtccctgtcgcgcgccgcgctgtcggccgcgctcgtcaccgctctgtccgctgccctgtccctggccgaggagagcccgattctcaagcccgtggagaagcccgcgcccgccaagacggcgacgccggccgctcaggcgaagcccgctccgaaccagaagcccgcgcagccggcgccgtcccagcagcagcaggtccccgccgccgcccggccggagattgaagtggtgttcgtgctggatacgacgggctcgatgagcgggctgctggagggggcgaagcggaaaatctattccatcgcctcgcgcatcgcgcagggccgtccgacgccgcacctgaaggtggggctggtggcctaccgcgacgtgggcgacgactacgtcacgaagcgcttcgacctgagcgacgacctggacacggtgttcgccaacctgcgcaagttcgaggcgggtggcggcggggatacgcccgagcatgtggggcgcgggctgggcgaggccgtgtccaagctgtcctggagcaagaaccgcgaggtgatgaaggccatcttcctggtgggggacgcgcccccggcgcagcgcaacgacgactgggacttcaagcactgggcgaagaaggcccgggagaagcacatcgtcgtgaacaccgtgcggtgcggcggggatgcagagacggaggcgtcgtggcggttcgtggcgaagctgacggacggcaccttcgactccattgaccagggcggtggcatggtcgccgtcgccacgccgtatgacgcggagctggcgaaggtgaacgcggagctggccaccaagacgctctacacgggccgcagggaggtccaggcggagaacatggcgcgcgccgcttccatgggggcgctggcgccggaggcggcggccgagcgcatcagctacatgaagaagacgcgcggcggtggggccgcgggagcccccgcgagcagcgcgcccaaggcggtgggcggcgcggtggacctggtggaggcgccgtccgcgctggatggcgtgaaagcggacgagctccccaccgagctcaagggcatgtccaaggaggctcaggtcgcgaaggtgagggcgctctccgaggagaagaaggcgctggagaagaaggcggagacgctggccgcggagcgcgaggcgtggctgacgaagaacgctcccgagaaggaggacgccttcgacgccaacgtgatgaagggcgtgaaggcgcaggccgcccgctacaacatcgcctactgagcgtcagcgaagcgggggacaggaagccgcgggcgcgcttggaggcgtccgcggctttcgcgtgtcaggcgtgggcgcgcaggaactccagcagcgccggattgacggcttccgggtgcgtcatgttcgccgcgtgtgcggcgccgggaaccgggacgaagcgcacgctgccgggcagcgtctggtgcaggtgctcgccgtggaccgggggcatgccgtggtcctccagcccgtggaagacgatggcggggcagcgaatctccgtcagccgtccggagatgtcgtcccggtcgatgagcgagcggatggcgttggcgaagtgtccgccggggatttgccgccagcgtggcagccaggtgtcgaagtagcgcgtgtccccgatgatggcctgtgccagcccctgcaccagcgggtcgatggggccctgcgtctcccagatgtcggcggactgctggtaggcggcgcgggtgggtgcgtcgtcgttggtgccccgggtgctcagcagcaccagcgcccggacgcgctcggggtgcttcagcgccacgcgcagcgcgctgtatccgccctgggacatgccgcccacgacggctcgctcgatgcccaggtggtccagcagcgccacgcagtccgcggccgagtcccacggcgtgaagggcttgccgtcccagcgtgtctgcccgaagccgcgggcatcccagcggatgacgcggaactcgggagcgagcgccgccacctgcgcgtcgaacatccggtggtccatgaggaagccatggcccaggatgatgggccggccgtttccaccggagtcctcgaagtagattccctgtccattcagctcggcgatgggcatggcccctccgtctatcacccccgggaaggccgcgcgcgctactcccgcgtcaccgcctggagcaccacttcacgccgccgctccagcagccgcagcgccaggggaagcaccccgcgatacagcgccacgttcaacgcggcggccaggagaatcatcgccgccgtgtgccacgtgggcccttccttgcccgccagcttgagcgcccagccgaagggcatgcagcccgcgctggccgcgaggatgcccagcatggaggccgtcagcggaaccttgtcccgccgcttgaggctcgcgtggaacttcaccgggaagtacagcgacaggaagttgcccgcggccagcagcatgggcaccacggcgcccacggccgccatggcgcacagcatgtccagcccggtgccgaagccgaagtacacccggtagaagagcgccaccattgccgccatcccgagcgccgccgcgccctgcacttgattcttcgcgcgcagcacgtccgccaggtccaggggcgccgccaggaaggccgcgaagccctgtccgtcgtacgcgaaggtgttctgggagaacgtggacgcaatcaccaccgcgccgtagatgcacaggccccccatcagccacgcatccgccgagccgcccaggaggaacacgaacaagtcccttccggacagcagcttcagcaggatggccaggatgaagggcaccgacgccagcagccgcgcgcgcgggttgcgccacaggtccagggcctcgcgcgtcaccagcgtggtgtagcgcgtccgcgtggtggcgaacgggttgctatcccccgagtccttgctcgagccccccgcgcggcccgcctgccggtgaaagcgcatcagcagcgcgtaggccaccgccatgcccacgcccgcgaagaagagcagcgccgccgcctcgaacatggccgcccggggccggtgccaggcgagctgcgccagcgcgtctccgaagagccccgggggcacgcggcccagcgccaccgccgcgttgatgatgagggacatgtccagcgcgtccacgcccgcctcgcccaccgccgtcagccacgaggtgtcgatgggcggaatgaacgacgcgcccaggaggaagagcgccagtcctccgcccatgatttccgcgctgtgcttcgcccgcagcacgttgatgacggcgtacagcgccacccggctccaggccgcgcacaggagcgcgaagaggacgtagaggaccaccgccagccacggcatgtacagcacatagacggacgcgaagcccagcgcggccccggtgagcggcgcgtagaagacgagcgcgcgcggctcgaagaggctggccaccgtcgacgcgatgagcagccggaagggggagatggggaaggcggcgtagcggctcagctcggagtggtcatccacacccgcggacaacagcggccacgtcacccacaccgagaaggtgacgaagcacagcaggttgaggatgaagtagggccacacgtcgctctccgcgatgggccgcagccgcatcagcgcgaagaacgtcaggcccaggaagaggcccggcgcgctcgacgcggcgaatgcggccaccgccagcagccggctgcgtccggggccctgattcaacccgatgtcgaagcgcagcccccacagcagccacaggtgccggaagaagccgggcacggcggggcggctcatgcggtctcctggcgcagcggcgtcacggacgcgggcgcctcaccgtagaaggacaggcgcgcgttgcgcgaggccggtacggagatgagcttctcgaacaccgcctccaacgacgggcactcgtatcgcgacagcagcgagcccaccggcccctggtccagcatgcggccgccgcggatgatgcccgcgtgcgtggccagccgctcggcgatctccagcacgtgcgtggtgagcagcagcgtcacccctcggcgactcagctcgcgcaggagctcgcggatgacgccggcggccagcacgtcgatgccctcgaagggctcgtccagcagcaccagctccggcgcgtggatcagcgccgcggcgatggcgagcctccggcgcatgcccttggagtactccgccaccagcgcgccggccttgtaggtgagctccgtcagctccagcagctcggtggcgcgcgcggcggcctcgtcgccgtccagcccgtacatgcgcgcgcagaaggtgaggtactgccggccggtgagccgctcgaagaggctcagctcctccggcaccacgccgacgcggcgcttcacttccatgggcctggccaccgcgtccaccccgagcatgcggatggagcccgcgtcgggaccgtacaccccggtcagcaaggcgatgctggtggacttcccggccccgttggggcccaggtacgcgtagaaggcgccgcggggaatctgcaggtccaggccgttgagcgcgctgaagccgccaaagcgcttctgcagtccgcgggcgtcgaccgccaggtcatcagtgggagagggcatcatggaatgtcctccatctcacccgagcccggcaccgggggacaatccccacccgtcaacagggggatgcccgctggctcctacggtgccgtctcagtggacgagcgacatctccggcggaccggcaatctgctgcaccgtcatccgcaccttgtccaggtccacgggcttggagatgtagcccgcggcgcccacgagctcggcctcccattcgaagccgtagccggagatgatgatgatgggcagaccccgcgcacggggcatcttcttgagtgcgtcgagcaatccccaaccgctcatgactggcatccgcaagtcgagcagcacggcggagggcatgtctccctccagcaggtccagcgcctcacgaccgttggccgcttgaaccgtgggatagcccatttcctcgagtgcatcgcagatgagcgtgcggtggctcgcgtcgtcatcgacgaccaggatgtgggacatggcagggcctcggaagctgcggctgggtgtggcgccgcgaaattctatgggcaggatgatgggaactcctcttccattccggaaggggccccggtgcttttcaacagcgaacggcccgtgaggacgaggcttgcatccggagccggatgtccacggggctcacgctccgtacaactggagcgcattctgccccaggatgcccgcgagtaccgcgtcatccaacttcatccccagcatcgtccgcagctcacggtcccaggcgtaggggatgttgggaaagtccgtgccgtagatgatgcgctcgggccggacctccagcgcgcggcgggggatggggacggggaagtacccggccagggccatggtggtgtccagccagaggttgtcgtgccgctcgagcagccgcgcgtaggcgtcgaactcgtccgcgcccaggtggggcacgcacagcttcagcgtgggatggtccttcagcacgcgctccacccgctccgcggcgcagagcgcgtaggtgtcgcaattgtagtggggactggagggctcccgccccgcgtgcatgacgagcggacggcccgccttcgcgcacgcggcatacacctcgtgaaggtgcggcgcgtcaggtgagaagcattgaacgtggcaatgaatcttcaccccacgcaggcccgcgtcgaacgcctcttccaacacggccgtggcatcgggttcgcccgggagcacggtggcgagccccagcacacgaggctcttcccgggccacctccgccacgtaggcgttgagcgcgcgggccatgcctggccggtgggcgtaatgcagcgccaccacccggtggacacctcgcgacaggaggaaggacacgacctgtcgcgtgtgcagcttgtagcggatgggccagccgtactggtcgaaccagcgccacaccgcgtcgaacacccggtccgggaagaggtggacgtgcgcgtccaccacgggcggcagtccttcgggcaggcgagggccctccgtgtcctggagggcgggcatgggcatgcggatgccggcgtcccgccacgtgggcgcggaggccaggcaggggacgggcacgtcagcgtcggagtcggtggccatggcgagccacccgtctacgccttcttggcggtgtcgtcctcgtcgccgtcggtccgtcgcaggtaggtgttgtgcggatacccctggcgggacagccgctgcgcctcgatggcgtctgcgaccttggcgcagacctggcccagcatgcgcagcgactcggcgaggagccgctcggcgtggtcctgcgcgtcggcagcctggatggtggtgcgctctttgcggaacagtccgggcagcttcatctcccccaaagcataggtgacgcactgctcccgtgccaccgccccgcgaggccggccttaaccacgttgacggcccgctcaatttacatttttgagcagttgccctggctcctcgcctggatgcctgccagttgtgcttgtaacctcttggacttccaggcttttgacgaattttcaagtagggggatgacacggagttaatccggccctacattcgattccgttggatttacggcagaggagctgcgcatggcttacgacggcgagctggtgaagatggagaacggtcgctgggcgcggttccagcggtgccaggtgtaccgcccgggcgtcgaggacgcgggcgagacgatgctgctgatcgccgtggagctcgatgagcgctatcagcgccagctcgacgaggcggctgactccctggctcagtaccgctatcagggcgttcccgtgcaggtccgtttcgattcgggttcccagggcatcactctgcagcccgagcagacggtgtccgcacccgcggtgcactgagcgctgactccgcgtgagcggagtgtcaacgggttgacggattcacaacccaaggggcctcgcgattcacatcgcggggcccttggtttttacaggccctgacgagcagcgtcaggcgtcgtccagccaacgggtatacgcctcgaagccgtagtccctgcccaggaatgaccggaccaggtccgccgcgtcacgggagccgcccggccccagcacggcgtcccggtagcgctgggcggtggaggtgtccatcagcccgtgctccaggaacggtgtgagcaggtcccgggcgatgacgagcgaccagaggtaggcgtagtacgcggaggagtagtagccgtcgagctggacgaaggagagatgggcgtaggtgtcgtccactgcggggaagggcatgtagcgctcctggagcgcgttcacccgcgcggtggtgtccacgcctgcggggtcgctcgcatggagctggaggctgacggccgcgtagaagagctgttggcgaagccacagtcccttgccgaaggcgtccgcgcgccgcatccggaggatggtctccgtgggcagcaactcgccggtgacgacgtgccgggcgaacgtctggagtgactccgggcgccaggcccactcctccagcacctgggcgggagcctccacgaagtcacgctccgtgcgcgagccggacaggccggcccagcgcgtccggccgccgaggacgtggtgcagcaggtggccgaactcgtggaagaacgtctgcacctgggagtgctggagcagcgcggggtgggcgccgggacgcgggaagttgcctgtcagcacgccttcgggaagcgtcctgcccgcgcggccggtggccaggtcccactgcgccggatgggcgtacttgttcgggcgtgggtgcatgtccaggtagaagcgccccagacgcgtgggtccctcgtagatgtcccaggcctcgatgtccgggtgccacaccggcgcgtccgggacgcggcggtaggtgagcccgaagagccgcgaggtgatgtccagcacgccctgcttcacccgcgtgtattcgaagtagggccgcaggtcgcgcgagtcgaagcggtaacgctccgcgcgcacctgttccttgaggtacgtctgctcccacggctccacgtgggacgcgccgggcacgtcgcgccgcttgcgctccagcagcgcggtgtagtcgtcctgcacgcgcgtggtggtggcggtggcgagctgttcgatgaagtcctcggccacgtgctggtgccggaccatcttgtcctcggacgcgtaggcggcccagtctttagagcac

SEQ ID NO: 1050 - DNA, 9165 bp, Myxococcus xanthus
ggtgcgcagcatcgccgaggccgtgagtcagcaggacgcgggcatcgcggagttgttcgccgcgctcagctcgatggccgacctggcggaccagattgtcgaccggatggccgcgagcgagcagtccgccatccagctctccgcggcgtccgctgagctgagcgctatcgtcggccggtaccagctctagcgcgcttatcggcctggggctcgcgcctgagccgccgcgccagtgggcttcgtctggcccgagcgggaattaccgccgcccgcgctcacccagccgctggaggcaggctcagcgggcgccgtcatgtcgaaggcgcggatgctcatccgctgcgtccagtcattgctggcattccagttcgtccaggcccccagcaccacgcgtccccggtgcagcgcgggcggggtgatgtacggcgcctttcccagcagcgcgcaggcggacaactcgttcccgtcctggtccagctcccgcaggaacgaaccgagcgcggcttcctcaccggtacaggcgtgctcgccgcacgtctcggccactggccggtccaccagcagcagcgagccacgctgggtgagaagcggtgacatcggccaggtgcccacggcccggtgccagcgcaccgcgccgctcgagggatccagcccatagaggaacgtgccccccggatgcgtggtggtggggcagccctcggtggtgcaccgcatgtcgggcaggaccaggagccggtccgcctgcatcgccgtgcggccgaaggtcgaactggagcggcccagcgagtaatagaaggactcagcggaggcggtcgccagcgtggcgattggcgctcccgtggccgcatccaccagctccgcgcggcccagcatcaacgtccctccgtccacggccgtgggctcgagcacgcccgtgcgctgcgtccgccagcggagctgcccatccggcgcgtacgagaagagctccgtccgctgctccaggacatcggaggcgccgccatagacgttgccctccgtatccaccaccagcggcgcatggacgggcggcacgggctccttccacgccaccgcgccggtctccgcgtgcaccgcgacgagcaagtcctcggggcccgcgtctccaaacatgtcgtgtaccagcgcaatcagatagggcgggctgagcacgagcgatgcgatgcgaagcccatggtgcgcctgcgggtcttcgtccttcacggcccctagcgacacgctccagcgctcctgtccggtggtgctgtcccgagcggagagcagggccagccggcctgtgacgaagagctgtccccccgccaccgtgtgaacgccccaggctcccgggggcggaaggtcgcgccggtagcgctcggtcccttctgacgtgacggagacgagctgacacgccaactggctcgggtccttgtccacccaatagctgctctcgcactccgtccagtaggtgtgcccgtccccgtccattgccccccggaagtccactgtgcggttccacgctgcgtcgtagctccacgcgagtcgcgccgtgccatccggtccggagcacgccgccgatgtcgccgggggcggcacctgcggctccggtgtgggctcctgcggagcgggcgtctcagctccaggggtgggcgtttgcgttacatccgcgggtgtctcgacggggggcgccgctccgttctccacggacgacgaacagcccacccacagacacgcgcccagcaccatgcttcgcagtccactcacgcccacctcccgattgctgaccaccgcgcggctcgtcaccggggtggtcgcgcacagtggggatgggattcccgctgcgcaacgcacccggccacgggtggcggccgggcaggcagtcaggcggaatgggagtgaagtctcagcccagctcgccaccgtcgatggcgtacgccgagccggtgatgccgcccgccgcgtccgacgcgaggaacaggcacagcgcggcgacttcctccggcgtgatgatgcggcccatggcgttcatggacgcgagggcctcgcgcgcctgctcctcgctgcggcccgtggaggcgctgatggccgaggtcgcaccggcgaacatgtccgtctccacccagcccggattcacgatgttcaccgtgacttgcttcttcgcgtactccaccgcgagcgcgcgcgtcaggcccagcagcgcatgcttcgacgcgcaatacgcggacgtgtacttcacgccccgcaccgcggccatggagccgatgttgatgacgcgtccgccgcccgcctgggccatggccggcatcagctcgcggcagaggaggaaaggcgccgtcacgttgacggccatgacgcgggccaggtcttcggtgcgcgtcttcgccaggggcgcggagacggtgatgcccgcgttgttcacgagtacgcgcggaggaccctcggcgaggattcgctggctcgcggcaatcagcgccgcttcgtcggccacgtccaccgcgagcggccggatgcgctcgccgccttcctgccggagcgactccagcgcttccgtcgaacgcgccagggcccacacgtcatggcccgccttcgcgaaacccagcgccaccgcgcggccaatgcctcggctcgcgcccgttaccaccaccgtcttggaggtcgtcgtcatgagaccagcctagcgccgggccctcatgctggcagcaggacgtgccgaggccgcgtggcgctgccgtcacgggcggcatcgccaccctccccacatccacgagggacggggagggtgggaagacgccggtgtccgactcagccgttctgggcttcttcgctgctggccttcggctcggtcggggccgcctcgccctcggacgcagtctcagccgaagcctcggacgcagtctccgccgaagcctcggacccgccttcgggctcgtcgggcagctcgggcgcggtgcccgcggcctcggcggcctgctgggccttgagctcctcgtcgttcatgaagccgacggggttctccttgcggttgaggaagcgcaccgacttcttcgacagcgcgaacatctgctccgccgccgacgaaggcaccagcgagtgctcgatctgtgcgggctcggggcgctccaccacgcccagctcgccctcctcgagctgcttcgcctgcgccgggctcagctccagccggcgcagcttgcccttgcgggtcatgaagtagaacgccgtctcccccgcctcgacggggacctgggagcccagcaccagctcgcgcagggcgcggtccagctccacctgccgcttggactcggcgcgctggtaggccttggagcccggcatggggggcagcttggggatggcccgctccgccgccgccgcggccggccgcccgtgctggggacctccgccgtgccggggggcacctccgaagccgccgccaggacgtccgccgccctcacgacggccggcgtcacggccgccactcggacggcctccaccctcgcctcggggcgggccgcctggtgtccggttgtcatcacggcgggggggaggacggttgccgcttgaacggccgccctcctggagtccgggccgccgggcttccgcctggctgggcttcgtctccaccttcttggcctggtcctcggtgacgaggcccgccttcaatagcttgtcgcgcaggttctgcatgagttgggcgttctatcccttgcacggccgcacgcaagccactgcttgctgctcgtgtatgccccacgtaacttgccggccttgtcgtaccctcccggaggagtcgtgagccgtctgaagaagtccgccttcacccttgccgtggcgctggccgccgtcggctgctcggacccggtcgacaaggcggccaaggcacgcatcttctcgccggaagacccgcccaaggtggttgcgtccgcgaaggaaaagctgccccccgaggacgtcgcggacaacccccaggtggcgcgccgcatcctgggcatggacgccgccgaggtgaccgagcgtctgggcccccaccgctaccaggcgacgctggggtacgagtggacctccgaggcctccatccccgtgaagctcaccgagacgcgcaccttccgcgccggccccggcggggtcagcggggatttccacggcgtgctggagaactcccgggaccagggcctggaggtgatgcgggtgggtgggcaggtgttcgcccgcaaccggtatggccccttccgccagcgcctgcgcgaccgaggcatggccgagcgcacccgcgcggagctgaccggcgccatccgcgacttcgacagcctcttccaggggcgcatcaagctgacgcccgagggcaccgtcacccatgagggccgcacggcctggcgttacgtggtgacgctggcccccgccgcccaggcggacgcgtcccggcccctgccgcccacgccccaggccaagaaggggggagtggacgagacgacggtccgccgggccaacttcttcgcccaccgcctgccgcgctcgctggacggcgaggtgctggtggattccgccacctccgtggtcctcaaggcccggctggacgggcgcatgggcgtgcccggggacaagacgcccgaggcggccgagctgcgcctgacgctggaggccgccctctccgaggtaggcaaggacccacggctccagccgcccgaggatttcctcccggacgcggacaagccccagggcatcgccgatgcgctcgacaccttcggtatccagcgcaagaagccctcggactcggattcggccagcccggagtctgccccggagcccgaggacgaagagggcacctgacggggttccggcgctctttccgggcgccgttgcctggtgaacggctggccgggactccggggtatcccggacgggggtggagggggctgcgctacatctcggcagcgagatgttggaagaaaatttgcgctgactcttgcgtcctctagaatcctcgacggttgcggcccggacgcgtccgacatgctcggatgttcagtggggcttcacagcaagggagcggcgatggagcgcaaggtcggaagtagcacggtgacggccaaggaggtcaaagcggcgctggagaaggcgcgtacgctgtcggccgaagaagagaaggtactgcgcatgcgccacggtgctggcgcttccagcacccgtgcaccgctgccccgtgccgccggtgacaaccaggagctgggcgacgagctgctcctcatcgagatgcagctgatgaaggcgatgcgcgctcgcgcgggtggcaagcccgcggccaccgccagcagcaagcccgtcgccgccacgcgcgcgcgggatgccgccgccaatcccaccaaggacaagattgtccgggcgctccgcaagaagaagtagtcgtcttgcgggtgtcccctaccggttgaggatggccacgaggcgctccccggcctcgggcaacgccaacggcgtgcctgacgtctccgtggccaatccttccgcatcgtcagtgcccccacgcgcgtacagccccttcaaccaggcggcggccgcggggttcctccaatagtcctcgttgaactgctccgtgatgcgcgcggtgagctgggtctccagggcccaggaccgcaggtagtgcgccacgtacagttgcgggtccacgtcgtggaggaagaaaccagggtgtggctcgacgaagagcgcatggcgctgcccgtcggcgtattcgtccgcgcgttccgtggaggcgccccgctgcgtgagggacagctcgtaggtcagcttggccgcgtgacgccgcagcagcgcaagggcctggaaggcggccagtcgcaccgtgtcccgcgcggccacggtgggcagtcccaggtagcgcttgagccactcgggggacaggagcagccgttcgaagacggcggcgtgggcctccgtcacggacgcgtcgcccagccggcgcagctccatgggcagcgtgtcggagacgtgggcgcggtgctgcgcgtggcccatctcatgtagcaggctggccagcccgtcgatgccgcctcgcggctggagcaccaggcggatgtcgtctggcacgcgcaccacggcgacgaaggggcgcggtgacttgccaggccgggcctcgtcgtcgatgcggatgcggcctccggcgttgggcgtcaggccccactcgcccagccagcgcaccacggcggggaaggcgtcctcgcgccggaagaggccgcccatccacggtgcttgaagcgcggcctgcaggtcatgcctgcgggcctctccgccgggcagtggacgcagcagtgggtccaccttcttgaggacgtaggcgagcacgtcgcggtaggcgtcctccgtgcgcgcgagcatcgtcgcggcggactcggccagtttggcgaagtcgatgccggtgacgtcctggcgcagggcggggtagttcttcgcgcccaactgctccgcggtgtgcagggccgcatcgcgccggtcaccgtaacgggtgcggttctgccagaggaactcgccggtggcgcgctccagcagggcgcggcggccccgggcggactcgtggggaatgcggcccagcgcctcgccgaaggagtaggtctggtcgtccaccatcagccgggcctgggcctccagcgaggcaatggcctccacgtgacgggcggcgagcgcgtcctcgacgtgcgaggccaccagctcacgcaccagtcggatgcggcggacggtgaggggctcgttcttcgattgggccttggcgagcgcctcgttggcggcggcgaaggtgtccggagacgacagctcggggaaggcggcgtggagctggctgggggaaacatccagcgcgagcccggcgccttgccggtagttcagcgtggcgagctcggcgaggaagtcgtccagccgcgtacggacggagtgcaggggacggtccatgggggcgcggaaggtaacaggaagcgggcggcgcggaagggcgatgcgcgcgtagagtgccgccgcatgacatctgcggtggacagagggagggggggcggcgtgccggagcacgtggcgcatggcgcgggctcgtacgctgaggctgtccgcccggtgggcgaggtggcggcatgaagcgccggacgttccgagtggaaggggcgttggtggggaaggccgtggcccgtgcggtcgcggatgagttgggactgcccgagcccggggcacgggggctggtggaggtgggcgccgtctacgtggcgggcaagcggagccgggatgcgaatgcgcggctgacagccgggcaggtggtgacggtggtgctggaggagggcgggcagagccccctgtccgaggcgccccccgcgcccgagctgcgcgtgttgtacgaggacgcggacgtcatcgcggtagacaagccggctggcgtgtccgcgcagcccaccgaggggcgcgtgggggacagcctggtggacctggtgggggcgaagctgggacgccccgcggggctggtgcaccgcctggaccgggagacgtccggcgtgacggtgttcgggaagacggcggaggccacgtcggcgctggcggccgagttccgggagggacgggcgcgaaagcgctacgtcgcggccaccgggccgggtttgcccccgtcgggcacggtggacctgccattgtccaaggacccgtcgcgccctggccgctggcgggcgacccgggcggccaatggtgtacccgcgctgacggacttccacacgctgtcatcggggccggcgttctgtgtcgtcgagctgctgccgcacacgggccgcacgcatcagctccgcgcgcacctgacggcgctgggcgctccgattctgggggatgcgcgttacggcggcgcggcccgggcggaaggcgtggaggcaccgcggtgcttgctgcatgcccaggccctggagctgggacatccgcgcacgggcaagctgctgcgcatcgaggcgccggtgccggaggacctgatgcggttcttcctggccgctggcgtgccggcgccctcgggggccattcgcggcgccgagtgagtcctcacgccgcgcaggtgaagtcgcgaccctccacccagccccgtccgatgaggtcctcgcgaatctccgcgcgggcccagcggacgcccacgcacaccaacaggtgtccatccccgggggcgccgagctcctggggagagatgaccgggatgccatggatgcgcgtgcccaccttgcgagggtggacctccacgtagcgccgcacgcggacgccttcctggtggaggaagtacgtcagcgtcttgccgctcgggcccgcgccccacaccgtgcaggggcgcccgtccgccagggggccacggcctcgcgtcaggtagcgcgccttcgtccacatgaagcgcttgacggcatagcgcgggtccgttcgcgtcatccgcccgtcgctgtcgcgccagcgaagcaatacctcgggcaggttgcgcagcccgaagccccggtccagcagctccagccacagcgcgtagtcctccgggaagtcgccgtcccgccagcctcccgcggccaccagggcgtcccggcgcaggcagacggaagggtggcacagggggctttcgatgaagcgctcccggtcgagtcgctctgcggaggtgagcccgctgagccacatggcataggcctggagcgaggggctcacgggtttgtcatcccggaacagctccacggccgtgcccacgccggccaacccgggttccgcctccagggcggtgaggcttgcctccaggcgtttgggaagggcctcgtcatccgcgtccatccgggccacgtagggggaggtggcttcacgcagcgccaggttcagcgccgccaccaggccttggccccggccgtcaaggacttccactcgcgagtcgctcgccgccaggtcggtcagcacttcacgcgtaccgtccgtggagccgtcgtccaccgcgaacacgcggaggtcgcggacggtgcccgtcaagaggctgcggacggcgcgggccacagtggcttcggcgtttcgcgcggggaggaggacactaacagccggaacgggcatcgttgtgtgtagactgctgcacccatgggtggcgtgagaaacggcaagagcgccggcacgccggagcccggagtggtccgacaggaggagctgcaccccgggatgcccgac

SEQ ID NO: 1051 - DNA, 15271 bp, Myxococcus xanthus
tctcaggggcatccttcaccgcgcctcgcccgccaatcaggaggaacacgttctcgaacaccacccagccgatgtgctcccacgctcgccaggcactggcggactccacgccgaagatggacaggggccagtactggccgcgaagcaggtggtccaccgccaccagcgccgagtagaggaacagcacccgcgcgtcccggtacatggccagcagcgccagggacccgaagatgtggaagtgcgtctcgatgcgcccgtccgtcagatggatgagcagcccggacaccaatgcctgcgccgtggcgatgacgaagcgcgtgacctcccgacccggcaacgcccacgccatggccaccggcaggctcgccaggagggctcccaggccggccgccgcccagacgtgtggatggacctgactggacgtcccactccacgtgcggggggacagcgccagggccaccaccagcccgccaacccactggagccccatcagcacggcgaacatccggtccgtgcgacggctcagcgccacctggtgggtgtcgaacagggattgcgaacgtctcgcgaggacgtcggcatcgagcgagacgttcatccggcactttccgttgaggcagcaagcggggtcaaaacaaccccaaccctacccgctcaccacctcgaaacgtaagtccgaacagaatttttcgatgatgcccggattttaggactgccgggtatttcatgacctcgacactgggtagggcccgctcacgtctgagcccggcgggcggctttcttctcacgctcgcccagcgcggcctggaggtacttgcccgccagcttccggccaatcagctcctgggcaatctccccggcctccaccagccggtccaggttgatgcctgtgtccacgcccatgccgtggagcatgaagacggcgtcctcggtggccaggttccccgccgctcccggggcgtaggggcacccacccaggccgccaatgctggcgtcgaaggtcgtcacccccgcggacaggcccacgagcgcgttcgccagcgcggtgccgcgtgtgtcgtgcaggtgcagcgccagcttctccacggggatgtgcttcagcagcgcctcgaggatgacctcggtctggcgcggcgtgccgatgccaatcgtgtctcccaggctgagctggtagatgcccgcgtccacgagctgccggcagatgtccaccacgcgctccaccggaacgtcaccctcgtaggggcagccccacacggtggacaggtagccgcgcacgcgcatgcccgcctggagcgcggaggccgtcacctcgcgcgcgcccaccacggcctcggcgatgctcttgttgatgttcttcttcgagtgcgcctcggaggcggagatgaagacggcggtctcctccaggccccgcttcttcgcgcgctgcaggcccttgaggttgggcaccagcgcggagaacacgacgccgtcgcgacggcccaccagccgcagcagctcctcggcgtccgcgagctggggaatccacttgggtgacacgaacgacgtcacctcgatgcgcttctcccccgcggccaccagtgcgttgatgaggcgcgccttgtcccgcgtgggcagcgtgcgcagctcgttctgcaagccgtcccggggaccgacttcgtagacgtcgacctgcttgggcaactggcccagccagcccaacctcgccctggagtgttcctgcatctcagccatggcgccgctccgctcccacgatcaggtcggttgactgcgcgtccagcggaccacccgccaggccaccgtgcacccagacgacggaaaatcccgtgctttccaacagccgcacccaatccgcaaggggatagtaacgaagggaataggatgcgcgcaggcatcgaccctccggggaggtcagcgtccgacgtccctcgtcccgccccgtcgaggcgtcgaagcagctctcctcctccaggacgcttccatccggcagcgtctcgcggaaggccgccccgggggacgccgccagtcgctcgaacggcaccgtctggaacacccaccgtcctcctggccgcagcacgcgcgcgacctcgcggaggatgtggttgtgctcggcgtccgtgaaggcggccagcgtcgagtaccacgcgtaggcccccgccagggacgcctcgcgaaacggcagggcccgcaggtccccctggatcgccgggaagcccgggcgccggatggccaacgacagtgcgtgcaacttcagcccgatgacgcgccccgccagaggccccaccgcgttcagccgcgccgcgtggcggccatggccgcaccccaggtccaccaccggcgccggccccgccacgtccgcgaaggctcgggccaggtagtccgcctcacgcgcggtgacggcctccgacaggaacggcagcgtgctgcgaaggtagagctctccgaagaagctcatcgcggcgacaggcccgcgcgcaggcggcgcacggcttcgtccagcaccgcatccgtcttgcagaaggcgaaacgggccagcccctgccccaggtgccggtgcgccgggccatagaagacgctgggcggaatggccgccacgcccaccttggacaccaggtggcggcagaaggccacgtcatcggcgaagccctggcgcgtgatgtccgcgaggatgaagtagctgccctccggggcgaacgccgtcagcccggcctcgcgcagcccggtgagcagccgctcccgcttcgccgcgtaggacgccgtcagctccgtgaagtacgcgtccggcaaccgcagcgcctccgccatggcggcctgcagcggcgcggcggtggcgaaggtcacgaactggtgggcccgctgcaccgcgtcccgcagcggcggcggcgcgatgacccagcccaccttccagccggtgaggctgaacgtcttcccgccgctgctcaccgtcacggtgcgctcggccagcccgggcagcgtggccggacgcaggtggcgcgcgggctcgaagacgaggtgctcgtacacctcgtcggagaggaccttcacatcgaactcggcgcacagctcgcccaggaacgtcagctcatcgcgggtgaacaccttccccgtcgggttgtgcggcgtgttgaggatgagcagccgggtgcgcgggctgaaggcggcgcggacctcgtcccggtcgaaccaccactgcgcgtggtccgcgtccggcgggcgcagcggcacgaagcgcgcggtggcccccacgaaggtgatgttggcgtcgtaggagtcgtagaagggctcgaaggccaccacctcgtcgcccgggtccaccagccccagcagcgtgtcgaggatggcctcggtggcgccgctggtcaccgtcaccatggtgtccgggtccaccgtctggccgtagaagcgcgccgagtgctcggcgatggccacgcgcagctcccgggcgcccgcgcccatggcgtactggttgcccccgtcgcggatggcgcgctgcgccgcttccttgatggccgccgggccgtcgaagtcagggaacccctgccccaggttcaccgcgccgtggcgggcggccagggcgctgaactcggagaagacagtagtggcgaaccgggtgactcgctgcgcggctacgggcctggacatggacgtcggctcctcgcgccgccaacgtccgggcgctcagggcctgacgatagcgtccaccggcacggaacgcgcgtccttcgccacttcgcgctgccgggccgcccgggaaacgcccagcgccagccccgtcaccaccatgaccatgggcaccgcgcagagcaggtccgtggcgtagtggaaacggcccaccagcgtggcagcgatgagccccaggcccggcagcaacatcacccagaagacgcggcgggagaaccgccaagcataatacagcaccaacatcgtggcgccggtgtgtcccgacggaaagcagtcacgcgcgaacagcggcttgcgcatgagtgaatccagcagcggcgccagcgtgccctggagtggcccatcgaacgcgtcgaccaggaagtagcgaggccccaccgcgggcaccagcgcataggccgcgtagttgaggaagaaaagcagccccaacgcggtgaggtactcgtcgtactccgcgccgcccgggcgccggtagagcaccagccccatcaccagcgcccagatgaagtggccgtagtagcagaccagcaggatgtcgttgagccacgccgggacgacgcgtgacagcaccaccgccgcctgcatgccgaagagccgctggtcggccgccaccaactgcgcgtccttgaggagggggttcaccgtgtccaccacgggagacagccagccgtgcgtcatcaccgccgtgggcagcagccaccaatccgcgaggacatggatccaccggtgccccgggaacgacgcggccagcgtccggaggacgagcggccccacgcccaccaccgcgaacaatcccgcgcagcgcagcgcatccggcgcccaccggcccggccccagcaggagcagcgaagccaacgcgcaggacacgacgatgatgaggtccacggtggtgagctggacgcgcaccgcctcaccgcgaacgctttgggaaacccaggaactcacgccgacttacgctcccccggcggcgcggcttgcgcgccagaatcgccgagttcgaggctctgaacgaccgctcccttccccgccaccacattctcgcgccccctccaccgctccagcaaggcaagcagcgcggggaagaagaccgtggtccccaagaaggtgcacatgacccccagcagcgcaatctgaccgatactccgcaggccctggtggttggcgaccagtagcgcgccatacccggccgcgttggacagcgtggccaccacggccgccagccccgtgtggcgcaccaccttgccgagcgagccgggcccctcttcctcgtaccggtggaagagatgcaccgagttgtccacggcgatggccagcaggttcggcaggaccaccgcgttgatgaagttgagctggacgtcgaagaggtacatgccacccgccaggcacgtcatgcccaggaacagcggcccggtgacgagcaacgcgcgcttgaagctgcgcaggctcaccaggatgacgacgaacaccaccgcggcggcggaccacaggatgagcggcccgtccgcgctcaccagcgcgaagatgcgcgcggcgatgcggttgctgtccagcacggccatgtcgatgccgcgcgccttcacgccctccaccacctggtcgatctgcgtggcccagcgccgcagctcctcggtgtcggagttggagacggaggggaacaggagcaggaaggtgcccttcccgtccgtggcctcgaagcgccggcgcacctccaccggcaacgcatccaggccgtagggcttcgcctccagcatccgctggaactcctggagccgcgcgtcctcgcgaagctccgcgggcaggtcctccaggccctggaaggcctcgcgcagggccgccagctccacctcccggcgctctacatcggtaggcaacaagtcgttgagagacgcggagtcgaggatggccgagtccgcgccgttgcgctgcttcacctccgcgatgacggcctccacctgcgccgcctgcgccacgtcatccaccaggaagatggccgggttgaggggctggcccaactgttcggtgacgcggtcatccaggcgcgatgccggggactcgcccttgagcttgcgcatgtccgtctcgaagcccagttgaggcgccacggagacggagaacgcggcgaagcccaccaccgacagcgccagcacggcgatggcgcccgtgggccagcgccgccacgcccgctccggctgggatacctggggcgcggtggcttcggccgccacgtccacgcgggccgggcgcaggcgctccgcgagggccagcagcgacggccccatcgcatacgtcgccagcacggcgagcagcacgcccaggcccgccagcaggccgaactggttgaaggcctggaactgggccagcagcagcacgaagaacgccgccgcgttcgtcaccgcggacgtcaccgcgccgctgaaggtgccgcgcaccgccgtgacgatggcctcgcgggccgggtgagcgcgccgctcctcccagtaccgcatgcacaggtggacgccgtactcgatgcccaggccaatcaagatggcgacgaggaaccccgtcacgatgttgaggtggccaatggcgagctgcgccgccgcgaacgtcaacaccacgcccaccatgacggggatgccgaccacggccagcgccgcgacacgccgcgtggcgagcaggatgagtcccaccgcgatgagcgccgacaacgtaccggcgcgcgacaggtcgccgcgcatcaccgcgtcctcttcgatgcgcccctgaaagttgcccgtggcttgcagcgtcacgcccggatagcgctgcgccgcgagcgtgcctccggtgcccatggcctggtccacgaagcgccgcgcgaaccccaaatccccggccgtcccggacggcttgatcatcaaatagacttcagtgccgtccgcgctggccaacgtcgcgcgcatgggcgcgtccggcgcgtacttcttcgcgatggcctcgaagtccggcggctccgacgtgccccccaaatcgaagaagaacgggttggcgcgttgccgctcgtaacgcacacgcgccgtcaggtcctggcgcagcgcagcgagtttctcgatgggcaataacagcagcgcatttcgacggaagaagtccacgtcatagcggtgctcgacgtagcggacctcgggcatcgtttccaattgcgtctgcaattcggccgcgtatgcctccaggcgctccggagtgtctccctttgccacgaggaccaggtagccgtccccgcctgccttctctgacacgcgtgtcagatcccgcacttcttgggatccctgagggagcaactccacgaacgatccgcggaactccaagcgcgacgccagtgccataccgcccagcgcgagcagtgagaacacgagcaacacctgccagggacgcgagaccgcggcctggatgaagccttcgaaccaccgttgtgacctggtcaacgtcgactcctcggggaccggcgaccgagcaaattcccggccagtcagcggcgtccttgaacagcgggtgaagcggagggcttccaggcgcgtcacgcccactgcaggtgtgcagcccgatgcacaccttgcgctccagtatcgactggagaacaccgtgtgtcagacggcggggtgccatcaaagtctcagtgctgtcaaggcgagcccggatacgaggggcgacagcgggatggacggcgcggcgcttgccttgacactgccgcgctccctctttattcacggccccgcgtcccccgtgggaggccgccggacgcagaaatccccgaagcggaacgttccttcaatcgggggagtcgcgactggagagccccaggctcccgggccggtccatgcctcccgacgcagcctgagagaaagaccgatcacccatgagcgacgtcttcgacaagtgccgtaactggaaggactaccgtatcgcgaaggctacgggtctctatccgtacttccgtgccatcgaagcgtcgcacggtgccaccgaggtggagatcgaaggcaagcgcgtcatcatggtcgggtccaacaactacctgggcctgtccgccgatccgcgcgtgaaggaagcggccatcaaggcgacggagaagttcggcaccaccagctccggctcgcgactgctcaacggcacactggcgctgcacgaggagctggaagcgcggttggcgaagttcctcaaccgcgagtccgccatcgtcatctccacgggcttccagacgaacctggcgctggcgtccatcctgggccggcacgacatcgtcttcagcgaccggcagaaccacgcgtcgctggtggacggaatccgcctgtccttcgccaccgagcgcaagttccgccacaacgacatggaccacctggagcagctgctgtcccaggcggatccggacgcgggcaagatcatcgtcaccgacggcgtcttctccatggagggcgacatctgcaacctgccccgcatcgtggagctggcgaagcactacaacgcgcgggtgatgacggatgacgcgcacgccatgggcgtgctgggcacgcggggccggggcacctccgagtacttcgacctggagaaggagacggacctcgtcatggggaccttctccaagagcttcgcgtcgctgggcggcgtgctggccggtcccttcgaggtcatcaactacatccgccacaaggcgcgctcggtcatcttctccgcgtccatgacgccgggctccatcgccgcggcgctcaaggcgctggagatcatcgaagcggagccggagcgccgcgcccgcctgctggacatcgcggagaagatgcacaacggcttccgcgccatgggcttcgacacgggtgtgtcggtgacgccggtggtgccggtgcacatcggcgaccaggtgaagtgcttccgattctggcgcgcgctgcatgaggccggcgtcttcgccaacccggtgattccgccggcggtggagccgggccacgcgctcatccgcacctcgtacatggccacgcacacggacgcgcaactggaccgcgtgctcgacaccttcgagaccattggccggaagctgggcgtgattccggagacgcgcccctccgtctacgagccggtgcagattgcccgcccgggcacccgcatcctgtccaaccgcgcgagcgagaagtgggccgcgggctcgaacggcctgctggcggacaagggcggcatcaccctggaccaactgtcgcgcatgtcgtcgcgcgaggtggccggacgcctgttcgacgcggtggagcagctcacgtggcgcgcggccaatctccagccggaggacctgcggaagctgggcaacgcgccgatgaagctgtgggagaagcgcggcgagctgccgggcttgttgttggagaagggcgctcacttcttcatgcgcaacggcgcccactccgaccggaactgaaccgcccatggccctccacgccgagccaacccacgcgtcttcgtccatgccctcggacgtgcaggtgacccctgtccgcggcgaggcggagcggatgcagttcatccgactcccctacgccctctaccggagcgacccgcactgggttcctccgctggagatggagcgccgggacttcctggacccgaagaagaaccccttcttcgagtacggcgaactggagctgttcctcgcccggcgcggcccggacgtcgtgggccgcatcgccgccatccgcaatccgcggcacatggagattcacggcacgaaggagggcttcttcggtctcttcgagtgcgtgaatgacgcgggcgtcgcccggaccctgctggaatccgccgcgacctggctgcgcctgcggggcatggacgccatgctggggccggcgaacctgtcctccaaccaggactggggcctgctcatcgacggcttcgatacgccgcccgccgtgatgatgccgcacaacccgccctactacgcggcgctgctggaggcctgcggcctgacgaaggccaaggacctgtacgcctacgagctgtcgtcgtccgcgcagccgccggagaaggtggtgcgcatcgcggagaagattcgcgtgcgcgacggcgtcgtcgtgcgtccggtcaacatgaaggacctggacgccgaggtgaagcgcatccgcgacatctacaactcggcgtgggagaagaactggggcttcgtgcccttcaccgatgcggagttcgaccacctggccaaggagctcaagacggtcgtccggccggacctcgcgctcatggcggaggtccagggcgagccggtggccttctccctgacggtgccggatgccaaccaggccatccgcgcggccaacgggcggctcaccacgttcggcctgcccatcggcctggtgaagctggcgctggcctcgcgccgcatcaaccggctgcgcctcatcatcctcggcatcaaggagggctaccggcgccgcggcctggacgccatcctgtacctggacaccctgcgcacggcgaagcggctgggctacgtgggcggggagatctcctggacgctcgaggacaaccacctggtcaaccgcgccatcgagtccatgggcgcccagcgctccaagacgtaccgcgtctacacgcgcgcgctctgaccacagcccgactccgaggagtcttccttgcgattcctgctcactggcggcaccgggttcattggccagcggctcgcgcgccgcatcgtggaacgtggcgacacgctgaccctcatggtgcgtgccagttcgcgccgtggcccccttgagggactgggcgcccgcttcgtggtggcggacctgacaacgggcgcgggactggccgaagccgtgcgcgacgtggactgcgtgctgcacctggcgggtgtcaccaagtcccgcgagcccgagggctacatcgagggcaacgcgaagggtacccgccgcctggtggaggccatggccgccctgccccaccctccccggctggtgtactgctcgtcgctggccgccgccggcccgtccacgccggagcgcccgcgccgcgaggaggacccgcccgcgcccgtgtccatctacggccgcagcaagctgggcggcgaggaggcggtacgggcgttcgcggaccgggttccgtccgtcatcgtccggccgcccatcgtctacgggcccggtgacgtggagttcctcccgtcgctgctgcccatggccaagctggggctggctctgaagagcggcttcgggcccaagcgctactcactcatccacgtggatgacctctgcaccgccctgctcgcggccgcggatcgcggccccacggtgtcgaaggaagacccggcgcgcggcgtgtacgccgtgtccgacggcgtggagcactcctgggaggacgtctgcacggccatggccggggcgctcggcaagggccggcccgccgtgctgcccgtgccgcagacggtcagctacgtggtggggctgggctcggaagccgtggcccgcctgcgcggcacggtgcccatcctcaaccgggacaaggtgcgggagatgcggtgccccgcgtggacatgctccaccgagcgcgcgaatcgggagctgggcttcctgcccaccatccccctggcccagggactggccggcaccctggccgcataccgcgaggcgggcgggcgctgaaaagacgaaggccgaggcaccctggagggcacctcggcctggacacgtgacgcggaccgcgctgggcctcaggggaccgcggtctgccccgcgctcttctgcgccgacgtcgcgttctccttctccaactgcgtccgcttgctcttcagcgtggacagcaggccgtcgaagcccttgtcggcgagcagcttgcggaactgccccttgtacgtgtccaccagggacacttcgtcggtgatgacgtcgtagatgcgccacgccccggtcgccgacgtgcggtacaggcggtactcgacggggatggcgtccttcttcactgtcaccgtggtgcccacggaggcctcgttaccgtcgatgccctcctcgccgtacttcacctgggcttgcgcctgccccagcgccttctgggcataggacgcgcgcagcaggcccgtcatcgtctcggtgaactccttgcgctgggcgggctggaggccggcccaggtcttgtcacccagcgcacgcttcgccagctcctcgaagtcgacgaacttctccacgacggtggccagcgactgcgcggtggcaccgggcgcgttggcggccttctgcacgtccgcattcccggattggacgaccgtcagtgggccgggcgcggcggcaagcagggtggcggcaagcagggacgcaatcattcaatgggctccgagtgatgaaaggacgacagggaagactgtggtgagcgcatggttattcacccggagccagcggcgccccggttacccgcgcgagggcggccatacctactcgaacgtcgtgccagctcttgcctttgtcacctgaagcctgggcataggccgtgaaagcgtccaccaggtcacgagtgtcaccggtccccaggtcgaacgcggtgaaggcggccgtcacccaccggcgggcgctccgctccgcctcgccaaaggcccgggcgcgactccaggcggccaccagctcgccgtgcaccttggagacctccaggcggatgcccgcgcgaatctgcttctcctgcgcgcgcagcttgtccagctccgcgcgggcctgctcgagctgggcgtccttgatgggaatgtcgaacgtcccccgcatcaccaggcccacgcccccggtgcggtcgttgtacggatcaaacgcgaagggcgtgcgctgccgcgtggtgctggtggtgaagcgcacatcatagaagccagccagacccaggtccgggtagtagctgcgctcgcggatgaagacctcctgctcgcgagcggcgatgccggcggcgacggccgtcaattccggacgggactgctccgcgcgcaccatggcctgctccaggctgggcaccggcacgtcctcttcgagctccaggtcttcgtccaccaccgtcactgcgtcttcgggccccacgttcgccagcaggccgatggcggcgagcgcgaactgacgtccctgcagagcctccgccctgcgcgcttcgacaatctgccggaagaagcggaccttgtacgagtccaccgcggacacctgggccgagtcctccttgagcagccgttcgatgcgctgggcagcgtcctccaaccgcttcgagacctcttcaatctgctgaagcccgttccgcgccaactggtagccgaagtacgcctgcgcggcctggaagccgacctcgttgcgcgtgcgctcgcggagcgcggcccccagcaccggcccctgcgcgcccgccttctccagcgccgtcagcttgccgaaggtgtagagcggcagcaccgcgttgccggtggagaacatcgtcacgccgacgcggccgaagttcaggtctcccttataggtggcctccgtggtgggaggtccacccaggccgtcgttgcgggcctccggcgtggggcctcccgcgcccacggtgatttcgaacttggggaaccaggcccaccgcgcctgttggtagagcgcctggaacttgcgcagctccgccgtcgcctcctccacccgggagtccgcttcgcgagcccgcgccaccagccgcgccagcgtcagcggctccctccgcgcgggtttctcctccgagtccggcgcacccgtgacgccctccttcacctgctccgcctcggcggagggttccagggctggcgcgggtgaaatggcccgccccggctgggaggaacccggcgtctcctcaatcgagctcggcgcaatgcccggcggactcggcggcaggtcccgccccccggtccccacgcgaggcgtgggccgcgtccctcccggcgccccagtgccaggcaccgccgtcggcgcgtcggagcccggcgtccccaggtccggcgtctccggcgcttgcgtagtgccgggcgtggagggggccggcgtgcttccggtgccggttgaagggctgctccccgtcccggccgagccgggggtgagctgcgctccggcaacgcccgccgcgagcatcagcgccactgtcacgccatgatccaggtgtctgcgcatcaagccgccttgtgtagctccccatagccgagaacctcacggcggcgcagcatgtccgttcggcagcgggccgtcaccggtgttgtgcgtcccacggcaccagccggagattgtggacggacgcgccgaaaggcacgggggatgtgcactgtcgtggaacccgtgacactcgcgcgcgaaaaggagttggtaggacgtggcgcatgcagcagattgcgactgttcccgagacagaggatccccacacatgccccataccgatcgcgtcaagcagatcctgtcgtggtacccgtctgacaaccccggcacgctgaccaacctggcccggctgctgaacagcggcacgctggccggcacgggcaagctcgtcatcctcccggtggatcagggcttcgagcacggcccggcccgctccttcggtccgaaccccgcaggctatgacccggactaccacatcaacctggccatcgagtcgggctgcaacgcctatgcagcgccgctgggcttcctggaggcggtggccggcaggtacgcgggtgagattcccctcatcctcaaggtcaacaactccgacaccctggccaaggtggccaaccccatgtccgcggtgacgagctccgtgaaggacgccgtccgcctgggctgcaccgccgtcggctacaccatctacccgggctccggggcgcgcaacgagcagtacgaggacctccgcgacatcatcgccgaggccaagtcctacggcctgcccaccgtgctctgggcctacccccgcggcaacctgtccaaggagggtgagacgggcatcgacgtggtggcgtacgcggcgcagatcagcgcccagctcggcgcccacgtcatcaaggtgaagccgccgcaggaccacatcgagcaggccgaggcgaagaaggccttcgagaaggccggcatccccaccaagacgctggcggaccgcgtccgcgaggtcgtccgctccgccttcaacggcaagcgcatcgtcatcttctccggcggcgaggccaagggcaccgacgccctgctggaggagatcaagcagatcaacgccggcggcggcttcggctccatcatgggccgcaacgccttccagcgtccgcatggcgagtccatcaagctcctcaaggacgtgatggccatcttcgccggcaaggcgtaatcggctcggtggaaaacaaagaagcccgccaggtttccctggcgggcctcttcatttcagagtggagctaatcgggatcgaaccgatgacctcttgaatgccattcaagcgctctcccagctgagctatagccccgtcttctgctgtgggtgtcgcctaccgcttcaatacaaaaggcccgccaagtctccctggcgggccttttcatttcagagtggagctaatcgggatcgaaccgatgacctcttgaatgccattcaagcgctctcccagctgagctatagccccgtcttttgctgctgagccgctttggggagcg

SEQ ID NO: 1052 - DNA, 11579 bp, Myxococcus xanthus
ccccccggtggggcgtagccaagaagttgtgccccgggtggtcgtccaaaagcaggaatggattaagcttcgggatggcattggggttccggaagaaataccccggacgcgaaaccggttcgggcccagtggaccccggaaggcgagtagacgccttcgacttggcgtccctagccaccggctgcgcgagcctgggtgttcagggtttgtggtcgtcatcgctcttctcctcattccaagcaggagacccgccggcaccatcgccatccgtagatgacgccttgaagaaatcgggcgcctcctcgcaccgacgaggactctcaccagggcccgctacaacaatagtcaccgttcaccggttggagcctgcgtgaagggaccgccgggcagcgggcggtgggcgggacggcgctcggcggtggtggcctcggcgtgacacaccgccacgcgtggcggcgctcgcccccaaggctgcgcgcatcgcggagttgagagcacaggtgccgctcgaagtgacgcatcgagggcacgtcccgtggcggatgcgacgtccgccacgggacaactgcttcacttgctgatgacaggcgggcgtgtctcttcgacgcgctactcgacgaacgacttcgtgctgtagagcgaagcatccaccttgtgcaggacgggcaggttcgtgccgggcttgcgctcggcctgacggtcgatgtacgtctggaggacgtcggcatcgagcacgccgatgtcggagcggcgctcggccggcacgttggccagcgtcacgtagccatcaccacccgtggcattgaagctcagcacgaacaggcgataggtggcggtcggctgaagttcgttccactggcccgtcgtctggtccagcacctccaggttgctggcgcgctggccgcgagcgtgagcggcgttgacgtcgaagcgcaggccgccggtgtacggatagggccccgtggtgcctccctcccggaacgtggcgtgcagcccgtcctcaatcatcgacttcacctcggtgccagtgacgtccagccggaacagcatgttgccgaagggcagcacctcgatgacgtccgccgccgtcaccggtccctgcagcggccggcgcacgccgcccgcgctctgcaacgtgatgtccgcgccgccgtaatccgcgttcgccacctccaggtaggcctgcgccaccagttgctggatgtcgccgccccggctgtggacctcccccagggcgttgcagctcacgctggagcggcccggctccgtgtttcccggcacgcggcgattgcaaagctcgtcgtccgccgtggccaccaccgtccggctgtactcgtcgatccggccctggaacggcgccagcacctgcgcggcggcggcatccggctgcgtcacccgcaggaagccgctgacggccacgctggccagcatcgcggcgttgtcggattcggagacgggcgtcccgtcaatggagaactgattgccgatgagtacgtggggcgtgccgccacaggaggtgaccacgccctcggcgtcgaagcggagggtcatctctccgacgacctgcgagtactgccaggcctgccccaggcacacggtttcgccgtcgcggttgcgcagcgactccgcgtagggccccgcgggcgttccgacgttgaaggtctccatggcggcaggccccagcagtgtgtgggagtcaccgccgatgaccgcgtccacgccactcaactgcgggatgatggtccggtcgagctggtacccgatgtggctcatcacgatgatcttgttgatgccctgggcccgcagcgcatcgatggcgcgctgggcggcgggcacctcggcctcgaacgtggtgtccgcatccgggctggaggactccttcgtcttgcccgcaatcgtcaggccgacgaggccaatcttctggcccccccgttcgacgacggtgaagggctccacgtagccggcagccctggaggtgtgcagggcggagcccgcgccgaactggacgttggcgctgatgacgggcgtctgacactggccggcatgcaggcggtcgatgaagcgcttcagctcggtgtcgcccttgtcgaactcgtggttgcccagggtgaaggcgtcgaagcacaccgtgttcatcatcgcggcgtcggcctcgccaatctggcccgcgcggttgaagtacagcgtgccggtgagggcgtcacccgcgtggagcttgagcacgttctccttaccggccgccagctccttcatcgcggacgtgacgcgcgcgaaacccgaggattcaacctccgcggccacggtgtcacccgcggcgttcgtcacattcagctccagactggaacccgcgaggtgcgagtggtggtcgttgatgtggaggatggtcaggtccagcggcgcgggctgctcgccagggtcgacggcatcgtcatcaccacacgcggacagcacgctggccgccatccacgtcaccgtcaaccagcgcgtccggctcgacgaacgcgcccccctgcgcacttccatctccgtcttcaatcgcatgaaccgctcccaggtgcctttcggaaggcagcatggtgtcgggcgcgaatgacagcccggttacgccttcctacccggccggtgacactttcatggcgattgtccgcggcccaggacccagcaccttcaccccacccgcatttcgcgggcaaccatgtgcatcccgaggagcatcaagctgaccaggaaacacgcccggaacagcacgggcgagagcttctggcgcagccactgccctacctgcatcccgacgagcgccggaagcaacatcaggagggattggcccaactgcgccccagcgccagcggcgttgacgtagagccccgccgccagggccagcgtggataccgtgaacgagatacccatggcctgaatcagctcctctcgctcgaagcccaacgcttgcagatacggcaccgccgggatgacgaagacacccgtcgccgccgtcacgaagccggtgagcgcgcccacccagggccccaggcgcgcctccgccaccgggcccaccgggagtcgggccccactgagtccccaggccgcataggccaccaacgccacgcccagggacaccgtggcccacgcgcccacaggcgcgcccagcacccacgctccgacgagcgtgccggcgcagacgcccacctgcatccgcgccagtcgccgcagcagaggccccaaggtcgaccagggccggagttgccagacattggtgaccagggagggcacgatgagcaggacggccgctcgggcgggaggcatcaccagggccagcagcgccatggcaatggtgggcaggcccagccccaccacgcctttgaccaggccggcgagcacgaagacggcaacagtcaccagaaggctgtcggatgaaggcatgagggaagatcccggcgggtgagggacacgcgacgcattgattctgggtgacaccctccggcccgaaaattcggaactgcccgctgccgcctcaggcccaccctgaggcagcgtgcgacctgccgcccaaggcgccctgcgggaagaccgcgccgcggccctcgatgcgctagcgcggcgacccaccagggaagcgccacggcccggtggaataacgggatatgtacgttcgtacatatcgccagcggcacctcgcggcttcatgccgcctgccgcatccccggagacccacgtggccacgcgtagacatgaccccgagcgaagggatcgcatcatcgaggccgcgctggcggtcatcgccgaagggggcgtggccggcacgtcgcaccgccgggtcgccgagcgcgcgggcgtccccctgggctcgatgacctaccacttcacgagcatggacgaactgctgcacgaggcgttcagccgcttcgcccagcgcatcagcgagcggttcgccgagcggatcgccgcggccaccgaccttgacgcgttggtctccgccatcgtccacatcgtgcacgacgacctcgcggcggggcaggacgagctcgtgctcacgctcgagctctacacgctcgcggcgcgccaacgcgccttccggcaaatcacccacgactggatgcgccgcagccgcgccgtgctggaacggttcgtcgacgccaggatggcgcacgagctcgacgccttgattgaggggctgttcatccacgtcagcctcgaccccgccccccgcagccgcgacctgacccgggacgccgtgcgccgccttctctcgcgctccccctgacccgccatgccctcctcctcccctcgtctggtcccccgcgagtaccgggcggcccgcgcggccgtcgcggcgctgttcctcaccaacggcgccatcctcgccaacctcctgccgcgctatccgcaaatcaaagccgacctgggcctcagcaacgcgcaatacgggctggcggtcgccgcgttccccagtggcgcgatggtggcggggctcgccgccggagcgctcatccgcggcttccgctcctcacgggtcgccgtcgccggcacgctattgacgagcctgggcgtgctggtcgcgggcctcgcatcatcatggtgggtgctcgccgtttcgctcttcttcgcgggcggcatggacgccatcaccgacgtggcgcagaactcccacgggctgcgggtgcagcggctccatggccggtccatcctcaactccttccacgcggtctggagcatcggcgcggtggtcggcggactcatgggcgggctcgccgcgggactgaacgtgcaccggggcctgcatctgggattctccgccctgctcttcgccggggtgtccttgatggcgctgcgctacacgctccccggccccgagcccatcgtcgccgtcgagcctgagcccgcggcggcgcacctggacagcgttcccgcacggcgccagccgacggggcgcatctggctggtgattgccgcgctggtcttgattgccgtcggcggcacgctcgtcgaggacgcgggcatgacgtgggcagccgtctacctctccggaacgctcggcgccacggcagccgtcgcttcattcgggttcgtcgccctcgtgggcgcgcagttcgtgggccggatgctgggcgatggactggtggaccggttcggtcagcgcgccatcgctcgggccggcggggccaccacggcgctgggcatgagcgcggcgctcctgcttccctcgatgccgggcaccatcgcgggcttcgcgctcgcgggcttcggcgtcgccacgttggtccccgccgccatgcacggcgccgatgagctgcccggcctgagaccgggaacgggactcaccgtcgtcagttggctgatgcgcctggggttcctcgcgtcgcccccgctcgtcgggctcgtcgccgacgccgtgggcttgcgtgtggggctgctcgtggtgccgctcgcggggaccatcgtcgtgttgctctcgggagtcctggccaccgtccgcgccaccgccaccgcgccgggtggccaaggcccctccctcccgcagccccattgatgcgatagggcagcctcgcatcctggtccgtcttccaggggtgtcatctcatcaagggcggcggatggccccgccccgctgcacggccgcatccagaatgggaagactcagcgcccatgcagcggggctccagctgacggtgctcccgctcaggccggacgttcgatgcgcccatccccgtgccgggcgaagcgcccttcctctggcggatggaccgggtcattggccggccacggccagcccccgaagcccgtgcgctggtagtccgcgaaggcctcctgaatctcctgccgcgagttcatcacgaacgggccgtactgcacgacgggctctccaattggacggccctgcaacatcaacaactccgcctcgtccgcgccgttctccaactccaccgcgacgtccgcccgcagctcgatgccatgtgacggcggaatggcacgccccgccacgcgcaggctggagccgaggaagaagtagagcatccggttgctgccacgggccgccgccggcagcgtccaccgcgcgcccggggccagcttgagcgtccagatggccacgtccgactctgcctgcgcggcccacgacttgggcggcggcggtggcgccttcacgtctcccaggcttccggccaccaccgtgacttccgtggcgcgcccttccgcgtcccgggcaacgtgccgcgggatgacgtggttccacatcatggagaagtgcggctccacgagcttgttcgcccgcggcaggttgagccagatttgaaacaactccaccgggttgggttggtcgcgctggagcagcgggaacatctccgaatgattgatgcccgcgcccgcggtgagccactgcacatccccaccgccgaagcgcgccgccgcccccagggaatccgcgtggtcgagcagcccgcgacgcaccaccgtgacggtctcgaacccccggtgcgggtgctggggaaaaccgggcaccacggtgccgtgatacatgttccagccgtcccgcccatcgaagtcctggcccaggttgcggcccgccagcgaggcggacggcccgaggtcgctcgttccccatggggtacttgtcgtcgtggtggacgcaaaaaagaaacggatccggggtccgccacggcatcccgagcggctccacacgaaggacggcttctggctgctgactcatctcctacgcctcatcccttccagagccccataaaaattccctgagccggggctctatccggtgagcgtaacaacgagccctccgcgccgcttgccccgtagggcccccgcccagatgccgagccacccgctgggtgcacagcgggcgcggcgagtggggcacgtcacctgccccaccgttccacgaacctcaggcccacagctcctgagcgagcgtgtccaccatcgccacggcgacctcgggcgggggcagcccggcctcggacacgagcacgggattcaccggcacgcaggcctcctcgcgcagggccgccgcggcccgctgcttcgccagccggagcacctcgcgctccccctccgacagccgcgcctgcgcccaggcatcaatcttccacgagagctccgcgtgccgcgtctcgtcctccgcgatgcgggccatggaggcgcgcacctcggcgtcctgggcatggagcgactggtgccgcgccaccagcgcgccgaatgtctcccgcacacagccctccaccgcgttgtccagcgccaccgcgaacagggaacggggcgccgccgcgtccaccctgggagcctggggcgtcgcgccgtgccgccccgccaggcgggcgctgacctccgtgtgcatgacctcctccagggcactcatcagcgccgcgtcctgcagcgcgaggtccgcgccatgcgcggccagctcctcccggagcaacaggaaggcctggatggacgcggcctccagatgggcaatggcggcgaagtgctgtcccagcacatcgtcacacgccaccgcgccttgtgagcgcagtcctccgggcctgcgccccacggaacagttatccgcaccccgctccaacacattgcgctcctcctccaccacctcgcccgttgacgacacgcgcagagcatactgcgtcaactccgtccccttgccacacgccatgcccttggtgccgacgacgccgaacgcaccgtcgcccaactccttcaccgccccatacttgagcccgccacagcgcactgcgtagcccgcggcaaaggccgtcagcgcggcctcctgcgccgtatcaatcggccctaggaacgacttcagggcctccagcgaggagatggcagacaccacgtcgccccgggtcgtcgcgaggaaatagtcggtgcagatgaagccgcaggcgtcgcggaacccacgggcaggcgccaacgcctcgagctcagacagacatgtctggggctgggtcgccgtcgcgcaaggtgttcctacggaggagacggggctcgttgccgcgggctcgcccgccgcatggaagctccgcagttgcacgaagtccggcgcggccgcaggtgacaagcctgtcatggccagcgcgccattgtcgcaagcgggtggcgaataccccgtcaggtccacctcaccatcacatccggccagcgtcaggggagacaggagcgaggcgcgaagggcccgggagaagagcagacgcaagcgattcgaatccatgggtgcaaggcctcctgcggttgggagcccgcacttcagcaatgaagatgccaacgcctgcacgccagggggcgcctgacaggtgtcacgaaatgacgacgtttcctgcctgccctgctcagaaacctgaggggtggttcctcgtctgacgccctgcctgtcattccggcccgacttgcctgggtcatcccgtcccgggcggaccgcgtcttgtcaagccatcgacagccccttgcatgaccaccgaaaggcgagggagcctcctgtcaagctcggggcctaccactggggggtgagggacagcctttcagtcggagcctattgaatggcctgacacagaaacggacccgcagggttgcctgaccaggcaggaaggaagctcgcgtcgatgaacgtctcctcccatgagttcctactccagaacaaagtcatcgcggcactcaacagcaccttgtccctcccccaagcgctcgaatccgcccgggagcccctgctggagctgacgcccgccgactacgtgggcctgtgcctcatcaacctgggccccatcgtcgagttccaatggctggtccccggctaccggctggccctcctggatgagtattccaagtgggtcgattccgacttcgtgcgggcccccatcttcgcccagccgaatgtggtcctccgggactcggagatgattacccgcaaggaattggagcgcagcgcgctctaccagcgcagcaaggagttggacctgagcctggagcacgtcatggcggtgctcctgcccgtccatcctcaactcctgggagccttcacgctctaccgggaccgccggctggctttctcggagaaggacgccgccttcctgacgagcctcacgccccacctgctgaacgcggtgcgcaactgccgcgacatgcagacggcctcgacgggctcccggctcctggaggagctctacagccggccggacgccgcctacgtcgtggtggcgccgccctcgcacgaggtgctgcgctcacgccgggccgccacgctgctggagcggtggttcaagccctcggacctgcattcctcggggattccgctcgtcctcatggagcggctgggggccctaacgcggatgacgccggacgcgcagctccaaaacaatctctgggtctccctccacggcgattcgtaccgcgtggtgcggttcgtcgagctccccgaaaccgaaggcccgcgtcagtgggccctgattctgaacgagattcccttgtcgattccgctccccgaaaccatgcgcatgcagctcacggcccggcaggtcgacatcgcccggggcatgctccacaactggtccaacgagcagattgccagcgagctgggcctctccgaggacaccgtgaagacgcacgtgcgcgacatcttccgccgcctgcaagtcgataaccggacggacttcctctaccaggcggcgcacctcaacaagcccgtctgaggcgacgcttcagaagcgcggcagctccagcaggttgtccgtgaggatgccattggccttcgtccgcaggtacggaggccgggcgtcgatgacctcgaccttcacgtcccggggccacgtctgtacccgggcatctccccccgccttgagccactggaccagctccaagcggctgccctcccccacctcgttgccctccttccagcgaaggcgggcaatgtgttcgtgaagcgcgcctccctcgagacggatctgggtgatgtagcgcatgaagacgcctcccacttcgcggacgacgattcgcaggggaggatcgccttcaggcgcgggactgtctctaccaccggggaggtatgcggccttcagcgctcgcggaagatgcccgggtagatgcaccgcgtggcgcgggcggagaaaatcaccgccgcctggtcctcggggtccgtcagcgtccgcagcaccgcttccatctccgccacatggtccccgtcgagcgcgccgtggctgcgcaggaaggtgacggacttccggatgttcggaatcgcgtcggccgcaatcagacgttccacgacccccgtcgctcgcgtctgggacaggtactccagcacatacgcggtccccagcaccgccgtcggcacgccggaccgggaggtgaagaagttccagccggtgtaggcgtccaccgcgggagtccgcgccgcggtctccacgcgcacctccggacaccccaggttcttcaggtccgacagcagccacttctcgtggccgcgttcctctccggccttctgcaccagcagctccgccaggtgcgggtgccggccctggcgctcgagccggtggcccgcctccgccagcatcggcgtgctccagcgcgcatagtggtaggtctgaatcaggtagtggatatagccctcggtgtcgatggtgccgtcgaagagacgacgggcgtcgggctgcacgtccagcgcggccaccagcccgcgggcctcctgctccagcactgccacccagtccacctgcgtcgggttctgcacttgcgtgttcacggacgtctcctgtttccgggccgtttccggtccccggctgctgcgcgttgaaggtgaagggaagggagaagcgccagcggcctaggcggcgcggcgaagggggtgctgcgccagcgcgttgaagcgcgccagggtgctggcgggaacctcatccagcgcggcgatgagcggcagggtgaagcgacggaagctggcgtcgtagagaggctcggagatgaagcgcgcccccatcttccgggcgaagagcgtgggcgccctcggcacgcgcaagccgtccagcaggccctgctccgcgcgcagccgctccatgggcgtgtagtagggattgctggggatgacgggtgcatccaccggctccggcacgtccacgcgccagcgctggctcatccagccccggtaggcggccacctgacaggacagcatcgcgtcctcgcgcgaatccgtgtccaggttcgcggacgcaagccagtgcgtcacgccgcgccgccggctctcctcgtagatgcccgcgtgcagccgggtgacggcctcggagtggcgccagccgtcgagcacgcagaagcgcgacgtctccgcgacgaccatgcccgggcggaccacctcggacaggtccagcttctgctccagctccagccccagccgtccgccgatggcatccgccacctccgggttgggcagcagcagccgcaacgtagccaccggggccgcgtccgcatagacgaccagatgcacggtggtgtccagcgtgtcgaaacagctcacctcgcgacgcgacggcggcatccaccccgtcatcaaccccagctctccgccgaagacggtccagcggacgcggaccgcgtcatcgagctcgcgg

SEQ ID NO: 1053 - DNA, 13624 bp, Myxococcus xanthus
gccgtgcgcccacctggtctgcgagcggtgttacgacggaagcgactacagcgcgtgtcccatctgtcaccgtcgcttgtctccgtccgagccgttcctcaagcccacggcgctcgaggccgccgagcgcgtgtatgcactggccgtcaaccggctgacgcggctgtccttggggaccgacgccgctcgtcatcgacctcgtcgagaagcagctccgttgggtggatgtgaaggttcctcccgaggatggcttccagagtgtgcacagctcgcgaggcgagctcgcgaaccttggaaaggacaccctggcctatttcggaaccggcgcccgccccacgccctgggagctggcctgccttcacgtcgccgcgcgcagtcgcacggtgcaggtccggcgccgggatggcacggtgtccgtcctgaagcggggctcggacgaggacaccgccgccttcctgcgtaggctgcgtggccttgaagtggatgccaccagccacgccttcgcgcctggctcggcgcccacgttcttcgcggggatgacggaccacccctcgctcccggccggcagcgagggctatgcgctgcgcttcctccacacctccgcggaatccgtttcatggctggccgcgggcgatttggtggccgcgctgaaggcatagcgcggtccaggttcgcctggatgctgcgcacctgccgcaagcgctatgcgttccgcgcggcgccggctacttcacgatgcgcgagagcccggtgctgacccggctgaagccgtcgcccggcaggagccgccggggcggtggaggtggggccctgacgcgtcgtgtgcggggggcctccctctgggatgttgctccgagcgcactttagcaggaggggcggaaagtgcgatagtcgggacggcaaccaacgccttcacgaggagcgactgacgtgcctttgtactacgtgcagaacttcacttacgacggtcctggcagctcgaagatgtatggcgccatgggggcccacaatcacagccaggccaatcagttcaccacggactgtcttgcctacctggcggccattgggtgcacgaacgtgacggcgacgggcagcttcgcgagcaaccaggccgagccgcttcatggcaaggagatgcgctgggacgtgctcctaagcaagtgggtgaaagcttagcggtgctcgcgggcgtgcctctcctcgcgggccgaggcacgccgccgcgtccggagactcagggcgcatccatcgcgtgcgtcaggcgcctgccgtccttgggcgcggcgaaccgggcctcatcgcgcgagaagcggtacttcttcatggccgagaagtcccccttcatccgagggaattcgaggtccatgacgacccgtccttccttcacgaagacgagcagacattccgattcgtagatgtctcgcgcgccggaccagtcgttgccgagcgattggcggacttcctccgcgaccacgtagggcgtgaagacgtggagggtgtcccagtcgaagtccgtcacctccgacaggtggaaggcatctcctacctccgtggcggagcggatgcgctgctccagcttcgtggcgagcgccgcgcgctccttgccccttccacagccgctcatcgccacgccgcaagcgagccaaagcgtcaccgcaatcactgacgtgcctgcccagtttctgtgtccgcgcatgcgcggcactctaacggtttgtctggctagaagtcccggagcagggccgtccgtggggcaagccgggccagggaatggccagtgcgacgaacagcatggccagcaggagccccaccgcccaggtgcggtgcttggattgggcgggcgcctcccgccgcgtcatcgcggaggtggcgtgcgcggccgtgagggccaggagcatcagcagtgggtgctccaggctgaagaagcgcaggtggctgatggacatgccccatccgcagcgcgtccaggctccggggcgtgacggggctgagcgcgaagtagagcgtcatccccagcagcatctggatatcgaaggcggagacgaagaagacctggagccgccggtcgtcgggcgtccagtcacgggctcgcgcccagcccatcagcgccctcacgagcgcgagcactcccagcaccaccaccgcccagcgcagccaggagtggaggagcaacacccctgagtagagcatggcgcctacccccccttcttcacgggcatcgcttcaatccagcgctggatgagcgcccgaccctgttcatccaccacgagggtgcccaggggtggcatttgcatgaagtccccgcgctggcccatccggtagagcagcgagctgtgctggacgtcacccggcgcgacgcgctgcgagctcttcccgaacatgcccgacgtctggatgagcgccttcacattcacggacgtgcgccaggtgtccgtctcctgcacggagccgagctcgcccgcttccaggcgcaggtgcaggccggagctgttgcccagcgccatgcggttggcgctgtggcacgacacgccgcagttcatgtgcaggtagcccagggcggcctgctccaccggcgtgccaggaatgcggggcacctgcgcgggcgggtggctcaggtgtccctcctccaccagcttcgccagcgtgaggcctcgcgcgccgtcgtgggccaacgcgacggcctcgaagccgagcacctcgtcgccgcgacctcggtggcaggactggcagtcctgctggctggggatttcgtagccctccgtgccgggcacgtccttctcaccgctggtcaactcgagcgccgtcttcccgtcgtcgctccagcggtaggtggtccgcagccagctcccgtccgggcgcttccagaggaagcgcgtctcgatgggccgccccttccaactgaactccttccagagcttcgtgcccacggggaagcgccactcgtcgctcttggacgtgtccaccttcgtgccgggcggcaggtagatgaagcgcgtcttgtccaggccgtcgctccagagctggaggccgggctcgtaggggcgcacctcggggggaatcgcccgggtcgcccacccggtgccgccctcgccgtagaggcccgtgcaggccaggtgctggagcgtctggcactggatgctgccgttggcttccttccggacctcctcggtgggcgtcttggtacagcctccggcggacacgacgatggtgagcagcagcgcactcgcgcgtggcggggacatcggacctcctgacaccttccaccctaccggcttgggcgccgcgtttcgtgcgtcttgctgacgcaccccgggggctcacttgggaacggggtacttggacagcttgcgttgcaggctccgccgctggatgcgcagcaaccgggcggcctgggagatgttgcccccacagtcggcgagcacgcgctggatgtgctcccactccgcgcgcgccagggagggcacctcgtgggtgagcgcggcctcctgcccggaggggagggtggcgccggcgaaggccagcaggatgtcgtccacgtccgcgggcttggccaggtagtgtgtggcgcctcgccggacggcctccaccgccgtggcgatgctgccgtagcccgtcagcaccacgacggtggtgttcgcgtccagggccttcagctcgcgcaccaactccaggccggagccgtcgggcaggcgcaggtcgacgacggcgtaacccggacgcaacgcccgcgcggcctcgagcgccgcgtgcgcgctggccgcgccgtgagcctggaagccgtgccgcacgaaggcgcgcaccagccgctctcggaatcgctcgtcgtcgtcggtgacgagcaccgtggcgggggcttcacctggtggcatcggacgactccttcctcaagggcagctccagcgtcacgcgcgttccctgtccctcctcggagctgagctccaggcggcctccacacagctcggcgtacgtctgggtgaggaacaggcccagccccatgccctggcccgcgggcttggtggtgaagaagggctcgcccagccggggcagcagcgcgcgcgggatgccggtgccccggtcctccacgatgaagcgcaggcggtcctcctcgcggtgcgcggacaccacgacgttcgctccggtggcctcgctggcatgcagcccgttgcgcaccaggttcgtcaggacctgcaccagtcctcgcacggggcaccagaagggcacgtccgggccgggctcgagttggaggcgcgcctggtcggcggtgcccagttgttcccggaggcgggcgagcacgtcgctcggcgtcgtccgttcggggacctcgcccatcgtctgtccggcgcgggcgctcatgcgctccaggatgtcccggcagcgctccacctcgtcccggatgaggcgggcatcctccagcgcttcctggggcgcctccaggatgagcgcgtccagttcgttggccgcgatggcgatggtgcccagcggcgtgcccagctcgtgtgccgcgccggccgccagcgtggacagcgacgccagcttctccgcgcgcgccgccagccgctgcgtgcgcgccagcgcggcatgccggtctctcagcgcggcggccacgcgggcgacgacgaagccgatgatgagcgccgtcagcgtgaaggcgacccacatgcccacgacgtggagcgagtccaggccgtggctgcccggcgggttcaccgtgtcgggcagtgggacatggcaggcgaagaggctggtcgagcccagcaccgacagcatcgcgatgagcgccgtccaacgggggcccagcacgatggccgccagcgtcacgtggacgagatacagcatggcgaacgggttggccgggccaccggacagcgcgagcagccccgtcagcagcgcggtgtcgaacgcgagcacggcgcccagcaggccgggacggacctcgggctcgcggcggagccagagcgcgaggagcaggttggacaccgccgtcgtggccaccagggccagcaggggcatcacgggcaactccagctccagcacccggacggcaacgcccaccgtcagcgcttgtccggcgacggcgtgccagcgcaggcggaccagccacccgagcgcgatgtcgctggaggacaatcgcgccgccatgtccccggtggagcgtcggaaggcggagcgcgggggcgaggacaggacgtcaggcgacggcgcctcggtgtgagtcggcgcggtggacacccgcacgtcatatcccggcgatggcagtgaagtgtgcgtcaagttgacgcattggcctgccgggccggtgcctggcctccgcagccgggagacgtctcgcgagggcggcgcgccagacagccggctgtactcccggctgaactgcgaggggccctcatcgcccaccgagtgccccggccagctcggccggatattggggggaggagcgtatgcggcccgtacctccgggccaggggattcatccgttcgtgcaggattgggcaagaacccggcagcatcggcatatcgcttcagcggcgccagcgcacagattgcggtcatccactccgcagtcacgaggcgcatccatatgtctggaattgaagggaaggtcattgccatcaccggagcgagcagcggaatcggggaggcgacggctcgcctgctcgcgaagcgtggggcgcacgttgtcttgggcgcgcgccggacggaccggctcgaaaccctggtgtccgccatccgcgcggagggcggctccgcgcgctaccggaagctggacgtcacgaagcgggacgacgtcgagtccttcatgggcttcgtccgcgccgagcacggccgcatcgacgtcatcatcaacaacgcgggcgtgatgccgctgtcgaagttggaggcgctcaaggtcgaggagtgggaccggatgattgacgtcaacatccgcggcgtcctgcacggcatcgccgcggggctgcccatcatgcaggcgcagcgctccggccagttcatcaacctctcctccattggtggccaccaggtggtgcccacggccgccgtgtactgcgcgaccaagtacgccgtcatcgccatctccgagggcctgcggcaggaggttggcggcgacatcagggtcaccgtcatttcaccgggcgtgacgacctccgagctcgccgactccatctccgatccggtcgcgcgcgagggcatgcgcgaataccggcgggtggcgattccgccggaggccattgcgcggagcatcgccttcgccatcgagcaacccgacgacgtggacgtgaacgaaatcatcgtccgtcccaccgctcagtcctgacggagggtgacaccgcagggcggggcttcgcgcggctccgtccaggaagaagcgagtctgggcgtcgtggcggacaggggtctgggtcttgattgacagcctgtcttacgttttagtaatcgagcaaaagcagtaaatgtcgaaatattcgaagccggggaatgacgtcatgaagctggcaacgggaaagctgttctgcgccatcgcttccaacgggtcccaggcgttgctgtaccggaacgacacgaccttcaccttgagctgagtgaaggctggcacggccctttttcacgtgggaagggcagcgccggggtgccgtgacttgcgggctgcctcatcgcggggatgaggcagcccgtgttttttcgcggctcaggcccgttccacgcggatgcgcgcgggcagcccgttgatgctggcttcttcttccttgccggtgaggccctcggggcccacgaggatgctggaggccagcgtctcccgagcgatcaactcccgtgcttcgtccgtcacgcgcttcacgcgcgcgtcgccgtccacccagagctggatgcggtcggtgtagcccagctccatgtccttgcgcgcgccctgcacgcgggcgagcagctcgcgcaccaggccctcatccaccagggactcggtcagctcggtgtggagcaccaccacgcccacgcccatgccggcggcggcgtagccggggttggcctccaccagcgtctccagctcctcggcggtgaagaccaggtcctcgccggccaccgtcatggccacgcggcccgtctggagcaactcgcggtgcagcgcggcgccgtcacccgtgtcgaaggccttgcgcaccggggccagcttggggcccagccgtccgcccaccgcgcgcaggttgggccggacgcggaagcgcaccacgtccgcctccgggctgcccggctccacgaagcgcacctcgtggacgttcagttcgtccgcgatgaggtcgcgatacaccgccacgcggtccgtcagctccttgcgcgccaggatgacgtccgcacgcgacagcggctggcgcaccttgaggcggttgtccgtgcgcaccttgaggcccagggagaccaggtccctcaccgcgcccatctccgccgcgagcccctcgtcgatgagggacgcatccacggtggggaagcgcgccaggtggacgctctccggctgcgtggtgggccagggcttgcgcaccaggttgccccacatctcatcggcgaagaaggggatgaagggcgcggacagcgaggcaatggtggtgagcgcctcgtagagcgtgaagtacgcgtcctgcttgtcctgttcgaagcccggcgcccagaagcgcgaccggctgcggcgcaggtaccagttggacagcgcgtccaccagcgccaccatccgctgggccgcgtcgtagacctggtaggtgtccagcgcgctggtgacgtcgcgcagggtgaggtggacctcggacagaatccagcggtccagcaccggccgcgccttcacctcacgccagccctggctgcggcggatggcttcccacggcgagtcggtcgcgtccgtgttgccggccgccgggttgaaaccgtcgatgttcgcgtagatggtgaagaacgagtagacgttgcgcagcttgacctggaagtccttctgcaacagtcgcacgttgctcagcgagtgccgcgtgttcgaccaggtggggctcgccgcgtagaagaaccagcggaacgcgtccgcgcccggcgccttggcgggggggtccttcagcaccacgcgctcggaaggcgccatccggggcgcctccaccggcatgacactggcgccacgctcggagggcgccacgtccagcgtctgcaggtcagcgggcgccagcagcagcacgcggcgcttgagcttcttgtgcgccttcaccgtcgcggtgatgaccacgtccggacggtctggccggaagagctgcaccttggcgccctcctggatgtccaggccctccaggtcctcgcgagcgatgagcgccacgcccggctcacccggaacgccggcctccgtggcagtgaggaccgcgaagtccatgcgcacttcgtccaggatgatttccggcggcgtgtagttgcccttggacttggactccttgcgcccctccttgtcggagacgtggcccagcacgatgcagctcttgtacggctgcggccagccgcgctggggtgacaggcccatgcgagcctgcgtctcctcgtcgaagaggagcgtgctcaccatcagcagcgagtagaaccagccacgcgtctggtcgatggcctcggagatgaagtccgcggggaaggcgcggttgaagatctcccgcgagcccggcgcgtgcgggaagccccactgcgcgaagggcatgcaaccggagtcgaaccacacgtcgacgacctcgggcacgcgctggaagcgccccggcatgccgggcttctcgaacgtcaccttgtcgatccacggcttgtggacgatgaggtgtctggcgttggcctcgtggggcttgcccgcgaggaaggcattcagctccgcctccaccgcggccacgttgttgcccggcttctcgcgcagcgcctggagcgaggggatggcctccacctcgcccgtctccgagtgcacccagagcggcagcggcgtgccccagtagcgctcgcgcgacagggcccagtccacgttgttggccaggaagtcgccgaagcggccttccttgatgtgctcgggcacccagttgacggcgcggttgttggcaatcgcctcgtccttcacggacgtggtgcggatgtaccaggcgggccgggcgaactggatgagcgggtcgtcgtccgcgcgccagcagaaggggtactcgtgcttgtactgctccgtgaagaggaccagcccgcgctccttcaggtggcgctggatgtccttgtccgcctccttcacgaagcgccccgcgacgagcggcacgtcgtcggagaaggtgccgtccggcttcaccgcgcagaacagctccagcgcttccggctgggcgaagcgggccttgtccttgcggaaggcctcgtagtcgtcctcgccaaaagccggggcgatgtggacgatgcccgtgccgctgtcgagcgtcacgaagtccgcgcccagcacgcgccaggcctgcgcgtcctcaccgccgtccttcagcggcagccgcgtgtcgcccgcgcgctggtggtagaggtcgaagggcggctggtagcgctggcccaccaggtcgctgcccttctgcgtggcgagcaccggcaggtcctgcttgagcttcttcgccagcgcctcgcgcagcgccgcggcgacgatgagcttgcgctcgcccgcgtccacggtgacgtagtccacgcccgggttgacggccgcgtacatgttggacggcagcgtccagggcgtggtcgtccacaccaccagcgcggtgtccggcgtgtcgcgcagcgggaaggcgacgtagacgctcgggtcgtccaccgtcttgtagcccaggcccacctccgcggcgctcagcgcggtgccgccctgcggccaccaccacaccaccttgtggccctggtacagcaggcccttgcggtgcagctccgccagcgcccaccacacgctctccacgaacggacggtggtaggtgacgtaggcctgattcaggtccacccagaagccgatgcgctcggtgagccgctcccactcggaggtgtagcggaagacggattcgatgcagcgctcggtgaagggctccacgccgtagcgctcaatctccgccttgccgtggatgcgcagttccttctcgacctccacctccacgggcaggccgtgggtgtcccagccggccttgcgggggacgtagtggcccgtcatcgtcttgtagcgggggaacaggtccttgatgacgcgcgtgaggacgtggccgttgtgcggcaggccgttggcggtcggcgggccctcgtagaagacgaagctgggggcatcctcacgcgtttcgagcgagcgctcgaagatgcggcggtccttccagaaggcctggatgcggcgctcgtcggaaggaaagtccatctccgcgggcaccgcatcgaacagggaagggggcgtttcaggcatggtgcggtgcttgatagcaccgcccgcgccggggatggatgcccgtcctgtgaatcagtacagcggacagatgagcggcccgttgcggccacagacgtcgcggttgatgtagtagccccagtccgggctgtagtaggcgtacatcgtcggtccgctgcggcaggacacgtactgggacgagaccaggcagtggatgtccgggtcatactccgggtagagcgcctgggacgcggactccgtcgtggcaggctccgccgtggcttcgtccatggctccaccacagccagccatcagcagggcggcaatgcacatcagggttgcgcgattctggggcatgggactctcctgagaccggcgtccatcgccggggtgtcgagcctaagccgggatggtattgatttcagggtaagcccgttgacgcccatgtgtgtatgtttctagattctcgggcattgagaatttcacgccctggaatcgagagagacatgaaaaggctgctgctctgtgccctgtcgctggcggtcgtggtgggctgttccggcgcgccgcctgaacagtccatcgcgcaggagggcttcaaggtccttcagcacgacgcgacgacgctggaggccacgtacggctccgggggggctgtggtgcggatgctcgcggtggagacgcaggccaacgtcgtcgaggtgacgtacgactttggcgaccccgtcatcgggttccacatcgacttcaatcagggcgtaggccagttcatgccgtcgggcagcccgttggacgcggcccattcgcacctgctcgcgtcgctgatggaggggcttgcccgcgagctccccgaagagggccgcacccgcgtcgaggacgccgccgagcgccagacgagcttcatgcaaatcgtccccgtgggcgaggtcctcacggcgtacgagtacgtgtccgagcgcggctggacgcacatctcctgctcctgcggccggcagtacatcggctctggctactaccgcacggcgggcatgggctgcggctgcaccggcggctcgggcaacggctgcaagggccgttgcgggcagggctgcggcgtcaccagcctgccgcgttgcgtgggcaccacggcctacacgcaggactgcgccaagcacgactacggcctgggcagcttcgcggcggcgtcggatgattactcgttcgcgcgcaacaactgcagctgcagcggcgtgggttcgtgcagttgaagaagcgcgtgctgacaggtgcggtgcgggtgctcgtcgcggggatggccctgggctgcaaccgggcttccgggccttgtcctgatggcgcgcagcttcagggccgcgcgccgcccgacggagtcctccagtggtgtgcccggcccgacgggaagaagcacggccgttgggcggagtggcacgccaccggggcgctgaagacggaaggcacctacgtcgacgggaagatggagggccgctgggtcagctacttcgaggacggcgtgaagcagttcgaaggtgactatcgtggcgggctcaagcaaggactgtggaccctttactaccaggagggccagaataaccgcgaggagctccattcacccggctccggcccggtgaagtggaccgcctggcgctcggacggctcgaagtgggcggaagggacgctggcggggcatcgctcgcagggcgcttattcggagtggcacccccatggcgcgctggccgtgcagggccagtacgagaagggggagaagacgggtgagtggaagtactgggatgtcgcgggcgtcgccacggatgttccgcagggcgacttcgacagcgagtgacgtcacgtccgccgccgtgggactcctgctggcggcgggagcgtgcggtccttctgtcgttcccgtctccccggagacgctcaccccggcgcggcgggccgtggtgggcggagcgcccgagccgggcttccccacggtggccgccatcgttcccgtcccgcccttctgtggggagcctgacgaggcggctcgcgtgctctgcacgggcacgctggtggcgcctcgggtggtgctgacggcggcgcactgcgtggagaacgcggatgctccacgggtgttctcggtggtgttcgccgcggagacagcccgtgcctccgccgcgcagcgcatccgcgtggtggagggccggctccatcccgcgtggcgcccgggcgtgagtgacctgggcgtgttgattctcgccagcgatgcgccggtcgctccgctggcctgggcggcgcgggcgtttcccgctgacggcgtggggcggctggcgcgggtggtgggctttggcgcggacggggagggcggctcgggcctgcgccgtggcggcctgtcccgaatcacgtcggttgaagcggacgcgttctccatcgaagcggcgccagcgatgtcgtgcggcggggacagcggtggcccggtgttcatcgaacaggacggcgtcgagcgcctggtcggtgtgacttcgtttggtgacctctcctgcaccacggggacgaacagccgcgtcgacgtgcacgcggacttcatccaggtcgccatcgaggacgcctcgcgaggcgcgcccgtccggacgctggtggacccggatgtggacgcctgcgcgcagtggtgccgtgcgcatgcggactgccccgtgggcatggcgtgtgtcgcgcgggcggacggcacccggagttgcgcggtggcggggctcgaggcgggccacttcgggcctgcctgcaccggcgcgcagggtgagcatccctgtgtgaaggcgggctcggcgtgccggctgtggctgccctgctccgagccgcgggatgcaacagcgccgggcgggtgcgcggcggcagggggcggaaaccccggcctgattccgctggtgcttctggcctggtcctggggacgcggccgtcgcgcgaagggcgggtagtccgcgagcgccttctgctgcccgcctgcccacccctctggcatgttgtttaactgggtagtttaatttagggcggaggtcgttatggtcacccccatggttcagcaacgttccgagcagctcgacgcggtcttccacgcgctttccgacccgacgcggcgggagatgctgcgcagcctgtcctcgggaccgaggagcattggcgaactggcggcgccgtctcagcatgtccttcgcgggcgctagctagcaagtccagacc

SEQ ID NO: 1054 - DNA, 9497 bp, Myxococcus xanthus
gtgctctaaagagcctgctggtggcggccttcgcgctgtacgaagaggcccgcatggcgcccacgccggccgcgcgtgacgcgctgatcgccatgggaaacaactacatcgcctggcgtgagcagcacgacatggcccagcctgtcttctcccccgccgttcagcgcccagacgaggtctcgcgcgtcgaactgctgcgcgccatcaccccgctgctgtccacggacttcgggacgatgacgtggacgtacgcggacttcgcctacagccggccggaccgcgacggcaacccgctcacctcgccgcccactgagtacaactgggccctcttctgggaccgctggacgggcattctcttcgcattcgacgcggcctatcttcagcccacggcgctctgggtcatgcctgaacccctggtggaccccacggcggcagcgaacggaggctgagcgcgcatgggcgagtcggggcggcctggggggggccggaaacgggggcgaagggaccggcgccgtgagcctcctgacgcaccaggagcccccgcgagcgccacgccgggcggcttgacgcctccggatggccgggagaccttcccggcccccatgagactcgctccgtcttccgagcccggtcgtccctcggagccgccccccgcagtcaccaccaccgagctgcctgcgcacgccgccgacgaagtcggcctgtccgccgaggcccggttgtgcgtgctgcaggagatgatgggcgaggccttcttcacgctcgacgcccacggccgcgtccgcgagctgaacacgcacgccgccgccctgctgggtgtgtcggccgagcaggtgcgcggccaggagccctggcttgcgcagcccgagctttcgggcacggtgctgcacgaacggctgatgacggcgctgaccacgcgtgagggcggtcgcttcctggcggagctgccgtcgcggacctggctggaggtgacggtccgcgtggtgggtgacgagacgtgggtgctggccacggacatcacccagcgccagcacgcggagaacgaagtggcgcgcaccgaggagcgcttccgccagttgggcgagcgcttccaggtggcactcgactccgcgcagatggccgtctgggagacgaacctcgtcaccggccaggtgttccgctccgaggcgcatgaccggctctacggctacgcgcagccacaggcggagtggacgcacgagaagttcctcgcctccatccacccggaggaccgcgcggaggtggaggcccaggtcgccgcgctcttcacccggcacgtggacgcctacacgtccaccttccgcacccgctggccggacgggagctggcactggctcaccagccgggcgacggtgattcgcgatgccacgggcaacgtcgtggtggtgcgcggggccatcctggacatcaccgcgctgaaggagacggaggccgcgctgcaacaggcggtgcgcacgcgggacgacttcctctccatggccagccacgaactgcgcacgccgctgacgtccctgcgcctccagttgcagttgctgcggcgcctgggcgcctccacacctggcgcgacgctcggctcggacaaggtcgccgggaagctggacaacacggagcgccagttgcgcaggctgggcgcgctggtggacaacctgctggacgtcagccgcatccagacggggaagctggacttccagttcgccgacggagacctggcaagcgtggtgtcggacgtcgtctcccgcttcgccgaggaggcccgcctggcgggcgtgcgcctggactcgcacgtggacgcgccggccccgtgccgcttcgaccggctgcgcatggagcaggtggtgagcaacctgctcaccaacgccttccgctacggcacgggcaagccggtgaaggtgtcgctgacgtacgcccccgacaggacccggctggtagtgcaggacagcgggccgggcattcccgcctccgaccgggatcgcgtcttcgagcgcttcacccagggcgacaacgcccagcggcgcggcggcctggggctggggctccacatcgtccggcaaatcatcgacgcgcacggcggccgcgtccacgtggaggaaacgcccggaggcggcgccgccttcgtggtggatttgccacggtagggcaggtgccaccccgttccgcggggcgggtacggcatccacttatggacacatgcggggcgcagcccacgggctgacacccggcccttcctccgatttcttacaccctgacgcttttcgggaaggacttggcgtcatcagtgaatcggggttcgccgaacacgtgcaatatgccgtcccggttcggcgtccaagcgggcgtgggttcgttgctcgtcatggccgcgccgatggttccgtcaggaggcgctccgatgtggattgagagcatcatcatgccgcgcgaggacgactcggagccctacgtcccggcgccccagcgggaccggcgcagcgggctcgcggcggcgttggaggagagccgcaagctgcgcgacagggtgcaacgcttcgtgagcgcccatgacttgtcggacggcgtgaggtggctcagcgagcccggcctcctccccgtcatcaccatccactgcacggacttcgcgctggcgaagttgcgcgaagccgcggacttcgtggtgggctgcgcggcgcccatcgacgtctaccccgcgctggtcggcacgcagggccaggtggctcccgaggccctgctcacctcggcggtgtcacacctgcaacgccgcgtgtagggccgcatcacagcgtggggatgcgccggtagctgtgtcctcgttcctttccagtgctcctgccacgtccgcgaggacagctcagccgaagcgcgcctggaacgcgcgcagattgggtccatccccaccgcgctcgtagacggcgaagacgacccggtcaaaggcgcccgggagcgagcccagcccgagcgcgaaggcctccgcgacttccacggggttgttgcggaacacgccgcatccccaggcgccgagcaccaaggtgcggtgcccatggtgcgcggcgacacggagcaccttcagggcccgctcatccagcaccttgcggatacgtccccccatgccccggtcgcgtgactgcgccacacccgcgttgggcgcgggcgcagtgaggatggacacatggaagggctgctccagcaacgtcaggccctcatcccgaaagaacggcacgtccggcgaataaatgagatggtccgtgtagagcggcgacggctccgcgcggttgacgtcgtagtactcgcgctgcgtgagcaggcacgtgtacagcgccgagcagcgtgccaggtcctcctcctgcgccttcgcgccgcccaggaaaccacccccgggattcttcgccgacgcgaagttgagcgcggccacatgggacgcgcccgcctccaccagccggcgcgcggcggcgcccgtcttctcggcggtgacttcgattcgaggcgccgacgggttcgccgccgtggggaatgacaggcgcgagaagtcacccggccggtacagctccgtgccggagaccgcgcgctccacggcctcgcccagttggacacactgccccgagggagccaggtactggccccgctcgatgatgtccaccgtctcctgtccaatgcccttcaacgacatgtgccgcgtcctgtctgtccgcgctcacgcgaaggtgcgcgagccttagtgtcacaaaaacacgaacaaaccccaggcaacctgacaggaaccgtgctccgacgtggctcagtcgcagccgacgcgctgcgtgctcaccacgacgttgtcaatccacgtctcggagccggacgctcccagcgggtggacgaagccgtagcccacggagaagttgttgaaggcgcgcatgccgatgttggtgaagtcgtgcgccagcgtgccgtccacatagacgcgggtgttgccatgcgtgctcgacgggctgtcgcggcggacctcccactccaggcacacccagcgccccgcctccatgcccagccggacgggctcgggctggcggttccatccctgcccttcgcggaaggaccagtcatccagcgcgaagccgctgtcctgcatgacctggagttcgaagccaccaaagtccgcgccgaagttggacagcacgaagaaggtgcccatctgcccgaacactcccggcagcgagcgcatgtagacgtgcgcgcgcacgaagagccgggtctcgaaagccgggatgctcttctgccactgcgcgatggccttgccaggacgctgccgctcgtcgtgtccatcctcggtgaggacgtgcagcgcgcccgggccgttgcgcgtccgcgtgctgtccacctggagagaggagttctccgcgctggcgctccagccgttggtgtcgttgccgctgtcgaacaactcgcagagcagcgcgttggaaggacaggtcccgggctcggtgctgggccccgggttgtcgtcgcccgcgtccgtgccggaatccgctcccgcgtgggtgcccgcatcggtgccggcgtcattgccaggaggtgggtcgtcaccatcgtccgagcacgccggcagcacgcccagggacaggaccgcgagggggagcaggaaagactgcttgagacgcataggttcaggtatccggacaggcccgcggggccgggcatgcgctgaggggacgcggtcggcgggctccccggaccggtgccgaccgtcatgaatccctatcactcgcagtgcctgcgggtcacctgggctgggccgacccagggggcagcccgacctgcatccgaattcatggcgaacggcgccggagtcgtgcaggaatccgcgccatgaaactcttctactcccctggcgcctgttcgctgtcgccccacatcatcctgcgtgagggcggcttctccttcaccaccgagaaggtggacatccgcgccaagaagacggcggcgggcgaggacttccacgccatcaaccccaagggctatgtcccggcgctccagttggatgacggcagcctgctgaccgagggccccgccatcgtccagttcctcgccgaccaggtccccgacaagaagctggccccggccaacggcacgctggagcgctaccgcctccaggagatgctcaacttcatctccaccgagattcacaagggcttcagccccctgttcaacccggcgttcccggatgacgtcaagcggctgacgcgtgagcggctcgcgcagcgcctgggcgtgctggaggtggtggtggcgaagcaggcgttcctgctgggcgaccagttcaccgtggcggacgcgtacctcttcacgacgctcaactgggccgggcacaccaaggtggacctggagcccttccccgcgctgcgcgcctatcacgcccgcgtggcggaccggccctccgtgcaggaggccctgaaggcggaaggcctcgcgaagtgacggcggccttcgtcaagctgctcgtcacggacagcgcgcgctcggtggccttctatgaggcgctgggcttcacgcgcgtgagcgccgagccccccttcgtccacctccggtgggcggaggccctggatgtgtacctggtcaccccgccgccgcagctgaagctggaaggccgtcgcggcacgggggtgctcgtcggcctccgcgccgaggcgccccacagcctggacgaggtgctcctgcgggcccaggcccagggcgccgccgtggacggccccacggttcagccctggtacacccgggaactcatcgtcaccgacccggacggctaccggctgaacttcatcgagccggcgtagccgcgcttcaccgcgggccagggcgcgcggccttcacttgaggccgccgccctgcgcccccgcttatcgaaccgcttgccctccagaggcgacgtccggcaggcacctctccgagcagcttctgcgcacataggagcccgacagttccggggcatggaagcgacggccctcgccggttacggtgcgggcctccgctcccgcatcatggaatcccgcgtcgccgccctcttcgcccacgtgcgcgagcacgccgagaatcgcccaggcgtctaccggatgctggggccttcggacgaagtgctctacgtgggcaagtccgtgcgggtgcgcacgcggctcttgtcgtacttccgcgcggaagcgcacgagaaggcggcggaaatcatcgcccacgcgcaccgaatcgtctgggagtacacgcccagcgagttcgccgcgctgctgcacgagttccgcctcatcaagtcacagcgccccctctacaacgtggagcacaagcgggaccggggccactgcttcatccatctgacgcgcgagcccgtccccaggctgcgcgtggtgagtcgcgccagcagcgagcgcggcgactactacgggcccttccacggacgaagcgccatgtccgacgtggtgcgcgcggtgagtgacttgctggagctgcgcgactgcgcggcggacacgcccatgcgactggcggaccagggccagctcttcccgctgaagcaggagccgttgtgcatgcgcgggcagctctcgcgctgcctggcgccctgcgccgggggctgtactcgcgcggagtacgacgcgcgcgtcgcccaggcccgcgccttcctcgaagggacgtccgacacgccgctgacgctgctgcgtgagcgcatggcgctggcggcccgcaggctcctgttcgaatacgccgcggagctgcgggacagggcggagcggctggagctgatgcgcggctgggtggtggagctgagccagatgctcaagcgcctctcattcgtctacacggtgcccggccatggcggcgatgaccgcgtctacgtggtgcgccggggcagcgtgcgcgcggagctgcccgcgcccgtcacgctcgagcaacagcaggcgctggaggcgaaggcccgtgaaatccttgagcagcccgagccggagacgctgggcttccgtgcacacgaagcgcaggaggtgatgctcatcgcccgctggttccgcctgcaccccgtggagctgaacgaagggccctaccaaccggtagggcccttttgttttacacgggcctcgcgatgacatcgcggggccttcgtgcttaagccgctgaatcccaagggattctggctcgcggtgatgaagagggcgctctcggctctctaccccgcagagcgagatgcccccttttctccgccgccggctgggctctctgatgcactctttcgcccgttttggggagagagaggccgagagtggttaacagttttgttaaccactgcgggcagccgattctggcaatccagggctttcgatgtcgtaccttccaggagtgcttcgtttcccggtctcctaaaggtgacggaacctcttgccacctctcgccatcaaggtgttgttaaccgagatcgcaaagacgcgaccacgctttactgggtactcacgacttcgtcgccgtggtgcagacactccgagccggggggccttaggctggaaaactcccgtccgctgccgcgaggcccaggtgcaccggatctgtcttacccctcggcgctaccagttgctctgtcgtgccctccagagagagtcgcccagaaattcgaggttgcggctcaccacggtcgctgggcaggcatccaccggcccgggctccacgaccctagcgctgaaatggcgagtcgcgcattcacgcggggcgcgcatcttcagcggcttggatgggtgcacggtgttgtagtcgtcgaaccaagtgggcagttgctgaaggaccacctctgtgctgtccaaatgcgacagctacacatagtcgcacttgaagctcttcgcgaaggacgcgtccatgccgttgctcttgagcgagcaggccagcccattgtcggtgagccacgtaatcgggtgtggtgccctccggcagccagcgccgaatcgggtctcctgcgtcgtggctatcaagcccagcgccagacgggcgcgatgacctatcgcccctctgtctcgacgttcactcactggcaatgacttcgagtggaacgcctgcagtttccaaaagatacacttcggtagctgccaagagttccagttgccggatctcggctgcagacctggacaaaccaggttggacaataacgattcgcacctccagcgcgcaccgggacagcgcctgatcaagttcgcgaagcgtgcgcagacttccacgctcaaagcgtgagacatgcggcttacctgctcgctcaaggcgtagctgtcgactagcctcacgatttcgcagatgaatcagcagatcacggatgtagccacgccactgagcacttcgctgtgcctgtccgcagacagcataaaggtcgtcgagacgggcgcccggacgccctgccgaagaaaacttacagtgatataagtgcacgatgagtcggtcctcgctgttgccgaggcagacaacgtctgcggcctctccagcatcatcgtcgtcgaatacaacctggaacaactgttcttgaagcatgcggtcaagcacacgtcgctggatcgaatccgccctcttctccagtccctgagactccttactcagatccactccggtccagtcccatgtttgaatgcgctgccgttcatagggacggcgcgcctctggcctgggcagctcaaacaactcgttgtgctccaattgagagccgtcctcaaaccggataacaggcggttcctcttgaaaccactcgctgagggggcggcgcttgcgccccactttgatgtagacgggatggcgaccagcagggtcgtaatgaacgttgtttccagcgaaacgcaccacgtactccgccaagcgcgtaggagtcactacctggaagcgaattgggccttcgctggcgtagttgacgatgcgtagctcagcatcactgaagagcacagactcaccatcgatctcgacttcgatcgagtcctcgggccgaatgaggaatgcctcaggccagtcaatctgcagggggataagagccggccgctcagttacgaggcgcggcaaaattacgttccggaagacgtccgcagttgagatgctctcgtccttcagtttggctccaacggcgtggcaccaattgacccacgatgcgaggtccatggcggttgacatcgaccaaacccggcccttctgggaatacccgatggtgacccgccgcccctgctcataccctcgagcgaagaggttcgatttcttcttctgctgacgtagtgcatcgggaagtacgttggagatatcggacccgacgtggaggctaaatcggaggcggtcgttgattatgtcgctgagaccaaggttcgtgagaactaggcggttgacattgtgaagtgaccgaaacaccgcctcgccccgaattaactccacgccatcgcctccgacagcccgcgcgagttcttcgtgcatgccgacgtgattggagctgttgatgaagaggagtcctcggcgctcgtccctgagag

SEQ ID NO: 1055 - DNA, 9981 bp, Myxococcus xanthus
gggcggtgcggctggatgtggggtttggtttctaccatcagccccggggcacggcggggccgctgggactggatgtgatggagctcttccgggtgccgctggcggacatgccgctggtggcctcggtgaaccggcgggcgtgggacgcggacgcggacttcgaggtgacgtccgagcacgtctggctcagcaaggcggggcgggcgaaggccatcgagctgtacgagcggcgcaagcgggagacgtggaagaacaacgtgctggggtactcgctcagctatgcgcggctggtggagctggaggtgcggctgctggagaaggagtggaccggcaagccggggctgttcgcgacgttccgcttgaggtgagccatggccgagccgaggcgttggtatttgattacctatgacatccgcgaccccaagcggtggcggaaggtgcatgccctgctgaagggatacggagagtggctgcagctctccgtgttccgctgctcgctgacggaccgggaccgggagaagctgcgctgggagctgtcgcggcggatggacgccgtggatacgttgctggtgattgggctgtgtggcgggtgcgtggagcgcgtgcgcgccatcaacgcgaaggaggactggccggaggagcccgcaccgttcaaggtgctgtgagacggacgacaatcaagcacctcgccgtggcggaggctcgcgatggcgaaagtggcggattccctgtcgtttcatgggggtgaggctctttgacaggtgaataggtgcatgatcgatgaaaagccgagtggtttcatggggttggcgattctgggtagggcctgggatggccaacctgggggaaggagggggaggtgcttgaaaggggtttgtaaggtgccggaattgctgggggattcaggcgggctgtctcgctcgccgtgatgccgaaaggcgttgagcactgctgacgcaccacggcaagcggatggggcgctgtcagtcccgctcgccgtgatgccgaaaggcgttgagcacgtttccgacgcgcacgcgcttgcggtgtccgtccgggtcgtcccgctcgccgtgatgccgaaaggcgttgagcacaaggcgttgcgcgccaccatctggcagtgcatgccgtcccgctcgccgtgatgccgaaaggcgttgagcacccgtggcggcacacctgtacggtgccaagtcatgagtcccgctcgccgtgatgccgaaaggcgttgagcacaatcctcactgtacgaacagcccgcgctgcgtcctgtcccgctcgccgtgatgccgaaaggcgttgagcacgcctgatgcagcgtggatacacgctgaagccgcctggtcccgctcgccgtgatgccgaaaggcgttgagcacgagaagggtgtcaaggctagcattgaaggctttgtcccgctcgccgtgatgccgaaaggcgttgagcacgaggtcgctgccgccctgcgcgccgtgggcttccaggtcccgctcgccgtgatgccgaaaggcgttgagcacgcgtctatcgccaggacaagggctgtgtgtccttggagtcccgctcgccgtgatgccgaaaggcgttgagcaccctcggatgttgcgttggatcgcgtcgtaggtgtgttgtcccgctcgccgtgatgccgaaaggcgttgagcacggcgcggagccgaccgccatcgcgcgttccttcgtcccgctcgccgtgatgccgaaaggcgttgagcaccgccagggggggtcctgaacgcgattcaccgcgtcgtcccgctcgccgtgatgccgaaaggcgttgagcacaacgacctctggtcgaagttggtgcgtggcaacgaatgtcccgctcgccgtgatgccgaaaggcgttgagcaccctcggatgttgcgttggatcgcgtcgtaggtgtgctgtcccgctcgccgtgatgccgaaaggcgttgagcaccagggctgggacctgtatctggagaagacgcgcgttgtcccgctcgcagtgatgccgaaaggcgttgagcactacccacccatgccgaccgttatcagctcccacatctgtcccgctcgccgtgatgccgaaaggcgttgagcacctcgatgcgatgggttcgaatccgggcggtcctgtgacgtcccgctcgccgtgatgccgaaaggcgttgagcactcccgggcctgagctacacatccgcgctggcatgtcccgctcgccgtgatgccgaaaggcgttgaaagcacgtcagcatcgcgtccatgttcttgctctccatgtttcgtcccgctcgccgtgatgccgaaaggcgttgagcgtcgctggttgttacgccagtcgttgttggtgtggccgcacacactatttgagttgtgaatgactgttctcgcggacactgattgaggggctcgcgaggagaggttccgaaaatgccattacggagccgcgccaccggaaatcacgctcgtgatgggagtcaactcattgtcgcgacagcagtttccgcgagaagcggaaatgattgctcccatcctgcggttctccggtcgcgtcagggctgcccgaagggcaccgccggaggcggccaagcccttgacgcgactggggaaccgtagtcccgaggctaccaaccaagtggctcaccggaccatcaacaaaggtgcgcggcaacacctcgggcgacagctgcaaggtggtattgacggagatgctctgcgacatcaacaagaagtcatgctgaactctctcttgctcccgtttgatgccctacgccatgaaagaactgctcaagtacatcaatggattcgaacccgcattttccgatcaggcccagggagcgtcggcagtggaggtctcccggctcgagagcctgctcaagcggcctcttccctcccactacaaggacttcctcctcagcatgggacgaagcatgggaagcctccgcgaggaagataccgacttcgccatcggccggatcctgaagttctacgaaacgagcaagcggcatccccctcggaggtacatcttcattggcgcccagctcgtggacacctacggaaggttcttgctcgactgcggggaggccacggagcaggctgactgtcctgttgtccaggcggacccagaagagccgttcaagaacgaggaccatatcgttcccctgtatggtcccttgaaggacatgctcttcctgatggccttcagcaggaagcggatggcccttctggagcatcggcgacggttcctcccttcactcgtgcgcagcggaacggggaatgtccgaatcgtggctccctccttggtgggagccatcgacgagacgcttctccagctcggcttccagacgctgccctataccagcccactgactccgctctacgagcgcggtgacgcagccttctacgtcgaccgttcttcacagggaggaggactgtccgccgagttggcggcacgagatgagcgagaattcgggaggctggtcgaagtcatccaggattctacgactcttgtatagtattatccggtcaggtgcaccaagcgcggtcgccccgtgctgacggatacgggcgccattgccatcccagaggacggcaagtcccgctcgccgtgatgccgaaaggcgttgagcacaacgcgacctgcggcgtctctttgtatccgtgcaccgtcccgctcgccgtgatgccgaaaggcgttgagcactccctgcgcgatagggccgcgcgcgtggtacccttcggtcccgctcgccgtgatgccgaaaggcgttgagcacaaaggtggggcgtcctctcgcaccaggtgccccgcgtggggtcccgctcgccgtgatgccgaaaggcgttgagcactcgacggggacgaaatgggctcacgcctctggacggtcccgctcgccgtgatgccgaaaggcgttgagcactggaagaagacggccatccgccggctgatcaagctggtcccgctcgccgtgatgccgaaaggcgttgagcacacatggatgccgcgcagtgcctgcatcggcccgagcccgtcccgctcgccgtgatgccgaaaggcgttgagcacccagcgcatatccctcgtaccgcccgaggttcggtcccgctcgccgtgatgccgaaaggcgttgagcacctgagctgcgggtgaagggggcgttgcaggccaaggtcccactcgccgtgatgccgaaaggcgttgactgccctatcagaagatcttcattgtagcctgggccagccatgaacgcagcgcctcgccttcaacccggacgggcgcgttctcgtgacccagatcaatccaggaggcctgggtcgcctgtaatccggaggcgccgcggagatctgccccagaaagcctcgctccatgaaggaccgcgccttccagatgcgcatctcggagattcgcggacgcgaggttggcactgaccaggtaggcgccttgaaggtccgcgccttgaaggtccgcgccttgaaggtctgcttcgccgaagctggctcggagcgcgttcacctgcgtcagaatggcccctcgaaggagcgcatagtccaggttggcctttgaaagctgcgctctggagaggctggcgccgatgaaagatgcggacgcaaggttggcgtgggcgagcttcgtcctgtccaggatgcatccatccaagcgcgccccaggaagcgctgcctccgatagatctctcgacgacaggtcgagtaaggacaagtcagcgtcctccaggtggaggcgcttgccgttctgtcccccggaacgcagccattcggtatgccaatccaatgccttgatgaactccgccgtcatggtgttcatgcgctcgtccgtattcgtcctagggaaaccacaagatcctggacgaaactgaagggcccaaggcgtctatcgcgtttcgcagcgcttgaacgtgctgcgcgctcatgttctcggtgttgagaatgacgttttcaccacgagcgagttcggctttgattttgtcaaggtctcgttcaagcgagaagccacccttcctgggcgggaatcgagagtcaaaagtcttgatatcccacttgataccttgggagtcaacgaactctgactgccccgttggatcccgtttgatgggtgctgggagttgtctccgctcctcaagttgaaggcccacttccgcctcacgacgtgtcttgggggtgactttccctccctgtgccgggtcgctggccagttcttcaatacgagtttctctcggaatgcctcccgccggattcagtgctgtggcggccacggcattggggacgactcccacagtgagaatgccttctgccagggaaatcgagcgaacgccgcccgacatcgctgctgacagttggatgcccgcgttcgtctccgttgccagggcggcacgcgcgaagcccggaagcatcggacccttcgaggccatgttcgcggcccctccgcccaacgcagccgtcagcgccaggatgaggactcgcgcaccattggcgcccatgactcttccgaagtggtatccggcgtcctctagttgctcaaaggatacggcgtgcttcgtgtctgatgacagtcgttgccaccccttcacgaggtttgagaatgcgtccaggccgatgtacgcgatgacgtatgttgtcagggcaatggccacgagcttggtgaccggctcggggaccacgacgaggaccatgtaggcggccattgccgaggtaatcatcgccttgaggaccagtgggttgacgacttccttcaccgcctcctccactccttcccacacgccgtcccaagcaaaggacagggccatcttccgccgcatcttggcgtccaggaaggtgaagccatcctccagcaaggagaggcactcgcccggattgtcttgttgggcgcaccacgctccataatctctcccttggggacgcgactccgaaccccacgaagcgagatgtacacgtgggcggacctcctcctcggatcgtagagagaagcgcatctccagcacgagtcgggtcatcgccttctggaatgcccccgagtccacgacgatgggctccacgcgcttcggcggagtgtagacaatgggtgcgcctgctcccgtgtccaagcgcacgatccgcggcgtcgcgcagcccatcatgagccatccgaccagcaagatgcttccccaatgtatattcattgtgtcctccgagtcgtccgcccgcgaaaaggaacctgaggagtggtgttagcatttgagcccgacatccctcatgccggaccccacgcacgaggacagcgcttcagttcgccaggaattagccgttcagcagtgggtggctgctcgaaggggctgctggagggtggaccgtaggcgggacggcgctcgcatgctggatgtcccaccttcctgagccatggcacctccccttccaaggggccgactgaatgatgcgattccgcgaggggggcgagaggaagtcctattctaccaacctcggcgagcggttgatccgcttctatccgaaggatgctcgcatcccgatgggcccgaagcacccgggcatcaagctgtcggccctgattggcaatgagcggagcatgttgagtgtctcctcctcgctcaaggaggctatccagaagcactgcgcgaacgagattgaatccctcccattcacgctctacgaccactgcaatcgcccccaccgcgagggcaagtagtcgcggggcattcgtccgcagtgagtcctggcggtactcctttcgccgcgttgccctccgcaactagcggttgcatcgaaaatgacgcaggatgcgagtgtttggctgttcctgcttggcctgagtcggtcgttgacgcaagcggaaccacctggcggtccatgggcacgcgggcacgagatgaacaagcgccgcaacgcgccaccgttctggtggtccagccaggacccctcctagtaccggcaacagtgggtcatcatgcttggctggcgcgtgctcaccagtggctccaaccccatgtacaactggggctcgctgcgctgaaacacgtactctacaggccctgcgccggaagatggctcaggcgcccgcggcagcgacctcggcccagagcgtgtcgccttccagcacctggttcagtggcgcgcgttgctcggagacacgcagcagcacggcggcgagttggtccaggtggatgggccgcatgttccgcagtggaggcaggcgggtgagggcgcgcagcacggggttgatgtggtggtactcgccctcgaaggcgggcgggcgcaccaccgtccaggggatgccgctctctcgcaccagccgctccgcctccgccttggccttgaggtacgcgcccaccggccggcccgcgcccacggagctgagcagcacgaggtggtccacccccgcgcgcctggcggcctccaccaactgccgcgtggtgccgatgtcgctcgtctcatacgtgtcgcccgacccgaagcgcttgcgcatggtgcctatcaactggagcaccgtggtgcagccgcgcatcatctccaccagcgcctcaccgtcagacagctccaccacggccttgtggggccaggggcggaccaggtcactgtccgcgctcttcgggcgcacgtgcgcgaggacaggcggcgcaccgcgcgacagcgcctgtcgcatcagcgtgcggcccgtggcacccgtggcaccagcgacgaagagatgacgagagggcgtgttcatgagggcggactccggtggagatgggcagcgcgtcgtgcgggcccgagcgatgacgcgggctgtcggctcttcatcacactgcgtcgcgcgagcccagcgcggcgtggcgctccgtgtcgaaagaggcacacgccgcgcccccaagccgggtgttgaataaccatcgatagacagtcacccgatgggttgaggccctgtcctccaggcgatacattgccgcgccttggaaaatcccgaaccccttgtattccagcagagcttccaggggctgcttcgcgccttgggtgatgacctggatgacgcgtgcgtgggccgactgcgcgaggcgggcctcgatgcgcgaggctcgctggcgctggcctatcccttgaaggtctgggtggccgcgctgaaggtcgcggcggccacgctggcaccggaggcgccgctggacgaggccgccgcggtggtggggcggcgcttcgtggagggcttcagctccacgctcatcggcaacgcgctgttgggcaccgtgcggctcctggggccgcagcgcatgctgtcgcggatgacgcgcaacctgcgcacgggcaccaactatctggagacgcacatagagcaactggggcccacccggtatgagctgacctgccggcccgtggtggtggcgggcttctacgtggggctcttcctggcggggctggaggccagcggggcgaaacacccctcggtccagattgtccggagggagggcgaggaggcggtgtacgacatcgcttggagctgagcattgacggggagggcgtgctagtgacggcctgaaatgtcgacgccttcacccaccccctcttcgtccacgggtttctcggatacccaagcccagctctccgccaccctccgcgcgctgtccgcgcggctgcccgaatctctgacggtgcgggagctgatgcaggcgtgtggtgagcagggcctgctgctcttctgttgcatcctgaccttccccttcctcctgcccgtgtcgattccgggcgtgtccacggtgttcggcctgctcatcgtcctcatcggcgtgggcgtgacgttcaaccggacgccctggctgccccggaagctgctggacaagccgctgctgcgcaccaacctggccccggcgttggacaagggcgcggacgtcttcaccaagtacgtggacaagatgagcaagccgcggctgctggcgctcacgcacggctccagcaccaaccgcttcaacggcttcatgctcttcttcgcgggcgtgctgctgatgatgccgttcggcctgattcccttcagcaacacgctgcccgcgctggccgcgctcttcttcgccatcggcatcctgcagcgcgacggctacttcatcctcatggggcacgggatgacggtggggtcgctcacctacttcaccgtcatcatctacggcgccgtgcaggggggccgcagcctggccagtgtcttcggcgggggctgagcccgcgcctgggtagtggctgacctgccgcccaggctcgccttatttgcccggtgagccggggattacggtgcgtctggaatcagtcctaccgccgccaggggttcccgttatcatcgggggcgggcggcccccctctgatgcggcaatttcctcatgaaacccggcaccggccggaggatgcgacgcgtcgccacgcggaaggcgaggtcgtgggcgggcgctaccgcatcctcggcttcctgggccggggcggtgcgggcacggtgtggcgcgcgcaggatctgctggcgggccccgtcgcggtgaagcggctgcaccagacgctggaggacctggcgcggctgcctcggctgcccgagggcgagtacacgccgtcttccatcgcccggcatgagctggcgctgtcgctggcgcacgagttccagacgctcgcctcgctgcgccatccgaatgtcatcagcgtactggactacggcttcgacgccgagcaccggccctatctggccatggacctgctggaggacgctcggcacctggtgcaggcgggcacggggcagccactgcgtgtgcaggtggggctgctgatgcagacgctgatggcgctggcgtacctgcaccggcgcggcatcatccaccgcgacctcaagcccgccaacgtgctggtggcccacgggcaggtaaaggtgctggacttcggcctggcggtggggcgcgagcacgtccaccacgcgcagccgggcggcacgccgggctacctcgcgccagagctgttcgaggaccagccgccctcggagg

SEQ ID NO: 1056 - DNA, 12299 bp, Myxococcus xanthus
agcttgcccaacagctggtgatgacgccgcagctgcagcaagccatcaagctcctccaactgtctcgcatggaactgctcgagcaggtccgcgaggagatggagcagaacccgctgctggagcaaccagacgagcaagcgccgggggatgtgggagacaaggaacccggggaagcctccctggaagcagacaacatggaggtgccgcgggacgtggatctgcccgcggccaccagcgacaccgccacggagttcaaggcggacggggagggccccccggaaatcgactgggagcagtacctcaacagctaccagttcaatgagcccaccacggcctccaacaagggcaacgtggccacggacgacatgccgtcgttcgaggccaacctcgtcaagaaggcggacctggtcgaccacatccaggagcagctgggcacgctgcgcctgaatgacgccgagcgccgcatcgccatgctcatcctgggcaacctggatgacgacggctacctcaagctgccggaagtggacggggatccgctcatccgcctggccaacgaggcggacgtgcccatgcacgtcgcggagcgcacgctgcggcgcatccagatgttggatccgcgcggctgcggcgcccgtgacttgcaggagtgcctgctcatccagctccagggcatcagggagccgcacgcgccgctgttgggcctcatcatcaagcggcacatgaagtacctggagagcaagaacctgcccgccatcgccaaggacctgaaggtcaccttggaagaggtggtgggggcggtgcggctgctcccgaagctggacccgaagccgggccgcaacttcagcggggacgacgcgcagtacatctcccccgacgtgttcgtctacaagatgggggacgactacacggtggtgctcaacgatgacggcctgtccaagctgcgcatctccggcacctaccggaacgcgctgaagacgggcgcggtgggcccgggccagacgaaggacttcatccaggacaagctgcgcagcgcgatgtggctcatccgctccatccaccagcggcagcggaccatctacaaagtcaccgagagcatcgtgaagttccagcgggacttcctggacaagggcattgcctacctcaagccgctcatcctccgggacgtggccgaggacatcggcatgcacgagtccacggtgagccgcgtcaccaccagcaagtacgtgcacacaccgcagggcatcttcgagctgaagtacttcttcaactcgtccatcgcccgcgtctccggtgaggacaccgcgagcgaggcggtgaagcaccacatcaagcagttggtggcgcaggaagacgcccgcaacccgtactcggaccagaaaatcgtcgagctgctgcgctcgcagggcaccgagattgcccgccgcacggtggccaagtaccgcgaggtgctgggcatcctccccagcagcaagcgcaagcggtactactgagtcagggctgttcgggcgcgccgcttgtcgtcggtgcgcccgggggggcagagtgggcgtcccatgagcgccaccctccctcccgattccgccgtgcaccggcgtgactgcgtccccctcgtcgttccgcccgtcacgctcgaagggcacgacgtccgcctggagccgctgcgtccggagcatgcgccggccctggccgcgctgtgcgaggacgacatcttcacctggttctcgagcgtgctgcggaccgaagcggacgtcgcagccttcatcgacaacgcctgccaggcggccgagcgagggagcgagcgccccttcgtcatcatcgagcggcggacgggcgcgccggtgggcaccacgcgcttcctcgaaatccagcgcgaccaccggacgctggagattggctacacatggctgggccgccgcgtgtggcgcacgcgcatcaacacggagtgcaagtacctgctgctgcggcacgccttcgagtcgctcggcgtcatgcgggtgcagttcaagacggacaagcacaacgcgcgttcgcgggcggccatcgagcggttgggcgctcgcttcgagggggtgctgcgccaccacaaactggtgcgcggcggtgtggtgcgtgacagcgcgtactacagcgtcgtcgacacggagtggccggaagtgaaggttcgtctggaagggctgctcgcggacggcggtgcgcgggtatagggtgcggcgccgcatgaatcccattcttcgtcgcaaccttcttcacatcccggcgggggccttcgtcgcggtgggcctgttgtcgggttgtggcagcagcctcacttcggaagccgtggacctggcgggactctccggccggacgctgatgctgtcccagtcggacgtggacatcttcgagggcgtggatgagccgggcgcccaccgcgtcaccgtcaccttctcgcccgcggcggaatcggaccggtgcaccgagcttcgcgagggcgtcacggccaccttcaacggccagcccatggcactggagcggggcggggtggacggcaccgcgggccgcgacgtgtgcgtgcccacgcgggcctactacgacttcgaccccaacgtctgggtgcggcagcccatggaggacgcccgcatcgtcctccaggacgggacgcacaccatcaccctggtgatgaagaacggaaaggccaagcgcctcttctccttccagggccccggcgccgaggaccggctcacgcgcggccaggagtattcgttccggtggctgcccgagggcgaggtccccagccgcgccgcggccaccctgctgcgcgagggagggagcgccacggccaccatccccacggagcaggaagaggcggtcctccgcttcaccctgctgccgacgacgcctgtcgccgcccacctgctcacgctgagcgcgaccgcgcccggcgaggtgctggagtgcacgggcgtcgccacgtgcgaggcgacggtgttccactccgaggagcgggtcgtcaacgtgcagtgaggggccagggggcccgctccctcgcccgccatcctccactacgccgtcaccaagagcgccatcgtcaacttcaccaagggcctggcgcgggagctcattgaacggggcatccgcgtcaacgccgtggcgccgggccccgtgtagacgccgctcatcccccagtcgtttgacgcggagaagacgtccaagttcggcaaggactcgcccatgggccgccccgcgcagcccgcggagctggcgccgtcctacgtgttcctcgcctcggatgagtcccgctacgtcaacgcggaggtgctgggcgtgacgggcgggcggctgctcgcgtgagctgacgcggcgcgtgatgtcagcgggcgcgtcctggcatggttccaaacagggggccattgccagtgacgcgaggtgcaggcgggatgtcctgcctcggacgggcggtgtgtccgggaacaggcaacctggtggggcgggttgctttccagggctgggaaagtttcagatccgtcacggagctcacctctcaccctaggaggcagccacgcatgcagttcaacatcaccttccgtcagttcggagcgtccgattccctcaaggagtacgcacgcgagaaggtcgaaagggtgaaccggttgctggaccgagccggcgaggcccatgtggtcctgtcgttggaacgccacctccaccatgcggacatcaccatccactccggcgcgtgggtcctgcggggccgcgacaagagcgatgacatgtacgcgtccatcgacctggcgatggacaaaatcgagcgccagctgcggcgctaccgtgacaagctgaagtcgcaccatggccgtgagcgcgtccaccaccggcatgatttggtggagcagctccgggtccgccacgccgtgttcgagctcccggacgtggacgcgctgacgtcgctggccgaggcctccgcgagtgaagatgcgccgaaacccgccgtcgtgcccgcgcagcccgcggccccgtcgcaggctgcgcgcgaggtgcgtgccacccacctcaccgtcaagccactcaccgtggatgatgcggtgatgcagatgaacctgatgaacaacgacttctacgtcttccacaacgtggagtcggagtcgctgtgcattgtctaccggcgcaaggatggccagtacggcctcatcgagccgcacgccccggcgatcgccgccacggggacctgagccgtcgctgaccgctgacttccgcgcgccgtcacccggtgaagcagggtgacggcgtgtgacggcgggaagtccgccgcgtcacgctgtggcggtcgacgcgttgggcggtccaccaatcgaatgcctccgcgtgctggagggcgtcggtgcgggttcccatggggccccgcgcccacgtcccgccgaggggggcggtccaccaggctgctcccgaatgggggcctggacgcgggtgggggccaccccggcgagcatgcgccggtcgccctcgacgcgatgtcgatgacagtcgacaggaacagacgcttcatgggaagtccctacgtcccgtgggacgggtttcccttccgcgtcatgatgcgcagtgagtgcggagagcgcgcatccagacaggccacccttgcgctaaagaggggtggggagtaattgccgccaaccaggagcgccagcgcgggagcgtcagtgagaatcgccgagttcctcagcccccaagccgtcatcgccgacatgcagtcgcggacgaagcctgaagtcctgcgagaactgagtgccacgctggtgcgcgcccatccgctgctgaccgcggaccggctggtggaggtgctgcgcgagcgcgagaagcttggcagcacgggcatcggcgagggtgtggccatcccgcacggcaagctgccgggcatggggcaactccaggccgccttcggcgtgtcgcacgcgggcgtggacttcgaggccattgacggcaagcccacccacctgttcttcgccctggtggcgccagagaacagcgcgggggtccacctcaaggccctggcccgcatctcccgtctcttcaagaacccgcgtttccgggccgccatcctcgaggcgcccacggccgcggacatccacgccctcatcgtccaggaagacgcacggccttgagtgggcgtgcgttccggggggaacatccgcaccatggacgtcgtcctgagacccatcagcgaccgcttcttccacgaacacctgctgcctttcttccagcgggccatgggggatgcccccggcgcgctggagtccctgcaggagcaactgggggacggtcaggcgcgcatgctctgcgagcggatgctcgccacggcgctgcccggcggcgtgggctccgtggacgcggacccctgggcggacctggtggaccggctcgtcttcctgcactggaccgaaggccccgcgggctgggaggtcggtgaggcggaggcgggctacgcggacggctgggacgaggccctgcacctggcgctgatggtggaggaggcggactatccctactgggacgcgcggggctcgcgcgacgtcagggatcgcttccgtttccggccgcgtgaggacgtgggcctggcctcgctgctcgctggcttgtgggagcccttcccggagttcccgccggaccaggtgttcaccacccagggccggggcgaatactcccccgtcacacgctacgccttcgcggactgggcctggcgcccggcgaagaaggtggcgcactggcaggtgaacctgccgcgcaagctggagcggctcctgacccgcgagcaggcgcggatgaagctgccgtcgctgccggagaaggaggaggtgctggcgtactggctgggcaagcagccgcagccgccgccgctcacggtggccttttccggcttggggccccgcgcggccaactggattcgcgagctgggtgccctcaccgcgcaccttcgcggcgcggcgctggcgaagcaggggctggcggcgctggtgacgaagggctccggcgtccgaatctagcctttgggcgcggccggcccggggctctccagcagcagcgtgacggggccgtcgttgacgagcgccaccttcatgtccgcggcgaagatgccggtgcccacgctcaggccgcgctggcgcagcagctcacaggtgcgctcatagagggccttggcgctcacgggctccatcgcgtcgatgaagctgggcctgcgccccttgcgcgcgtcgccgtagagcgtgaactggctgacgacgatgagctgccgggacgtctcctccagcgacaggttcatcttcccggcggcgtcctcgaagatgcgcagcgtggccagcttctccaccatccacgccacgtccgcctccgtgtcgcccttgcccacgcccagcagcaccagcaggcccgggccgatgtcgctcacgcgctggccctccaccgtcaccgacgcctccagcacgcgctgcaccaccgctctcatcgaagtcacctcgtggacaagcgtgtctgaccgggggctcgcgtcagtcacgccgttacagttggaatgtcaggtttccgcctgctggaagagcgagcgcccagacgtggactcacgcagccactcacccttgcccgtcttttgccccgttccgcataatggcacctgacttccccggagagagtgtgcaggtccatcgagccagctccatcttggccgtgtcggccattattttcctgtcgctttctcacgcagcgcacgccgcgcccgctccagcggagaagcgtgcggaccgcgaggccctcaagtccgcgctgctgcaggtcctccagcgcgcgccactgaaggccagtcgcatgggcgtgctcatgcagagcctggacgacggcgccgtggtgttcagccacaacgccgacgaactgctcaaccccgcctccaacgtgaagctggtgacgtccgccgccgcgctcgcgtcgctggggcccgagttccgctacgacaccgagttcctggtggagccggagctgggcgcggacggcaaggtgaagacgctctacgtgcgcggcaagggcgacccgtccatgacgacggagcgcctgtggggcatcgtcgcggaactgaagcacgccggcgtgcgtgacgtgggcgaaatcgtggtggacgactcgtggttcgacgccgagcgcacgccgcccggctatgaccaggaggacacggaccgcgcctacatggcgcccaccggcgcggtgagcctcaactggaacgcggtggccatctacctgcggcccggcaacgcgccgggcgccaagggcgtggtggagatggatccgcccagcgactacttcgtggtggagaaccagctcaccaccgggccgcggcgcgcgcgccgggtgtccgtcacgtcggacccctcgggcctccagcagaagattgtcgtgcgcggccagctcccgggggagcgcggcggcgccgtcagcgtctggaagaagatcgacaacccgcccatgtacttcggccagtcgctcaagcagatgctggtgacgcgcggcgtgaagatgaagggcaaggtgaagctgggcaagacgtccaccaaggcccgcatgctgcacgtgtcgcagtcggacacgttcgacgtgctcctcaagcgcctcaacaagctgtccagcaacttcgtcgccgagcagctcctcaagacgatgggcgccgagctgcgcggctcgccgggctccttcaccaagggcgtggacgtggtggagcagttcctggagcgcgacgtgggcatcccccgcggcacctacgtgatgaagaacggcagcgggctgaacgacgccaaccgcttctccgccacgcagctcaaccaactgctgcggcacatggtgcagcgcttccccttctcgccggagtacctgtcgtcggtgcccatcgcgggcaaggacggcacgctcaagtaccgcttcgagggcagtgacgcggtgggccggctgcgcgccaagacgggcaccctggagagcgtgtccgcgctgagcggctacgtgacgagcgcgggcggagagcgcttcaccttctccatcatggccaacgacttcgcgggccgcgccggtcccatcgtcgcgggcctggacgcgctgggcgcggcggtggccgccaccggctccagcctggggccgtccacggcggtggccgcgctggcggacagcgggcggccctcgggcgccgtggacgacgtggccgctcgcatcaagacgtacctggagctgggcgcgcagcgcgaccagcgcaacatcggcttcctgcgcaccgcgtggcgcagcgagagagacccggccgtgcgcgcggtgctggcggagagcctctaccagtccaacccgcacgactacctgggcgcgcgcacgctgctggacagctattcggccaccgccgaggtctacggccggctgaaggacgtggcgcgggtgctgtccgtggaggtgccgggcgtcagcagcatggtggagctggcggcgggcggaaacgccgaggcgctggcccgggtgctggagttggcgggcgcggcgggtacggacgcccaggcccaatcggagatggccgaggccctgagcgaggtggcccgcaccgcgccggaggagctggtggtggcgcttcgggccgccagcgccggtgaccgggacgcgtgcaccacgttgctggcgcgggggctggtgcaggcggggcaggcggaccaccccttctggaagtcgctgcgccgcacgctgggcgcttcggatccacggctggcgtccttcgccaagggactggactccacgctgtcgcagaaggtggcggaggccaaggccccggcgaagacgccggagggcttcacccccgtgcagatggtggcgcccgcgggcaacgcgcccgaatcctcctccgccgacaaccgcccgggggggtaggccggaatccgttgtgtttctcgcgagttccctccggccgggcatgcctccctggccgggtggcaggcgggcgtacgacacccaggaagaaggcggctttctggctgggtgtcagtacccactgctataggtgggaatcaaacccggcgggtgcgtccggggtgtaaccggtcctcggtggaccggttctcgtgagaaaggaatgcagtcatggctggaggcgtgaacaaggtcatcctcatcggcaacctcggggcggacccggaggtccggttcactcccggcggtcaggcggtggcgaacttccgcatcgccaccagcgagagctgggtcgacaagaatggccagaagcaggagcggaccgagtggcaccgcatcgtcgtctggggaaagctcgcggagctctgcggcgagtacctgaagaagggacggcagtgctacgtcgagggccgcctgcagacgcgcgagtggacggacaaggagaaccggaagaactacaccaccgaggtggtggccaacgccgtgacgttcctcggcggtggtggccgtgacgccggagacggcatgggcggcgggggcgggggcggtggacgccggcagttctcccagcagcgtgggggagacaacaacgactacggtcagccgcctccggacgacatgggcggtggccatggcggcggcaacggcgacgacgacatccccttctaggcccggctgacgccagcggcgccctggaaatgaaaccggccgctccccggaagtctcgggggcggccggtgtgcttcgtgcgcctggacttccaggcccgggagcgccgggcccgggccgcgtcacggaggggtggcacccacggggctgaaggcggcgcccgcggtgtagagcgcgtagatgaccgcccagctcatcgccgtcaggaccaggaagaggatgatgaccaccggctcgaacttgcgcatggagcgctcgctggagagcagaccccagcccatggcgaagccctggaggccgttggccaggtggtacgaggtgcccagggtgcccagcaggtagacgaccagggtgggcgcgtggtggtgcatctcccgggcgatgtcgtcgaacgcctccgggtgacccagcaccagccgcgggtagaggaaggccagccagatgtgggcgcccaggaaggccagcacgcccaccgcggtgatgcgctggaggatgtacttgaggttgccgtagttgttgtagcgggcgttgttcggccggaagctgaacaggcgcaccaagccccagccggtgtgcatcagcagcggcagcaggacgatgaggaaggtgaagacctgggagaacgggttggcgtacgtcgtcaccgacttctgccaggcgtccgcgccgttgaaggcggagaggttgtcccacaggtggttgatgacccagatggacaggggaaccaccgcgaggaacgagcccaggcgggacttgaggagcggtgtcttcgtctctactgcggcagcggcttgggtgctcatcgaatctccagcggcggcgcgtgggcgtcttgccgcgtccacggtcgaaggcaagtgacagtcggacggcggtttatagccgttccagcgccggggctggatttcttcctcaccccggcatgccagcacacccacacggaggcataaggctgaccttatgcgtcaccccggtccccactgctgccctcctgtcgggcgcagggggccccgccttctgtcgttggcgggcaatgcgggctcgggcacgctagttgccatcgatatgtccgacgagcttctcagtggaatgttgaagaacacggacctgcgcgtggtgctcgccaccacgacggagctgtcgcgccaggcgcgtggcacccatggcaccgcgcccgccgccgccgtgctcctgtcgcaggccctcaccgccgccgccctgatgggggccctgcagaagggcgacgcccgcatcaacatccaggtggagtgtgacggccccctgcgcggcctcttcgtggatggggacacgtccgggctcgtccgcgggtacgtgaagaacacctacgtggagtactccgggagcgacgggcagtaccattggcgccccgtgctggggaacaagggcttcctgtccgtgctgcgggatttgggcggcggcgagtactaccgctccgcggtggagctggaggccttcgacctggcggccgacctggagcgctacttccgtcagtcggatcagctcccgtcacatgtgctgctggcgcagctgccggaaggcggggccgcggagccgctgggccgcgtcgccggcctgctcgtccagccgcttcccagcgcggacatggaggccttcgcggcgctgggggagcggctgcgccgtgacttcgtgccctcgctccaggcgcacggcgaggcgggggcagcggccgtgctgcgcgcgctgctgccggagtctgacttcgaggtcatgtcgcgttacccgctgcgcttcggttgttcgtgcagcaaggaccgtgtgctgcgcgcgctcctggccatgggacgtgaggaattgacggaccttctggagaaggaagggcaggcggaggcgacgtgccagttctgcacgacgcgctatgtcattcctggagacgaaatccgcggcatgttggagcgcggcgccatttgacttgcacgaggcgcgacggtacttgccgcgcgccatgagctacttcacgcagttgcttgagggcggctacgaagccgtccatttgttgagtgattcgaagtcaggcctgcgtgccattgtgggcatgcacaacacgcggctcggtccggggttgggcggcactcgtgcgctcgccacctatgccagcgaggaggaagccgtcgcggacgcgctccggctggcgcgcggaatgacatacaaggccgcgctcgcgggggtgccccacggcggcggcaaggcggtcatcatgctgccgcgcggcagcttcgaccgtgagaagattttcgagtccttcggccgcgcggtcgagtccctgggcgggcgctacatcaccaccgaggacagcggcaccagccccgacgacatggagcacgtgcgccggcacacgaagtatgtcgttggactgaaggagcgcagcggagacccgtcgccggtgacggcgtatggcgtggcgcgcgccatggaagccacggcgaagcacgtcttcggcagcccggacctgaagggcctgcgcgtcaccgtgctgggcgtggggcacgtgggcatgtacctggtgaaggaactgcaccagcgcggcgccaaggtgtgggtgagcgacatcaaccccgccagcgtgcagcacgcggtgacgcagtacggcgtcacggcggtggacgccgacgcactgcatcgcatggaggcggacatctacgccccat

SEQ ID NO: 1057 - DNA, 10916 bp, Myxococcus xanthus
gctccgcctttgtccttcatcccgcccacgcgcagggccgtaggccacgttctcgaagatgctcttggggaaggggttggacttctggaagaccatgcccacgcgccggcgcaggtccaccacgtccacgccgcggtcatggatgtccgtgccgtccagcaggatggtgcccgaatgcgtggtgccggagatgaggtcgttcatccggttgagggagcgcaggaaggtggacttcccacagccggaggggccgatgagcgccgtcacccgccggtcgaggatggccagggacaccttgtggatggccgtcttggggccgtagcgaagggagagctcccgcgcttccatcttcgctcggggattctggggttggagggacatggcaggcgtaccgtcagtgggcgctggcggccttgcggcgcgtgcgcgtccggatgatgaccgcgacgaggttgagggcgaaggtgagcgccagcagcaccagcaccgtcgcatacagcggaccactggcctccgtcacgttcggtgactgggtggccatgacatacgtgtggtagcccaggtgcatgaactgggagtccaggtgcgtgggcaggtccggcaggaagtaggcggcgccggtgaagaggatgggggcgacttcgcccgcgccgcgggagatggccagcaccgcgccggtgaggatgccgggcagggcgccgggcagcaccacccgcgccagcgtctgcgactgggtggcgcccagtgccaggctggcggtgcgctgctccagcggcaccgcgcgcagcgcctcctccgtggagacgatgaccaccggcagcgtcagcaccgccagcgtcagcgaggcccagaggatgcccggctgggcccagtgcatctcctcatagcccagcatccggtccaggttgccgccgacgaagaggatgaagaagccgagcccgaagaggccgaagacgatggagggcacgcccgcgaggttgaccaccgccacgcgcacccagcgggcgaagcgtgactccggcggcgcgtactcgtggaggtacacggcggtgagcacacctaccggcatcaccgccagcgtcatcaggagcgtgagcgcggcggtgccgaagatggcggggaagatgccgccgcccatcatgccgtcgctggggggctgggtgaggaaggtccaggagaggtgacgggcgccgttgcgcgcgatgttcagcaggatgagggccaacatgcccacgatgaagaaggccgcgagggccgtcagtccggtgaggcccagccccaccgcccggcgcgtggtgtacttcacgaggcgctcccggtcagccgctggaggaccttcttcgtccacgtggaggcgaccatgttgaggacgaaggtgaagatgaacagctccacgccgatgaagaagagcagggagtagtgcgggctgcccaccaccacttcacccatctccgccgcgatggtggccgacagcgagcgcgccgagtcccccaggttccaggacacgatgtccgcgttgcctgacgccatgaggacaatcatcgtctcgccaatggcccggccgaagcccagcacgcacgcggcgaggatgccgggggccgccgcgggcagcaccaccttccacgccgtctcccagagcgtggcgcccagcgccagcgaggcctcgcggtagctgcggggcaccgcggtgagcgcgtcctcggatacggtgaagatgaccgggacgatggccagcgccagcgccagccccgccagcgtgccgttgagcggccggtccaggtggaacaggtccttcaccaccggggacagcaccatcagcgcgaagaagcccagcaccaccgaggggatgccggccagcagttcgatgatgggcttgagcaactcgcgcaggcggcgcggggcgaactccgcgacgaagagcgcgctgaagacgcccatgggcaccgccaccagcatggagaccagggtgattttcagcgtgcccacgaacagcggaatcatgctgaccttgggcgtgtccgacacgggctgccaccggaacgggtagcggccctcctgcggcaggaacatcttggccaggctggcttcgtggcgggcgtccgcgtcggtgaagagcgtcagcgcctccttggccacgaagacgatgatgaggatgagcgcggcgatgcccgtgaacgccatcagggtgatgaagcccgcgacggccttctcccgcagttgacgcttccgcgccgccgcggacaggcgcggcgcggccacgacccgcgtgagaccttgctccatggtcgcctgtctatccatagggattcagcgcctcttgtgacattcgtgtgacgctccgcggctacttcacggggaagtagccgacctgggtgacgatcgcctgaccttcgggggagagcgcgaagtcgatgaaggccttgatgtcgccggtcggctcggcgcgcaggtagaagaagaggtcgcgcgccagcgggtacttgccgctcttgatgttgtccgcgctgggggcgatctcctcgttgcccttcttcaccttcagctccttgatgccctctgcgtacgcggcgccgccgtagcccaggctgttcttctccttggagaccgcgttcaccaccgcggcggtgccgggcagtgtctggatggcgggcgcgaagtcctcgccgtccagcaccatgtccttcacgaagacgtaggtgccggaggagttctcccgggagtacgcgacgatgggcgcgtccgcgccgcccacctgcttccaggaggtgatgtcgcccacgtagatcttcatcagctgctcggtggtgagcgcgctcacggggttgccctggtggacgtagaaggtgacgccgtccttggccaccgagcgctgcgcgggcggcgccttgtagcgcgcgcggagcttgtcggcctccgccttcttcatctcccggctggacatggcgatgtccgtggtgccgttctggagcgccgccaggcccacgccggagccgccgccggtgacctggaccttgatgttggggttcttcttcatgaacgcctcggcccagcgctggccgaggatgaccatggtgtcggagcccttgatggtcacggtgcccgcctgggcaacggcggggagcgccaggaggaacaccgcgagcaggggcttgaggagcgatttcatgggggacttctcctggctggaggatgtgaatcggaatctggaggctgcgcgaggcttgcgcgaagacgccgcgcttctacgtgacgtgggtgtccgtttcgcgtccgccacgtgacatcgccgtcacgacgttcagcccgcggctgggtccagcatccggtagccgacaccgcggaccgtctccagcagcgcgcgcgccgggcccagcttgtcgcgcaggcgcatgacgtgggtgtcgatggtgcgcgtctccagggaggatgacaggccccacacctcttccagcaactgctcacgtgtctgcacccggcccaggcgggcgagcaggtgctccaggagccggaactccagcgcggtgagggccacctcgcggtcctccacgaagaagcggtgggacgccacgtccaggcgcaggggccccagcgccagcggcgccgtgcccccagccgtgggcgcgccgcggcggaggatggccttcagccgcagcaccagctcccgcacgctgaagggcttcaccacgtagtcgtccgcgcccacctcgaagccgcggatgcggtcggactcctcgcccttggcggtgagcatgacgatgaggacgccccgggactgggggctggcccgcagctgccggcagacatcgatgccggacatgtccggcagcatcaggtccagcagcacgaggtcggggttctgctcccgcgctgccaccagcgcttcttcgccagtgtgggacacgtgcgtggtgaggccggaaccccgcaggttgaaatcaatgagctccgcgaggtcgcgttcgtcgtcgatgatgaggacatggggcatggcgggccgtcactctgcgcgcccccttttccgaacgtgtgacgcatgtgcaacaacttcgtcatggcgtgaacacgcgcgggagcgggcgacccggggcgatggccggccctccagcgggcgggcccctggccaggtggcctgattgcgcgtgaaggtgcttccgcgccgaggtaaaccccagggagctctgtcatgacttccgcccacctgccgccaacaccaccgccactgccgacgctgacccccacgccgggtgagctggcccacgcgcagcggcgcggggggcgctccgcgctcgtcggtctggggctggtggggctggtggcgctgacgagccccgtgctgggctacgtggaggacgtgcgcaacgcgcgcgaggagctgctgagccggctgctcaaccaggcgcaggtgcagtcggaggcgctgggcgtccacctggggctgttggaggcggagctggcccgcgtggccgggcaccccgcgctgtctcctgaggacggcgcctccccggcggagctggccctgctggagagcgccttctaccattcgtccctcttctcggagggcgtggccctgctgacgcccgcgggcgagcgcgtctggagcgaccctccggacatgccgctggggcgctcgccgctgacgctgcggccctggttccgccggatggtggagggccgccagccggaaatcgacctgctggaaggggagggggggcccatcgtggtcgccgtccccatgttccaggagggccgcttcaagggtgtgctgctgggagagctccgcgccagcgcgctgcccacgcggcccaccgcgcagacgtcactggtgctgatggatgaccagggtcagatcctgatgccagtggggttcaatctgggcgccggggacatcacgggggggctgcgcgcgctggcgaacatgccggggccgctgacgctggatgacaagcacatgatgggcgcgggcgcgtgggtggggaagagcgacctgctgttggtcgtcctggaggaggagacggccaccgcgggcctccgggcgcgcttcctgcggcagctggcgttccacatcgccctgctgagcagcacgctcatcatcttcatcctcctgctgcggcactcctaccgttcgctgctggcggccgaggagcggctgcgacgccaggagaccatggcggcgctggggaccgcggcctcgctcatcgcgcatgaggtgaagaacgccctcaacggcatccaggccgcgctgtccgtgctccggcatacccccgcgggcagcgagctgcccgtgggcgcgctgcgctcgcaggtggagcgcttgagccatctggcgcgctcgctgctgtccttcggggcgcctcgtgccgcgctgcgccgccgctgcgaggtgcacctgctggtgaaggacgcgctccagggcgtgaagctgctgccggagtcagaggccgtggcactgactacgtccctggaggagtccctgtgggtccagggggatgcggcgctgctggtgtccgccatcgacaacgtgttgcgcaacgcggtggaggcaggcgcggtggcgaaggacacagggatgcagttggcaccgtgggtcagcgtgagtctgacgcgggacgaacatgacgccgtgctcgtggtggaggacaatgcgggcggcgtggatccgcgtctcgagcccaggttgtgggaacctttcgccaccgggcgggcgaagggcgtggggctgggactgcccatggcgcgtgcctccgtggaggcccatggtggcagtctgaactatgtccggagtccgctgggaagccgcttcacgctgcgccttccgttggaggtggcccgatgagcacctatctgttgctggtcgatgacgaccggaccttcgcctcgctggcggcctccgtgctgcgacacgagggcttccgcgtcacgctggcgcattcactccacgacgcacgtggggccatgtcccgcgaggcgccggacctggtggtgttggaccggcgcctgccggacggggacggcatcgacttcctgccggagctgcgcgcccagcttccgaacacgcccgtgttgatggtgacggcgcacggcgacatcgccagcgcggtggaggccatccaggcgggcgcgcgcgactacctgtccaagccggtggagctggatgacctggtgctgcgcgcccgtcgcgccgtcgcggacctgcagctccaggagcggctgcgtctggcggagagcgagctgggcggacggcggcgcctgtcgcgtccgcactcgccgaagatgctcgccgcgctgcagatgctggagcgcatcgccaaggcgccgcgcagcccggtgctgctgctgggcgagacgggcgtgggcaaggaggtgattgcgcgccacctgcacgcgctgcaaggtgggcagggctccttcgtccacgtcaactgcgccgcgctgcccgccacgatggtggaaagcgaactcttcggccacgagcgcggcgccttcaccgacgcgcgaaccgcccgccgcggcctggtggaagtggccgcgggcggcgtgctcttcctggacgaggtgggcgagttgccgctgcagctccaggcgaagctgctcaccttcctggacaagggcgccttccgccgcctgggtggcaccgccgagctgagcagcagcgcgcgcgtggtgacggccaccaaccgcgacctgaccaaggaggtggccgagggccgcttccgcgaggacctctacttccgcctgagcgtcttccgggtggacattccgccgctgcgcgagcgccgcgaggacttgttgcctcttgcacagtccctggtggcggagctgggcgccgagctggggcgccggcccgtgagcttctccagcgccgcgcgcgcccggctggagcgctacccgttccccggcaacgtccgtgagctgcgcaacgtgctcgaacgggccctggtgctggaggccggacccgaactggagctcgccgccctggagccgcagggcaccagcggcccgcccgatgtggaccccgacgcgttcgtcgtctctggggctccgcgccccttgcaggacgtggagcggttgtacgtccggcacgtcctcgcccgcttggatgggcgccggatggaggccgcccgggtgctggggctctcctatcccaccttcctccgccggcttgaggaggagtaggcgagcgcgcttcaagattcttgaggctggcggcctcaaggatttttaagtctggattcgggacttaaaatcgttttcatattcccgaccgcaatcaccttgcgttccctctgcgcctgtcggaaggcggacggcacgctctttgcggagggcctccacgtgaaccagcgcacgcggcagtcgcggcgacttgtgtggaggtgtgatgtcgacttcgaagagtcctgagggcgttgcttccccctggaaggcgctggccacggacctgcctgcttccctggtggtgttcctggtggcgttgccgttgtgtatgggtatcgcgctggcttcaggcgcgcccatcgtcagcgggctcattgcgggtgtgattggcggcatcgtggtggggctctttggaggcgtgcccctccaggtgagcggtcccgcggccggcctcgcggtcatggtgtttggcttcatccagcagatgggcctggcgatgacgtgcgcggccgtggccgtcgcgggcgtggtgcagatgattctcggtgggttgaaggtggcgcgcggcgcgctggccatctctcccgccgtcatccacgggatgatggccggcatcggcatcctcatcgtcctggggcaggtccacatcgtgatgggcggcgcgccgcagtcgagcgcgtggcagaacgtgaaggagctgccggggcagattgcggaccttcatggctccgcgacgctgctgggcctgctgaccatcggcttgatggtggcgtggcagttcgttcccggaaagttgaagaaagtccccggtccgctcgtggccgtggtgagcgccaccgcggcggcgaccttcatgggcgccgacgtggcccgggtggacctgccggagaacatcttctccagcatccaactgcccaccttccccaagggcgactgggtcgccttcggcacggcggtgctgtcgctggcgttggtcgcgagcgcggagtcgctcttgagcgcggtggccacggacaagatgcacacgggcccccgcgcgaacctggaccgcgagctcttcggtcagggcctggcgaacacgatttcgggtctggcgggcggcctgcccatcaccggcgtcatcgttcgcagcgccaccaacatcaccgccggcgcgaagacgcggctgtcgggcacgctgcacggcgtatggctgctcctgttcatcacgttgctcggctcggtggcggggctcgttcccctcaccgtgctggcgggtctgctcgtcttcgtcggcgccaagctggtgaacgtgcaccacatccgtgagctccagaagcgtggggagctggccgtgtacctggtgacggtggccggcgtggtgggcgtcaacctgctggccggtatcggcatgggcctggcgttcgcggcgctgcgcctgctgtggcacctgggcagcgtcaaggtggacgtgcaccagcaggcgcatgcgtcctatcaggtgcgaatctcgggtgcgctgacgttcgtcggcgtccccaagctgtccaccgcgctggcgcaggttccgacgggctccaaggtggaactggacctggcggtgcagacgctggaccactccgggcacgaagccctggagagctggtgcgacacacattgcaagacgggcggctcggtgttcgccgagtcgctcgaagatgtctggagccgcaagggcacggtgaagccgagcagccccgtggtcgttgacggtcccaatcacaactcgcttgtctctggaggtgcgcagtgaggaagctcattcgcggtctgttggactttcaactcaacgcccgttccagctaccgggagaagttcgcgttgctggcgcaggagcagaagccggattgcctcttcatcgcctgcgcggacagccgcgtggtgcccaacctgctcgtgtccatggacccgggcgacctgttcgtggtccgcaacgtcggcaacatggtggcgccgtcggattcgaaggggcagtcgacgggcgaccagtccgaggcggccgcgctggagttctcgctccgcagcctgccggtggaggacatcgtcgtgtgcggccactcgaactgcggcgcgatgaaggccgtcctcgctggcggcgtggggcctgagaacccgaacctcaagagctggctcgagcacggcaaggccgcgctccagcggatggatgcgaacccgacgctgggggagggccggtcggattacgatcgcctgtcccagaacaacgtgctgctgcagttggagcacatctccacctatccgttggtgaaggagcgtctcgacgcgggcaccctgcggctgcacggctggtggttcgacatcgccaccgcgcaggtccacgcctggcgcccgttgctgggccgcttcatccccatggacgaactggtgggcgaggcactgctgcgcgagctgggcacggacacgcacgcccccggcgcgctcgccaacggcaacggcgctcagcgcatgtcggtggtggccagagctcagtagcccggtggaagcaggcaaccaggggagcggctcgaatcgagccattctcctggtggccaaaggccggtgagggggagaggatggggcgcagcttcgatgactcccttcctcttcatgctcgtcgtcctggggttttccgtgggtgcgggactgctgggctcgctgctgggtatcggcggcgggctcatcctgattcccgtgctcacgttgctcctgaaagtggacatccagtacgcggtgggggcgtccatcgtctccgtcatcgccacgtccagcggcgcggcggcggcctacgtgcgcgaccggatggccaacacccgcgtggccatgttcctggagctggcgaccaccgcgggcgcgctcagcggcgcattcatgtccgggctggtgggtgggcgcggcgtgtacctcgtctttggcggcgtcatggcgtggtcggcgctggtgatgctgcggcggatgcgggcgagcgccgagacgccagtgcccgcggacgcgctggcggaccggctggcgctgcacggcagctactgggatgagtcgcagggccgtgaggtgtcctaccgcgtcacgcggccgctgacgggactggggctgatgtacgtggcgggcacggtgagcggcatgctgggcatcggctcgggcgcgctcaaggtgccggccatggacctggccatgcggctgccgctgaaggtgtccacggccaccagcaacttcatgattggcgtgacggcggcggccagcgcgggcgtctacttcgcgcgcggcaacatcgacccgttcatcgcggggccggtgtgcgtgggcgtcacgctgggcgcgtggctgggctcgcgccacctgatggcccgggtgaacagcacatggctgcgcgcgctcttcgtgggcgtgctgctgtgggtggccttcgagatgctgcgcaaggggtgggcgtcatgagcgaggcaccgaagctagagccgcgaagccttgaggccgtcaccgcggcggtgcaggacggcgaggacgcttcgctgctccatccggagctgctcatcagcgacttgctgcggtacggcgtggccgccagcctggcgttggtgacgctgggcaccgtggtgaccttcttccgccacccggactacctcgtttcatccgaggcgttgctgcgcctcacctcgccgcacccggtgccgcacaccctgggggacgtcgtggcgggggcgctggccgcccggggccaggcgttcgtcatggcgggactgctggtgatg

SEQ ID NO: 1058 - DNA, 14467 bp, Myxococcus xanthus
  unsure (1)..(14467): unsure at all n locations
tggtgagaatcggcgggcggtccttcccctccatgggagcgctgtgagctctcttctcctgcagcagcatggccggcgccacggtggacaccgggacgttgccgctctccgcgccgaagaagccgttgaagacgccgggcttctgccccgaggcgaggatgcggttcaccgccgacagcggcgtgcccacgatttccacgccgcgcaccagcgtctccttccccgtcttcacatccacccggtacaccatgcgcggcacgcccttgaaggcctggtaaccgtagccggacgtgttggtgttgcccccggtgatgtcgcggatgatgaggccaaacggcttgccctggcgcttcgcctcggcaatcagacgcttcttcaactccgcgtcgctcacgccgttcgtgctctccaccatcaggttcgccatgcgcgccaccggcttcaggttgccctggctgcggccgtggccgttcgactggaggaagccctccaccggtcggcgcccctgaaggtagttgcgcagcacgcccttctccaccagcgtcacccgctggccgcgcacgccctcctcgtcgaagaggtagtagccgttgagcggctcgttctggagcacgcgccgcgtcgggtcgtcgtggatggagatgaacgacggcagcacctgcttgcccacctggcccttgaacgtcttgccctcgttgtcaccttcctgccggtctccctccagccggtgccccaccgcttcgtggaagagcaccccggccgcttctggcgcaaggatggcgggccccgtgtacgggtcgatggcgggcgcggcgcgcagggccagcagctcctggatgacgtcatccgccgccttgttcaggcgcgccacgtccggcagctccgcttcggcgggcacatagaagttgcgcgagttgtccagcagttgcccgtccggcgcccgggtgacggcggagacatgcaggccgtacagcgtctcctcggtgatgatgcggctgccttccgaggacacgaacagccgcgtcaccttgtccttggtgacgcgcacctccgagtcgaacagctccgggtgcgcgttgaagcgcgccgacacgtcgcgggcgaccttcacccagcgctcgcggtcgaacggagcctccaccggcggttccacgtgcttcaccggcttctcgcgcgtgaaggacggcggacgcttcgggtcctccaccgcgtagacgtcctcgcccttcttcttcaggtactggaacagcgcggacttgtacttctcatcggtgatgagccacagcgaggtgcgcagcgccaacggcgagtcgtccagcgggccttccttgcgtgacacatagctggtgcccttggtcgagaagctgaactccaacccctccgccaccgagctgtcgaagtcgtagtcaccgacgcgcacgtcgacgtacagcttccgctcacggtagccgtcgtccatgaacagcgccccgtagcgcgcggagatcgcgtgctgctcgtagtccttgagctggtagctcatgaaatacgggggttcgtggttctgcatcttcagctgctggtgattgcgcgccagctcagcggacatcgcctcgagcagcttcacgcgcgcatccggcacgggcgccgccgccgtcagcagcgccgagagtgccagcaggggaaacacggttcgaaggagggattgcacggccccgacactagcccatcccttccacgatacgagcagctccacgctcacggatgccgcgaaggcggaatccgtgaacgaggggccccccgctcggagggtcggtttccgggcgggcggcgaatgactgtcaggccttcgtcactttctcacgacccttgctgacacccttggtggcgttgcgcgtgtcgacgacgaccttcgcgcggtccaccaacatggcgtagtcgatgtccgagtggtccgtgaggatgaggaccgcgtcgtactggcccagcgtctccggcttcagcggcacggacttcatctccaagttgaagccgtggcccttgtgcagctcggggacgtacgggtcgtggtacgacagctcggcgcccttctccgccagcagcgtcatgacgcgcagcgatggactctcacgcatgtcgtcgatgtcctttttgtacgccgcccccaggcagaggaccttcgcgccgttgagcgtctgcttgttcttgttcagcgcctccatcgtgcgctgcaccacgtagtacggcatctgccagttcacctcgccggccagctcgatgaacttggtgtggaactcgtactcgcgcgccttccacgtcaggtagaacgggtcgatggggatgcaatgcccaccgaggcccgggcctgggtagaagggcatgtagccgaagggcttggtgctcgcggcctggatggcctcccacacgtccacgcccatgcggtcgcagagcatcttcatctcgttgaccatggcgatgttgacgcagcggaagatgttctccagcagcttggtcagctccgccacgcgggtggaggacaccggcaccacttccttcagcgcgctgccgtagagggccgcggccatctcggagcattcgggtgagtagccaccgacaatcttcggaatcgtcttggtgttgaagctcttgttgcccgggtcctcgcgctcggggctgaaggccaggtagaagtccttgccggccttgaggccgttcttctccagcagcggtttgagcacctcctctgtcgtccccgggtacgtggtggactccaggatgaagagctgtccaggacgcacgtgcggcgcgagcgcctcacccgtctggatgatgtagctcatgtccggctcacgcgacgccgtgagcggcgtgggcacgcagatgatgacgcagtccatatccttcgccttggcgaagtccgtggtggccttcagcttgcccgacttgctcagctccgccagcggagcgccggggatgtgcttgatgtagctctcccccttctcgattttgtcgatcttccgcttgtcgacgtcgagccccatgacggggaagcccgcctccgcgaacgccatccctagcggaagaccgacatagccaagcccgaccacacccaccctcgcgtcccgcttcttgatgcgatccagaagcgggctgctcaccatcaccctcatcgtcctcacctctcctgatgcgacgtgccgttaagacggtcacgccccgacccgacactcagcggaaaacgaccccccacctcaaccacgccggaggcgtcacctgcccccggatctccaccgccagcgacggcaccacccgcccgtaccctggcgaatacttcgacggcaccaaccgcgccgtcagtcccttctccagcaccacccaggcgagcggggccccttccggccccagttccaccacgagcggctcgaacgacaccggctcttccatcacacgacccgcgcgtgacaggacctgcacttgaggcgacaccactcgcgcctgttcatctggcagatggaatctgcccaccacgtcatgccggcccgtgcccacgaagcggtcacgtccggccagagcgcgctcgccccggtccagccggaacgtgcgctcgattcccacgggcgcgggcagccggcggtagccgtcatgccgcaccaacagcctgtccaccgacttccccggcaggaaggccaccacccgcgcccgagcctcctccggcagcgcgaacaaccgcgcctcatccaggggcgcctgctccgcgccatccacctgcaccgtgttgtgcgcggccgttccgcggaaccagttccgcaacgcgggctctcgcgtataggtgccggtgcccggatccacgatgacgggacgcccgtcgacgtggagttcgaaagagagtttgtcgttgtggctgtgtcccccgacaccgccttgtccctgcttgccggcgctgacagtgataacgacacccgcgccgcgcaagatgtgaaaaccaccctccggaaagctcaccgacacgggctccggcgcgggcgcgagcgcggcgaaacgcgcctgcccggcgcggcccagcagccacgcggcctcgtccacgaactcgccgccgcccaggcccgcatcgccgaagagcgccgcgcccaggcccaccagatagccgtgcgcgttgtcctcgcgatcacgcagcgggaagacgcggccggagtcgttgtcgccaatctgtggcgccaggccctgctcggaacaccacgcgcgcacggcgtggaacatgcgacgcagccgggactcgtacctgggccccagtggcacacccgcaccgcgcgcggcgaggtaccccagcgtgaacagctccaccgacaggcgatgatagggaatggagccctcgaaggacgtaccctcgagatgcacctgcttctccatctgttcgggcagcccacccaccgccagcgacacctgctgcggcgcgcccggcagctccgggaagagcaggcccaccaccaacaggcccacgtaattggagaccaggtggttgttgggcaccgcgccgcggtcctccaggtgggcctccacccaggcggtgtgctcggccagcgcgctcagcaccggcaccaggaagtccggccgggccacagcgggcgcggcggagaacatggccagcgcctgcgccaggttcgcggcgcgcagcgccacctccatggcgcatgtccagtgcacgccctgccccacggggttcgcctggaggaagtccaacacctgcgccacgaaggcatccgccagccgcgcgcgtacgtcagcggccgtctccacccagtacccctggcccagcgccacgacgctgtcgagccggcccatcacccacgggtacttcgggtcgctccccgccacggcgagcgacaggcgctccacgggctccaccggatagcggtgaccactcaccggatccaggaaccagtccacgggacggccctcgccgaaaaccaccggggtgccgaagatgtcccactcctggcgaagcgcggcctgggcacgggcccgcgcgcgctccaggccgccaggcaccgaggcgagcgcctccagcaccgacgcgcgctgagagacttcacaccagatgcgtgagctgcgctggcccagcgccagctccaccagctccacgccatccgtcgcgccgtagcactcgaggagctgcacctcgtccgcgcgctcgcgccgacgatagagtgcctgccgcgccacaccttggacacgccgcacagcgctgcgcgccagtccgcctggtgcaagtcgagcgatcgccgcgtagtaatcgagagtccccattcgccccttccgccacccgtgtcggatgccgttagcaagtgcctggccaggagctgtttcttaggagttgggcggggttgcgcggtgcccccgtaccccctgacggtaaaaagtggggggctcacacgccctgaagggaaaaggatttccgattcgcgggcgtccggcgccctccctgggcagcgttgcggcgcgtgcatagcgtgcccataccttcccgcgtgctggcaggtgctcggacggggtggcgcatcggcaacgagtccgatgcaggggtggaacaggcgctcgcggaggttgccgagcgtgccttccgctgtggtgctcgtgcgggattggagtccttggtacgcgaggcccagcggatgacgggcgcttccggagcggctttctatgacggacgcgtctgtgtcgcggcgacaggggtcgtcacggccacgcgcgcccggggaaggaggcgtcgtcggccggccctggtggtgtggcccgaacggcccaccggccgggatgcgcgggtgctcgcgcgaatgtcggcgttcggcgccgtactgctcgcggcgcatgcccgggagtcggacgcggcggcgcggcacgtgcatctgctgaagacgcagcggcgattggaacggcgggtggtgaaccaggagcaccggcgctcccgggcgtcacacgacctcaggacaccattgatggtcatcaagggatacgtggacatgatgctgaagggaacggcgggcgggctgacggcccccatccagcgctacctggagcgcctgcgccgctcggcggacgaccagagcgccatcatcgagcgccggctggcgaaggtgcaggacgagggcgtggaggacctgcgccctctgctgcgcacggccttcatccccgccgcgcgcggccagcgcatcatggacacgacgatgacgctcccggaccggcccgtggccattccgggcccccgcgatgacgtggagctgctggtgcgcgtgctggcccgcacggtggcggcgtcgggcgcgcccacggcggtgcgcgtggaagctgcgggggacgcgagcgtgtggcagctgcgcatcaacatccgcggcggcaagccgctgccggagaaaacggtcacgctgctgcggcacctgacgcagcggctgcggggtggcctctcgttgccggaggagaccggcaacggctgggtggtccacctgccggtggatgacaccgtgcccgtggcgcctcgcgacgcgtgaggcgcggcgccgtcaggacacgggcagcagttggcgcaccagctccagcaggcggcctcgctccacctcgcgcttgacgaggtacccgtccgcgcccgcctccagaccagcggcgcggtcctcgggactgtcgagcgacgtcaccaggatgatgggcgtgcggtgcagctgcgggtgcgacttgattcgccgcgccagccccacgccgtccagccggggcatctgccagtcgctgaccaccagttggcagggcgtgcgctccaggatgccccacgcctcttcaccgtccgccgcggtcaccaccgggtagccggcaatctccagcagcgacttcatggcgaagcgcgtggtgagcgcgtcgtcacacacgaggatgcgaggccgcgccgtctcgcgagccaccgagcgcgtctccggccgcgccgcgcgcaccaactccgcggcgttgagcaccggcaccacgcggccgtcgtccagcaccgccgcgcccgccaggtgccgcacgcccttgaggtggcgccccagcgagcggacgacaatctcctgctgccccaccacctcgtcgatggcgaacagtactttgtcctcgcccaccgtcagcagcgcggcggcctgcacgttcccggagtccagcgccagcggcagccggggcaggccaatggcctccgccagcggcaggaacgtgagctgctccccatccagccgcgccaccacgcggcccgcgacggtgcccacgtcgtccgggttcaaccggaggatgcgattcacgctgtcggagggaatggcggacaccgtggtgcccgtgcgcacgagcaaccccaacgccgcggccagcgtcagcggcaggtccacggtgaagcgcgtgccccggcccgccgtgaaggccacgtccaccgagccctggagccgttgcgccgtcgcctgcaccacatccagacccacgccccgcccggacgtcgcggacacctgctcccgtgtggagaagcctggctggaagatgagccgcgccgcctgcgcgtccgacagcttctccgcctcatcggccggcagcagcccccgccgcaccgccgtggcgcgcacccggctgggtgacaagccggagccgtcatcctccaccaccaccgcgatgcgcgagccccgaggctccacccgcaccgtcagccgccccgcttcggacttgcccgcgacccgccgctcctcggtggactccaggccgtggtcgatggcgttgcgcaccaggtgcagcagcgggtccttcagcgcgtcgaggatgcgccggtccaaccggacctcgccgcccgacagctccagcgtcacctgcttgttcagccgcgcggacgtctcgcgcacggtgcgccgcaggggctccagcacctgcgaggccggcaccatgcgcaggtcgcgcaaatcatcgcgcgccacctgggccaccagcgtgagctgctcaccgtcgcggtgcgactccttcgtcagctccaggagctgcttctgcagtccgcgcatctgcgtcacgcccgcgcggagtggctccagcgcaggaccgccgcccgccatcgcgagctgcgacgacgcgcgctccaggtgcatgagcacctcgcgcatgccgtccatcaacacgcggtgcgccgcgccacgccgcgtctgctgcgcgcgtccggccaggagcagctccacctggagcgcgatggactccagcgtcttcaccgacacgcgcaccgtctggtccgccggtccgcgggactccgtcgtggccgcagctcccgcgggcccctgtgccgccgcgccttccacgggcgcgggagacggcgacgcgcgcagcgaatggacggcgcgggccaccgcccctgcgccaccctcggcctccaacgccgtccgcaggtccaccagcgtgccagccacgtccgatgcggccagccccgcggagtcaccgcccggctccatgcgcgtgaagcccagcgccgcggcttccgccagcgtggccaccttctgcgccccggcggactcggcggacgccttcaacgtgcgggcccgctccaccgccgtgcgcaccacggccgcccggtccggcacatccggcgagcacagcgcgctcaaccccgcttcgaggaggtccagcacctccaacgcctgcgcggccgcgcccgaggccgccgtctgggggacggcctccgcggactcgtggcccagggccgccagcagcgaggacagtccttccaccacgggcgactgtccggcgtcgccacgggccatggcgccttcgatggcggagaggccgcgcagcatggcctccaccgtgtcgcggggcagccgctcctcctgattgaaggtggccagcccgtcctcgatggcgtgcaccacctgctcgatgtcgtccaggcccaggctggccgcggagcccttgaggctgtggaccagccgcttgagcgacgggagcaggtccggctcacgcccctgcgccgggccctccagccccaacaccttcgacccgatggcttgaatctgctcgcgcgtctccgcggagaacaccggccagatgctgcgcaagagctgaggatccatggcgcgtgcctactccccttcgggccgcgtggcggacgggcccccgagctgctccaggtccaacaccgtcagccggtccggcgtgaggaacaagaagggcccgggcggaggctgagacagctccgccttcggcagttccttgcgtccttcgacggactccgccgccagcccgaacccctcttcactgtcatccgcctcgaccaccaccaccttgctgaggtccgacatgccgcccccctccagccccaggagctggcgcaggtccaacaccggcaccacgcgcgagcggctcaccagcgcacccagcacgtgccggggagcaccgggcagcgaggcgatgccgcgcgcttcgatcacgtggtccacgtgctcgattcgcaccgcatagcgttcgccgcccacctggaaggccagcacggagagcacctcctggcgctcctcgtggcgggattcagccagggcccgggcacgggcgctgagcacctcgcgacgcttctcggggctcacaccctgcttgccgtccagcagcgagtgcgcctcggtgagctggcgtcgcagcccggtgtaatcaatcttggcgtcgtctttcgacatgcgctcagtaccgggtcgcagggagcttcaggatatcgcgcaccttcgaacgaaggtcgtccacggacaccggcttgttgaggaaggcgctggcacccaccagcttgcccttctgccggctcgcgtcgtccttcagcgacgtgagcatcatgaaaggggtgtcgtgaagttgccggtccgcacggatcgccgcgcacagcgcgaagccatccatctccggcatctgcacatcggagatgatgaggtccggcttgagctcccgcgccttggtcaatccaatcgctccattcggagcgtcgaagaactccaacccccaccccatcaggtacacctgaagaaggttggtgatggtcttcgtgtcttcgacgatgagcacctttgcgttcataactggtacctacccaccaggtccgagaaccgtttcgagagattggtcagattgcctgacacctgttcgatgcgccgggtgctctccaccgagtctcccatggcggatgtcagctcgctcatcgccgtggaaatctgctccacgccaatggtctgctgacgcgtgttgccggcaatctgccgcgccgcgcccgacgactcgcggatgacctccgacaggcccaggatggtcgtccccgcttcgcgagccagttccatggccgcctgcgcccggcggctgccttcctccgtggcgctgacggcctgcctcgtccccttctgcacttcgttgagcaggccgcgcacctgctccgcggcgatgcgggactgctccgccagcgtgcgcatctccgtggccaccaccgcgaagccccggccatgctccccggccttggccgcttcaatggaggcattgagcgccagcaggttggactgctcggccacgtccttcaccgtgccgatgatgtcgccaatctgcatcgtgcgctcgctgaggtcggtgatggacagggcaatggccttcacctgttcgcccagcttctccatgccggagacgctctcgctgacgacctgctgcccctccgcgctgagggcttcggacttctgcgtctgggagatgaccgagtccgcgtaggccgtggcctgcttggacgtctgggcaatctccgccaccgtggtgctcgtctcattgatggcggaggcctgctggtgggccatggccgactgctgcgtggaggtggccagcacgcccgccgcctcgcgctccatctccgccgccgcgctgcgcagatcctgcagcaggtgggagagcgcgtccgtcatcaccgcgaagctgcgcgccacgtcgccaatctcgtccgagccctggaggtccacctgctgccgcaggtcccccgccgcgatgcccgcctccgcgcgcgccagccgctccagcggcaccacgagcatcccggacaccagccatgccgccaccatgcaggccaccagcacgagcaggctgatgatggccgtgaagcgcgtggcctcccgcagcgtctgactcagcccctcctcgtggagcgccagttggagggtacccagctgcgcggtggagccggccgcgagcacgggcgtcgtcgtctccaccaggcccgtgcccttcacggacctgcggcggagcaccgaggcatcgccttcgacggaggccggagcctgcgcctcgccgacgtagcgctccgcggcggcctcgcccaggaggacgccgtccgcgtcatggacgcggacataggcgacctcgggccccaggctcagcgcgccctgcaccaactcctgcagccgctccgggtcgcgcttcacgctcagcatgggcgccagcgtcttcgccagctccacactcaccgagttggcgcggcgggacaggtcgttgcgaagcgcgtcgcccatctgcatccacgtcgtggtgatgaggatgacggccaccagcccccccgtcgccccggtgagcgcgaggattttcatccgcagactgagcctggtccccagcgcgcggcccggcggtgtcaggtgcgtccctttgacgtccacgttgcctcccacctcgtgaggagcgcgcgcctctcagcgcactccaagccagccagcctgctcgactggcgccagggcctgcctcaggccgccggccgtcatcgtctccaccccacgcagcgggtgttcatcatccagtccatccagcgcgcgcagggcgttctgccgcgcacgctccgcgtcctcgggccgatccatgcgcccatagagggccaccagcgtggcgtgccccagcgccaaccggggctccaggtacagcgccttgcgaaccgcttccacggccccgttcaggtcgccacgaacctcggccaccatggagagcagcaggtacgcctcggggacgagcgccttcgcggcctcgcgcgccagcgcctccgcctcctcgaagtgtcccgcgcgcgccgcgatgatggcgcgctccaggggaggaacctcctcggcagcgagcgcatccacggccaccgaccgcggcacggccggagtggcggcgtctggcgttgacgcggcccacgcagggcgcgacgtcccgggctcgttcagagatagacgcccctccggcacgcgcgcgcggcgcgcccttgaatcgtccagcgcctgaggccacccggttggaggcaccggcgaggccacctgattgcggcccatccccaggcgaggaagccgcgactccggcgtcaccgcgcgaggcgcgcccggcacggggacccgaagcaccacgctgccctcggcgtccacagtctccagccccagaccgttggtcagcggaacctccgccggagagacgaagagcagcccgccgggggccagcgcggagatgaagcgcttcagcacctcctgcgcgagctccgtcgggaagtagatgagcacgtttcggcagaagatggcgcccaggcccatgaagggcggcgggtccacggccaggttgtggcgccggaactccacggcgtgccggacctgggggatgacggagtagtcgtcgccgttggcgaccaggaagcgcttctcctgctccggctcgatgcggcgcagggaccacgggccgtacacgccctccctcgcgcgctggagcgcccggcccgacacgtccgtcgccagtatgcggaagcggccttcgggcagcccctccgccatcaaggccatggcgatgctgtagggctcctcgccgctggcgcagcccgcgctccacacctggaagcacggggccgggtgcgtctgcgccagacgcgccagggtgcgaaggtgctccgggtgacggaagaagtacgtctcgccaatgacggcgtgctcgatgaagcactccaccgccgcggcctcgcgcaccagcagcttgcgcaggaaggcgtcgggctccaggcctcgcgaacgcgcggcccggcccagcgccgtctccagcgagcggcgcaggctgcgcgccaacgtcaccccacaggccgactggaggacgtcctcgacccgggccagcgtcgcgtcgtcgagcacaccctcgctcacggcgcctccggccccacgagcaccgcggccgtccgaagcaacgggcgcacgccttcgggcgtccggcacagccccgccatcagcccgctggcatcccacggcagcggcgacgtcccatccggcgtcccgtccaccagcaccggggactccaccaagtcgcgcacgcggtccaccagcacggccaccgtccgcgcaccgccgccgcagacgaccaggtgcgcatccagggaggcctctcgcttcacccccaggagcgccgccaggtccacgacgatggccgggctgccccggtagacgaaggtccccgccacgtgcgcgggcgccccgggcagcggctccagctccaccagccgcaccacctcntgcaccgtctccgcgtccatcagcgcgctggtccccgccgcgtccaccgccaggtacatccctggaagtcgcagctcacccgccagcgacgccagctcctgccgcagctgggcctgctcctcctcgagctggctcagccgctcctcgacagagagacggcgcgactgcgcgaccatggaattgtctggtgtgtctgccatcaggggaactcccgcctgtcactgaagcgcgggattggagcacgctagtctgtccgacgaagaagcgtcaatgcgggctaaccggcattcactctcacacgatcggcgagtgatggcggcaacggaaggcatcagacgtgctggatcggacagcccactggtgcggagcgctcggcaggtatggtttgatgaagtgcggcgacacttctggagaaccgatgttgcttgcagtctggggctacgaatgatcaagggcgactcgccgaatcccgaggcacccactggaacgggcgcggatcctctcatcgggcggaatctgaacggccgcttcagcatcctggaaccgttgggcatcgggggcatgggcaaggtctaccgggccctacaggcgccgctcgagcgcgtggtggcgctcaaggtactcaaccccagcttccccagcagccgggaccctggcttccagaagcgcttcctgcgtgaggcgtcgctgacgtccaagctgcgccatcccaacaccgtcaccgtcatcgactacgggcagacggacgacggcatcttctacatcgccatggagtacctggacggccggacgctggcccaggtgctggggcaggtcggcccgctggcgtggtctcgcgccatcgccatcacccagcagatctgccgctcgctgcgcgaggcgcacagccagggcatcgtccaccgcgacctgaagccggccaacatcatgctcctcaacgagcaggatca

SEQ ID NO: 1059 - DNA, 12419 bp, Myxococcus xanthus
gatgttcatgcctcccgtgaagcccacgcgcccgtccaccaccatcagcttgcggtggttgcgcaggttggcgaagggcagccggtagggcatcagcgacggcaggaagcgcgcggcgcggacgccggctcgccgcagccggcccaggatgggcggccacgtgtagcgcgagcccaccgcgtccaccagcacccgcacctccacgccccgcttcaccgctgcactcagcgcctccacgaagcgccggcccgccatgtcattgtcgaagatgtagctgcacagcgacagcgtcgtgcgcgccgcgtcaatcgcctccagcattgcggggtaggcgtcccggcgggactccagcacggtgaagcggttgcccggcagcagcggccgtcccaccaccgcgtcccccagccgcaccaggggtgccaggggggcggcctcggggtgggggccactcaccgtctccgccttcatgggggccacctggaacagcggcggaaagcggccgtgctcttgtttcagcatcaatgaacgcgcccggcgccggatgcggttgatgcccagcaggacgtacagcaccccgcccagcaccggcaccagccacgccagtcccacccagcccaccgcggcccgcacgtcccgcttgtgcagcaccgcatgggcgctggccaccacgctgatgagcacggtcagcgccgccaccacatggggccaggccacctccaaccacgcggggatgtcgaacaggtgcatagcgaacggcggggtcctcctgttccgcctatcacgcccgcatggagcgcgcagtcctcagcgcccctgggcgtcgggaatcaacccccacggccgtcatcccccgtgtcggcgctggctgaatgaatccggccctgctgtggtgagagggttgacgcaggctgtctgggaatgcatcttgccaatgtctggcgttttgcaacgggtggttttctccccgggcgcagcggacctgacccacggggcaggtgaccgataaacagacagcactgtctggtttggatgcgactgcctcgaaaggagcgattcctccgtgccgacgccacgttgccgggcgcgccgtcaggagtttttacgtcctttgacttcaaacatggaatgtcgctagtccatgcaatgcagtgaaagcttgctttgtcctctaggcgtcggattggcgcggcggttgctcaagggcggagcgctccaggccgcggctggcggaatcgccgggcggcgggtgcgtcccccgaagtaggcgtcagaggaaaccccaagatgctcaagttccgctccgttgcgctggttgctggtgtggcccttctcggttccgcgtgcggtggcccggaggcctccgagtccgagccgacgaagatgacgtgggaggagttccgggcctcggtgtacgaggatcccgagggtaagctgattttcgacggcgacatggcgctggacagcgaggaggagctgcgcgccttcttcgacaaccacgtcgcggcggagacgggcaccagccggggcggcctggccgtctacaatacgagccccaccaaggccctcagcggggacgtgaagtggagcgccacccaggcgcgtaacctcacgtactgcgtcagcagcaccttctccggcaacaaggcgcgcgtggtgacggcgatgaacagcgccacggcggcctgggaggccaccgcgaacgtcaacttcacccacgtgaccgcgcaggatggggcctgcaccgcttcgaacaacaacgtgctcttcgacgtgcgtccggtgaactcgggcggccagtacctggcgcgcgccttcttcccgaactcggggcgctcgggccgcaacgtgctggtggacaacaccgccttcggccccatctcgccctggacgctggagggcatcatgcgccacgagctgggccacgtgctgggcttccgtcacgagcacacccgctccacgggcagctgcttcgaggacaacgcgtggcgcgccctgacgtcgacgtatgaccgcgcgtccgtcatgcactacccgcagtgcgctggcacccagacgggggacctggtgctcaccaccctggacaagcagggcgctcgcgcgctgtacccgtagtctcacgatgcaggaccgccgccctggccgcgccgtgaggcccggtcaggaaggcgcgctggctggagggcaccccttgctcgggcgggtgccttccggcctcatcgtgctcgcgtggggcccgtcgtcaggacggcgcgccgatgcccagctcgtcgcccgcgcgttgcggctcgaagaagatgagcgtcttcacctggtccgcgtcctcgatgtccaggcactccagctcgccgctctcgctctcgtccgcgtagatgtggtcgggcttgaggatgcggtgggtgacctctccgcccggccggcccacgatgatttccacggagccctggtcgctccccttcgactcgagggcaatctccaccagcggcagcctgccggcgagcggctggtcgccgaagtcgacgctctccgtctcgatgcgcacccagtggtcgcgctccaggttgctcagcaaggcgaggtagtccccccagccttccctgggtatctcccgagtgtgatgcatgtgtttgccctccggattccgttgctcagcaaaaccgtaaggcttgtgcgtgcggggtgtggaacgggcctgcttccctggcacgtcacctggcagggaggcgcgcggctacacccgccgcgcctggacctcgccggcctccagcgtcagccggagcgtgccgtcgttgtctcggtggccaaagtgctcgtaggcggcccgctccagcaagggggcgagcgtggtgcgcagccctcgtgcgcccgtctcccgcttgagcgcgcgggccaccacgaactcccgcacctcggtgtccacctgcaggcgcagcccttcctgctcgaactcgcgctcgtaggcacgcagcacgttgtgttgaaggatgtcgtccagggtgcccgcgtccaggggcgaaaaggagaccagccggttgaagcggccaatgagctccgggatgaagccgtagcgcgcgaaggcggtggtctgttccaactgctcctccgtcactcgcgtggcgatgctctccacccgcgccgggagcggttcgcggccgaagcccaggtgttcgctccgggccagcccctccgcggtggcgctcaggccactgaaggcgccgcacgcgatgaaggtgacgcaggccagctccatggtgtcgggccgctggcggctggtgaagccgaagtcgggcgggaagtccgcgctgggggcggacagcatgtgcagcaggctgcgctgcacgccgaagccgctgacgtccttcgtggtctgctggccggcgaagcggctgtcggagcggctggtggcgagcttgtcgaactcgtccatgcacaccacgccgcagccggcccaggccgcgttccggtccgcggcttcgtacaggcgcgacagcagcgtgctcacgtcgtcgcccacgtagcccgtttcggagaactgcgtggcgtccgccagcacggtgggaacggcgaggatttcgcggaacagcagctccacgaggaacgtcttccctgagccggtgggccccaggaagaggcagttctcccgcatgcccggttcgggggcgagcccctccaggaacaggtgacggatgcggcgcaggtgccggtacgccagcacggatgccgcgcggcgcgcctccgtctgcccccggtagccgaggtccgacaaccgctcgtcgatttcgcggggagagaggacctcgatggcggcgacgcgcgcgcgcacgtcctcgtcaggcgattcgggcagcggctccaggccagggtgggtgatgctcattccaggggactccaatcaggggcgggtggccgccggcgggcgcatcatcctggcggggcgcggggccgacaaggcgggtcgcgcgcctgctcacggccgtcttccaacccggggtgtcgtcgtcacgaacaccgtcggccggttcccattccttccgggcaccatgcctacccgtgaacatccgccgcgcggcgggcgcgtccggccacacggagtgctcctcaagggcaggggtgacgcattacagggacatgcccatgggtccagcggatgagtctcgggcagcgcggtcgaaggcccctctcttgggggcgtgggtggaggcgggtgagcgggtgcggtggcgtgtctgggcgcccggccaccagcgcgtggaggtggtgctgcacgacgcgcaaggcaatccgggccgcgtcttgccgatgacgccggagcccggcgactgcttcggtgcggtgctggaagggcagggcgcggggcttcgctacaagctgcgcgtggatggcgaaggccccttcccggacccgtggtcgcgttcgcagccccagggcgtgcatgggccgtccgaagtggtggtgcccgacttcgcctggacggacgcgggctggaagggcgtggcgccgcaggcgctggtcatctacgaggtgcacgtgggcacggccacgcccgaaggcaccttcgagtcgctcatcccgcgtctggccggcctcaaggagctgggcatcaccgcgctggagctgatgccggtggcgtccttcccgggacgccgcaactggggctacgacggcgtgagcctgttcgcgccccagcaggcctacggcggtccggaggggctgcgccggttggtggacgccgcgcacgcgcacgggctcgcggtgctgatggacgccgtctacaaccacttcggaccggatgggaattacctgcgggtgtattcgccgcactacttcaccggccgccaccacacgccgtggggcgacgcggtgaactacgacggcgaaggcagcgcccacgcgcggacccaggtgctggccaacgtggagatgtggattgctgactaccacctggacggcctgcgcctggacgccgcgcacgccatcatcgacgacggcacgccgcacctgctcaccgaggtcgccgagcgggcgcgggcctgcgcgccgggccggaaggtgcatgtcatcgccgaggacgagcgcaacgagcggcgcctgatgcgccccgcgtcggagggcggcctggggctggacggcgtgtgggcggatgacttccaccaccaactgcgccgcgccttcgcgggggacagcgacggctactaccaggactacacgggcaacacggaggacctggcgcgcacgctgaaccagggctggttctacgaagggcaggtgtcgaagaacctgggccatgcgcgaggcacgaaggcggatgggctggagccctggcgcttcgtccactgcatccagaaccatgaccaggtgggcaaccgtgccttcggcgagcggctggggcacgacgtgagccccgcggccttccgcgccatgagtggactgctgctgctgtctccctacacgcccatgctcttcatggggcaggagtggaacgccagcacgcccttcctctacttcaccgagcaccacgcggagctgggcaagctcgtcacggagggccggcgaaaggagttcgccgggttcgcgcgcttcgcgggcgcggaggtgccggacccgcaagcggacgacaccttcacccgctctcaactggactgggcggaggcggagcagccagggcatgcgggcgtgcgagcgctctaccgggagctgctccgtctgcgcgcatcggagcccgccctgcgcgagacggggcggggctcctatgcggcccgggccctggggccggacgcactggtgctcgaacggcgtgggggcggccagcgactgcaggtgttgctcagcctgcgcggcgcgctggattatccggtgcccgccggctcggcgctggtgctgtggactgaagacgcttgcttcggcggctccgaaaaattgcagccattgaagcaagacacggtgcggttgaagggttcggctctggctgtgataagacttcccgccaaagactgagaaacgcgccgtgtttcattgcatgtatcgctgcagggcgagcgggcatggctgaaaacatgctcaagaaatgtcgtgggaattccatatcgactcaaagggtattggggcccgcagtccgtcgttgagtcggtaacacctctggccgctcctggagaaagcctccgcgcgtcagcgcgggtgcctccttccggacggcaggagaaatggaagtccacgcgccgcggggggaacgcggcgctccggaaaggctcctggccgctccgatgtgtcgcggaagctcgcggcctcacttgaggtagtcacttgaatcgacagcactcgacttcgtccctggggggatggaagcgcttccgcacgtctgtcaccgcgttctcgctggccgtcggcgcgttcgcgacgcccgcgctggccgctggaggcttcgtctccgccaccgccagctcctatgacgctcccacccctccctcgatggcggtggacggcaacaaggccacgcgctggtcggcctcgggcgcgggccagtggattcgcggcgacatggggtcggtgaagccgctgaacggcctggacatcgcctggttccgtggcaacgagcgcatcaacctcttcgacatcgccacgtcgacggacgggaccacgttcacccgcgtcttcgtgggcatctcctccgggaagtcggctgacttcgagcgcgtcaccttccccacggtgaacgcccgctacgtgcgcgtcaccttctacggcagcacccagacgacctggggcagcatcacggacatggcggccctctccggcgccaccatcccggacccggagccggagaatccggacccggagaatccggacccggagaatccggaccccggcccgggctccacgcaggacaagttcggcgtgacgatgctctacccgaccaagtcgggcggtgagcagtggttcctggcggacaacgcgacgtcggacaagcgctttgacccgcagaacaccatcacccgcaactcggacggctcctggaagatgaagaacagcaaggtgcgcatgtccgtgttcacctccacgggctacagcgcgtccaagattccgacctatgaccgtgacgtgctggccagccgaggctacatgcaggcggcgaacgactggcggaacgtggagatgacgggcttcatcaaggtcaactccacgtccgacgtctcggacaacttcgcctggtacgcgcgtggcggaaagcacaacgacaacaactcgggctgcgagggcagcagctacaagggctcgctgcactatgacggccgcgtgcgctggcagaaggagacgtggcacgtctcgtacgaacaggcggcgtacaagtccggaacgtccgcgctccgcggccgctgggtgggcttcaagtcggtgatgcggaacaccaaggtcaacggcaaggacgccgtgcgcctggagatgtacctcaacgagaacgccgacaagaagacctggaagaaggtctacgacatggtggactcgggtagctggggtggcgacgccagtcactgtggcggcgcggtgaacgccatgccgattacctggggcggccccatcgcggtcttccgctgggacagtgccaccgacgtggacttcaagtggatgtccgtgcgcgaaatccccgcggagcagtgaacggctgacgacagttggcgcccgccccggtactcccaggagtgccggggtggggcgttttcagcgcatccgatgggggccatcaacgccatccggcctcctggtggattcccgctgtcgacaggggcccctctcccgtgttctggattcggcccgatatggccatgaacgtccagaccgccaccgactcgtccgaccgcatctgggagcaggaaatcctccccgcgctcgagcgctacattcgtatccccaacaagtcgcccgccttcgacccggactgggtccgctccggccacatggaggccgccgtccagctcgtcgcggactggtgcctcgcgcaggcccagcacctgcccggcctggtgctggaggtggtgcgcctcaaggacgagaagggccgcgagcgcacgccggtcatctacatggaggtgcccgggacgaagggcgacgacaccatcctcttgtacggccacctggacaagcagccggagatgacgggttggcgcgagggcctgacgccgtggacgccggtgcgcgagggcgacaagctctacgggcgcggcggcgcggatgacggctactccgccttcgcgtcgctcaccgccatccgcctgctgcgcgagcagggcctgccgcacgcgcgctgcgtggtgctcatcgaggcgtgcgaggagagcggcagctacgacttgccggcctacatcgaggcgctggcgccgcgcatcggccagccgtcgctggtggtgtgtctggattccggctgcgccaactacgagcaactgtggatgaccacgtcgctgcgcggcatggtggccggcaacctgcgggtggacgtactcacggagggcgtgcactccggggacgcgagcggaatcgtcccgtcgtccttccgcgtgctccggcaggtgctgtctcgcgtggaggaggagggcacgggcaaggtgctggtggaggccctgcacacgcagattccggaggcgcggcgcgaccaggcccgcgcggcggccaaggtgctgggggaggaggtcttcaccaagttcccctgggtgcccggcatccgccccatgtcggacgacggcgcggagctggtgctcaaccggacgtggcgtccggcgctgtccgtgacgggcgtggacggcatgccggcgctcaacagcgcgggcaacgtgctgcggcccttcaccacggtgaagctgtccatgcgcatcccgccgcgcgtggaccccaaggcggccatggatgcgctgactcagacgctggtgaaggacccgccttacggcgcgacggtgacgttcgagggtgagaagtccagcaccggctgggacgcgccgccgctggcctcctggctgtcgaacgcggtggagtccgcgtccgccacctacttcggccggccggccatggccatgggcgagggcggcaccatccccttcatgggcatgctgggcgagcgcttcccggaggcgcagttcctcatcaccggcctgctgggcccgggcagcaatgcccacggtcccaacgagttcctccacattcccacgggcaagaagctcacctgctgcgtggccagcgtcatcgccgaccacttcaagcggtaggcggcttccgccgggcccgcctcccaggctggggggcgggcgcctcgtccagcgcttcgtcggtgaggcgcacggtgcggcggttccaggagaacgtcaggcgcttgcccgtctccggccagtcgaaggacaccgcgcccgtgcggcggtccttcgccaatgacagacgcacgccccactggggcgcctcctggacgcggtggcgcaggtcctgggcgacggcgtccaccgcatcccgcagggccacgcccaggttcatcaggccgagctgttcgccgttcaggatgtgcggggcagggggcggtgtggaccccaggaactgttgctcgcccacgggccggaaggccgcggacgtgggcggcgcatccatcatcagcaggggaccgccgtccgccttgcggaagaagtacggcacgtcgtagcggcccagttgctcgcgctcctcggggctgaagcgcacgcggccccggtcgctggcgccgggcacctgccctgaggaggccagcatcatgtgctccagcggcgcgtcatacgcgtccgagggtttgacgagcacgcggacatggtgccgccgcgccgcgcgcgcgaggaaggccgtcacgcgttcgtgctccatgagcagcttggtccacacgtcgaacatgccgcgcaggaagggcagcaggtgggccgcgtagcctacgtggccgtctgtgtccgccaccacggagcgggcctcctcccgggcccacgcgcgccttcgcgggcgaagctggagcgcgccgttccgggtggggaagaagcacagcagcggaccgccggtggtgcaccaccaggcgcgccactcgaagccgacgtggtggttgccgcgccggttccccgctgaaatcagccctgtctccgggagccggcgcacgggacagaagaacagctccaggtccaccaggtagggcaggggctcgcgttgaccgcgccggacgcccaccaccaggttgctgccctgcaggtccgccgcgcccacggcgaagcacgtgccggtgagggcgcccgcgtggtgccagaagcgcgcggcctggggcggcggcaactggcagccgtggagcctcagttggggcgaatcgcggaggacgccccactggcggggacgttcaatccagtcctgccagttgtacgtgaaggcgtccctgcctcgtccgcgcaggacgcgcagggtggggagccgcaccgctcccgaggccgccgggagctggttgacccaggcgaagaaggaacgtgggccacgccgctccggctccgccaggaagagggcctctccgctcgcgggccggggcttgtacgccagcgcgccgccccggcggaactggacgcgcaggacgtgctgccgcccgttgtgcgtctcctcggggttggcccagagctgggtgacggggccctcgaagcccgcgcggcggaagacgccggccttcaggtcgcgtgtgagccgcttcgtgaagaggccgaagaaggccaggaacccgtccctcaggcggagcagccctgggtggggcccctgtgtcgccggggtggcggcgcacaaggtgaaggcatccgtcagcaccgggccgaacagcgccgcgttggtgagccgcacgacgcgcgcgccgaacaggcccgggtgtcgccgggcaatggcgtcgcacccgtcgcccagggcttcatagaaatccacgagcggccggaaggcgggctgtgagagcagggcgcccagccgcgcggcgtcactggcaccttggaaggcgcgcgccgcttgcagcacacgctcggggccgggccggacaatgggcgggaagcagtcgctggcctcggggcccttgcggacggcctccaggaggcggcgggtctgcggaggaaagcggggtggggcggctggaggtgttggtgcaagggatggcagcacatgcgcccttcgcgtcatcagtcggccctggcccggtggggcgaaaatagaaacgcgcggcccggcgaggccgggacgcgcgtgtgacgtgttcaatcaggcgccagcggcgcgtgtcctagacgcagtacatgaagcgcgagcaggtattgaacacgttggcggaacccgcgggcttcgtcgtcttgttcagctcccgaagcgcctgggtcagcttcttggtctgcttggacgccttcgtcttcgtcttcgccttcaccatgggaatcctccacacgttggggtcagacagctcaagcatggtaaagtgtgtaattcgcttgagtcaagttgagatgtctttgctggctacgtcatcggcctgccagttggatggctcgaaatgtcagtagaatttccagcatccgacgcatgcccgcccgcgtcgcgggcagcggtttcaaggcgcggagcggcaggtcgcctcgcgaggggaaggggtgcaagagttcacccacgcttaccgtgcgcgccgtgttcaatgtcgcgacaagtttattcaccggctgccgaaggcctgaaacatgcaatgcgttgccattggctgagcaacaccaacccgttcctgttttctccagcaggatggggaaacttttattcccgtgaagaatgtctgtgtccttgaggggccgccgtctcgcgggaggtggtgggggctcgaggccgcccgcggagcgccggttgagccacagggtgcggatgtgggcctgcgttcgtgcgtcacggctgttttcgcgcaaggtgtttgcggcctgccgcagggcggcgggcagctcacgcggcagcacgccgtcgccgtcgagcacgcccggtaccagcgcacggccacgcaccgtgtcgcgagtgcgtggtgcgttgctgtggcctgggcccacgaggtcctccacgtcatagcgggcctggtgtccggtgacggggatgcccacgttgacgctggtggcgacgtcccggctcgcgctctctccgacgtggtagtagctggcgggccagtagaggatgtcgccgggccccacctccgcggtgaaggacttcgccagatagggcgcgtagtccaccagggtggtgacgggcatgctccagggacgcttggcccagaagcgcatccgcttgcggccccggatggcgaagaggaacgtggtgaagcggtccaggtggacgcccaccggactgtgctcgtagttcccatggaacagcgtggtgatgccgcctgacaggggcag

SEQ ID NO: 1060 - DNA, 12253 bp, Myxococcus xanthus
ccgttgaacggacacgggaaaattgctcagctctcctcgcgcgcaatcactgcgcgcgcggcctccacgtcacgcttgatctgccccgtcagctccaccaccgaaccgaaacgctgctcggggcgcaggcggtcgaggaactgcacgcgcagctccttgccgtacaggtcgccggtgaagtcgagcaggtgcgcttcgatcgtcacctccgtgccgccaaaggtaggcttcacaccgatgttcgccgcaccgccatgccaggtgccctttgactcgcccggcagttggacgcggatggcatagacacccggtgcggggcgcagctcgttctgcgtgtccacgttcgcggtgggaaagccgatgccccgcccccgccccgcgcccgtcaccaccgtgccatccaggtcgaagggacggcccagcagccgccgcgccgcggacacgcgcccctccaggatgtactcgcgaacgcgcgatgacgacgccaccacgccatccaccgtgacgggaggaaccacgtgcaccgtggcgccacgccgtgccgcggcctcgcgcagcgtctccgcggtgccgcgccgggccgagccgtaggtgaagtcgctgcccaccacgacgtgcgcgacgccgagcgcgtcgaagagcgctgcctcgaagtccgcgggcggcgtgcgcgcgtattcgcgcgagaagggttgcaccaccgcggcgtccaacccgagctcctcgaacagctccagcttgcgcggcagcagggtgatgagcttcggcgccagctccggctggagcaccttgcctggatggggattgaaggtgaaggcggcggcccgcccgtggcggcgcgcctccgcgaagagggcctgatggcccacgtgcacaccgtcgaagttgcccagcgcgagtgcctgtccggccagcgcccggcccgcgtccgccaccgcagggtagaccttcatgggctcccgtatactccaggcctcgcgtttttccctggccaaacccgtcgtcgccgtggttggtggcgcccgcccatgtcccgtcctcgcctgctccccgagcccgttggcctcaagttcgtcacccaggagaccccgccggactgggacgccgaattcggtttcagcggaccgctcgagctggaaatcggctccggcgcgggcggccacgccctggaatactgccgccgccaccccgaggtgcgcttcgtcgccttcgagtggcgcaagaagtacgcgcgcgacacccaggaccgcgcggacaaggcgggcctgcgcaacctgcgcgtcatcgaatccgacgcccgcttcatcgtgccccgcatcttcgcgcccgattcgctcgccgccatccacctccagttccccgacccctggtggaagcgctcccacgccaagcgcgccgtgattcagcccgcgttcgccgagctgctgtacggcaagctcgcaccgggcggactcttcgacatgcgcaccgacgtccaggaccgcggcgtgacgatgctcgccatcttggaatccgttggtttcaagaaccccctgggttcaggtgttttccatccctatgacccggaggaagtgccctccacgcgtgagcgccgctacctggccagcggggagcccgtgtatcgggcgcggctactgaagcctgcctgacgtcgcgccacgggcgcgcgccgagcctcttgcatccccggtgcgggcagtaagaatggcgggcaaccccgcaccgcgcgcgggacgattgcaccgggggcgagacattcatggcggatggcgaacggaagaggacgctggaggtcgcccgccgtgcccccctcgcaggggaactcagtggccgcacggtgctcctcgtggacgatgacccggtgcatctccggcacgttcgcgacggactggcccctcacggttacgtcttcaccgaggcccatgacggcgcccaggcgctctccgccatccgggagtcccgccccgacctcatcctcatggacgtggagatgccgggactgggcggcgtggaggtgtgccgcatcatcaaggcgaacgcgggcgaggacggcttcggcttcatccccgtgattctcatgacggcccggcaggccgcgggaaaggtggagggactggagctgggggcggatgactacctggtgaagcccttcgacatgctcgagctgtcggcccgcgtgaagtcgatgctgcggctgaaggcgttgcaggacgcgctggtggagaagaaccgggagctggaccgcgccaacaaggagctggcggcgcggcgcgaagagctgctggcgctcacccgcacggatgcactcaccggcctgtcgaaccggcgcgccttcgaagagcggctgaacgacgagttcgcccgctcgcggcgttatggagcgcccctgtccctggtgatgctggacatcgaccacttcaagcgcatcaacgacagcttcgggcatcccttcggagaccacgtgctgaaggccgtggcccagacagcgcgggcgcggctgcgggaagtggacctgctggcacgttacggcggcgaggagttcatcgccctgctcccggagacaggccccgcggacgcgctccgggtctgcgagcgggtgcgcgacgccatcgccgccctggagctggagcatgtgggcgggagtggcaagccgcagtgcgtgcggctgaccgcgtcattgggcgtggccacggtgccgtcgggcgacctcccgagcgcggaggcgctgctgcgggctgccgacgccagcctctatgcggccaagggagcaggtcgcaatcgcgtccatcagcacgccgcgtgacatgtccgaacctcgggctttcccccggcggcgctttgacctaaacccctgtccccatgcgtctctccgcgacgatgccctggctggtagcgctggtcctgctgctgagcctgggtggctgcaaccggccgcgcttcggcaccccgcaggacgcctacacgtccttccaccggctggtgaagcgaggggagctgcagcaagcgtggggcgcgctgtccaagcccacccaggacgcgctggcgcagcgtgcgcaggtggtgggagaggcctccgggggtgaagaaaaaccggagcccatggccctcttcttcgcgaatgtccctccgcctccggatgttacggaggtctcgctcgtccgagaggagggagacgtcgcgacagtgctcgtgcgcgcgggagaaagctcccacgaggtccggatggtccgtgagccatccgggtggaaggtcgacctttcagcatccctccagccgtaaagccgggcatgcccggaaaactcgcatcaggtaacgtacgactgtgaacgacaggaagacacggcgggtgattcccgcggtcgaagtcatccggcgcccggcaacgacgccaggcactgccgctccgaccccgactccggcgcccacgccgcgccccacgcctaccccgcgccccacgggagtggcgcccacgccccggcccgctgctggctcggcgcccctgccgacgcctcgtcccgcgcccacgggaaccgctccggtgccccgccccgccccggtggcagcgacagcgacagcggcccccacgccccgcccgacgacgagcgtgacgcctggcgcccgcccgctggctccccgcccctcaggccctggcacgggtgcgcctccaggcagagcccccggtggtgggttcggcggacgccccggcggcttccggccgtccacgccccggccgccccccacgcccgagcagattcaggcgctggcggtgcgcgagcgcgtccccgcccgcatcgcgaagggcgagctggaagggaagatgaagtgccgcatctggcgcaagctgcacgccgaggaggcgaagcgcttcgaccaggtgtacgagctgatgggccagacgcccagcctgtccctgggtgacgccttcggcgtgctccagagcgggatgacggtggccgagttcatggcccgcaaggagcgcacccagcgcaaggcggccatcaagcaggcgcgcggcgaggtcgaaaacgccgtggtggcggacttcctggcccagctcatcagcgacaaggcagaagtctccgtggtgctggcggagcgctccctgctggacacgctacaggccgaggagcccatcgccttcacgctggagcgcacgggccgcctggagaagctccaggtagtgctgctggcccggcgcacggactgggagcggctgctgcccggtctggagcgcgatgccaagctgacgcagaagccgtccgcggtggcgcgtcagccggacaagcgcccccactcggacccgcgcgccttcctggaccacatcgggcagacggtgcggatggtgctgcgcaacggcatcaccctccagctcccgctgatgcgcgtgggccggttcgacctgctgttgggcgaggagggccacgaagtcttcgtcccgctccacgccctgctgcgcttcgagcccgtcacctccacctccgacgagagcgcccccgcggacgaggcctgagggccatctccgcggggcgtacgccccacaccgccgagacatccatgcgtcagttcatctcccgcatcatcaagccctggctcgccttggccgcgacggccgccatggtgggcatcacccagcaaggatgcacgaaggacgccgacgcggcgaaggcgcccgcggtccccgagaagcgggagaacggcgtgcgcatcgtcgagctctccgtcaccgagaagggctacgagcccagcccggtgagcctcaagaagggcgagccggtgaagctggtggtgacgcgcaagacggaccacacctgcgccaccgaggtcgtcatggacggctacgacatcaacacgccgttgccgctcgaccagccggtggagattgccttcacgccgaaggagtccggcaagctggtgtacggctgcgccatgaacaagatgatttccggcgttttcatggtcgactgacggacgctggtcgatttctaggcagcgccgccgggaggagtagtctccgcggcctgaatgggcggcgcggcggagctcttcacccggcatgtgttcctcgacctcgaaaccacggggttggatccgcgcgtggacgaggtcatcgagctgggctgcatcttcttcgagaacgggcgcgaggtggaacgcttcgcgcgcctgtactcggcgtcgcggcccctccccctcaccatccggcgactgacgggcctgacggacgcggacctcgaagggcatccgcgcttcggcaccgacatcgcagagcttcgcgagaagctctccggctggacggtagtggcgcacaacgcgccctttgaaaaaggcttcctgccggacctgctggggcccatccacgccccggtgctcgactcgtgcgagttgatgcactacctgcacccggagctgcccagccactcgctggagtcgctgctgcgctggggcgggctcgcgttgagacagccgcaccgcgcggtgtcggactgcgaggcggtgtactcggtgctggtgcacgccatggagcgctgcgtccgcgagggccgtggcgatgacgtggtggacctgctcgccgcgttggacccgcgcaagggcgcggagctgcgcctggcgatggagggcgtgggcctgaaagacggcgcgagcggcgcgttcgactatgaggaatggccgctggtggacctgctgtcgcgtctggccgccgcgtgccgtgaggaggctgcgccgctgtcgctggaggcccagggcttccttcgtgggaagccggagcggcggcgcgcggggggcgccacggcgctgcccgagccagaggcggatgcccccgtgctccccgtgcgtccggacgaggtctcagcgctgctgggcgttggcggcgcgctggagcaggccggtgaaggattcatgagccgggccgcgcagctcgacgtggcgcaggcggtagcgagggcgctgtcggacggcgggcaactcgcgatggaagccggcacgggcacgggcaagtcgctggcgtacctggctcccgccgccctcttcgcggcgcgaaatggacgcaaggtcggcgtggcgccgcacaccaagacactccaggaccaactcctggagaaggacctgcctcggcttcaccgcgccacgaagggcgccttcggctacgccctgctgaagggccagacgaactacctgtgccgccgccgcgcgctggaagccactcgagtggagcccggcatggggcactccgcgcgcgcgccccgggcgtatctgcgtgcgtacctgcgtcgcagtggcgaaggagacctggaccgactgagccactggttccgcgagcgcttcccggtgctgatggcgctggtgcccgccgtgcgctccgaggcgtcgacgacgctgggcgagaagtgcccgcacttccaccgctgcttctatcactcggccgtggcgcaggcccgtgaggcggacgtgctgatcatcaaccagtcgctcgccttcgcgtggcccgcgcgctacccgaagctggaccacctggtcctcgacgaggcgcacgaggtggaggatgtcgccaccaccgcgctgacgctggagctgtcagacttggccttcctccgcctcatcgaacggctgcatggcagggacggaaggcgcggcctgttcgccgagctgcgcaaggcgctgagcgcttcgcgccggacggagacacggtcactgatgggcgaggtggaggatggccttcgccggttgcttgacgacgcgcgtgacctcggtgcgcgcgtgacggagctgtgcgagcccaccgccacagccgtgggcgaggacccggatgaaggtgcgtactctccggagctgcgcatcaccgcgaccgtgcgcaccctgcccgcctgggagccggtacgcgaaggactggaaggcgtgcgcggcgcgctccaggcgctgcatgtcctgctgtccgtgcgcgtgctggccgcccttcctgagctggccgctcgacaacccgcgctggagcgggagctgtcgggtgccaccaccgagcttggcgaactggcggtgctcgcgggcgagctgtccggagaagccgcgccaggacggtgctacgcggccaccgcggaaccgaagcggcagcggtggagcttgagcgcccagccagtggatgtctctgcctacgtgtcgaaggacttcgcggagagcaagcgcacgctggtgctcgcatccgccacgctgggcactggcgacggcttccccttcgtcctccggcgcttgggtctcgatgggcgtggaggcagacctgcgccccgactggtacgcgcggccacgcccttcaagctgcatgagcaggcgctggtcgtgctcgtcaccgatgcgcctcgtgcgcacgaagaagccttcgtggagtgggcctcgctccggatttcgggcctggcacagacgatgggaggccgggtgctggggctgttcgcatcgacacgccgcatggagcgcgtgggcacgagcgtccgcggacggctggacccactgggcatcgaggtgctgcggcagtcacgggggcacagccgctcgctggcggcacggcaggagaaggacacgggcaccgtgctgctggggaccaagagcttctggcagggcgtggacatccccggtcgcggcgtcggctgcgtgttcatcgacaagctgcccctggagcccgccatgcgtccgctggtggccgcgcgcgaggagcccctctctcgcagcggcggcgaatacatgggcttcctccactaccggcttccccgcgccctgctgcaactgcgccagggcgtgggccggctcatccgggcgacgacggaccggggcgtggtcatcatctcggacccgggacaccccagctaccgtggccacctgatgaacgcactggagggctatcgcgtcgaggcgcttccgtgggcccaggcgcgcctgcgcatccacgcgatgctgaaggagacggggctcaccgtggagtcaggacccgcgcggtcctgggggtgagccccggaagggctcagtcttcgagccgggtgcggtagcgcgcatccagggcgcgcagctcgtggatgagctcgggggaagcgcccgagcgctccgcggccaggaggacgttcgccaaggtcctcgcgtcctcctcgttctgctcgcggaggcgctgcaccatcttccgcgtggcatcgaagaggtcctggagatcatcgccatcccggagcccgtgctggggtggacgcagccggccgtcgtggacctcctgcaccatgcggcggatgcggaagagtgggcccgccaccttgtgcgtcaccacgatggtccccaatcccaccaccgcgatgaaggccaccagaaagcccccaagcgcccaccaggtgagcttctgctgccgctccagctcagcgcgttgggcaacgatggcggcacgctcggcctcgtaggccgcgtcaatggcccctgccttctcgcggaagctcgcctcgaacgtggggtcgtccatccgagtcagcagctcgttggagagcgtggcgccggacaattcgcggctgacctccgccgcgcgggagcgggcctccaccgccgtcgctgtctcgcgcatcagcgcctgcgcgcctctcacgaggaacacgcccagcagcgccgacagcacgagcgtcaccgagacgatgtacgccgtcagcttgagctggaagcccgtttcgagaaggaagttgcgccagcgccgcttggctggcgtcaggggcgccgtggtcgtcgtcatgtctcgctgctccactcgaaggtctccgccgcttcctccaccgcgcgaggtaccagcgccttgaggagatcgccaggctgagcgcccgcggcattcacttccacctgccccatcagcgacaggtccgggtaggtgaggcacaccagcgccacccgcagtccgccgccgtccgtcgcatgaagctccggggtgatgcggtagccccgcacccgaagcttcttcagcgtgcccttcgccgccgccttcgtctccttcgcgggcgcgagctgggccccgctccgcatcagccgcgagcgcagccgcgcctccgtcgccttcaccaggtcggcggggagcttgcccgtgcggtccttgaccgcctcgagatgcacgtagaagcgcggcgggcgggactggtactccttcagggcccccacggcatcgctcaccgccgcctggaccgacgcgtccgcgtccgccttgtgggcctggaggcagtcgagcccgccgggctccagcagcttcgccagccccttcgccgcggccgcgcgcaccagctcgctctcgtccttcaatccgttgcacagcagcggcacggcctccgggtcctccgtggcgccgagcaccagcgccgcctgcgagcgcgagcgcgggtccttgctcttctggagctgcttgcccaggaaggcaatacgggagtcaccctgagccagggccgcgcaaggcgcgaggagcagcaggacgagggcggaggaaagcagctgcatgtgcagggaaggagtccggagagtctaacgccgtctgacgattggcgaacagttgcatggccttgcacatggaagacagtgggtcatgcccactcccgccctgggggctggcccgcttctgtcggtccgggtgtctgttcagacctggggatgcgctgggaagggcacggcgcggggcgcgaacccgggcggcatgtccacggcacagcggctcgggctcggcccctggggcccccataaccggtgcctcccgcctcctccacggcagcaggaccggcaggaatcgagccatccgctcggggatgtggccctcatggggtaatgtgcgcgtctccaggagggctcaccaggtgtctttcacgtcccggttggaaggtctgctccagaacgtggggttgggcggtatcgtgggtgaggtgcgcgcgcgcctcgggctcaaagagcctcgagacacatccgcgccccgggcctcggacttcccttcacctcctccccgtggcgccacgcagcagaccgtggtcgagcgtacgccgcgtcccaggccagtcgtctcccagccgtccgacgcgccgccgtcggagccgaccgtggcagagcgaactccgccgcgtggtgcggtaaccaccgatgctgtcgcaccttcggcggcccaggccgctacgcctgagccttcccgaaaggtgacggcgaaggcgcctcgcacgggggcgaaaaagaagaagcccgcaacacggcaggtgcagagcagcacgggagccaagtcggagaagcggacggcccgcccggccacgaagacgaagaagcgagcgcgccccgataagaaggccggttcgcccgcgactggaaatggtggcaccgccgtggaccagttgctgtccgcgttgcgcagccatccgcggcagcaggatttcatcgctgcaggcaagcagaaggaccagctcgtgcggtcactcatccccctctatctcgcacgctcgctggatgcggagttcgaggtgacctctggaacgacgtcgcgcttctggggggagctgggtttcacctacgccgcgccgaacgcggccaaggcgctccgcctgcacggtggttacgcacaggacacccagaagggcaaagccatcacggctcggggcgtccagtacgtggaagaaatgctgagtcgtttcgggaacgcctcttcgggcacctgactggcgagtggatggcatggacacctgggcgcggcgggctccgccgtttgcatttcctcctcgacggcacgccctggcattcaccaccccggaattattgatgcaccaagttgactacaatcaggtcgcccgctgacgcatccactcccggcgcgcccgctacacctcgaagcccaattctttcaaatagtctgcggaccgagaatggcccagagctgcggccaacctgaggtaccgagctgcgcgtgtcctggatttgggcacgccattgccttccccgtacatctgtcccaggctaaagagggcactggcgttaccttgttctgcggactgttggtaccacctgagagcccccagtatgtctgtagagcccccgacaccattgagacacatccaacccaggacgcattgggcatcggcatttcccgcgtcagcggccttcttgtagatttgaatggctcgtcctagattcttccggacgcctcggccctgctcgtaggcaaatgcgacgtagagcaaggccttcacattccctaaccgtgcactttcccggtaaagcgcaacggactccttcagcttctccttatcggagctctggacgagcagtgccgccaggttcattcgagccggagggaatcccagggatacagcacgcctgtaccaatactcggcaagcctccgattcggccggatgcatggtcccttctcgtaggacaaagccagattgaaagcggcaaccccgtcccccaggcctgcggccttccgcatccatcggaatgcgtgccgcacatcctggggaacaccatccccgtacaggagatggaggccggcattcgtcatggcctccactctgcctgcccgggccgccatcagataggcgtggaaaagtgcatcacgcgccccctccggaacctcttccaggtcccaggcccgctccatcgcctcgaccgccaacggcgcgacaatgccccttcggcctctgcggactatttctttccgttgaaccaatcgtcgaatcccggaggcttgggtttaattgtcttctttcccgtttgaggatgcttaaactctaccttatcgggccgccctcgaaccggcctgtagtgcttaaatgcgttatctgacccgctctccttgcctgagaagtttcgctcccccttccccatcgggcaagcattcgggggcgctggcggattcatgacgggatcatccgccgtctgttccggccacggaaaactaggacacgagcctggatgagtggcgcaataggcaatgattcccactgccgccgtccctaccgccgcaccgacgagtgcacctaccggacctcccacaacggctcccgccatggcacccgcgaccggattttcccctgtgggatcacgatagctcaaggggttgttcgaggcatatgcataaggcggcaatccctgccccataagcgcataagcttgaagcatcgcaggattctgcacgaacggctcctcctgaaggaaacgtcctgtggccggctcatagtagcgagcccgaaagtagaatagccccgttccgtcatcctcccgccccgtaaacgtctg

SEQ ID NO: 1061 - DNA, 11732 bp, Myxococcus xanthus
  unsure (1)..(11732): unsure at all n locations
ggcatcgcccgccgtgccgtgatggacggatgacgccggactggcgcgcaagtacttagggggttgtagccgggggaaggcggcgcccgtccccacgccagccgccccggagctgacggctgcgtcttatgatgcgacggtcctgctctcgtcgcgtactggcgcgagccaggcacaggtgcaactggcctgccgggtgcccacggccacgcccgaagcataggcgcgctacgcgctgatggctgagttgattcacaatcacgcctcgggggagatgcgctcgcgccggggggcgacgtacggcttctccgcgcggccctggctggggcgcggcggcgcggcccacctggtgctggagggcgcggtggatgcgcagcgcatgggtgaaggcatcagcaccgtgacccagctcctcgcgtccttcgggaaggaagtgcccgagcacgcgctggagcgggctcgcagggggatgctggcgtcccaggccgtctccttcatcagctcggaagcctgggtgaacgcgctgctgaccgcgcgcgtccgaggcttcgagccggacacggtgacgcgccggcccgcgctgctccagacggtgacggccgagtcccttcggaaggagttcgagggctgcttccagcggcccgttgtctccatcaccgcggatgagggcaaggcgcggcccgtcatccaggccatgtcccagccgtagcccaccccggccccctgcctgctggccgtcccgcctggcaggggctggcgtccacctccgtgtccctggctgcttatcttgaggccgccagggaccagccaggggggcgccgcatgcgtcgaagcgcgctgacggtggcccgtggggcccgggtcagccgagccggtccaccggtaccagcaacacgtcgcgcaggcgccagtccaggcgcttgaggttctcggcggcgttgcccagccgggtgacgagctccggtccccgctccccgctccttcggctccaggcgcacgtccgcgcagaagacgtgtccgttcctcgcgcacgcgcacctgagcggcctccacccagtccaggccgcacagggcctcgtgaatgcggcgcggcagcggctcggcgtgcttcgagtcgagcgtgcgcggcgtgcggtccatcaagtcacccagcgcggtgcgcaggtgccgctgtccgtcccaggcgatgtccagcgcgatgacccccgccgccaccgggtccgcccaccaccagcccatgccgatgcccagcacgcccaacatggcggcgaccgcggtgagccagtccgccttgttcatcagcgcgtcggcgtgaagcaccttgtcgtggagcgactccgccagtggcagcttcgcccatcccagcaacacggacggaatcgcctaccacagcagggtcgccagcatcagccagcccatccacacggtgtggccgaacagctgcgtggtaccgatggaagggtattcggcgcgcaccagcttgagcacggacttcacgaacagccacgtccccatgaagagcagcgccaccgagcccaccaggtacgccacggtgacggcgcggtggtagccataggggtactcggcggagggcttccggtgcgccacccggctgcccaccaggaaggagatgggcggaatgaggctgagcaggtcctccagccacgccgccttcatggcctgggacgcgcccagcgtgaggtagatgacgacgatggccgacccaggtacgccagtgaccaggcctccagccgctgcgcgcgcttgaggacgcggtgcttgtcgtcaggcaaatcttccgggtccaccgggccgcgcgcatgtccggcgtgttgccgtcgttggcgccagctcatcgccggtcctcttcggaggtcgtgggtgtctcgccggcgtaggcacgcggcggatgaggcgctacgcgccccgaccgctcctcggggccatggcgaagaggggaccgcctgcctgctcgcgggcccgggacgcgctcaatccaggtagccccagcgctcctcctcgaagacgaagaaggggcgcccgaagggaatcctgtccgtccatcccagcacgtgacggcgtgcgtccgccgggccgctcacgtcgtaggtgaagccgaagtgagggccgctgaacttggcgggtggcagctgggggaggaactccggtacgagctgctccagggtgtcggggagctgtccgtgccgggcctggtaggcgcggcaggccgcgatgagcgtctcggcgttgcgttgcgcgcgttccgcctccttcttcccggggcggagcgccatgtacagcgtcaggggaatgccgacggcattccgcagcagcccccgagcggtgccaaggaatcggtggagcgtcatatgggcgcgaccatcgcatgactggcgactgcctatgttctccaagaggaggacatcgccatgccagatgtggaagcgccgcggccgctgtccgagccgccagacgaggcggaggagcgacagagccgctacatggaggaagagccgggccacacgccggggagcgcggagggcgacgacgaagacgcgccgcaccgtgttcgcccctacccggacccggaccacaccccggggcgggcagaaggttgaacccaaggccgccgggagggctgacctaccagaggacgaggtaggtgcaggaattcgcgcccttctggcggcaccctgctgaagtgtcgtgggtgagggtggcctcgggcgcgaagcgccgggccatgcccttcacgagtcccatgtcgaagcggcacgggtagggattgtcgaagaccaggcgggcctcgtctcggccctccgccgggtggaagtggcagtggcccatctgcgggttgcagagcaggaggagcctggggcttggacgtgagcccctgcggttcgtgccttgatgactctcccagcgggagccgacgctgtctctaactgaagtggcgctccagcactgcagcgacgtgcgggttcttctccgcttgagaggccgccgctgccagggcggggcagttctgaatgaaccaggccttgttcgggcgccagtgcgtcatcacggtgacgtagaggtccagcgcgctgaagcgcttgccgagcacgtgaggcttgcccacctgggcctcgatttcgcgccagaggttggcgcggcgctccatgacggtgtcgcgcagccggtccgcggcgggaccgggcagggtccacttcggcgggtcgtccgcgtaggtgaacgtcgggtacaccgcgcccacgaggcggaacaagaggttgaggaagcgcacgcgctcgggcgccgtgggctccggcaccaggccgctctggggcgagacgtcgtgcaggtgcaggatgatagccgcgctctctgtcatcaccgcgccatcggggaggatcagggtgggcacctgccccaggggattgagcttcagcagccggtcgcgtccggggccaggctccaggtagggcagctccgtcaagcggtgcgggatgccggtgatgctcagcgccatctccacgatggccgagccacatcccggtgagccaatcaactcatagtcgttcatggaccgttccgtcattccccagaagagggcagtggctgccagttgggaaccaacctggggacgatttccccggaggccggaatcgtcaactcctcccggtggaaatagaggcggcggtgccgtcaccagcctatggcgacaggttcgcgctctccgcaggttcgtgaggcgtagcgtccagcagtgaacccaggatggaaggccccggactcatgtggatttcacccaactccacatctccttcgaagggaacatcgaccgtgagggttcgtgatgccatcccgggggcatcgaatctcagcgtctgcaccccagatttcagagtcgaccatttgaaagcgccgtcctgggggtcgacatagaattcgcggttgttgaggacgaaatttgagaagggcgacccatcgggacccaggagcctgcctcggatttgtgaatcacgttgcatgacgatacggaggggggcctcccccggcttcacaagaagtgcgaaggtctcgtattcggtccctcccgaggattgtgctgggacgaaggtatggccatctatcgaggccgatatcgtgtgcgggccggaagacagatgccgcaggacgaatcgcccatccgcgcctgtgcgaacgccgaaaggtccgccgcatctgaagctgacggtcggcggctctgtcgcgtcagctggtgactgccgagaggccgtgatagtcgcgccctccaggggtcttccgctcgttgtcaccacgatgccggagaccgtcacaccttcgggaaagcgcaactccacctgcggcggaggtccctctcgcaactcgatgtcctgggcgacggtccgccggatgacacccagaacctccttttgtgcccacaccgtgtagtgccctggcggaactgccccgagctggaagtgtccctgggcatctgaagatgaatattggctgtgcgtgtctttcgcctcgcgcctggcgaggatgacgtccgcatcgggcacgggaacaccgtgctcatccaacacgatgcctggcaagatcgggccttgcttcagcgagatgcggaggtctccgctgggcgcgtgcaccgaagcgacgtctggaaggaagcgcgggtcatcggcttggagcccccaattacctgcgcggcaggctttcagctcgaaatggccggcgtcgtccgtggtcgtcacatgattatggtgcggcaccgtggggttgcattggcgctccaatctgagcgtgacgttcggagcgggcgccccgtgtgcgtcgactgcaacgccggtgatggacaccgcgcgaaacagggtgatggtggcaggggacgtggcctctggggaactcagggtgacgacttcgtccagatggcccggtgctgacaccgtgacctggttcatgtcggggccgaaggggcccagacgaaagcggccatccaggttcgttgtcgtgaccgggtagtcgatatcaaggcgctgcggaacgacggagacgcgggcacctggaatgggctggcgcgcctcgtcttgaacgattccttcgaaataaggtgcaggccgcagttcgagtaccgtctcaaccccgtttcgctccttcagggtgacttcctcgctggcaatcatcccttcatggaaggccgacactttgaggccgtagccattgcggagtccggagaaatgaaaccgtcctttcgcgtcggacgtggcgaactgaaaggggaagtcatgtggaaactccgcggtgagctcgacgcgggcgcccgcgacggggcttccctggaagaggacccggcctgcatggttcagcggccgtgtgaggtgcacgctgccccacggaagggcggtggcctcattgagatggaggagctccggtcgccagccatcctgcttcgccaggaggacgtaatgcccatacggcagcgggccgatgtggaaccggccatccggacctgcgatgccgtcgaagtatcggtccgttgccacggagaccaggctgatgcgggcgcctggtagcggtacgtcctcaccaaaggcggttccctccacccgtaatcccggagccagcaccaactgcagtccgtcgtgcgtccccaggatgccttgttgcacggccgccccgtcctcgttcaaggcccagaccgacaggattccgacgtccagtccatccaagacgtaggtgccgtcaccgtcggtgaccgtctctgcctggaggatggcttcgcccatgcgggaggtcatccactccgtcagaatgtcctgggccgcctgccagcagtcatgcaagagccggaggggtttctcctcgcggcgggagccccctgtgccaggcgcccagtcggggcacggcagctctgccaggggctcctcggcccgcgacagggcggacacgcgcacgcccgcgagggggactcctcgcgcatccaccacggtgccacgaatgcgccgtctcttttcgggttgaggaatcgggcccagtgccgccatgcctggggtgccagttccttcgatgcggttcgcgccttgcgacgatgcggcgacgcctgcgcctcggtcgacggcctctgacgtggagcgcgcgtcccaggcgagcatcccgaggaccccgacggccagaatcgtgaacgccccgccgctgcgcgtgcgccgctccctcgtactcgtcatgccccgacggtagggagccgcggcggggcaatcctcacggaatggtcatgattggctcagcaatcgcgcagcatgagcgtcgcgtgtcggacgcctcatggagcccgcgtagcctcaccaagctgggggaatccctccgcaacgtggttccggccctgcgcctggggagagagcgacctgggtcagcgtgcccagaagtcaccgaagctgacggcggtccgttgaagcgggcggcgtttcctgggaggaatgcgcagactgcacgcatcactgaacctggaggtcatccatgcaactgttcctgacgggcgcgagcggcttcatcggcggctcccttgctcattcgctgaaggcccgcggccacgccatccgagggctggtcagggacaaggtgaaggcggagcggctggcggcgctcggcatcgagcccgtgctgggtgacttggaggaccgcgcgctgctgacagctgaggcgcggcgcgcggacgcggtcatcaacgcggccagcagtgaccacgcggaggccgtcgaggcgctcctggcggggctgcgcggctctggcaagccgctgctccacaccagtggttccagcgtgattggcgacgacgttcgaggcgaggtgctctccgacaaggtgttcgacgaggacacccccttcatcgtcgagcccgacaagcgggcccgtcacgcggtcgacaccagcgtgctcgccgccgagggaatgcgcggcatcgtcctgtgcaacacgatgatttatggcacgggcaccgggctcagcccggacagcgtgcagattcccccgctggtgaagcaggcgcgcaagagcggcgtggtgcgcatcgtcggcaagggcgtcaaccgctggtccaacgtgcacatcgacgacgtggtggcgctgtacctgcttgccttggagcgcgcgcccgccggggccttctacttcgtggagaacggcgaggcctcctacgcggagattggtgccgccatcgcccagcggctcgggctggggcccgtgcaatcctggtcggtggaggaagccagccgcgaatggggtgaaggccacgcgcgctactccttcggctcgaacagccgcgtgcgtggcaagcgcgcgcgccgcgaactggactggaagccccggcacgactccgtcacggcgtggattcgcgacgagatgccgctcggttgagtgctagttccaggggaagaggggaccccagacggagtgcgagctcagcgcgatggggagcttgagcgtcaacaccagccccacctcgcgggcatgccgcgtccgctccacgccgccggggccgatgtcccggtccccggccagcggaatcccgaagcgcacgcccaggctgccgaacacgaaggccaggtagggcgcgacgtgcaggcccgtggtcgccacgcgcgtccggctcgccgtttcatgcatgacgcccagctccacacccccgaagagcagggtgccctgaagcccggcgcagagccgcgcgctgccgcgctccatcttctgtgcctgcgcgaagaggcccagggcgcccacgcccttgaaccaattgagcgtcaactccccgcccacgcccgtgccgggcgcgtccgccccgaatgccgcgctgtacagggggcccacggacagccaggtctctctttcggggaacagcgtgatgtccgccctcgcgggcagggcgaagagcacggacgccgccaggagcgggacgggaaggcgcatgcggccgcttgggtgcaaccaccgggccctgtctccgcgcgaagggatggcacctcttgcatgtgcaagggactgcacgttgcgtcaccgcccgtgcgcagtcgcgtggacggacgggacgcgtctgctcatttcttccgaggcttcggccccgcggggcgagccggcgcggcggagggctccacggagtccagcgtgacggggccttcgcgatacagggcattgaccttgccgccgcgaagctccagggccgcgaggttccgcccgtacccggtgctcagcccggtgtcgatgagcagcgccttgccgttgaaccgcaccttcacctttccgtcgcggttcgtggtgtgccccatgaccatgcgcctggcgccataacgcttcagcaccgcgtccagcgcgggttcggcgtcccgtggctcgcccagtgcgtagcctcggaaccacaaggggccctgtgcgtcccgcgcgccgccgggcggatggtcggggaagaagtcctggcgcacccagcggttgagctcggccaggtttccgccgggaacgccgggcgcgacgccgccgtgcacgaagagggtgtcgttgatgcgcaccacggcggcgtgcttgcgcagccactggccgtagcggccctggaggctgtacgcgacgcggtgcccgttgaggccgggtggggagccggcgctgtcctgctcggggctctggtcggcgaacgaggccatctccccggggttcacgtatcgcaggtcgcccagcatgttcatggcttcatggttgccgagcagggcgtggacccgtccgcccgcggcgagcgcttcctgctccagccgcatgagcaggtcgaacgccgctcgcgtctggtcgccccggtccggcacgtcgcccgtctggaccaggtgcgtcttgccgccaatccaccggtccttcgcgtcaatgaggccggcgagccgtagcacctccttcagggcgtccacgtcaccgtgcacgtcccccaccgccaccacgcgctccacgccggtgaaggtgtcggggaccgcgtcctccagccgaggctgcgccggggcatggggtgcgggtgccgccgccaggagcagcgggatgagcacgagcagggggcgcgtgcggagcaaagaggggggcatgggcatgtcctctggtgagacggcgcgcctgggctggccggcccaggcgcgctggaggacctcagcgtgtcacgcccgcgcggccctcggtgcctgaatcgcctccaggcacccgggtcgctcggtcaggcgacggagggttcagcggtagtcccacttctggttcgggttgcccgtgcactcgtagatgatgagccgggcgccgctggacgtgttgtggttcacgatgtccacgcacttgttggcgagcacgctgacgaggtcacccgcgccgctcagcacgaactgctgtgccgggttgccgctgcagttggccaactggatggccgcgccgttggccgtggaggcccaggccacgtccatgcacttgccgcccgcctgaacggtgccgttgatgaaggtccaccgctgcgcgttcgtgccattgcagtcccacatctggagctgcactccgtcggagaagttggagttgggtacgtcgatgcacttgccgttgaggcgcgacacgaaggaccgtccactgccgccaccgcccgtcgtgcggagcgtcaggccgtaggcgcccaggatggggttgacgggttggtagaacgtctgcggcggatttccgttggcgcacgtgcccgccacgccggacgtcacgccctgggcctggttgccggagatgacggagccgccggagtcgccgccgtccgcgcacgcgttcgtcttgtgcaggccgtacacgggcccgacggagtagttgacggtgatgttcttcgcctggagcacgccgcaccgccagccggtggtgtagccggagcggcagatggaggcattcaccggagcctcctgggagcccgcgacggtgacgttgccgccgctgtagttgttgacccacggctgcggggtccacgagccatgggtggccacccagccgtagtcggagccgggccagacggagccacggatggtgcccagggccacgccgttgtgccccgtggtgggcgtgccggcgccgccgcagtggccggcggtgacgaagcccccgttgacggggaagcccaccgaacagcggtagttgctgaagtagtaggggtcaccgccgcgcaggtcataggcgggctcgggcgcgtgggtggaggccaccacgcggaggctgccgtctttcaggcccgagctctgcgcgatgaaggcatccgcgcgcagcttcgtctggctggaggcgtccacgtagacgacgacgctgttcgtcggcaggtcgacgtaccaggagtggatggcgggcgagagggcctggacgttctggtccagttccgccttcacctgctccagccgcgccaggctccgcgccacgtgcacggtccgcacgccggcgacccgggtcttggcgaggcgggcctcgtcggtgacaccaacgatgagctggccgccctccgcgtcgagccaggcgccaccgaaggcgtcgccaagttgttcacgcatcgtctgctccagcccgggcgccttcgcctcgaaggacaggcgctgatgcacctgctgctcggtgagcccaaggtcccgacgcatcgcggagacaatttctggcgacacgtcgctcgaggcctcggcggccatcggcaggcccgtcagggtggcaaggccagcgaacatcgccgcggtagaaagccaatcagacattcgattcatggaagtagatggggagtgttcccactgcagagcgaacgccagggcaggggacatcgcctgcgcgtgggagtgagagggattccctggcgtgatgtggagtccgcatgagcatgtggcatgccaatgcgggtgcagggacttccagggcgagtgaggtgatggcgtatgccccactcgcaattttatgacggacaggtggtgacagccgtcctcggctggtgactggtgttaccaccctgcgtcaggccgaaatcgagctggctgacgttgggactgctgctgtgtggcagcgcggcacacgcggacgcgctgccgtacccaggtggacaaggtcgtggtggcctgtccctgacgcgcgcgcgacgaactgtactgctccctggatgcagcacagcgggcgacacgccgggaggacgtaggatggcgtcacgcccatgcgcacccacactgaggccattccctacgaagtccaccgcgatgacgggctcgtcgcctccgacgaccccgcgcgcatcgacctggacgtcgtccatggctacctgtcccgctcatactggtccgcgggcattccccgggagacggtcgagcgggccgctcggaactcgctcgtcttcgggctctattcgtctggaggccaggtgggctacgcccgcgtcgtcaccgaccgcgcgagcttcgcctatctttgtgacgtcttcgtcctggagccgtaccaggggcggggcctgggccagtggatgatggaggcgctgctcgagcatcccgacctgcaagggcttcggcggttcttgctcgccacgcgagatgcccattcactctatgcgcgttgcggctttcagccattgggcgcgcccgcgtccttcatggagcgccatgacccggacgtctatgtccgaaatcgagaagagggcgcgaaagggaaggcagattgaggtcatccggaaggcctgggncgtgacngtcgggcccaggccc

SEQ ID NO: 1062 - DNA, 10793 bp, Myxococcus xanthus
tgctcgcggacgacgaggaacagctcgtccagctcgtgctcgcgcccaagggacagggccggtacgacttcgagctctacagcctctccgccaccgccgacgaggagaccgagggatggctgctgaatggcacgggaacgctggtggtgggagacggccccgcccgtcccgagcccctctcgcggaaggacatcgaggcccgctgcgcgcgtcagctcgacggagggctctacgagcgcaactgggacatcggcttcaacctggggcacgcgttccgctggattgagcgcatccacagtgggggccgtgaggcgctgtgtcagatgcgcctgcccacggacctggatgaccggagcctgtacgtccatccgggactggtcgactcgttcctgcaggcgatgggaacggacctcatccgcgaggacgcgatgctgagcaccgtctacgtccccatttccgtggagcgcttccgattccacgcgcagccgaccggacccgtctgggcctacgccgtgcgacgggacgcggaggaagcggtgggcgaggtcatcaccggcgacgtcctggtggtcgacgcggatggtcaggtgctcatcgagattgaggggctgaagcacaagcgagcgccgcgagaggcactgatggcggtgctgcgccacggccagcgggactccctctacgaactgggctggaagccgcagcccgtgcccgaggcttcgcccgaagccggctgctggattgtgttcgctgacacctcgggcaccgcggaggcgctcgcggagcgcatcctgaagcaaggcggccgtccggtgctggtccatccgggagcggcgttcgtccgtcatggtgaagggcgcttcacgctggatgcccagcggcccgaggactacgcgcggctgctccaggaggcggtgctgcccggcgagtccctgggcggcatcgtccacctctgggcgctgcgtgggcccggtggcgaggatgtgggtgccctgcgagaggcgcaccaactgggagcgggcagcgcgctgtccctggcccaggcgctggcgaactccgccttcaccgcgcgcatctggtgggtgacacggggcgctcgcgcgctcgacacgcgtcctacgccgctggcgatggagcaggtccctctttggggcctgggcgccgtcttctcgcaggagcaccccgagctcgctggcgcgctcatcgacctggagccctcctctgtgccgggtgacgcggccgccgccatctggcgcgaactgggcgccaccgacggtgagcggcaggtggtgattcgcgaagggcaacggcacgtggcccgccttcgcgcctcgcgggacgtggcgcggacggagttgccgcgcctgaaccccgaagcgagctatctgctcacgggcgggcttggcggcttgggcctcgcgctggccggctggatggtggagcagggcgccaggaacctggtgctcatcggacgcggcgccccccagccggaagcgcaagaggccatccgcgcgctggagaccgcgggcgccaaggtgcttgtgctccaggcggacgcgtcgaagcaggaggacgtccgtcgcaccttggatgaagcggagaagctggcgcctctgcgcggcgtggtccacgcggcgggcgtgctggatgacggcgtcctcctgcaacaggactggaagcggttcacccgggtgctcgcgcccaaggtagacggggcgtggcacctgcacacgctgacgcagggcaagccgctcgacttcttcgtcctgtactcgtcggcgtcgtccctgctgggcgcgccggggcagggaagctacgcggcggccaatgccttcctggacgcgctggcgcatcaccggcgtgccctgggacttccggcgctgagcatcaactggggaccctgggccgaggtgggcatggccgcggagctcgcgtcccgctaccaggcgcaaggtgtggaggccttcaccccggccgaggcgctggaggccttcggcaaggccttcagccgtgcgcagccgcaactcaccctgttgcaggtgcagtggtcgcgctacctggcgcagttcccccggggggcggcgcccacgctgctcgccgacgtggcagggcaggtgcgtgccgagcccgaggcggacggcccgtcggcctcggagttgcggcgccggctcgacaccgcggaaccccgccagcgcatggcgctgctgttggagcacgtcctggacgcggcggtgagggtgctcggcctggatgcatccacgccgctggagccacggcagcggctgttcgaagtgggcatggattcgttgatggcgctggagctgcgcaaccggctgcagaagacggtcggtgcgtcgctgccttcgacgctcgtcttcgactacccgacggcggaggccatcgcggcctacctgctgggcgaagtcttcggccaggagccgcagccggccgcggaaggacagggagcggctcaggacacggcgcttctcgatcgaatcatggagctgtcgccggatgagcttgccgcctcgctcgaagcgaagctcgccgcactgatggaagaaggaacatgagcaactcgccaaagtcagctgaaccctccgcgttgcagcgcgccgcgttgctcgtggagaagatgcaagcccgcctcgatgcggtggaacgcgcccggaccgagcccatcgccgtcatcggcatgggttgccgtttccccggtggtgccgtcgatggaccgtcgtactggcggatccttcgagacggcgtggatgcgctgcgcgaggtgcccgagtcccgctgggacgtgcagggctacttcgacgcgacgcgcgggatgccggggaagatgtacggcacccgcggtggcttcctcgatgacgtggagcacttcgacgccgagttcttcggcatcgcgccgcgcgaagcggcgagcctggacccacagcagcgcatcgccctggaagtggcgtgggaggccctggagaacgcgggcgtggcgcccggtcagctcatgggcagcaagacgggcgtcttcatgggcgtgatgtccagcgactacatggcacgcctgctcaaggaagacgacgcgacccgcttcgacgggtacatggcgacgggcaacggctacagcttcgtcccggggcgcatctcctacgtgctgggcctgcaggggccgtgcatgccgatcgacacggcgtgctcgtcatcactggtgtcgctccacctggcctgcgagagcctccggcgcggcgagtccaatctcgcgctcgcgggcggcgtcaatctcatcctgtcccctgagacgacgatttgcctttgcagcatgcaggcgctcgcgagcgacggccgctgcaagaccttcgacgcggcggccgacgggtacgtgcgcggggaggggtgcggcatcctcgtgctcaagcgactgtcggacgcgcagcgcgatggcgacgacatcctcgcgttgattcgtggctccgccgtcaatcatgacggggccagcggcggactgacggtgcccaacggaccgtcgcagcaagctgtcgtgtcgaaggcgctggagaacgcgcgcgtgccgccggccctcgtgggctacatcgaagcccatggcacgggcacgccgctgggcgaccccatagaactccgggcgctgggagccgtgctgggcaagggacgtccggaggaccggcccttcttcatcggctcggtgaagacgaacatcggccacctggagccggcggccggaatcgccggcgtcatcaagacgattctgtcgctccagcaccgggagataccgccgcacctgcacttccacacgcccaatccccacgtggaatgggaccgcatccccgcgcgtgtccccgtcgagcgaatcccctggccggcccacgaggggcggcgcatcgcgggggtgagctccttcggactgagtggcatcaacgcgcacgtggtgctggaggaagcccccgcacccgcggccacgcccgccgcttccgaggtcgataccgcgcagctcgtcgtcctgtccgccaagacggcgccagcgctggccgacctggcccggacgtggagcacgttcctgaagcgcgaggacgtgggaacgctcgcggacctcagctacacggcggccctgtgccgtacgcaccatgaccaccggctcgcgctcgcggcgaagtctccccaggagctggtcgcgcagctcgacgcgttcgccgccggagagagtcaccccggtctgtccgtggggcgccggagcaacagccagaaggtggtcttcgtgttccccggccagggctcgcagtggctcggcatgggacggcaactgtacgcccaggacacgacctcccgtgaggccatcgaccggtgccacgatgcactgggccgctacacggactggtcgctgcgcgagctgttgacgaaccccggtcagcaaccgcgttggaatgacatcgacgtcatccaaccgacgctgttcgccttgcaggtgtcgctcgcggcggtgtggcgttcactgggcctggagccgcacgcggtggtggggcacagcatgggcgaggtcgccgcggcccacgtcgcgggggcgctgtcgctggacgacgccgcgcgcatcatctgcgagcgcagcaagctgctccggcgggtcagcggccagggcgccatggcggtggtggacctctcacgcgaacaggccgaggcggagattcggggcgcggaggaccggattgccatcgccgtcagcaacggcccgaaggccacggtgctctcgggagacccggcggcgctgaaggaggtgttggagcgcctggagaagcgcgaggtcttctgtcgttgggtgaaggtggacgtggcgtcccacagcccccagatggacccgctccggcaggacttgctggagcggatggctggcatccgtccgacgggaagcacggtgccgctctactcgacggtgacgggcgcccccatcgacggccgggagttgagcgccgcgtattgggtgcgcaacctgcggcagcccgtgctgttcgcggacgcggtgcagcgtctcatccaggacgggaacgtcctgttcatcgagctgagcccgcatcccatcctggtgcccttcgtggacgcgatgctgcgggaaggcgacgcctccggccgtggcctggtcgtcccgagcctcctccgggaacaggaggagtggccgtcactgctcgcgtcactgggcgcgctggccacccgagtggaccgcgtggactggctccggctgcatccggacaagcggcggcgagtcgcactgccggcgtatccctggcagcgggaacggcactggctggagctgaggcccacgcgtgcagcgggaggccgcttcgtgcgagcaggggcgggtgcccatccgctcctgggtgtttccttcacgacctccgtgcagcaggagacccgcttctgggaatccacactgagcgcgagcgagcccccgttcctcgcggaccatcgcgtggcgggctcggtggtggtgccgggcgcggcctatctggagatggcgctgtccgcggcgcatgcgatgtcgggaggcaccgcgcacgagctggtcgacacctccttcaaggaggggctgctcctgcccgagggccaggagcgcaccgtccaactggcgctgcacggcgagcagggccgcaccctcacgtttcagctgtcgagccagaaggcggaagcagcggggtggatgacgcacgtcgtgggcaggctccgcctcttggacgcagggcaggcggggcaggcgtccgaatcgttggaggccatccgcgagcgttgccccgacgtcctgacccaggcggcgcattacgagacgctggcacgcaacggcgtggcctacgggcccgcgttccagggcgtgcagcaggtctggcgagggcgaggggaggcgctcggccacctccgcctgccggagtcattggccgctcgggcctcggcgtatcgaatccatcccgcgttgctcgacgcctgcttccagttggtgtccgccgcggtgcctccggaggacatgccacaggacgtggggcccgccgtcccggtggcgctcgagaacctgcggcttcacgcaccgcccccgacggagggcttctgccacgtccggatgcggacacttgagggcacgcgccggggcgtctacgagttcgacctcgtgctgcgcgatgcgtccggcacgctgctgctggaggcgctggggctgcgggttcagcaactggatgctcccgtggcggatgcggagggccgggacctctacttcgcccagacgtggcgccatgccccctccgtcgatcagctccccgcacagggcgccgaggcgggcggaagttggttgctcatcacggatggcagcgagctggcggacacggtggagtcacagctccgcgcgcgccagggcgaagtcacccgtatcgacctgggtggctccaagccgggccgccgtaccgtggacgtgtcgtcgccgatggccttcgatgaggtgctggcggagacgttcggcaagggagccgctgcgcgcggcgtgattcacctgacgggcctggaatcgggcgacgtggacccgttgatgagctgtggcggcgtgctgcacctcgtgcaggggctctcccggttgggcctgtcgagtccgccacgtctgtggatggtcacgaagggggtccaccatggttcggacagccgctccgcttcggacgtcgtgcaggcgccgttgtggggcctggggcgcacgctcgcgcaggagcacgccgagctgaagtgcacacgggtggacgtgtccgcggtcatgcgcaccgaggacgccaccggcgcgctggtgcgtgagttgctcgtggcggacgcggaggaggaaatctccctccggcctgatgggcgacatgtcggccgcatcgttcgtggcacacccggcagggcctcccatgaggccatggtccccgccgagggccagtccttccgggtcgagcgtgatgctcaggggcgccaggagtaccggtccgcggcccgccgtccgccggggcctggagaggtcgaactcgaagtcgaagtggcggcgcgtccggggctcggcggggcgtcgagcccggagcgctgggacgaagcaggtgtcaccgcatgcagtgggcgcatcgtggctgtgggagagggcgtgaaggacgtcaccgtgggcgaggagcgcatcgcgctcgtgacgtcgggcctcgggtcacacctgtgcgtgcccgttgggcacaccgcgccgcgtccgccctcgtcgtcgcatgaagaggccgcggcgctggcagcgacggtgctgcctgtctggtacggcctgttccacctgggacgcttggagaagcgagaccgtgtatgggtcctcggggcttcgagcggactcgggcgaacggccatccaactggcacggcgcatgggggcggaggtcttcgccgaagccacgacggatgaccagcgggcctccctgctggagctcggcgccgcccacgtcgtggaccccacggacgcctcattcgccacgggactgctggatgcgacgggaggccgagggctggacctggccgtcatcgcgccgggcgctgtcggcctcaatccgagcctcgccgtgctggcggagggggctcgcgtcatcgacctgcgagggacgtccgaagcgccctcggccggggatgcgaacgtcgcgtggtgcgtggtcgacgtgcacaccttcgcgcgccgcaagcccgaccggttcgcccggctgtggcgcgaggtgaaggacgcctccgaggccgggggcctgccctccaccgtgaaggaggtgagcacgctcaccctgaatcatcccggggcacgcgtggtggtgccggccacggcggctcggcgactccgcgcggatgggacgtacctggtgacgggtggcctgggaggactgggcttcgcggtggcgaagtggatggtggagcagggcgcacggcacctcgtcctccttgggcgtgacgcctcgttgacaccagcgcaacaggcggacgtggccacgctcgaagcggagggggcgcgcgtgcgggtgatggcggcggatgtgtccgaccggcctcagttggcctgggtcctcgcggagatcgccgagggtggagcaccgctgcgaggcgtcatccacgcggcgggtgtgctggacgacggcgtcctgtcgcagcagacggtggagcgcttccgccgggtgatggcgcccaaggtcctcgggggctggaacctgcatgtcctgacgcgcgacctgccgctcgacttcttcgtgctgtactcgtcggcggcctccctgttcggcgcacccgggcagggaaactacgtggcggccaatgccttcctcgacgcgctggcccatcaccgccgggtgctggggctgccgggcctgagcatcaactggggacccttctccgaggtcggtctggccgccgcgcagtccaaccggggagagcgcctggctcagcggggctccgacagtctgacgcccgcggaaggcaacgtcatcctgggccggctgttggatggcgacgtgacgcagatggcggtcatgccgctcgacctccgcaagtgggtggagttctatccgcgagcgaagtcctcgcattggctgtcggagctcgtcccggccagcgcgggggagggcgcgcaggccgcccgggatgtggcgctgctcgaagccctgcggacggcgacacctcgggacgcgcgggtggcgctggagaagttcgttcgcgagcagctgggccgggtgctccggctcgactccgcgcgcatcgacgccgaagcgccgctccaaggcttcggactcgactcgctgatggggctcgagctgcgcaaccggttggcgtcgggactggggctgtcgctcccggcgtcactgatttggaagcacccgacgctggatgcgctctgtgcgcatctccagagtgaagtcatggaccgcgccctggccgagactctcgcaatccaggcagaggcggccgcaaccaacgacaacgaggtcttcgtcctatgagtgtacgggagctgttgggcaccctcgcggccaggggcgttcgcctgcgtgtcgacggtgacaagctggtggtggaggcgggcaaggccgtcctcacgccggagctgcggaccgagctggcggcgaacaaggctgacatcctcgcgttcctgcgcaagcacaccgcgcacgacgaggtgggcagcggccctgagcggcccgtcacgaggccccaggtcatcccgctgtccagcgggcaggagcggctctggttcctggaccggctgtcaccgggcaccgcgcagtacaacgtccacctggggctgcgggtacacggcgcgctggacacggtggcgctgcgccggagcctggacgagctggtccgccggcacgaggtcctccggacggccttcccggaggtggacggaagtccaaggcaggtcatcgcgccgcccgacgtgggcgcgacgctgagcgtcgtggaggtgcgggggctgacggaggcgcagcgcgacgaggaggtccaacggcgctcggaggcgctggcccagcagcctttcgacctggcccagggccccctgttccgcgtgacgctggtgtccctggacgccgacgactccgcgctcttcgtgacgaagcaccacatcatcacggatggctggtcgctcggcgtcttcgtccgggagctgtcggcgctctacgcgtctttcgtacggggacaggccgcggccttgccacccgtgtccatgcagttcgccgagtcggccctgcgtgagcaggcctggctggcgggggccgctggcggccgggagcgggccttctggaaggagaagctccagggactgccgccacttcagctccccgtggaccgtggtgtctccagcgccaccagccaccggggtgcgaccgtgcccgtggccttctcgcccgggttgagcgaggcgctgcgcgagctcggccagcgtgaagggtgcagcctcttcatggtgctctacgccgcgttcgccgcgctcctgcaccgctactcgggacagctcgacttcggcgtggggacggtgaccgcgaatcgggggagcgtgccgccggacctcatcggcttcatcgccaacacgctcgtgctccggagtgacgtgtccggagacccgaccttttcgcagtggctggcccgggcgcgcaagacggtgctcgacgcccaggaccaccaggcgctgcccttcagcgaagtggtgaaggcggtcggcgcatcgcgtgagggcgggctcaacccgctggtgcgtgcctgcttcacgctggagaacatccccgcgcccacgctggacctgcccgggacgcgctggtcattcctgggcggtgcacctgacggcagcgtggaaggcgtcgccaagttcgagctgtccctcatcctggcctctggcgaacagggcctggctggcatgctcgaatactcgcgcgagctcttcgacgccacgacggcggagcggatggtgggccacctccaggtgttgttggaggccgtcgtcgcgaaaccagagacgcccctgtcaaagctgcccgtgctgtcgacggaagagcggacgcggctgctcacggcctggaacggcccggtgctcggcgtcccggcgctgtgcatgcacgagctcatccaggcccaggtggagcggacgccgaacgccgtggccgtggtgagcggaacgcggacgctgacctacgccgagctcaaccgccgggcgaaccaactggcccatcacctgcggcggctgggcgtgcggcccgaggcgcgcgtggggctctgcgtcgagcggacgga

SEQ ID NO: 1063 - DNA, 11922 bp, Myxococcus xanthus
aggcgcagggactggccttgcgcgttgtggaactcggccagacgaacgccgttggcgtcctccaggaggtagtgggcgccctgggcgccgtcgacctcgagccgccgctccatccccgggcgcaggtccaccagcagttcggagcccttgggcggccgagcgtggagctgggggcggaagcgctcgttcggaatggccgcgttggcgcgctccacgaaggcggcgatttcgcggtagctgacctgcccgtcaccgtccgcgtccgccgcgccgaagaggcccgagcgcacctcatggttgaagacgccggcctcgaaggcctcccactcgtggctctcgcgggcggacgaggtggacagcaagaggcccacgttgtccgccagcgccagtcccaccgcgcgcgtgaagcccgcgggcagggggcgccgctgtccgccgggcccgcggctgtaggccaggaagtacgagtagcacgcgtcgacgatgaggtggacgcggtcggcgccgagcttgcccaccacgtccgaggacagcgtctgcccggtgaggggaccgtcctccaggctgacgtagccctcgccgttgcgcacgttcccgtggcccgcgtagacgacgtaggccaccgtctccacgccacggctgcgcgcgagggcgatgtcttcgcccagcttcttcacggaggaggccagctcggggtgcttggggtccagggcctcggcggcggcctgcgggtgtagccggcgcgtgttgtcatccatgcgcgcgagcaggtacgtgcgtgcgccgagcatgcggaacaggtccaggtagcgcgcggcatcgtcatccgcgaagcgcagcgcgggctggtccggttcatggctgcgattgacgccgatgatgagcgcgaaggatgcggtgcgcggcggaggcgtcgcggcctgtggtgaggcggcgcccgcggccaccggcagcagggcgaggagcagggcggcgaatctcatgggatgacctggagctggagcgaggtggcgtccgcgccagcggggagcacggcgtcgaggtcgccctgctccacgagcgcctccatctgcttcacggtgagcggcgactccaggaagacagcgtggagggtgagggccccgggagcgagcggatgagagatggcttcaggcagctcgcgcaaggtgtcgcccgggggaatggagatggccgaggggtcgctcgccgggtcggtccagctcgggtggtaccagtagacgcggcccgcggtgtcccgggcgaagaccatgaggaagcggtgggcgtcggggttgcggaaggcgaaggccagctcttgctcgggccgaagtttcgggcccaggagggtggtgtgcccgccgggcgccacggcataggcgagcagccgcgcctgggccgccgcattgcccgcgccccgggcggtgaagcccgcgtcgtcggtggaagcggagggcaggcggaccacgagcagcgcgaggcaggcgaccgccacaggtgcgagcgccaggggccaccagcggggaacccgtctgtcggacgccgggggcgtgggcatgggacggcgggacgttggcgccaccgaggtgttcgggctgggcacctgccggcccggaatggaggttccattccgtgcctcgccgacgggggcgagccgcgctggagccgaaggcgcatgtgggccgcccatgccgtggagcacccgctgccagagggacgcgggcggccgtgtttcgagccccaggccccgggccagccgtgtccgcgcatccggggcggaagggtccagccgggcgaggaggagctgccgctcatagcgctcgcggcagtgggcgcagtccgggagggtgctcgcgcatgcgccgttcgtccgggggcgcgattcgcccggagaagtgacggtcgacgagggggaagagggcgcaggcggggctcatcgggcctccggagtgaggaggaacttcttgaggagttggcggacgcgcagctcctggtaggcgagggttgtgcggcgcatgcgcagggcggcggcggcctcgcgctggctgagctggagcacgaagcgagcctcgaagacgggggcccatttgggcggcaggctttcctggcggaagcgctccaggaggaagctggcgtcaagcccgggctcgggtggtgtgggctcttcggaggcggaggactccacggcgagctgggccagggcgtccgactcacgccgctgacggcgcacccggtccacggcgaggttgtgggagagcgtgtgcagccagcctgccagggagccgccctggaaggagcggcgcgcggcctcgtcggacacgagccggaggaagacgtcgtggaccacggtctccgcgtccacagccgggaggacgcggacggcggcgcggtacaccgtgtcgaagtggtcgcggtagcaggcgttgaggacgcgggcgtctccggcgtggaaccgggcaagccacgggcctgtctccgccgaggtgtcgtcgctcaaagggccacgtctggaggggcctacggggtccacgaaatgcccaacgtccggggcggggaaaatggacgaaaccattttccgacgcgctctgtcccaccgttcatgtcaggcgttggcccaggtcaccaccgcgcgctccagccggttcgcggtcaggtcctccgggggagcaatacatgggcctggttcgtcccctatggaatccagaggggggcgaagccgatgcgccagcgctgagcgtacccttgaagcgttgccggcacacccgggagttggtttgacggggcgcctcgcatggcatcgaggccacgggggatgcccatgcggctgtcttggatgctcttgttgctgctcatcgggcctgcgtgctcgacggtgcgtgtggtccgtctggacacgggagacgtggcgcccatcgtacacacaccacgtgatgcggaaggcgccagttccgtggaacttgacgatgaggtgttcgaggccgccgtggtgtcattggcccgggacgtgcggccctccctgcatccactgcgcgatgcgcgacaccgcttcggtgtgccggacaggagcggcgtctatgtgtacgaacgccgaggccaacggctgattcccgtggaggagcgcgcggatggtccgcgcctgttgatggcttatgcggacgagagactgacgcgcgactacggtcaatggtgcgcgcaaaagcggcagccgggtgactgccttcgactgctggatgaaggccctctgctggccagcgatgggaagtacacactggcgatggccatcgccatggactcggtctgggatgagacggccgaggcactgcgcgacatggcggatccgcaggcctggatggcgacggtgacggcgtccgtcagcatgtacttgctgctgtgggccttgccagagccggtgagcaagggtgttgctgctctcgtgacggcgaccgcgattgcctacctgggcgtggacacggtgtggctcttgctggatgggtggattgcgctggtgcgccaggtggaccgtgccacgaccttcgcgcagctcagcgaggcgggtgaggcttacggcgaggtgctcggggagaacgccgcgcgcatctttgtcatgctggccacggcggccatcgggaacacggcggggctggcggcgaaggcgcccaggctaccgggctcctcacaggcggcgctgaacgtcgaggtgcaggcgggctaccggtacgcggcgctcgggcgcgtggaatctgtggcgatgacggccgatggtttcaccgtcgcgctggcaccgcatgccgtggcgatggcggccggtggctctagcggtgcgggccgcatacagaagcaccacatcgccacgaacaagaacgacgtctccgctgcgcgtggtgggccgtggacgccggagttcaggagaatcttcaagcgtgccgggatggagctgaaggacccggagaacatcgtccagattcaaggccaccaaggtccgcatccccaggcgtaccacgaactggtcttcaggcgattgaacagcgcgaccgcgcgttgccgcagcgtagaagagtgccgcaaggtcctgaccaaggcgctgcaacaactggccagggaagccgccacccagggaacggagatcaacaagctcctgacccatgggcacccgcgctagaacgccgccatggcccctcgctacttcgacctctccgaggacatccaatccgggaactgggatttgggcgaccctcgcgatgcgcaaggcaatgaggtggaggacccctggatgttccgggcgggacaacctgttcaggtccaggggcgcctgaccatccccgtcgacgcgacggggaggcggttggacttctcgaccgcgggcatcggtgtgacaccggtggttcacgtcagcgtggcatcgctcttcgcacagctggcgcccgatgacgtgcagctcattcccgtggatgttccggggcagccggactcgtacctcatcctcgtcgccaccaagctcatccgctgcatcgatgatgaggcgtcccaggtgcagttctggaagcccgaggacgacctgcccgagaaagtggggcagtactccgcggtggattccatgcacatcgacccctcgaaggtgggcgacgccaaggtgttccgcacctggggctgggacatcgcgctcatcgtctccgaggacctcaagagcgcgctggaacagtccggcgccacggggatgaagttcacccccgtgtgacgcgggcggctactccggcttcttcgcacccgtccgctgccagaactcgcgcagcagaatcgtggcgaagcgggagtcattcaggatgtaccgccgccacaggcgcttgggctcgttcaccaggcggtacagccattcgaagcccgcgcgcgaaatccacacgggcgcgcgcttcgccgtcccggcgatgaagtccaaccccgcgccaatgccaatggccaccgtggggcccagcttggaggccacctgcgaaatccacacctcctgcttcgggctgcccagcgccaccaggagcaggtgcgggtccttctcgcgaatcttcgcgacaatcgggtcgttctgcgcgtcgccgccgtccaggcgcaccatgggcgaatcccagcccaccacctccacgccgtactgctcgctgacgatgcggcccaccttctccgccacgccggggcccgcgcccagcaggaacacgcgccacttgcgccccgcccccagtttcattagcgggaggatgaggtccgaaccggcgatgcgctcgggcagcggcacgtccatggcgcgcgaggcccagacgatgggcatgccatccaccaccgaaatcgtggcgcgtgagtacgcctcgcggaactgcacgttgtcctcggccagcaccacgtggtccacgttggcggtgaacacgtagccgccctggcgcgagtccaccagccggccaatctccgtcaccgcctcctcgaaggtgagctggtcgatggcgagctggccgatgttcaggcgcgctcggccagtggtgaacggggtctgcgggggtacgggcgtcgcggcggagctcatggcttcttcaccgtcaggtcgagcacggtcatggaatagggcggcagccgctgggtcagggaacccgcggccttcgcaccgggagtctgctcggtgaaccccccaggtgcgcccgagtagcccagcacgcgcacgctgtcgagtgtcccgcagcccttgagttgaatctgcgcctgggcggcctggtccgggtcgaagttgagcaccaccgccaccatcttcccgcccgcctcgtcgcgcgaggcgaacacgctggtgccctcggtggccttcgcgggcacccaccagtcctggaagcggctccccttgccgtcgaagttccggaacgcgcggaacgcccagaacaccggcgagccctcggtggggtactgccagaagtaggcggagtagatgttctcctgcgcgaagcggcccagcgcctcggcctgggccaggccgccgctcatgtgccggaaggcgccgaagttgtactcaccaatggagatgcgcaggcccgggtagttgtcggcgacccactccttcatgcgcggaatcagccggatgggctcgccaatccaggactcgtccttgtacgtggggtcccacagcccgcgcgtggagcggatgcggcgcgcgttggtggccgggtccgtgttgccctccaggccgacaccgacgttcgtctgtggatagaagtgcaggtccacgatgtcgagcagccgcacgcccgtcttcttctcgtgctcgcgcagttgccgcaggtaccagggcagcagcggcatgttgccgtgcgcgcgccggtcggagtgcggcatcttccccggcgcgaagtccgccgcggaccacaggtagttcgtccagccccactcggccgggcccgcgatgaggccctccgggtcttccttccgcaccaccgtgccgtaggcaatcgtgcgctccagcaacccgtcatacgacagcggctccgggtgcacgtcgcggtgcgtggagttccagagcatgggctcgttgtccaggatgtacgtctggacgctgcgctgccctcgctcctggtccttcttccggatggcgcggatccactcggcgatgaactccggtggggcctcggtactggtgagcgtcggcgcgccgggcttcagcggcgtgccatcccgggcgagcccgttgcccgagccattgtcctcctgctgctgcgagccgaagcgcgacacggggaagcccaccgacttcgcgtccttggccacccagcccaggatgggcaccgtcagcgcggacgtcatcccgtgcttgcggttggactccaggaagtcgtcgtagctcaggccgatgtcgacgttctggtagaaccagtcgttcgcggtgttccacgcgccgcccagcttccagttgtagcgggacgtggggtttccgccccagcggcgcgtggtggcgcccacctcgtactggtgcttgtcgcgcttctccgtcaacccgtcgaaggcgatgccgtagatgagcgggctgatgcggtggctcggcgcggtgcagtcgatggtcatcggcgcttcgcggccactgccctggcccgtgcgtccgccccccgcggccagcgcggcggccagttcgggcggcagcggcaccagcgacaccttgtcgaacagcacccattcacggcccacgctcttggacgcgcgcagcaccacgcggtcgaacggctggccgcgcgggttgagctgctccatggggatgacaatctcagaccactcaccgtccttgcggacctggagctcggggatgatggggacgcgtgggaagctggcggcgcccggagcgtccaggcggacctccaggaactcgccgaaggactctggagcgctgaaccggaacgacagcgcgccgaaggtgccctccagcttgggccggtagagaatccacccggcgtagttgaacaggcgcatgcgcgccggcgcgcccttggggagctcgcgctgcgcccagccgaggtccttccaatcgggggacaggcctccgtcgtacagcatcaccggcgcggtcttctctgcgccggggccgttcgtgcccgagcccggcgcgtcgcccgcgcccggcgccgccgtggccgcgttgctcgcgcccggcgcttccgcgccgacggcccgcgccaccgtcacggtgccaccggccagcagcgcacccgccagtacagcggcgccaaccttcgtccgcgaacgcatcactccgtcctccctgggggcgccgccgtcaccgcggtacagcgcgccttcgtccgcgaacgcatcacttcatcctccatgggtggcgcccaccccgccgcgctagagcgcgacttcgtccgtgtccttgcgcgggaagatgcgggcgggaatccccacggccacgctgtccggcggcacgtcctggagcaccaccgcgttggcgccgatgcgcgagcgcgcgccgatgcgcaccggtcccaggatgcgggcccccgcgccaatccagacgtcatcctcgatgacgggatagccgttgtccttcgcggtgcccacggtgttgttcccgtagaagcgcacgcggtcgccaatgcgcgcgtcgccgccgatgacgacgcccaggctgtgcacgaagtacacgcccttgccgagcgtgacgtccttgccaatctcaatccccatcaccgccgtctgcgccacgcgcagtacgtggttgaccagggggatgcggtaggccagcgcggcctcgcgggcgcggttgagcgcggtgatgcggtacgaatcactggtcagcaccaccttggcgatggacttcgcgtccgagttgccattggcggccttcgccagttccagcgcatccgtgacgagcgagccaatcatcgattccctggccttcagcatggtgtgtgactactccccccggccctgcaggtagcgggcgacctcgcgggcaatgcccgtccagccgccggcctcgccgcgcgcgccgcgcagatactccatcccgtacaccacggaggtgccggcgaaggcggccttctccaggcccagcttgtccgcggcgttggcggcgtgcatcaccgcgcgcgtcagcacgcgtgacgcgtccggcgccaccagggtggcggccagcagcgggcgggtcagggggttggtctggaagagcagccgccacggattgacgtcacgcacgtccgggtgcttccgggccacctgcgtgtcgaacatgccgtagcggtgcgcgcgcttcagccagcgctcgaaggacacgtggtcactgccgtgcagtacgtacgcgtcacgcgcgaagacgaaggcgcagccggccttctccagccgcacgcccaactccacgtcctccgactgtcccaatgacttgtcgaagccgcccacgcccacgtagtccgcgcgggggaaggacacgttgccggtgaacaggtggacgccgcgggcgcgggcaccgggcgtggagagctcctcggccatgcggttgttgaggtacgcgtaccagcgctcgaacaacggcatgtcgccaatggacgggtccggccggatgcggcccagcaccacggttcgcgagccctccggatggtgcgccaggtgccgctccaggaagtccggggccacctgcatgtcgtcatccgtgacgagcaccacgtcgccccgggcggccatgacgccccggtgccgggcggcggcggcgcccgcgttctgctgcacctccacgcgcagggtgtagggcagggccagggcctgcagcggctcgcgagtgggctccttggagccgtcgtccaccacgacgacctcgaactgctcgggcggcagcgtctgcccggccaactgccacagcagccgggtgatgaggggcagccggttgtacgtggcgatgacgacgctgagccggggcgcggaggtggagctcatgccttcttcttctgggacgccgcccggcgctgcttcttcgtcagccggggaaaggtgacgctgccgaggaagcgctcgcggcccacgaactccagggtcttgctggcggcgccgaagtccgtctcgcccagggtgacgcagaggaggcagccgtcggcggccagcgccagcggcaggctggccggatgggtcatcaacgagtcgatgacggcgacgacacgctcaccccgggacacacgctcgcgcagttccaacaccttctgcgcggcggccgtgggcgacaggccggtggcgtcttccaggtggaccttctgcgtgtaggcgtagggcgcgcccgcctccagcaccgccgtggcggcttccagcgccggagcacccgggtgggccggcaccaccgtgaggaagctccacgcgtggcgctccagggcgaaccacagccgttgcaacgccggggacggaatggcgctgtcggtcgaggtggcgtcggcgggaggtgcgctggaatcggctgccatggggaggggctcggtatagcgcaacgcgtggcgccggcccaacggcctctccgggcagtccggggcgcggcggcccgcctggctgccgcggagcgcgccggtgacgcgcgacagtcaccgcctcccggaccgggcgttccatcgcgcgctccccaggtggtccggcggggctcgcgaagccctccccaccgcgagcgtgaagggcgtgtgacgggctgggtacgcgcctacccacgccgtggcaggggcaggcaggcgtgttatgccatccagtgtgcagaagattggctatttgattcccgagttccccggacagacgcacatcttcttctggcgcgagttgcaggcgctccaggggaagggcgtgacgccggagctggtgtccacgcgtccgcctcccgcgcgcatcatctcgcacagctgggcgcgcgaggccatgtcgcgcacggagtacctgacgccgccggggccgctgggggtcgccaaggccgccgcggaggtggcccgcgccatgcccacgggctgggcccggtgcctggcctccatcgcccgagcggaggggctggacgcaaaggggcgcgcgcaactgttggccttcgccgtcatgggcggccggctggcgtcgctggcgcgggagcggggctggacgcacgtccacgtccattcatgcgccaacgccgcgcacgtggcgctcttcgcgaacctgctgtcggggttgccctacagcctgacgctgcacgggccgctgtacgactacggccccaaccagcgcgagaagtggcggcacgcgcggttcgccttcgtgattacaaagaagctgctcaaggaagtgaatgacgagctggccggcgcgctgccgtcgcgcatcgagctggcacccatgggcgtggagctgcgcaagttcaaccgctccgtgccctactcggcgtggacgggtgaaggcccgctgcgcatcttctcctgcggccgcctcaacccctgcaagggccacgcggacctcatcgacgcggtggggatgttgcgcgcgaaggggctggacgcgcggctgtccatcgcgggcgaggacgaggccggcggcaccacgtaccgcaaggtgctggaggccaaaatccaggagacgggcctgggcgacgcggtgacgttgctgggcgcggtgagcgaggacacggtgcgcggtgaaatcgagcgcgcgcacatcttctcgctggccagcctccaggagccgttgggcgtggccatcatggaggccatggccatgcgcgtgcccgtggtggtgacgggcgcgggtggggtgccggagttggtggatgacggggtggacggaatcctcgtgcccccgcagcagccccgcaccctggcggacaagctggagaccgtggcgcgcgacgcccaggaggcccaccggctgggtgaggcgggccgccgcaaggtggagacgacgttcagcagcgagcgcagcgcggacatgctcgcgcagatgctccagcgggcggtggtgtagcgggctacacgataggaggtcccgccgcgctggaaggtgttaccaggccgtcactggcctggtacgggccttccgcggactggtgggcgtcctggggcggcaccatgatggggccgtcctgaccggggggcgctgggttcgcccgcctggcggagacccgtgggcacggcgggttggacccgttgccacatccccccatggcgcatgactgcctgggggcaggcacgaagggaggcatcgcgggtgaaaatgcccgagcaacccacgttccatgcgctcacccggctggagccgctcgccacgagtgtcctgctggtggacgacaacgcggccaacctgctcgcgctggaggccgtcctggagccgctgggtcaacggttggtgagggcgtcttcgggccccgaggccctgcgatggctgcttcgggaggatttcgccgtcatcctgctggacgtgcagatgcccggcgtggac

SEQ ID NO: 1064 - DNA, 11502 bp, Myxococcus xanthus
tgcgttgctctatggtacgagaaggtcaggagccggtcggccaacgccgccaacgcggccccgagccaccagacgcgcagcgcgccggtggcctgggatgcgaaatagaggctcgccagggtgagcagcgtcagcggccccgtggtgacgaaggcccagaagcggagtcccacgttgtcctgccgcgcggcctgggctgaccagtgtccgcccggggtgtcgagccatcggggcaacgagacgcggtgctcgtagagccccgcgccgaaggcgatgcccaggacgacgacgaaaagccacaggacggttgccgcgacggagtgcttcaggttgatcatggcgccaggatgcgtttccggcacgcgagcgtctttcgtgcccttgcgccgtttttcgccttcctgcggagttcccgatgagcccccggcccgccctgctcgaacagattggttcggacgtcgtgcagttccaggatgcgtccgcggagttcgatgccaccgtcgggaaggtcctggcgctcgggcgcgcggacctcgcgtgcctgacgcagattcactttggaggccccacgcccctgggcgccgttgcccgcgaagccgacgtggcgcggctggagcttgcgggctacgtccagcgagaagcggccggtggtggccagcggctggtgctcacctcgcatgcgcgcgagtggatcgacaccctctggggtcccctgcaggcggacggccaccagctcatggcagggctgccggaggagcacctgcgaatcgtcgcggggttcctgaaagcggcgagagccatccaggaccgacacgcgacccgggtggccaggctgctccaggagccggggacttcacgggcggcacgccagcgaggcgggctctcccccgccgcacttcgccgcgtgcagctttacgtggaggcgcaccttgcggagccaatccgtgtaggggcgctcgcccagcgctccggattgagcgtctttcatttcacccgcgctttccgccagtccacaggcatgacaccgcacgtctgggtgcagcaacgacgcgtggaacgagcgcgcgacctgttgagcaactcatcactgccattgggggacatcgcgctcgcggttggcttcagctcacaaagccacttcaccacggtgttccacaaactcaccgggctgactccggcagtcatccgacgcgaccagcggtgaggcgcctggagtcaggctccacccatctctcccctgtttgacagtgttactccgcctccgtagggtcgtgtccgtcccaagggggagtcatgcaaaagttgagtctggctgcgtgcgcgctcgcgatgctgatcgccgcgtgtggggagtcttcgtcaaccgggccgtacacaccgattcgcgcgaccgaaggagtgatgcgtctgccattggtgtcgaccgcgcccaatggcgtccagtaccggctcgtgggggcgaccttcgtcatcactgggacggagtcgctcacgatcacggatacgtcaccggacacgctgaaagtgccgttggtgcccggaacctattccatccagctcgagggtgattggcacgtcgaacgcgtgggcacgccatccgagatcgtgccagtgcagctgatttctcccaacccgatggcgttctccctcgcggagcgggacatgcgcgaaattcgattcctgttcaagctccccgcggacggcaacgcgaacgtgggcatcacggtcgatgagggtggctggataacaggcaccatgcgattcactgatcattcgccacgagacccgcccagtgagtacgccgaattggtcgggcaggaggtgccatttaccatcagcttcgaattcgcctacctgagtcgcaactactggcgaggactctcggtggctacgaatgagctcgtcgtccagttcgggggcccctactccgcgctgctgcatgatcatattgcaagatatctaagcggtgacacagccagattcgagttgaaccgaggcgaatcgaatctcatctacttcgacaacttcacgacgatgggaatgagcactacaggcaataccccgtaccatctgcaaatgactgggcgacacctgttccgaggagtcttggactccgaacaaattcctgtcagccagccgttccctttcaccgcggaagtcactcttcagagatacgacacctctgaaggcatgctccgtggagtcgcgactggtaccggcactacccagtagctgaagtcgaagggcacgtttccgggctctgcgccgccgcatcgagcaagcccctgtgcttgcgccttgacctgagtgcatggaggggctgttctgactccatgcactcgggaaccctgcgactcgctggactgtttctcatcatggcggcctgcgccacccgtcccacgcccgtcattcccgctccttcctcgatccccgtcgtagtgacggctcccaagccgctcctcacggtgttccgcctcgaaccggatgggacaagcgctgagttcgggcagttgccaccagggcccgaaggcttcgccccacctgacacgggcaactggtacgcagaacccttgcgccccgtgcgtaccgaagcggaggctcgcgaaatcgccgccgtgttgcgcgagcatcacgtgcccgaattgtcctttggcgcggtcggcgttccagcccctgagctgctcgtggccctgctccaggagtctggtgtcgtcgcgcttcaggtgtctggcacggacttcggcaatgcgcacctcgcctcgctggaaaacgcgacccagctcgaagccctgcacctcaatgccacccgagtcaccaacgtggggctggctcctctcaaacgaatgcgacgactggcagtgctgcggctggacgaaacgccggtctccgacgcaggccttgcgtcgctgtcagagcacaccaccctgcgtcgagtaaccctcgccggaacagccgtatccccccagggacttggattcctcgcgaggcaaccggggctggaggaactcgacctgtcagataccgcggtggacgacaccgtcctcgcagtgctgccgggcgccccgttgcacacgctcaacctcagcggaacgaaagtcacgaatgccggcctccgcggcctcagcgccatgccctcccttcggcggctgggcctcgcgcgtaccgctgcctcagacgccagcctcttgcacatcacgggactccgtgaactggaagccctccacctgggcagcactcaggtgacggacgccggcttgctccacctcgcgaaactgcccgcgcttcgtgcgctggttctcagcaaggcgcgaatccgaggcgcaggacttcgccacctcgcgggcctctctcgactggaagcgcttcacctcgacgacacgctcgtgggcgactcagcgctgcgccatcttcgaggactcaacgagctgagagagcttgacctctcgcgcaccgccatcacgggcacgggacttcaagaattgagcaccctggtggcgctcgaatcactctggctctcagggctcgcgctgacggacgattccctcacggcactcgctcccctcagccaactgacgcgactcgcgctcagccacacgccgattggcccggaggcgctgaaccacctgggttcccgcccactcctgcgacacctggacttgagcaagaccgggttcaccgacgaatgggtgccctccatacggcaggcctttcccggcctccattcattgaaagccgaacgcaccctcctcacggacgcggggctgggccagttcgccgaatggacagagctggaggcaatccatgtcgcggggactctcatcaatggctctggcctgacgcgcctgcacacccttgcccgactcacgacgctcgacctcggcgcgacgaggttggactcagagggccagaaagcgctccagggcttcacgaaactcgtctggctgagcgtcgccggcgtccgcaccggcgacgagatgcttggccacctcccccgttcgctccgaaccctctacctgacgcgcacgaaagtcaccgacgcgggcctcccggcgttgcacaagctgccacacctgcgggaactcgacctgcgcggaaccgcggtttccacagaggcccggagcgccctggcacgggagcgcggcatccacctcgtcactgggatgtgagccgcgcccgagcctcacggcaccgccaaggagacgcggctcagctcaccacgggcagtgaaaagccctccggcttgcctgtgccccccggccgcgccacacccgccgcgtcattcatgcggcccgagcggaacggctccagatccaacgccacgaacttgaaccccagcgccaggaacgcggtgttgatcttctgccgcacgtccgccgcgaggaagcgttcgtactcctccgccgcgacctccagccgcgccacgtcctggtggtaccgcacgcggaactgtcggaagcccagcttgcgcagctccgactcggcggcggcgacctgcagcagccgatcccgcgtcaccgccgtgccgtagggaatccgcgacgccaggcacgccatctgcggcttgtcccacgtcggcagcccgagcgactggctccacgcccggatctcctccttcgtcagccccgcctgcgccagcggcgacaccacctggtgctcctgcgccgccttgtggccgggccggtggtccttgaagtcgtccgcgttgaagccgtccaacaccaccgccaaccccagcgacttccgctgcgcctcgcagatgtcgtacagctccgtcttgcagaagtagcagcggttcgtcgggttggccgcgtactgcgggttcgccagctcgttgctgcccagcaccacgtgccgggcgcccagccgcgtcgccagctcgcgggcctcgtcggcctcctccggcgccacggacgcggacagcgcggtgagcgcgagcgcccggtcgcccagctcctccaccgccaccttcagcacgaaggtcgaatccacaccgccggagaacgccaccagcgcgctgccatgggcccgcagcgcggcacgcatcaactccagcttggggcgcgacgactcacacagggacttgatccgctcggggctcaacatgaggctctcctaaaacggaggggccccggattgcacgcgcgccgcgcggcaacctggagcccctttggaaatgacaccgggcccggaagcccagccgcctagcgagccttccgcttcgcggccttcttcgccgccgcggccggcttcgccacccgggccgcgcgcgtggccggacgggccttggcgcccttgtccgccttcggcgccttcgccgcgggcttggactcctcggcgcggcgggccttggcgccacccttctcggccttctcagccttctcccccttcgcggggagcgggttggccttcatcttcttgccggtgatgaccttcagctcctcggtgctcatgtagccgaggtccagaagcgactggaagatcttcgccgcgccgtcctccaccgactccacgttggagtggatggtgacctccggcgagttgggcggctcatacggctcggtgatgccgatgaagttggggatctccccgttgagcgccttcttgtagcggcccgtgctgtcgcgctcgatgagcttctcggtcgggcagtcgacgtagacttccacgtagcgaccaatcgaccggcggttctcctcacggcccggcttgtacgggctcacgcagggtaccagcgccgccacgccgtttcgcgtcagcaggttcgccacgaagcccagccgcttcacgacggtgatacggtcctccttgccatcccccagccccgcccacagcgcctcgccaagttcaccctcgtcgaggatctcgacgttgcgacccacctgccgcaagcgcgcggcgatgtaggcggcggtggtgctcttcccggtaccggacatgccggtcagccagagggtgaaaccagtgttggaggccatatgggtcgtctactccctgcgtccggagcacttcttgcaagctgcgtatggacgccgcagatccagaagatggacgcggttatagacgaaaacccggcgacttgacaattcgcgcccacctttccgcaggtgggggtgacgggcattcaagtgcttgctcagacaaggctttttcgtttctgcaatgcactttcagcccgttcgtaacacgaagtttccctcaagccactcatactccgacacgtagtgaacacagccgcgatgtacggatccgatgagataggaaacatctgggagcaacggatgcccctccggagccgcccgcagcaggtcctcccgggagaaggtggccggtgcatccacatgcgagtggaacacgcacaccactcgctctgaccgtacatccgcgtccatgcagacggccagccactcctcgggcgcgaaggcgtacgccacgcgtgggttgtcggcggcattgcgcagggggcggatccgcagggcgcccgacccctccgcgcggaggatcaccccacagccctcgaacggatacgcggcctccaggtgacgtcccacctcgtcgaggatgtgctcgggccagtgactcacgactcggcgggcggctcacggcccgcgcagcgcgagcacctgcgcatttccatctcctccacggttccaggtgccaccaaccaccggccgcccagcgcggggcccaggcccaaccgcagccgctgaaacacgagcgctcccagcgtccccacggccacgcccagcgccccatccgggggcgagcccaggtgccgcaccgtctcgccgaagcaccagaggcacccctcggggcctcggaagacaacggcggcccgcatgccgtcgccccccagcgccacccagggcgcctcgccactccacgccgcgggcagctccgccaccagcccgcccccctgccccaccgcgcccgcgtccggattcagcgcgggcacctcgcgggccagcgcctccgtcacgggcaggcccacgtcggaaggccccatcaggaagcccggcgcccagggccccagcgtcagcgagcccgcgcccgtcaccggcgtgccacctcccgccaggtacgccgccgccgtcagccccgacgcgccaatgccatccaaccgcgccgtgcccgcgagcagggactcctggccacgtccgcccacctcgcgcaggaggatctgccgggagtagcgcaggatctgatcttcgcgcagcgccatggccgtcagccccccgccatggcggggatgagggtgatgcggtcagcgtccttcaccggcgtgtccaacccgttcagcgcgcggatgtcctcgtcgttgaggaacacgttgacgtagcgccgcaccgcgccgcgctcgtcgaacacccggccgccaatgcccgggtggcgcgcgtccaggttcttcagcacctcacccacggtggcgccgggagccgcgacttccgcctgattgccagtgaagccccgcatcggagtaggaatacgaagggtcgccatgactcactcacctgccttgcttgcggagcaccagccggtgcgtcccgtccgggagcgcgtccagggacacgacctcgtggccctcgtcgcgcgcgttgcgaggcacgttcttcagcggctcggtgccccgaaggagcacctccagcaacgtgcccggctccagtgattccaacttcagcttcgtccgcacgtaggtcatcggacagacctcgcgggtgatgtccagcctcgccgtcatgtcgcgcacgcctccggagactccgggtacgcggggatggccgtgactcgacagccctcgcagtccggtgcccgcgccacgcgtgtccgccgtcccaggatcgacaccgcatccagcacgtgcagcgtagcctcgccctgcccacctcgcgcggcgcccgacagcagctccagcgccagcagggcctgcaccgcgcccaccagccccgccagcgagccgagcacccccgcctgggcacacgtgggcacggcatccggcggaggcggcgcttcatagaggcagcgcagacacggcccccccgggtccacgcgcatcgcctggccctgcatgcgcagcacaccgccatagatgagcggcacgcccgtcagcaccgccacgtccgacaggaagaacttggtggccacgccatccgtggcgtcgatgacggcgtcatgcgcgcggaagagcccctccgcgttgctcgcgtccacgcgctcggggatggcctccgtgctcaggccgggaaaggcccgcgccaggcccgccgtcgcggactccgccttgttccggcccacgtcttcgccccggtgccagagctggcgcggcaagttcgtcacgtccacgcagtccggatccggcagcgtcaggtgcccgacaccggcctgggccaacgccaacgacgccgggcatccgagcccgccagcccccaccagcagtacgcgcgcgcgctccagccgggacgcatggggaattcgggggtggtggtctgtaccgtggccatgcatcggatgactgctccacgcggtcggaaacgaatatggtggggccgcctgcgtaccacgatgcagaagggcgcaggtgtctctccaccgtcccgcgtccgcgcggcccccacctgccaggacatatgaaaaacctgaccggcgtgctcgtcttttccgctgtcctcttcctggctcctggctgcacccgcaagtcgggcgaggccccgggccccaccgacgcctccgccgcgacggacgaagccgcgcgcacgggcgccagcaagggggccctgcgcgccgaggacgcgggctccggcagcacggctcgcgcggcccaggaggcctgcgtggactcgtggctccagaagcaggggctggacgcgtacggcaacccggagggcagcatgtacgcgggcggcacgccgctcttcaatgagcgcacgggtgagcagatcgatcggctggacttcatcttcaagaacaagcccgaagtccgccaggcgtgctcgggtgacgccgccgcggagtaacgcggtgcttccgcccggcgtggggcctgccccctcgccccccagaaaacggggcgggccacctccgggattcccggccccccggttgctcccgtagactgccggacgaatggattcccaactcgcattgagcgaggaaacgcctgccaacgacctgcgcgcccgggtgcggaaggtcctggagcgccgcaagctgacggacagcgtgtcggcggagcaggccgccgcctcgtgggagcaggaccgcttcgtggcacgggcccgcgcgctcttctacgcgcggatgatgttcctcacgctgggcctgctcatcctcgcggtgccggcctggagcggctacttcggcctcaccgggcccttctccttcgtgggctacttcgcgatgctgctctacagcgtcgccaacctcctggtcatcgaccaccccaaggccggccgctgggtgacgtacatcaccctctgcctggacgtgaccatcagcgtggtgctcatcgccaagccgcacgtcggcggcggtctccagagcccgctgctggccacgcagctgctcttcaccacgctcttcgccatcctctttcccaagccgctggcgatcctgccgccgctgctggcgctgcccatcaccacccggctggacctgctcctcaaccgctccgtgacggcggtggagctgctgaccctgctctggtacctggcgctcaacttcatcatcgtctacgtgctcgtgtacctgaacgagcgcgaggccgccgcgcaccgcgaggtcgtgtcgctccagggagacctcaaggagctcgcggtggtggaggagcgcaaccggatggcccgggagatccacgacggcctgggcgcgtccctgtcgtcgatgatcatccagtccgaatacatcctgaacctcgcgcgcgaggagggcctgcgcgaggagatccgcgaactgaagctcaccgcggaggagtccatcgaggagctgcggcgcagcctgcggatgatgcgcgaggacttcgagctggcgcagggcctggaggactacgcgaagacgttccgcgagcgcacgggcctggacatccgcttcgagcgcaccgggctccagcgcaagctggacccggacgtgcaactggcgctgttccgcatcctccaggagtcgctgtccaacgcggtgaagcacgcggaggccaagggcgtccaggtgcggctcgacttcagcgaggaccgtgtcaacctcgtcgtacgcgacgacggcaagggcttcgacccttcccggacgccgcgcggccactatggcctgttgaacatgcgcgagcgcgccatgaagctcggtggccagctcatcgtggactcgtcacccggcgctggcgcccaggtggcattctcccttccctgtcgcccgtcatgaccggagctcccgtggacgccccgcagcctcctgattcgccgcccattcgcgtcttcgtggtcgaggatcaaacgaagatcctcaagaaccagctccgcctcttcgagaaccacccggagatggacatcatcggcaccgcgctctccggtgaagccgcgctggaggaagtgcccaagctgatgccggacgtgctgctgctcgacctgggcctgccccgcatgaccggcatcgacgtgacgcgcgaggtgaaggcgcgcttcccgaagattgaaatcctcatcttcaccatcttcgacgaggaggacaaagtgctggaggccgtgaaggcgggcgcctccggctacctgctcaagggcgccccggtggacaagatcatcgaggccatcaaggaagtccgcgcgggcggcaccgtcatccagcccaacctggcccgccggctgctccgtcacttccgcgtggagcccgacgccagccccttgatctcaccgcccgccgcgccggagccgtcggccagcgacctgccccaggagcccctgctcaagccgctgtcggaccgcgagcgcgaaatcctccagctcatcgccaagggcgtctccaacagcgaggcagcgcgcctgctcgacctcagcaaggccaccatccgcacgcacctggagcacatctaccggaagctggaggtcaccaaccgcgtggaggccgtcaccgaaggcatccgcaagggcctcatctccgtctgagccggagcgccgcgctcagcgccccgtggagaccgccgcgcccggacgctccgcggcggcggcctccatgaccaggtccgcgtaccggttgaccgggtctcccggctgcgtgccgtcccggtaatagaaggtgtagtcgtcccaggcctccggccgggcgtcggtggagaacatccacagcgcccctgcgccgacgccttccttccgcatgcactccagccagccgcgatagagcgcgcgccgctgcgacacgtcgaacgcgccttcgttgcgcagccccagttcgcccacgaacaagggcttgcccaggttccgggcgatggcggcgtgctcccgaatccaccgagcgccggggtcggggtgt

SEQ ID NO: 1065 - DNA, 12183 bp, Myxococcus xanthus
tctacaggacgcgctcgcgggcgccgccatctcgggccgcggaagaacgccgggccgggctcccccgacctgctgctccaggcgggcttccgccgctcgacgggggacgtccaccgcccctgggcacacgtcgcaacgcccttcccctggagcaccgtgcgcgccacctcacgtgtgcgggtgctcgcctgggacgatgcggcggtccggcgcgtggacctctgggtcaacggcctcctgcgcgccagtgacgacacccaccccttcgagctcgactgggacacccgggaagagctcaacggcccggccaccctggaggtccgcgcctacgacaccgcgctcaaggcctggcgcgccgcgcccatgacggtgacggtgcgcaaccccgacatcgccgacttcgattcgacgctccaggcgccccgctgcgccaccctcgcgttcgcgtgcgacaccggcgtgctcgtgcgcggcatgggcaccgtggggccagagcgccatgcgcccaacacgctcggcgcgagctgtgcggatggcatcgatggcacctacctcatcaccgcgacgctggaggggctgcgcgtctccagccaggacggcggccctctcaccgccggcaagccggtgaaactcaccgcgaccgccttcggcttcttgcccttcctggaagcggtggacctcttccatgcgcccgacgcgcgcagcccccaatggacacatgtcgcccggctcccgctcgaagagacaggggcgcaggagctatccaccaccttcacgctgccagagggagggctccaggcgattcgcggcatcctcggcacccatcccaccccggtcagctgcgccccgggagcctggacagaccacgacgacctcgtcttccccgtggccccctcgagtcgctgaaggcccacggcagcgcgccgttgtcgccagtgggagcgcgtcgtgtccccgcgtcgcgggaagcgtgagcttgcgaggccccgggctcagatgtagccacgcatcagagggatgggggccctgttgagggggagggagggtgcagaggggccgaggagggccgctgacggggccccccgagtgatgctcccgtccgcagccgtcgcgagcctggggacgctcgagtcgccgcccagcggcgccacgcctcgtccatgctgactgggagcgacgacctcgtatacttccgccatcatgacggagccgaactggctgaactggacgcgggagctccaagcaatcgcccagacagggctcgcattcgcgcgcgacccttatgaccgcgagcgctacgaaatgctgcgcgctctcgcatcccaaatcatggcggaacatacgaccgcgcctgccgagcgaatcgagtctctattcgaaggtgaaagcggatacgccaccccgaaggtcgatgtccgcgcagcggtgttcgacgaacaaggccgtgtgctcatggtgcgggagatctccgatggcggggcttggacgctgcccggcggctgggctgacgtgaacctgacgccagcggagaacgtcatcaaagaagtacgggaggagagcggattcgaagtgcgtgtgcgcaagctcgcggctgtctgggatcgcaaccgtcaggggcatccgcctgcggtattctcgtgctgcaaattcttctttatctgtgagttggtggggggaacggcggcgacgagcgtggaaacgtcggaggtgggatggttccgcgaagacgagctgcccgatgacatgtctctcgcccgggtgcttcccggtcaggtccggcgcatgttcatgcacgcgcgcgacgccgcgcttccgactgacttcgattgagccgagccgccagccgcttcgaagcctgctcgctgccacgacggcggccctttcggtccagactactccgccttgaggccttcgactggctccacgctgctggccttgagggccgggtagatggaggcgaggtaggtgacgagcaccgcgatgacgacggccagcacggtctgcaccggctcgatgcgcaccggcagcgccgacatgaaatacacgcccgggtccagcttgatgccaaccttctcgatgaagaagcacgaggagaggccggacagcagaccgaggaggccgcccgcgacgccaatttgcaggccctctgcgaggaatatcttcacgatgccaccatccgggacgcccagcgccttgaggacggagatctccttccgcttctccagcaccagcatgatgacggtggcgacgatgagacccgcggccacgatgatgatgatggagaggatgatgcccatcaccagcttctgtaggcgcagcgcggagaagaagttcttgttcatctcaccccagtccctcgcccggtaggggtagccacccagcgccttcaccacctgggaggcgatgcgccgcgcgtcgtcgatgtccgccaccttcaactcgatgcccgtggcgcccttcatgtcgaagaagtcctgggcctccttgagcaggatgtagacgaacttggagtcatactcgtacatgcccgagtagaagatggccgccacgcggaaggcgcggctcttcggaatcgggccaatgggccccagctcggtgcccagcggggacacgacgttcacccggtctcccaccaccacgcgcagcgacgccgccagctcccggccgatgacgatgccgggcagcacctgcggcttcttgggcgtaccggatcggcggatgatttcgtcctcctccaccccaccctcctcggcgggctcctcgtccggcaggccgcggtggacgatcttctccggcgtatagagggtgtcgagcgagccgccaccgaggatgttcttgggcaggtccgtcacctcgcccaccgtgcccgggtcgatgcccttgatgatgacgccgtccacgttgccctcggacgcaatcatcacctggttgatgatgaagggcgtctgtcccacgacaccgggcaccttgcggacggactccatgaccttggcgtactcgggcaggtcgcccgcgtacttggacaccacggcgtgcgcgttggtgcccaggattttctgctgcaggtccgcctcgaagccgctcatcaccgacaggacgatgatgagcgccatcacccccacgcccacgccgcccaccgacagggccgtcatcatcatggtgggggactgctcgtgctgcttgaggcggttgaggtcggaggcggccgccagcgggtccttcagccccagcttgcggatgcgggtgcgctccaccgcggcttccgccgagcggatgatgaagtagatgagcagcggaggaatgatgccgagcatcagtaccgccagcgtccccagcagcagcgaggggcggaacaccgccacgtgccggcgcgcgacgaagagctcgaagcccatcttcaggtcgacgcggccactgccggcggcgatgaagccggtgttgacgcccagcaccagcgccagcaccaggaacatgaagacgagccagtaccccagctccgggcggccgataagccccgcgacgtacgtcacctcgcgcagccggtagcccagcgcgagctggagcccaggcagccgctccatcagcgtgaggacgatggggatgggcaggcccaggtacagcacgccgatggtggcctcgggcagcgacagccgctgcgcccgcgaggcgccgatgaagccggagatgaacgccaccatcccgccggccatcaacgcgatggcgaaggcgccggtgggcgccagcgacaggccgccgccccccttcgccgtgcccgccagttcgttggtcgcccccccgctggacagcaccgtctgcaggaggatgaggacgacctccgacagcaggatgccgccgccgtaggcacccagggtgctccagtagaagtcccggtagcgcgccagccgcgggtacagcgtggcgcccgcggccgggctggggccttccgtggacgccggcgcgcggcggatgcccgcagcgatgagcccccaccccacgagccagacggccgtccccgccagcagcacgccggtgttgggcagcggcgcgacggcctgccgggacaccagcagcgccgcgttcagggcctggaccaggccgccccagcccagcagggagagccccagcgcggggctggcctcctcccaagcatgggcggacgtgagcgccaccccgagcaaggcgaagcccgcgagggcgaccagggcccccatccagatgaaggtccagcgatagacggtctgccgttccgcggagcgcacgcgccctccgagctacttcgccagtggctggagagggggaacaagatgacgtcccggatgctctacgaatccgtgaacagcatggatggtcctccagcagttgcccacctggctcgacaactacaacaccgcgcccagcccatggtgctgaagatgcgctccccgagagagtttcggctcgccgccagccctatccaggccgccagaaaagggctcgacctgcggcccggttcatccccaacgagcgcgaccatcgcccggtaccgggcccacgacacgcccgtcgtgcaccacgagcaggcgctcagggtgggcggcgacggcctcggggacgctgcttgcagcaatcacgaccaggtctgcgcggcagccgggatgcagtccgtaatcggtgattccgagcacctccgctgcggagtcggtaatgagcgaagaagcgtacttcaagtcgtcgtcggacatcagctcggcttggagcccgatgatggtcgctcgttcgagcatgtccgcggttccatacggccaccaggcgtctcggatgttatctgagccggaaaacacccggacgccatgctcgcgtagagcccgcagcggtggcatcgagcggctggggccgttcgtcatgatggcgaccccggctgcgccgagagcggcggccgttcgtgcgagctcgtgctcgtcgatctgcccgagcgcgtaagcatggctgaccgcgaccttaccgctgagccccaacgccttcgtgcgttcggcaatggcgcgcagttgttgggtgccgacctcgccgccgtcgtgaaggtggatatcaatccccgagccgcgccggtgggtgcagcccgaagacaatgtcgagttggcagtgggggttgccgtcgaagccggcagggttgagtcggccgatcaggtcgggcgccctccgagagcaccgcgtcgagcaggtcggcggccctttgggcggcatcgaagcagctgtgcgggaacgaggccagttggataccgagccgatcacgaaaagcttcacgcacctcgaagagcgcgtgcaagccatcgagctttccaaccgggtcgatgtcgacatgggagcggatgtggccggtgccgagggacaccatgcggttggcgagggccgtggctcgctgcgcgaccgaaacgccgactgcgttgcgcagagcgcgctcgtccacggtccgctgccggattgacccccccgcgcggtgcggctgccacggcgctccgaagaaggtcttgtcgagatggcagtggccgtccaccagcgcggggagcagcaatgcgccatcgagttgaatggatgtcgcttcgcggtgagcgctcttgcccgtgtccggtcgatgttcgtcgatcgacgcgatgcggccatcgcggaggaggacgtccacgcagcggccatcaggaagggttacgttcaccagctcgactggggtggacgtacgggaggagtcgactgactgacgcatccggagctccttatcggtcatccctgatgacgcttccactcgtcgtacagtccgtgctcgtccgccgggcgcagaggccgcaaggcgagggactgggcttggggctcgcgggccaactgcgcgtagatcggcgcggtggagaggccgaaggcttcaccctcctcgttggagtaagcgaaataggcgccctggattccgcacaggtacatggcggccagacacatcgggcagggatgaccactggcatagacgacgcagccgctcaggctggcgctaccgaggctctggctcgcattgcgaatggccagaagctcggcgtgggcggtgggatccttcgtctgattgacctcgttgaccgcgcgcgcaatcacccggccgtcgcgcacgagcaaggccccgaacggacggccaccggacttgacgttggtgcgagccagggcgatggcctcgcgcatgaattcttcggcggacctctccatcagcgacctccggcggctacgagcatcttggcaatcgcgtcttgcttgcgctcgcgggcgtgctggagcggcgtaacgccgtttccgtccgccaggttgacgtcggcaccgccgtcaatcaggagacgtacgatcgcctggtgacgtggcccgccgtcgctgagcaggatcgcctcgagcagtccagtccagcccaggcggttgacgtggttcggatcgacgccggcttgcagcaacgttttcacgacctccacatggccgcgttcacaggccggaatgagcgcagtgccgccatagcggttggtgctcttcaggtcggcgccgttcttcaaagtcaggcgcaggatctccaggtacccccgcgctccagccaggaggtaggcgctatcgagctggcggttctggaggttcacgttcgctcctgcctcgatgagggagcgggcggcagccacgtggttgccgtcagtcgccagcaagagcgacgtgttgcccgcggagtcccgggcgtgtacggccaccccctggcgcagcagttcggagaccgtcgccgcatcacccttctctgcggcccgcaagagggcctcgggcggcacgggagagccgccgtcccccgctcccgcagaagctgagcaggccatcgtgaacagcgtcatgagcatcaccctccaaatgttcgccaggtgcacgacttcacctcctgacgaggtgctctaatccccggccatcccatgcgaaagcgaaatgccagaatgattaccagtggggttctgaatggtttgaccgagagccctttgtggagacacccggatgatcgatctcttcttgctgcgaagcttcgtcgcggtcgttgaaacgcatgagtgatgctcccgtccggtggacaggccgcttgaacccccttggggtactcgcctgcccagaccgcgctctcatcaggtgcgtaggaggggcctgggcctcaccacgcagcctggggtggccctcgtgccggggccaacctcgcacatgccgtgggctgggattcggtccaccaggagcgcctgtcgctccgtgcgcccaggacgcaatgcagcgtgcgccctcccgcgaggtccagagctccaagcccctcaccggaccacccggcccccaggggctcggacatcgatcgacaggcatcggtggacaggtgccccggccatgcttcttttgatcggagggggtgccatgtccttcgaggatcgtgtcgatgcgggccggcggctcgcccagttgctgcgcgagcgtggctacacgggtgaaggcacgctcgtcctggcgttgccccgcgggggtgtacctgtggcctttgaggtggcaacagcactgggcgcaccgctggacgtctgggtggtccgcaaggtcggtgtgccgggctacgaggaactgggcctcggcgcggtcgcggaaggcggtgtcgcgttcgtcaaccggaggctgatggacgaggtgggcgtcaccgaggaagacatgcaaggcctcgtccgtcagaagacggatgaagtgaaggtccgggtggcgcgcttccgccagggcatcgaggcgcctcgaatcgaaggccagcgcatcatcctggtggacgacggcatcgcgacgggaggtaccgtccgagcggccatccaggcgctccgcatgcaccggcccggcagcatcatcctcgcggtccccgtcgcggcatcccagacgctcgcagagctcgcccccctggcggatgacgtggtgtgcgtgctttcaacgccgtcgctgtatgccattggccagtggtacgccgacttccaacaggttccagatgaagcggtcgcgacgctactggcacaggcccggctcaccctcggtcacgaccgtcacgcgccgcccggcgacacggcccactcctgaccgggcgccccgaagcatcagcgagccaccaccacccgggccgcgatatcccggtctcacaggagcccaccgggcgcagttcatcccggccctccgaaggagccgccgttccggcgcagggacggcagcttgagccctgccgtgcatcacgctccatccccatccttcacaggaggccatcaggcccgagcaggagcgagtgatgcccgtctacgagttctactgccgcaagtgtaaggagcccttcaccgagatcatgagcgtcaaggagcacgatgagcgaacgcccaagtgcccacgctgccaggagacgaaggaggtggagaagcgcatctccaccgttcataccgtgaccaccaagaagtggctgacgctctaacgcgctcccgggcttgctccgcgccgcacctgtggcgggaggccgattcacgatgattccggatacgccagacagggagcgaagcgccaatggctcgacgccttcggcctcggggaaggtgctcaccctcctgctatgcggagatgtgatgacgggccggggcatcgaccaggtcctgccccaccctgctccgccgggcctccacgaggactacctgaaggatgcgcgggactacgtccggctggcagaggaacgcaatggccccatccggacgcccgtcggcttcggtgagctctggggtgacgcgctcgacgagatggagcgagccgcgccggatgttcgaatcatcaacctggagacgagcgtcaccacaagcgaggcgtggtggccagacaagggcatccattatcgcatgcacccggagaacgcggcttgccttacagccgcccgaatcgattgctgcgcgctggcgaacaaccacgtgctggactggggctatccggggctcctcgaaacgctggcgaccctccggtgcctgggcatcgccaccgcggggctcggggaggaccaggagcgagcacggcggccggccatcctggatgtgaccgggggccgggtcaccgtgttttcgttcggtgatagcagcagcggaatcccacccgtctgggccgcgacggaagaccggcccggcgtggatctgctgccagcgctgtcacccaccgcagtgcggcaactgggcgagcgcgtcgcggccgtcaaacgcacgggcgacatcgtcgttgcctccattcactggggcggcaactggggctatgcagtgccggacgcgcagcgggccttcgcgcgagcgctcatcgatgaggccggcgtcgacatcatccatggccactcgtcacaccacccccgcggcatcgaggtccaccggggccacctcatcctctacggctgcggagacttcctgaacgactatgagggaatctctggccacacggccttccgtccggacctgacgctgctgtacctggcgtccatcgccccggccaccggtcagctgacgggcctccgcatgctcccgatgcagctgcgccaactccgtccccatcatgcttcacgacaggacgctgagtggctgggcggcgtcctggaccggcaggggcgggaccttgggacccgcacgcggctggcatcagacggcaacggtgcgctcgtccttcagtggacgtgagcctcccagacaagcgacgagcggcctcagggcccctggttcccccgcacggcggcggaacctccttggacgcggtgagcgcacgcctccggcccaatgcaacccggcgctcagcctttcaacacggcgagcggcaccagccgcgccaccttccgcgcgatgccagccgcctcgaccacgtccaccacccgatccacgtccttgtaggccaggggtgcttcctccgcgagctccgcattggagggacactccacggcgatgccctgacgattcagcgccgcgcgcagctcacttcccaccacctggcgtttggaagcggcccggctcagccgccgtcccgccccatggcaggcgctgctgagtgagatggcctcggcagcctccttccccaccagcacgaacgacgccgtgcccatgcttccggggatgaacacgggctggccgacctgatggtaggccgcgggcagctcggggtgccctggaccgaaggcccgcgtcgcgcccttgcggtgtacacagaggcgctggcctccatgcggctccaacttcgcgatgttgtgggccacgtcatagacgatgcgaggccacgcagcggaacggtctccgaaccaccggcggaacacctctcgcacccggtaggtgagcacctgccggttggcccaggcgaagttggccgcggcgcacatggccgcgaagtagtcctgcccctccgccgacgacagcggcgcacaggcgagttgacggtccacgagctggatgccctcgcgggccagggcgcggtccatggtgcgcaccgcatccgtgcagacctggtgccccagtccgcgcgagcccgtatggatgagcacggtgagctggccctcgaacagcccgagcgccggggccgcctccgagtcgaggacgcgctccacccgctgcacttccaggaagtggttgccgccaccgagcgttccaagctggtcatgcccccgctcctgggcccggacagagaccttggctgtgtcggcgccatcgaggcagcctctggcctccaggtagtcgacgtcctccggtgttcccagtcccagcacgtccaccagataggggacgccctccgtgaggacccgatccatctgctcgggcgccaacgacaggcggccatgccggccgaagcctgtgggaatgctccgagcgaggtcgtgagccaccttcggcaggacctccttcacgtcctcgtgccgaagcccggtcgccagcaatctcacgccgcagttgatatcgaacccgatgccgcccggcgagatgacgccatccggcaacgcggtacccgccacgccgcccacggggaagccgtagccctcgtgcatgtccggcatcccgatggcgaagccctggatgcccggcagtgtggtgacattgacgagctgaggcacgctccggtcctggaccatctgctggagcaactccgagtccgcgacgatgcgggccggtacccgcatgtcctctcggaagccctggcccagttcatacagggcgggccctatctgccggatgagcggctcgagctgctgcgggacctcgggaagtgtctccatgcttgcctcatgacaggggggctcagacatcgaggacgaccgtggccgtgaagccgtcgtcgtgctcgtgcaactccaggccatggaaggtggcggccttcacagcggtcttcagcacaggaggcgagacgccgcgaatgtgggcgcgcagcgaccgctcttggagctcgtccaccacgaggtccgtgtagacgcgcttcgccaggtccgagcgggcgatgagctcattgagccagtcgacaagcagggcctcggtgtccgccgccacgagcgcgacgtgctccaccgccgatgctggcgagggctgcggcaacggtgcctctccgagcatgagctccgcgagcgcatacccggcctcctcgaagagctccgggagtcccgtgcctgagatgcggagttgaacctcactgacgtgcggttcgaattgatgcgtacctgactccacgaccgcctccttcccgcgcccgaagtggagatgccctcatccgacgacaacatcgtcgacggctcacgaaggcgacggtggagaagcgtcctgctcctctgtccccatggagcgcgttgcttgttcgaactcgacctccgacggcgggcctgtccgcaccggaagttccagccgccgccatgccgacatgccgcccagcacgttcgagacctgctggaagccgttgcggagcaggatgctcgtggcaagtccggagcgatggcccgtgctgcacaccaccgcgaccggatggtcttcgcgcagtcccagctcggagaggcactcctccagctctgtcacatacgcatgtcgtgcgctcaggatgtggccacgctcgaactcagagcgctcgcgcacgtcgagcacctggaagccctcccactgggaaaagagcgcctcgggcgtcagcgtg

SEQ ID NO: 1066 - DNA, 12183 bp, Myxococcus xanthus
agcgcgcgtcgggaagggcgcgaaaccgcgtcccgtggcggaagggggcacaggcggagatcgcggcctggaagacctggtcgacggggaggatggggccgggcagtgccaggcgcgcgggtgccttctcccagtgttgcttcacgaaaggctgccaatcgaaggcgcggtgcatggcggctcccgtcacgaaggttggaatgtgcggcgaatcttccgcgcataggcggcgagcgacggcaggttcatctccttcctgcgcaagtcgacgccggcctccttctcgatggggtaggggacgagctctcccttcaccttgcggaacttcgttccataaagctgcttcttcccctctcgcatgcgcaccacgtccgtgaggtaggccacctgctggatgggaacgtcggcgcgcgccgccgcgtcccgcagcaacttcaggcagcgtttctggaaggccagcgagcagtcggcgtgttgaatcagccgccaggcggccgcggccccgcttcggcccacgaggcgatgcccgggccagccgtggaccttgatcgtctcacgcagccagtcgatgcccgcctcggtgagcgcattgagcttgcgttcaagagcacggtccttgaactccgtcgccacccacgcagaacgcaaggtgctgtcgatgcggtccagccgtagcagttgcgtgcggaggtctcgattgacggtggggcgaggtgcggcgctcgatgtccgggccgctcgcgaagccttttgggacggccgttcttcatggcgtcgtgagtcccgcagtcgttcaatgaggctcatggccgtctacattatcagacagtcgcgaccactccgtggaaggactgcaaggcaatgccgtgcgtcatgacccagaatgcttggtgccagacgggcgcatggctctcgttggcgtgctccatgtcgaccgtggtgtgctccagcaggtgaactcccgcatctgctcgaaggtggcgtggtcacgcaggaacgcgaagatggggtgcgtgacgttggatggatgaggtttgttcactgtgggtagtggcagctttggctctcggagagctgggacattttcaagacacggctttcagaagccttgtcatgagccactgcgtcatgggccagagaggtccccaatgacacgctggccatactccccggggagtaggtcccctgtctttccagcacggcgccgagatgcgagcctgcgcgtgcatgcccacgctcacgccgctgaagagtcccgccgatgccctctgctgggtggcgccgcccgcggagaatcccgagctgacctccgaagacccgctcgcgctcgactatgtctcgcagcaggtggggctctgggggttgcccacgctgacgacccgctccagcagggcccaggcctacgcgatggtgctctatggattgcagctcgtggagcgggccatcgagcaccattcctaccccgcgacggacgaggttcggcgagaactcttcgagcgttgggagcgcttctgggccctggccacgctggagttccgtgagggccagcttcctcggggcgattgggattccatgcggggcgtgcgaggtgcgcgaaatgcgtggcgctcaggtgcgtcgagcctgccgctcgacttccagctcatctcgcgtcagcaggagctgggaaacctgggggcctacctggcaccgctgcggcgctctgggctcgtcatcgagggttccctgcggccgggcccgggcgcgctggcgctcatcgatgcgttctgggacgagccctcggagaacaaacaccgggggcgatacgaggagtacgcgctggtggcgctggacaggaagtcgacgagcatcgcgcgggttcacgggcggctgacgttggctcaggtggggcggttcagccgtctgagctccctggtcgagcgcggacgcaccgcccagcagcaccggttgttcgaggccctcttcgtgcacgcacgggacccgcactcgttcgcgatgagccagttggtcgagtcggcagcgaaggccggggtcgctgctccgcgagacatcctcgacgctgcgctggcgggccggctgggacggctctcggatgagctgctggcgctcctgctgacggcgcgccgcttcggtgaggtgatgcagggactcgtcggggccttcgaccgggtctattcctgtctggatggcgccggttgggtcgctccccgcgagcgcatcggacgcgaggccctcgatgcggagacacttggggcgctgaagggcgcatgcgcggcgctgctgtcctcgccgagggtcggtgcgatccggcgactgcccatgcatggcgccgcttttcttcgattggtcgaggcgctggtggacgcggattcactcgcggcgctagacctgttgctgctctatcactccaatgtacagcgcgagcggcgacgcggcgaaggctggattcgcaacgaggccggcaagctcgtgctcatcgtcacgtcctacaccgcacggccagagtcggcacgcttcccctcgttcaagctggatgtggtccgcacgttgctgacggacctgggacggctgcccatgagccgggagctggatgttctggaaggtgccgcatgatgatcgaatcccggaggctcatcgagcaggtcctcgtctccgagcaaccctgcctgggagccgtcttttgctcctatacattcgacccttcctatttcgaggaccgcatcctgcgtgcattgctgcgcctgcagggggacccggaggaggaggctgtccgctaccatgaggaggcccgcgcggcgctgcgcgagacaccggtggcttgcttcgtcgacgcgcgtgtccgccggggaggccgtcgcctgccgtatgacctccagctcatccgggagcggacgttccacccgaaggtcatcctggtgctgtacgacggggaggcgcgcgtcgccgtgggctcgggcaatgccaccaggccgggccacgagcagaacgccgaactcttcttcacgcgcacgttgcgctacgacgtccccgccgacgcggcgttcctacggaacgtagacaggttcctcagaagctgcgcggcgctcgcgacccacccgggcacccagttgacgctggtccgctccgcgctcgcggcaagaatctccgacacgccgtttcccagcggccaggcgccgacggatgcgctcttcgtggacaccttcagcgcgtccatgctcgatcatctgagagaggcgctcccggaggacgcgcgagtcactcgtgtgggcatcctgtccccgttcttcgaactggatgacctcgacatcgcgaatgacacgacggggctcgcgtcggtgctctccgagttgctcgcgcttcgccccgggagtccgccgccgctggaccttggcgtgccatgggaggacgcaccactcgcccctccctatggcgggggaacgcccgtgctcgcggagggcgaagggcggctgtgggcctcgcgttatcgcgagtcagtcgacggcgaggacatcgagcgcctggagtactttggggtcaaccgcgtcacggcgaagcgtgtcgagatccagctcggctccgggcggcctggacggtacgagagagacgcattcgagcatgaagtcgcggaggggcggatgtggcccgtggagccgccgacggtccatgcgccgaggcgaatcctcgagcgcatcgtccgcgagcacgagatccaactctggctccatccaacggcgacgctgacacctgccgggcgcgcgagccgacgccccctgcatgccaagctcttcctgctgacggtgacgaccgcaggcaggacgctgacctatgcgctcatcgggtccgccaacgcctccgccgccgcgctttcgtgtggggtggagcagggtggcaacgtcgaggcgggcgttctgctctgcctggacggagaggtgcgcttgtcggaaatgctgccctcgctggtgtgcgcgcccttcgagtcagcgcgcttcgaggagcgagatgcgcccggggccgaggtcgacttctcggcgtggctcgaggacgtcgtccatgacgcggccgctcgcacattgaccgtcacctggagtcagcaggggccagggggactggggggctgggcctggtggtacctggacagggaactggcgaagggcgtggggccgcgctcgggtccggtggtactctccgacttcgatctggccgcggcgggagccgagctggagttccgcgcggcgggacggtcgtggcttgttcccatccgcgtcgcggacctcgcgatgctgcccacgagtgctcatctcgcgggcctgggagtccgggagttgctggcgctgttggcgcggcgtgtgggcgcggagcggttgtcgacccttcgcgagcagcgcggcgtggcgggggtcgactccgtcctggactccgtatttggcgagggctttggccccacggacgtcttcaaggcctggtgggggctgaaggaggatttgctcgccgcatcgacggtctccgcgtttcgttatcggttgttggggccgacgggggcccggacgctctgggagcggctgcgcgacttgcctcgggattccgtgtccgatgacgaaatctgggtctacggctgcgagctgcttcgagagctggagcagctcgtgttgcccgagagcgcggatctggaggcgaagcaggcgctgctcgcggagctgcggaccctgctgcgcgcggacttgacgcggctgcgaccgcgaggtgccgggtggctggacggtgtcgttcgtttctacgggcttgagggcacccatggaaagacgtgagcggacgtggttgcggagcttcctgcatctggatgcacgggctgattcgacggtgcccctgcgtgacatcgagcgacaggaggacaccgtcctccgcgcgctggagctgttcgatgatcagccaggagttgtgctggcggatgaagtgggaatggggaagacgtatgaggcgctcggcgtccttgcggcccggttgcatgtgctgccggatgcccgggcgctgattctcaccccggggcccgacctcaatacgaagtggtccaaggagctgcgtgccttctgtgacaccagccgccccatgtaccggggcttcgcgggtcagtccaagaccgcgagcaccctggctgagctggtcgcggccactcgcgagacgcgaatcaccatcgcgcccgtgaacatcttcgcgggaagtcgctccttggcggaccaggcctggctgctttcgttgtgggcggatgcacaggggctcgccggcaatcaggtggcggccatctttcgtcgctaccgggagggcgcggtggcgcgcgtggacgtcgagcagcaggcgttcctcgataccttcgagtggtcggtcatcagaccccatgtccgagaggcattgaaaagacacaaacagcgcgcgggagagggctcactcgacgcgctctggaaaagcgaggagtacgacggcttcgcgaaccagaggtgggtcgatgatgcgctgatggacctgcgctttcgtctggtcgggcagctcatccccgacttcgacctgctcatcgttgacgaggcccataagctgaagaacgtggactcggtacgggccaccggggtgcgcactgttttcgaggggcgcttcgacaaggcgctgttcctcacggccacgccgtttcagctctctgtcgacgagctcaagcaagtgctctcgctcttcgccctggcccggtccgcgcctgcggacctgatggagcaggcccagcgattgttggacgacgtgggggactacaagcaggcctataacgagcttgagcgcgtctggtcacaagcggacgaggccgtcgtctcggacttcggcgcgttgtttgccagggacccccagctggtggaggagccggcagatgcgtccctgcgggcggtggtcctgtgcgcgcgccggttgctgtccctgaagacggagcgcatcgagccgggcttccggcggtggatgattcggagcctccgggaggacaagcgtgtctaccgcaggagccaccgcccccgactgcgggcccagggtggggcgggcgttcccttcatgctttacgagcggttcatcgcggagctcttccgggggaagagccgcactcataaggcggcggttcagatcaacatggtctcctcctatggggccgcgcgcgagggggcgctgctctccagtgagcggcaggccctgcccgacggcgacgccgaggcctaccgcgggctcttgcggagcgtggtgggggaactgcgcgtggagcagggggggcacccgaaggtggaccacgtcgtgcgggacgcgctggaggctgtcgcccgcgacgagaagacgctcatcttctgcgcccgcatcgagacgctccgtgaactgaagcggagaatcgaggcggaatgggagcatcacttgctggagcgatggaggaaggtgtttccggccgcgagccacggcgacatcttcgagcacgagctggacggcaagcgggtggatggacatcactctcgcctgcgtgatcggttcggccgcgcccaggatgcgctctacctcgcgctgcgagagcggtataccggtacgctgttggagggcgtcgtggtggagggggcccaccttgaactcgtcatcgagcgggcgaacggcctcctgcgccagcaacgcgtttcgaagacgcaagcggagcggatggactggtccctggtcaaacgctgtgtcgagcaggccgtggccctcttcgtgcgagacggagtattggcgggggatgtcgacccggaggtgttgaggcgcctgacggacgcgcgcttcgtggcgctcggcttcgatctcgtcgccgacgacgtcgaggactccgccgagggagacaggacgccttcctggacgattgacgcaggggacgcggccctcgtgcttcgccgcgagcatctctggtcctacctcaagggtgccctgttcgaggtacctcccgagctgcgggtccgcaccgtcgagcggctcgccagctacctcgtcgctcgcaatgtccccttccttccggagctgctggcattcgcgaaggagcagggcgttgacgtggaggcggtggagtcccgggcgctgtcgtcggtggtggaccgcttctggaccacgcctcggggacggccctggttcgagttgctgaagcgcttcctgatctatgcggggaagctcgacgaggagcggcggcgcgaagtgctcgatgatgcggttcgcgcgggggcgctcgtccgccacaccgtggagggcgagagccgggagcggctccgcgaggccttcaacacgccactgtacccgatggtcctcgtggccaacgaggtcatgcaggaggggctggacctgcatcatcactgccgtcgggtggttcatcacgacctggcgtggaaccccgcacagctcgagcagcgcgtgggtcgcgtcgaccggctgggctcgctcgtccagcggcttcgcgcgcgacagccggacaccaccctggacgttcaccttccgttgattgccaacaccatcgacgagcgcctggagcgaacggttcggctgcgggagcgctggctggagttcctcctgggggcggcgccccgcatcgaggagtacggcttggcggatgaccccctgaagcctctgccagatgctttcgcacaggcgctccgcgtggagctggggccggtggcgaaggcacggctgccagacgggtgatgctcacttcggcacggaggcggcatcgcaatcgagcgcctccaggttcctggttttattcggattttcgcgatttacggcccctcattttcctgcggattccaagattttgggaaaccggacgcaactccgggagggccgtgacgacaatgggaaccaggagacctgaatgtccacgtccatcaattcgagccgccggggagcatcttcctcctacctgattcgcaagggggacaccctctcggagcttgccgctcgcttcaagacgtcggtgaaggagttggcgcgcatcaacaatatcgccaatccagacctcatctacgcgggtgccacgctgcgcctccccgggagcgctggcggccgcgccacgggccacagcggcaaggattccttcgactctggcaagagcggtccgcggggctccggcggtgcgtcgggcggcggagaggtcagcgggagcggcggtgtggccccgggccaggcgacccccgcgatgcgcaggctcgccgaggcgggccgccaggccgcgctgggcatgggcgggtacaacagccagggcctgtgcgccacgggtgtgagccgggccatccagaacgccttcggcatcaaggtctggggcaacggcaaccagattgacaacaacctgccgcgcgacaagttcaagcaggtcaacatgtcgctcgagcaggcgctgaagattccgggcctcgtcctcacctgggagagcacctccactcgactgggcagcatctacgggcacacggccatcaccaccggcgacggccactcgtccgccagcgacttcatcgagcgcaacacgaccaacagcggccgtaccgggttcaaggtcttcatgcccctcatctagttccgccgcacggtggaacctgtcgtctcatcgcctccggggcattcgaccgggggcgatgtcgtgtccgggattcaagttcacgggggaccggcgcctgacggagccctctcacgcgcccgctatctgacggcgctgtaggtccggatctgcgtgttgatccacgggatgtaattggagacccgcgtatagatgccgggcaaccccgccctcgcgcagcccacgccgaagctcacgattccctggagcacgtacccttggggccccggtacgatgagaggtcctccgctgtccccttggcatgcgtccttgcctccttccttgtaaccagccccgaacatcgcctgctcgttgatggtgattccatgggggcgatagctattggccacgtcccggtgattcagggtggggacccccacctgcagcaagagggaggacgtgtcatacccgccctcccgtgtcaggccccagcccgcgacggtcgccatcgtgttgtctgcaacccgatccccgctggcagggagacagacaggtgcgcgggtgcctccagatgcgtactggcgcggccagattggggcgcatggtggatgactgaccgcaggcaccggcaacggcctggtcgaacttgatgggccggtcgagcttgagaacggcgatgtcgttcatcgtcgtgtccggattgtattgcgggtgaaggaccgccctcaccacccgggctgtggcttgtcccgcggtggggcggtacaggtcatgagcccctgcgaccgcggtgacgttggacgtaccgtcgtagaaacaatgggcagcggtgaggacgatatcgctctcttccttggcgccgacccgcacgagggcgccaccacagaagtggctggtgccctgctgcaagctgacaatccacgggaaggagtgaggccgagcctcgattcctcccacaatctcctggtccatctggctgatcgtatcgaccgggtctcgctccacctccggaccaccgcaccccagcagaccgaccgcgacgaccactccgctcatgaatcgcaatgcaacctcccgtttcaagtgcggaggccgtcagcaatccacatgccggattgctgcccaatcgaatcacgtgcttatccgcggagcagcaggccttgctcgcgtcatgacacgtcaagtggaggcgcttgacgcgtcagtcgcaccttcctgaaccctgttcgtcgcggggcaccggcgcgggggcgtggtgccacgggggcatcaaggcttcacgaaccgccccaggaacagcacgttctgcgtcgccacgtgttcgatgacgaagatgaacggccgattgacgtggatcggctttggcagtgacacggggaccattcccacggcagtcgcggcggcggcctccgtcccaagctcgttcacggccacgaacgccttgtgattcacggtcgcaatcctgagcttcgtgggggagatggccgaaaagtcagcgccctccgtgaacgcgtcctccatgcccagcgcctgcaatgcggggatgagggggagctcggactcgatctggaagcgcggcagctggatgtcgatctgatggttctcgagccgtgcgcggacgtctttgaagaaagcgggagacagccgggattccacctcctcgaagcgctcccactccgggacgacgagcaccatgcggaaggtgcctccggcatagtccagggtgacggcttcgaagccatccccctccatgtactgccccctgccgccgctcatcgtcgggacctggtggctcgttccatccagggcccggaaggccgcgttccgcgttccttgctcgcggaacggccacgaccacgcgcctttgaaatagacggcgttgatgagcatcaagcgcgtcgcgttcgggagggactcttcattgaccaggtcctggatgcggtctctcgtgttcacctcgacccagcggttgatttccgcgcgcgcaccggccgcgtcgttctcgaagtccatcagacgcatgccggcgccgtaatgccgggccagggtgtcgaggaatccgtcatggaaggtcatgccctgctgaccccatgccgagttcagggaatgaaaggtcggcggtgtccccgaagccgggggagggctcgcgggcttcgccagggcgcgctccaaggcgttcgccgtggggtggtgcctcgactgggacagggagaagcgcagtgcctgggccatctgcgcctcggtgttcccccgtgccccggcgtagaccgtggagagggcctgcgtgacgctgtagggcgagaagaagaggttctgcttctcctggatggcgcgctgatagagcgccacacccaggctggtgttgccgctgacgaaggccgccagctcttcgtcgatggtgggcgctccgtcccgaggggccgacgaggcgacgtactcgcccggcgcttgctccagttccgggggaaggcagctggcgtccgcggtgggcggctccgaaccgcacagggtgctctcacagccagcaaacagtagggcagcggtgcaacaggcgacgacttggattcgagggacgaccatggggcctccgtggatgtttggaagagccgtgagccaaagcaagacgcgtgctcgacgcgcggccaagtgaattccagggcttgtcgctcctgatgctccggcgcgcctcagaaaaccgtggacgctctcgacggagcagctgggggcctgattgggcgcggcgcggattgagtccatcctccgggcgaatccgcgcatccagtacctgctgctcctcaacgagcccaacctcacggaccaggccaacatgtcgccgcaggccgcggcggagctgtggccacggtatgagcgtgtcgcccagaacaccggcgtgaagctggtggggccggcgatgaactggggcaccttgtcgggctatggcgaccccgttgactggctggacgccttctattccgcctatcgcgccgccaacgggaaccgcgacccgcacatcgattacctcgggttccactggtacgactatggcctggattacaacctggaccggctcacgaagtacggcaagccgttctgggtcaccgagttcgccaactgccacagccagccggatggcgcgcagattgactcggtcgccaagcagcgggtgcagatgacggagatggtggccgtctgcgagcggcgcgaggacgtgttccgctacgcgtggttcacggggcggtggacgaacgacccgtgcttcgcgagcctgctcggcgccgcgggcacgttgaccgagctgggtgagcactacgtgtcactgcccacgggcgcaccgtaggccacgctcggggttgtcccagggccaccgcgaggagagagtgggcgccgcgatgagtgaatcccctgatgcgttcctgctcggcatgttccagaagtcgggcctggcctgcggctccgtggacgaggcctggcagcgctccgagtacctctatcccttgctgggctggctgacggcgcggttccccgagcccatggccttccagatttgtgcggagtggctgcggctggccgcgacacgcgtcgagggcgccgccgccgccgcggctttagagcac

SEQ ID NO: 1067 - DNA, 15482 bp, Myxococcus xanthus
tctaaagggtgcacagacccccgtatggacgtgctggcggacgcgtcgaccgaggagcttcgagacatccggccccgcccggtgcgtgttcccttgatttcgtccatcaccggcgcggagatcgacggcgcgagcgcggacgcctaccattgggtgcggaacattgcgtggcccacgctcttcaccggcgcgctctcccacaccatgcatgagggctaccacacgttcctggaggtcagtccacatgcgattctggggcaccccatcgacgcgacgctgaagcacctggggcgccagggccgcgtggtgccctccctgccgcggcaggaggatgagcgccccacgttgttcgattcgttgggcgtgctctacgcggcgggacagccggtccggtgggacgcactcgccgcgcgtggggtggaccatgacggggaggcggtgcacctgctgcccctgtcggcgcggagcccggaggcgctcaaggcgctggctgcggactggcgcgacttcctggcaggggagccgggcgcgccgctcgatgacgtcacctacaccgcgagcgtgcgccgcggccacttgtcccaccgcttgtcggtggtgggcggctcgcgacgggagctggcggaggcgctggacgccgtcacgcggggggagctcccgccgggggtgagcgagggacgggtgagtcccgagggacgggccaaggtggccttcgtcttcccgggacagggctcccagtggttggggatggggcgtcagctcctgcgtgaggagccggtgttccggtccgccatcgaggcgtgcgagcaggccatgcggccgcacgtggactggtcgctcacggcggagctgctggcggatgagcagcattcgcgtctgcaggacatcgacgtggtgcagccggtgctcttcgccatgcaggtggcgttggcggcactgtggcgctcgtggggcatcgcgccggacgcggtggtggggcacagcatgggcgaggtggccgcggcgcacgtcgcgggtgcgctctccttggaggacgcggcgcgcatcatctgcctgcgcagccagctcctgcgccgcaagagcgggcagggggccatggcggtggtggagcttgggctggcgcaggcccgcgaggcgctggccggctacgagtcgcggctctccgtcgcggtcagcaacagcgcgcgctccacggtgctgtcgggtgacatcgacgcattggagtcgctgctgccgaagctcgaaagccagggtgtcttctgccgccgggtgaaggtcaacgtcgcctctcacagtccgcagatggactcgttgaaggacgacctcctgcgggtgctcgacggtgtcgcgcctcagggggcgcccgtgcccatctactccacggtgacgggccagacgagcgacggcgcggacttccacccggcctactgggtcagcaacctgcgcgagccggtgctgttccacggtgctgtcgagcaactcctggcggatggcttcacggtgctggtcgaggtgagcccacacccggtgttgctcgcgcccatcgaggagacgctgcgcgagtcgaaacagggcgccatcgcgctcgcgtccgcgcggcgacagatgcccgagcgccgctgcctgctggagtccctggcggcgctgtacgcctggggttgcgcggtggactggaaggcgctgcacccggtgaagggccgtgtcgtcgcgctccctcggtacccgtggcagcgggagcgcttctggctcccggacgaggcggaggtggatgcgcagccggagggcgtggtcctcgcggaccggaagggacatcccctcatcggtggttcgctctcttcgtccgtccagcccgggactcacttctgggagcggaccgtgagcacggcggcgttcccgtatctggccgaccactgcgtgtggggggacgtggtcttcccaggcgccggttacgtggagatggcgctgagcgccggcgcggaggtgctgggcgagacggggctcgtgctggaggacgtctccttcagtgagatgctcgcgctggagccgggccagtcgaggcgcgtgcaggtggtgctgaccgaggaggagccaggccgcgccaccttccagattgccagccgcgcggagggcgagatgtcctggcgcaagcacgcggcggggacggtgcggcgggatgcacgtgcggcagcggttgttgaatcacccgaggcgctccgggcgcgcgtcacggtggcggtctccgctgaagcgcactaccagcgccggcaggcgcaaggcctcatgtacggcccgacgttccaggggctgcggggcatctggcgcagtgagcaggaggcgctgggacgcctggaggtctccgacacggtggccttggaggcgggcgcgtaccggctccaccccgcgctgctggatgcgggactgcaggtggcggtggagctccttgccccgctgaccgcgacgtccgctccggcgacgcatgtgccggtgggaatcgggcggattcgtttcttccagcgtcccgggcgcgcggcctgggcgcgagtgaaggtccgtggggaaggggccgcgagcgagcgcgagcgcaccttcgacttctggttgctggatgagcagggccaggtgctgctggagctcgaagcgctgcgcctgttccgcctggatgcgggcgcctccgcccgcaaggagctgggcgcgtggctctaccaggtggactgggaggagcggccgctgccagcggagctggcgtggcccgagcaaacgccgggaagctggctgattctccaggacggcggcggggtggggcagcggctgtccgcgcagctcctcacgcgaggcgagacgtgcgtgctcgtcgcgccccgtgaggcgtaccggctgactggaccgcggagcgccgaggtggacccccggaatccggagcactggcgccggttgctcacggacctgcttggcgccggcgttccgccttgccgcggcgtggtgcacctgtggagcctggacctggcctcgacggaggcgctgacgccacaggcgctggaggactcgcggcggctggggaccaccagcgtgctgcacctggtgcaggcgctttcgggggcgggctggcgggatgcgccccggctctggctggccacgcgtggggcacgttccgcgggcaaggtggcagaacgtgtcgcggtggcgcaggctccgctcctggggttggggcaggtgctggcggtggagcaaccggagctgcgctgcacccgtgtggacctggaaggcggcgcggacgtcgcggcggatgcgctgctgcgggagttgtcatcgacctcgttcgaggaccagaccgcgtggcggggtggtacgcgacgggtggcgcggctggctcgggcggcggatgcgctgtccgcccgtgaaccggcgacgctgctgcgcgaggatggcacctacctcatcacggggggcctcggtggcctgggactggaactcgcgcgctggctcgtctcccagggcgcacgtcacctgctgctgatgggccgccgtgctccctccgcggaggcggagcaggcgctggcggcgcttcgtgaggccggcgctcgggtggggtccttccagggcgacgtcgcgcggctggaggacgtgacgggcgcgttggctcgggtggaggacgcgatgcctccgctgcgcggcgtgttccatgccgcggggctcctcgaggacggattgttgctcaacctcaccgaggcgcgcttcgcctcggtgtcggcaccgaaggtcctgggcagttggaacctgcacgcgcagacgcgacacctgccgctggagcacttcgtcctgttctccagcgtggccgcttcgctgggcacgccggggcagtcgaactacgcgtcggcgaatgccttcatggacgcgctggcccaggcccgccgggcggaggggttgcccgcgctgagcatcaactggggcacctggacgcaggtgggcctcgcggcggcgcagtccatccgcggtgagcgtctggaggcacgtggcctgggaggcatggcgccggacaaggcgctggcggtgctcggcatgctgctgggacaggagcggccacagctcagcgtcatggccttcgagccgcgccagtggctgggcttctatctggccgcggcgcagtctccgtacttcacgaagctggcgcaggagccgtccagccgtccctctgtgagcgcgggcaagagccggattcgagagcagctcgaggcggcccgtgcgtccgagcgccgcggcctgctggatgcgcacctgcgcgagctgattggcggggtgctgcggatggcgcccgcgcgcatcgaaccacggacaccgttggtgaccttcgggctcgactcgctgatgagcatggagattcgcaaccgcctggaggcggcgctcgggctgaagctcagcgcgacggtggtgtggacctatccgacggtggccgcgctggcgccgttcctggcggaaaagctggcgcttccgctggaggactcccgccccgagcccgcgctggaggtggcaccggtgaaggcctcccaggcggatgtgacggccagcgagattgacgacctgtcggaagaggaagtcgagcggctgttcgctcagaggatggcgcaaggctcatgacgacgttcgcggagaagattgcgcagtactcccccaagcggctcgcgctgctggcgatggacctcaagtcgcggctcgacgcggtggagggcagccggtcggagcccgtggccatcatcggcatgggctgccgcttcccgggcggagggaacgacccggcgtcgtactggaacctcctgtgcaacggcgtggatgccgtcaccgaggtgccatcctcgcggtggacccgtgaggacatggcgcggatggaccccgaggcccaggagaagctgggcgcgaagtggggtgccttcatcaacgcggtggaccagttcgacgcggatttcttcggcatctctccgcacgaagcgcaccggatggacccgcagcagcgcatcctcctggaagtggcgtgggaggcgctggagaacgcgggccaggacatgtctcggctggcagggagccgcacgggcgtgttcgtgggcgtgtacagcgatgactacgcgctgttgcaggtgggaaatccggcggcgcgcgactccagcagtgtgacgggcgccatcaactgcgtggtgccggggcggctgtcgtacctcctggacttccagggacccagcctgtccgtggacaccgcgtgttcgtcatccctggtggcgctgcatctggccgcgcagagcctccggcagcaagagtgcaccatggcgctggcgtgcggcgtcaacctcatcctgtcgccgctgtcgtcgagccgcgtgtcccgtgcgcaggcgctcgcgccggatggacgctgcaagaccttcgatgcccgcgccaacggcttcgtgcggggcgagggctgcggcgtggtcgtcctcaagcggctgtcggatgcgctggcggcgggggacaccgtcctagcgctcatccgggggtctgccgtcaaccaggatggcaagtcggcgggattgacggcgcccaacgtgctcgcgcagaaggcgctcatccgccaggcgctccagagcgcgaacctggagcccgccgacatcgactgcgttgaggcccatggcaccgggacgtcgctgggcgaccccatcgagctggaggcgctccacgaggtgtacgcccaggggcgcaccgcggagcagtcgctggtggtgggcgcggcgaagacgaacatcggccacctggagtcggccgccggcatcgctggcatcatcaagatggtcctgtcgatgcagcacggggccgtcccgccgctcgcgcacttccagcggctcaacccgcgcatcgacttcggcggtgaggccctcactgtccctacgaagctgcacccctggcccgcgcgggagacgcgcaagcgccggggggcggtcagctcgtttggcatcagcggcacgaatgcccatgtgattctcgaagaggcccccgtggccgcggcggcgcccgctgcgccttctcgcggggcgtacctgctgccgctgtccgcgcgctcaccctccgcgcttcaagcattggcccggaagtacgcggacgtcctcacgtcgtccccggagatgtcgctccgggatgtctgcttcaccgcggcgctgcggcggacccatcacgagtaccggacggcggtcgcgggggactcggcggacgctgtggcgcggcagcttcgggagttcgccttggaggggcctgctccggcggcgacggacacggatacccggcgcaaggcggtcttcgtgttcccggggcagggctcgcagtgggccggcatggggcggcagctcctcgaacaggagcctgtcttccgtgaggccgtggagcgcatcgacgaggccatgcggccccacgtcacgtggcgtctgattgacgtgctgcgcgcccctgccgaggactcccggctccaggacatcgacgtcgtgcagccggtgttgttcgccatggcggtggcgctgtccgcactctggcgctcctggggcgtcgagccggacgcggtggtggggcacagcatgggcgaggtggccgcggcgcacgtcgcgggcgcgctctccctggaggacgcggcgcgcatcatctgcctgcgcagccagctcctgcggcgcatcagcggccagggggccatgctcgcgacggagctgaccctggaggacgcgcgcaagacgctggcgggccgcgaggaccgcgtggccatcgcggtcagcaacagtccgacctccacggtgctgtcgggagagaatgccgcgctcgaatcgattcgcgccgacctggagtcgcgcaacgtcttctgccgctgggtgaaggtcgacgtcgcctcgcacagtccgcaggtggacccgctgcgggacgagctgctctcggtgctctcggcggtgcggcccggacgctccagcgtgcccattcactccacggtgaccggcgcctcctgtgacggctccggcttcgatgccgcctactgggtccgcaatctgcgcgacccggtgctcttctcctcgtcggtgctgcaactcgccgaggctgggcactccgttttcctggagatgagcccgcacccgattctgctgcccgctgtggagcgatgcctgcagcacgcgggccgcgagggcgtgacgcttccgtccctgcgccgcgaggaggctgagcggaccgtgctgctggagtccgtgggcgcgctgtaccgcgcgggactccccgtgcagtggaagcgcttcttcccggggggtgggacgccgctcccgctgcccacctatccctggcagcacaagcggtactggttggacgcggtggccacgcccgtggccgcgatggtcgagccggtgacgtccctcaagggccggccggtgagcgtggctcacggcgtcgatggccaggtcttcgagctggagctggggagcaactcgctgccgtggcttggtgctcaccggttgggtggcgtcgcggtcgttcctgcctcggcgttggtggagctcgggctgagcgccgccgccgatgcgttgggccctgggggacgggggctgtccggcgtcgagttcgagcgggcgctggtgctgccggagaccccgcggcggctcgtgcaggtccacctctcttccgaggcaggaggcaagcacgagttccacatccacagccgcgcggtgggcggggcctcgtccgaggcggggtgggtgcggcattgccggggccatgtccaggtgctcagtgccgcgatgggcgcgttggcgtccatcgacgcggtccgtgcgcgctgtgtggagcacgtcccgggcgcggcggtctacggcgagctggagcgctgcaacgtccagtacgacgagccgctgcggacactggacgaggcgtggcggcggccgggggaggcgctgggccgggtggtgctgggcgcggagcgacttcaggaggcgtcccagtatcagttgcatcccgcgttgctggacgccgcgctccagacgctggcgctcgcgctggcggccgaaccggggcaggcggcgctcttcatgcccctggggctcgaatcattcgagtgcgtccctggcagcgcggacgttcggtgggctcacgtctccatttcgcccgcgtctcgtcctgaggagcggctgggcacattgtccctgtcgccccgcagggtcgtccggtcacggtggcgcgcggtgtacggttgcggcacgtggcggtggagcggctgctcgaggtgttgggggaagtccgcgcgcaggactggttccacgacgtgtcgtgggagccgcggccggcggggacaccccagtcggcccccgcggattggcttgtgttcgcggaccggggtggttggggcgcggcattcgccgaggagctgcggcgtcagaacaccccttttgtcatggtgaccgcgggggacgccttccagcgcctgggaacgcggagcttcgtggtggacccacagcggccggaggacatggcgcgcttgctgcgagagcttccagcgctcgcggctgggcacgaaggccgggcgctcttcctgtggggcctcgacgaaacgttggatgggcagacggcagtgcccgcgtccacggtggcggcgctgcacctggtgaaggccctcatggaggtgtcagggcatgcgcggctttgggtggtgacgcggggcgcgcaggtcacgggcgtgggaaccgaacgtgtgtcgctggcccagtcacccctttggggcatgggccggagcgtctcgctggaacagccgggcgtttggggcggcctcatcgacctgccgccgactcggtcgccggatgaagtcacctcggtgctgcgggaagtctccgcgttcggaacggatggagaggaccagttcgccttccgcgatgggcgctcgctggtcccccggcttacacggggaagggcagggacggccgaggaggcactgcgcctgcgctcggatgcgacgtacctggtctcgggcggcctgggcgggctggggctgaaggtggcgcggtggctggtggagcggggcgcgcggcacctggtgctgctgggccgcagtggggtctccggtgcggacgatgcggcgtcggtgcggcgccgcgaggagctcgagtcgatccgggtgatcggggcgactgtcacgcccatggccgtggacgtagcggaccgcgagcggatggcggcgctcctgcgcgacatggcggcgacgctgcctccgttgcgcggcgtgattcatgccgccgcgctcatcacggagtgccggttggaggacctggatgtcgccgccacgacggcgatgatgcgtccgaaggtgctcgggagctgggtgttgcacgacctgacgcgcggcctctcgctcgacttcttcgtgatgttctcgtcgacgtccacgttgtggggcgcttccggcttggcgcattacgcggcgggcaaccagttcctggaagcgctggcgcatcaccgccgggccgaagggctgcccgcgaccaccattcactgggggacgtgggacgagattggcggagagcgcgccgacaacgcgcggggctacgcccgcttcgggctgaaccccatggcctcggagcgcgcgctcgatgcgatgggacaggtgctgcggtcgggcgcgagccataagacagctgactgcgtggactggtgacggactcaagcccatctgggaggctcggcgtcgccggcccttcctgctgaacatgggcgcggcgtcgctggccacgaacggtggtgccacttcgcgggcacggttgctctcggagttgaaggcgctccctgctgagcgccggttcgacacgctcgtgcaacgcatccagggcgaggtggggcgcattctcggcttcgctcccgccgacttgccccccgtggaccgcggcttcttccagatggggatgacgtcccagatgtccgtggagctgcgcaacgtgttgcagcgcggactcgagaaggagctgcccgcgagcctcgcgttcgaccaccccaccgtcgtggcgctggcgaagcgcctggcggggagcgtcaccgcggtggacatcccgttgcccacggtggcggcggctccggtgcagaagtcatccccggtgcctgcggacgtcggcgacctgtcggagcggctggcgcaagtctcggagctgtcggacgacgaagtcgagcggttgattgccctgaagttgagctgaatcggacgactgcgatgagcaaggaattctacgagaagatttcgaacctctctcccaagaggctcgcgctgctggcgctcgacctgcacgcggagagcgaagccctcaagcgcgcgcgctcggagcccatcgccatcgtcggtgcgtcctgccgcgttcccggaggcgtgcggacacccgaggccttctggcgcctgctgagccaggggttggacgccatcaccgaggtaccgcgcgagcggtgggacgcggaggcgctcttcgaccccgacccgagcaagcggggccgcacctatgctcgctggggcggcttcatcgacggcgtggaccagttcgacgccgcattcttcggcgtctcgccccgggaagcctcgcgcatggacccgcagcagcggatgctgctggaggtcgcgtgggaggcgctggagcgcgcgggccagccgccggaccagctcgcaggaagcaagtccggtgtcttcctgggcatcatcggcagcgactacgcgcagctccaggcgcggcagctcggcgatgcgccggacatctatcacctgacgggaacctcgctgaacgcggcggcgggccgcctggcgtacacgctgggcctccaggggccgtgcatgtccatcgacacggcgtgctcgtcgtcgctggtggggctccacgtcgcctgccagagcctgcgcaaccgcgagtgcgacctggcgctctccgcgggcgtcaacctcatgctgatgccggacccgaccgttgccctctccagcagccgagggctggcgccggacggacggtgcaagagcttcgatgccgccgccaatggcttcgtgcgcgcggagggctgcgtcgtcctggtgctcaagcggctctcggatgcgctggccaacggcgatgagattctgtcgctcgtcgcgggctcggcggtgaatcaggacggcgccagcagtgggctcatggtgcccaacgggccggcgcaggagcgggtcatcgagcaggcgctggcgagcgcggggctgaagccctcgcaggtctccttcgtcgaggcgcacgggacgggcacgtcgctgggcgaccccatcgagctgcaagcgctggcgcgggtgctgggcgcgggacggagcgcggatacgccactgtacgtcggctcggtgaagacgaatgtcgggcacctcgaagcgacggcggggctcacgggcatcctgaagacggccctatcactgcgccacgaggcgattcctccgaacctgcacttccaccgcctcaacccggacatcgtcctggacggggcgcccgtcgtcgttcccacggcgctccagccgtggccccgcgccgagcagcctcgcctcgctggcgtgagcgcgtttggcatcagcggcaccaatgcccacgtcatcttgcaggagccgccggtgccgtcaccgcggcctgccgtccctgctcgtggcgcggagttgctcgtgctgtcggcgcgcagtccggaggcgctccaggccatggccgggagccacgcgcattggctcgccgcgcatcccgaggtgtcactccgcgacgtctgcgccacggcgtccctgtcgcgctcccaccatgagcaccgcctcgcgctcgcgggccatacacacgctgaactcgaggagaagctgggggcgtacgcgcgtggagagcccgtgccgggcgcggccacgggacgtgcatcggggcagacccggcgccgggtcgtcttcgtgttcccggggcagggttcgcagtggctgggcatgggccggaagctgctggcggaggagacggcgttccgcgaggccatggagcgctgcgacgcggccatccatgcgtgcgcgggcttcagcgttctggctgagttggccgccgaagagggcaagggccgcctccatgaaatcgacgtcatccagcccgttctcttcgccatggaagtggcgttggcggagctgtggcgcgcctggggcatcgagcccgacgccgtggtcgggcacagcatgggcgaggtggcggcggcgcacgtggccggagcgctgagcctggaggacgcggcgaagatcatctgccgccgcagccggctgcttcgaggcgtgagcgggcagggctccatgctgctggtggacctgacgttggaagaggcgaagcaggcccttcacggctgggagtcgcaggtctccgtcgcggtgagcaacagcgtgcgctccacggtgctgtcgggcgctcctggggccctggaggacatcgcccagcagctcaagcaacgggacgtcttctgccgcttcgtgaaggtggacgtggcctcgcacagccctcaaatggacccgctgcggcccgacctgctcgcggcgctccaggacctcgcgccgcgcgcgtcccgtgtgcccatctgctcgacggtgacgggacggatgacggatggcgcggagttccgtgccggctactgggcggataacctgcgcgagccggtgttgttctcgaaggccatcgagaagctcgcggtcgacggccatgacctcttcatcgagctgagcccgcatcccatcctcttgcccgcggtggaacaacacctgcggcacctcgggcgagaggggacggtgctgccctcgctccgccgtgacgaagacgagcgcggggcgatgttgtcgtccctgggcgcgctctacgccatggggcacgaggtggacctcgagcgccagcaccccgtgcggggccggctcgcagcgctgcccacgtacccgtggcagcacgagcgcttctggattgagtcgtccacgcggacccgtcgtgcccgggacgctggccaccacccgttgctgggtacgcacctgtccctggcgggccaggacggcgcgcacctgtggcagacggagctgtacgcggacagcccttcgtatctggcggaccacgtcgtccatggggaggtcgtgctccccggcaccgggtacttggagatggcgctcgcgggggcctccgaggccttcgggccggcgcggctcgcgctggaggacgtcatcttccaggagatgatggtgcttcctcgggaagaggcgctgtcggttcagatgcgcgtcatcccggaggcggatggaacccgtcgcttccaggtctttggccgtccggtggacggcgccggggcttggacactgcacgctgaagggcgaatgtgtgagagcacgagcgcggagcccttcgcgctcgacgaggcgcgggcgcggtgccccgagcttctggagggcgagaagcactaccagctcatgctggagcggggcgtcgacttcggtcccagcttccgcctggtgaaggagatgtggaagggcgagggcgaggcggtggcgcgcctggaattgtcgccttccgtcgcggcggagatgacggcgcatcagctccatccggcgctgctggatgcctgcttgcaagccatcaacggcgcggggctgggggaccgccggggagagacgttcgtcccggtggcggtggactcgctgcgcatgcacgggcggcccggacgtgcgctgtggagtcacgctcgtgtccggccgggcacgggcagtggcccgggctcgattgaagccgatgtgacgttgctggacgcggagggcaacgtcctgatggaggcccgcggcttgatggcgcgccgtctggatgcggtgcggcgccggtccgcggatgaaatcgaccagtggatgtaccgggtggactggcaggaagcgccgcgcgagacgcccacggccgtctcggagtccacgcccggcacctggctggtgctcgcggaccgtgctggtttcagcgggaagctgcgcgcggtgctgagcgagcgcggggagcgttgcatcctcgtctcccacggcgaggagacccggctcgtcgagcccggccactacatggtggacccgtcacgagcggagggtttcacgcggattctcgacgcggagttcggcgccgggcgtcccgcatgcagtggcgtcgtgcacctcttcagcctggacgttcccggtctcgaggctggcacggatgcgctggtgaaggcgcgcacgcttggcgcggcgagcgcgctccacctcacgcaggccctggtcgcgtcgggcttccgggacatgcctcgggtgtggttggtgacggaaggtgtccaggccgtcaagccgggtgagcaggtggcccatgtcgagcaggcgccactctggggcttgggacgcgtgctcgcgttggagcatcccgaactccggtgctgcagcgtggacctgggggctcgcgatgaggcccaggctggggtgctggccgacgagctcctcgtttcgagttcggaagagcaggtcgcgctccgaggctccgcgcggttcgtggcgcggctgtcgcgcatggagcgcagcacggcggcgccggcgaagttgcgagccgatgccacgtacctgattaccggtggcctgggtggcctggacctgaagctcgcagagtggctggtagaccggggtgaccgccacctggccttgctggggcgcaagggcgcgtcctcggagacccagccggtgctgcatgcactgagtgccgtcggcgtcaaagtccgggtgttcaagacgcacgtgaaggcgcgcccggacctggatcgggtgctggcagaggtgtcgccggatatgcctccactccggggtgtcttccacacgtcgcccgtccttgatgacggcgtgctggtgaacctactccaccgagcgtctgcgcacggtgatggcgcccaaggtccacggcgcctggcatctgcacacgctgacggcatcggcgccgttggagcacttcgtgttgttcgccgcggcgggttcgctgctgggctcgccggggcagggcaactacgcggcggccaacgtcttcctcgacgcgttggcagcgtatcggcgtgggctcggcctgccggcgctgagcgttgactggggggcctgggccggtgtgggtctggccgcggcggccgaggcgcgcggggaacgcatcacccagcgcggcgtggacaccatgccaccgtcgcaagcgctggaggcgttgagccgcatcctgggcagccctctgtcgcgcgtggtggtgatgcgtttcgacctgcggcagtggagcgagttctacctgacggcggcgcgctcgcccttcctgtcacggctggcgcgtgagcaggccagcgccgcgaatatccccgctgttcgcggtgccttcgtggagacgctccgggccgcggaggtgctgaagcgcgcgtcgttgctggaggcgcacctgtgcgaacaggccggccatgtgctc

SEQ ID NO: 1068 - DNA, 12955 bp, Myxococcus xanthus
cgccgcggcctggcggcatcgacgcgaagtacgcgtggacggtccttggcggccaggggcagaacgtgaaggtggtggacatcgagggcgggtggcgcaccacgcacgaggacatgcccgacctcttccacatgggcggcacccagtacaccgaccagagctggcgcgaccacggcacggcggtgctgggtgaaatcgtgggcgcgcgcaacgcctatggcgtgacgggcatcgcgcaccaggccaaggcgggctacgagtccatcggggcccagagcacggcgagcgccatcaccagggcggccacggccgcgggtctgggcggcatcgtcctcatcgagctgcacgcccgcggcccctcggacggcacggcgtgctcgtgcaacacctcccagtgcgactacatcgcaatggagtactggcaggccaactacgacgccatcaagacggccaccgccaacggcgtcatcgtcgtggaagcggcgggcaacggcagcgccgacctggatgcgcccgcgtatgggagcgcgttcaaccgcaacacccgggactcgggcgccatcttcgtgggtggcagtacggcgaccacgcgcttgcccatgtgctggacgaacttcggcacccgcgtggacgtgcacggctggggtgagcgcgtctacagcatgggctacggcaacgtgttcggcgccagctatggcgaggaccagttctacacgtccagcttcagcggcacctccagcgcgtcccccatcgtggtgggcgccgccgccagcgcgcagggcgtggccctggccaacgggcgacgtctgaccagcacgcagatgcgctcgctgctgcgcgccaacggcacgccgcaacccgcgaacacgcgccagattggcccgctaccggacctggccaaggtcctgcccaaggtcatcgccggcgactactgagccggattctcggcacgcccccaccttccgcgtcaggacgggtgggggtgcgtttcctggcggcgaagtgactaccgctcgccgtagcggcggtggtccaccatcaggcagcggtcctgcaccacctggatgcccgccttcgccagcttctccgccgcggcgtcgttgcggatgccggactggaaccacaccgccttcggcttcttggcgatgagctcgtccacgtgcccgtcgatgtcctgcggccggcggaagacgtccaccaggtccaggtcgccaggcacatccgtgagccgccggaacaccggcttgcccaggatgtgtgtcacgtccgggtagtagacgggcacgggcaccacctcgacgcccgagcgcgccaggtagtccggcacgtagtaggccggctgccctgactgctgctccgtcttgatgcccagcaccgccacccgccgggcactcttcaccacgcgctccacacccgcttcgtcctcgatgaggttctgctcccagctcatcgcgcctcctcctggagcccctctgcccgggactccgtcgtgacagtccacgcttcgcccgccaccgtcgcccgcaccgtgagttggcggctcacgggcatgaagcgcccccggcccaccagctgttctccctcgcaagacacgcccggcgtcagctccggccggcccgccatcacccacgcctcccacagcgcgtccggcgcatcctccggcaccgcgtccaggcagcgcaggcccagcaccaccgcgtctcccagcggcgtgtcccgcgtgccctggaccgtgcgctccagcacgtaggccacctggctgtcccccacgggcaccaggtccaccacccagctctgctggccctccacgaggttgcgctggaagaggccggcgaacttcacctcccactcgcgccgcgcccgcgtctccagggcctcgggttcgaagaagcgctccaacacgcccgcctccgtgcccgagggcgccacctggcggagcgcctcctgcgcggcttcgggggccaccagcttcacgaaggggccatccgccgccagccacgcctgcagcgtgaagcgcgccagcacgtccgccacgccggtgggtacctcctgaccattgcgcgtcaggcgcgagcgcggcaccgcctgcgccagcagccagcccccttcggagggcgtgaagcgcgtctgcgtggtcagctccacttcctcgcgaagggtgtcaccccgccgctccaccgaacgcacgctgcgctgcgtctccgtgagcacgcggtccacggggggctggaagtccagtcgcaccgacgccggccgcggctccgaaggcgacacggagagcggcgccttgtggctacaggcagtggcgagcagtaacaggagaagactggacgtcagggggccgggacgcatgcgccgtcacacgctggcagaaagcgcccgcgcccgcgagcgcttccaccaggcctccccgccccaacgcccaccggttcacggatgacgcgtctggccgtccggtgcatcctccaccgcgtcccgcccgatgttgcggcggtcccggttcaccccgtcatcgtcgtccctcgagccccccagggcggagcgacgggatgcctcggagaggtcccgctgcacggcctcgcgggtggcgtactcgcgacgcggcaggcacttgaagaggttgatgacgtcggggggggcgcctgcgtcagcggcagccgccgccagttgctcccgttcgacggggtactccaccgcgtcgaggtgcggggtgatggagagcgctggatcctccgcgagtccataagccatcgtctgtctgcctttctgccggggcgcgctggccccggcactggtgcgttcgtgtgcaatgacaacgtggggatggccggggcgcgggaccacccggggcgcccccgtcccagcccctgtccagccagggggacagccgccctggccccttcccggttaaggtgtcgtcccgcgacgccttcctcgcaggagtcccacaccccatgtccgccgcgcccctgctgcttgcctggctcacgctcgccagtacgcccgccgccgccccgccgcccgtccatgacgtcttcgccctggacgaagcggccttcgtcgcccaggcccagaccgacctcgcgctgctggagcgccacgtccggggcctgcgcgggctgcaggaggccgtgaagcagtcgcgcgccgtgtaccagcagaagcagagcgtgccatacacgccggaccagaagcagctgctgctcagcacctgggcggccttcttcgactacttcgtgtccgtggaggtcatccgccagcgctactgggacttcgtgaaggtgcccgcccacgcccatccgaagaagcacgcctggggcttcctcctcacccacggcgcgctcaccacggagctggcccacggactcacctacgcggagctcaccctgggcaagaagcagctcgaggtgctgctggacgagcccgcgcccgagtacggcctgcccgcgcgcgccttcgcccggttcaaggacaaggccatccacgtctccaccagcacccagttgctcacgggggatggatacaaggaacagctccgcccgctgctggtgaaggccggcgcgctggacgccccgcgcgtgccctggctgctgcaggagatgaagcacaacagcaaggtggcgaagggactgctcacccggcgtggcgccacgctcttcgccaaggccacggtggacctgacggcggacaccgcgcagcgcgccttcttccccgtacagcgcgcggtggccgaatggatgggtgacacccgcgtgcgccgcgtgggccagccgctcatctcccgcgagcaggccctgtccctgctggagaagatggagcccggcgacatcgtggtcgcccggcagaactggtacctctccaacatcggcctgccgggattctggccacacgcggagctcttcatcggcacgcccgcccaacttggcgcgtacttcgacgacgactcggacgtgaaggcctgggtggccaccctccccggcgcaccgggctcgctcacccggcacctggcgcgcgccttccccgccaagtgggccgagtacaccggcaaggacgcgcatggcgaccccctgcgcatcatcgaatccatcagcgagggcgtgtccttcaccggcctggagcacggcatgcgcgtggactacctgggcgtcatgcgcccgcgcctgtcacgcctggagaaggcccgcgccatcgtgcgcgccttcaccttccagggccgcccgtatgacttcgacttcgacttcttctccgaccagacgctcgtgtgcacggagctggtgtggaagtcctacgctcccacgggcgacatgacgggcctgcgcatccccctggtcagcgtggctggccgtcgcaccctgcccgccaacgagctggtccgcctcttcgacaaggaatacggacgcgaggaccggcagctggacttcgtggccttcctggatggccgggaggcggaaggcaacgccagggaggcggacgccaccgctttccgttacagctaccgccgtgccaagtgggacatcgcccaggagtagacacacgatgacggagcagatggccgaagagatgctgcagctgtccagccagctcttcgagaagatgatttcccagcagcaggccaaggtgctgcgcctggcccgcgaggccgtgcccaacatctccccggaggaggtgcgcaattcccacgacttcccggaactcaaggaacatcctacatttgagttcgaggatggaatcctgtccgggctgattgcggcccagattgccctgcgggcggaaatcaagggacggctgccgcttgaacctccagcattctgacgctcggctgcctgcctttgccgtccgggccctcgtgggttactggttcttgccgtgagcattccctctggattcagcccaccgttggcgcgggagcggctggtgtcggccctggccgcggagcccccgcggctggacctggcggcgctggccatcgccacgctggacaagcccctgctggacgccccggggtgcctgcacatgctggacgtgctcgcgtgccgggtgcaggtggaggcggagcggctgagcgagaagggcgaagtcctggcgccgctgcgcgccttgcgccacgtgctggcggacatcgagggcttccgcggcaacgaggacgactaccactccccggagaacagcttcctggaccaggtgctggagcggaagctggggctgccgattacgttgtccgtcgtctacctggaggtagcgcgtcgcgcgggcatctccctgtacggcgtccccttccccggccacttcctggtggcgcacgacgcgggggaccacaagctggtcatggacccgttccatcaaggggacatcctcaccgagcacggctgcgaggagctgctcaagcgcgtggcgccgcagctcaagttcgaccgcaacatgctggcgcccgcgccggtggagctcattacgtaccggatgctgtccaacctgcggcgcgtgtacctgggcagagaggactgtgagcgcgggctggcggtggtggacctgctgctgctcctggcgccggaccacccgggcgagctgcgcacccgtgccgcgctgctcagcaacctgggggcataccgcgcggcgctgaaggacgtggagcgctgcctggagctttcgcccgatgcccccgaccgcgaccggctggagatgacggcccgcgagctgcgggagcgcgccgcgctgctcaactgaagggaagggctttcacgtggctcgagaggtgaagccctggcgccggctgcggcgagggctggagcatgacttcagcgtcgcccgggtgcgcgaggactggtgggcggacccgcgcacgggccacgaacacccacgcgtgcgcgtcgactgcgcggactgggtgaacgtcatcgccgtgacgccggacgcgcagctcgtgctggtgcggtagttccgcttcggcgtcgagacatccacactggagctccccggtggaatcgtggagccaggcgaagcgccggagcgggccgcggcgcgcgagttggaagaagagacgggctacgtgccgggccgcctggtgccggtgggccaggtgcaccccaaccccgcgttccagggcaacgtgtgcttcaacttcctcgcgctcgactgtgtgaagcgacacgaggggcggcaggacgcgggcgaggacatcgccgtggagctgcacccgcgcgccgagctgccgcgcctcatcctggaaggacacatctcccactcgctggtggtggccgccttcttccaggagcgcctgctcagcgagtcgaagtaggcccgtgcatcagggacgcgagcagccgcagccgcaggcgtcgaagaagggcgactcgccccgggcacaaacgaagaagacgacctgacactccttcctgtcctcggacacgtagcggcgctgggccgcctgtgcgtcgcaggcggcccggtccgccacgggctgcgacacctcggccgcgtcgccctcttccgtgagcgcaccgcagcccgcggcccccagggccgtcagcagcgtcagaacgcccctcaggtcgaacacccgtcacctctcgaaccggcgctgtccttcgcgcccgcatggactgaagagcaacgtgggggccttccccgcgcaccgggagccccctcggggacgagcgtgccctgggcgtggacagcgtcacattcgcggcgtgtggagacggacagaaggcggggctccagcccaccggtgtccgccgacgcacgggcgactcggcttcgggggaggcctcccttcagcgggccttcttcgcgcgcgtccggcgccgcggcgcagccgcctcaaccggcgtggcctcctcgcgctgccatgtgccggagcgcccgcccgacttgtgctccaactgcaccgcgtccagcaccatgccgcggtccacgctcttgcacatgtcatagacggtcagcgccgccgcgcaggccgcggtgagggcctccatctccacgccggtgcggtccaccgtcttcacctgcacgcggacccgaagccccgcgtcctccggcgccagcgtcacctccacgcccgagagcgcgatggggtgacagagcggaacgaagtccggcgtgcgcttggcggccatgatgccggcgagcctcgccgcagccagcacatcccccttctccaccttccccgccaggatgcgctcgcgcgtgtcgggcaacatccgcagcagcgcggtggccacggccacgcggcccgtcttcggcttctcccccacgtccaccatcttcatcggcgcaccccctgggccaccgcggcgagcaggtcatccacgatgtcgtctgggtcctccaaccccacggagacgcggatgagattctcccggatgcccgcggcctcccgctcctccggtgtgaaccggcgcgcgctggcgctggccgcgtgcatcaccaacgtgcacacatcccccagtgaaggaccgggccgccccaccttcaacgcctccaggaagcgcatgctctccggccgccccgcgcccttgatttcaaaggccaccatggggccgccgcccagcagtagctcctgcgcggtggcgtggtccgggtgcgaagtcagccccgggtagatgacccgctccaacaggggcgactccatgaggcgccgcgccacatgcgccgcgtgctcgacatgcgccttcatgcgcaccggcagcgtgcgcaggccgcgcagggtgagccacgcctcgaagggccccagcacgtcccccgccagcacccgcgcggcgcgcagtggcgccatccgctcacgcgaggcgctcaccgtgccgcccagcgcgtcgctgtgcccgttgagccacttgctggtggactgcaccgcgtagtccgcgcccagcgccaacgcgcgctgtcccacgggcgacgggaaggtgccatccaccacgaacgtcgcgcccacgtcctggcaggcccgcgccagcacgcgcaggtcgggcacgcgcagcagcggattggagatactctccgccagcaccatgcgcggcttcagcgctcggatgcgctcgggcacctcggggtccgtcatcaggaacgcatgcagctccacgcccagcgtggcgcacagactcttgtacagcgcgcgcgtgacgccgtagccatccgccggcatcaccagcttgtcaccggcccggaagccctgggcctcgaagacggagcgcagcgcggccatgccgctggcataggccacacagtcctcggcgccttccagcgcggccaccgcctcctccagcaacgtggtgttgggcgcgctgattcgggcgtaggcgtagtccttcccgtccagggcgctgtccaggtcatcgctgctgtcgaaccagttcaccgccgccgggtagatgggcggcgacaccggcactgccttgcttccagccagccgcgtcccggcgtgcaccgccaccgtcttctgcttcgagctcatggggattgctgcgtccttcgcgggaatggaaaggccggccccgggaaggggccggcctgggaatgctcagcggagccgcgcgagcgggtggactactcgccgtgctcgatgagccagcgctccgcgtcgatggcggccatgcagcccgtgcccgccgcggtgatggcctggcggtagtagtggtcctgcacgtcaccgcaggcgaacacgccctcgatgttggtgcgcgtggagcccggcaccgtcttgaggtagccgccctggtgcgtctccagcacgccctggaacagctccgtgttgggcgtgtggccaatggccacgaacaggccggtcgccttcacctgctggctgtcacccgtcttcaggttgcgcaccaccgcgccattcatccccttcgcgtcgccgaggacctcctccaccgcggagtcccacatgaaggagattttcggattctggcgggcgcgctcctgcatcaccttggaggcgcgcagcgtgtcgcggcggtggatgagggtgacgtggttgacgattttcgccaggtacgtcgcctcctccatcgccgtgtcaccgacgcccaccaccagcacgtcctgcttcttgaagaaggcaccgtcgcaggtggcgcacgcggagacgccgcggttcttgtaggtgtcctcgcccttgacgcccagccacttggcggtagcgccggtggagatgatgaccgtctccgagcggcagctgacgctctccccctgtatgaggaaggggcgctgggagaagtccaccttcaccacgttctccatgtggatggtggtgccgaaacgctctgcctgcttctggaagcgatccatcagctccgggccggtgatggcctccggaaagcccgggtagttctccacgtcggtggtcaccatgagctggccgcccggcacccgctgcgggtgctccagggtggggcccccggcgaacaccaccggctgcaggttggcgcgcgcggcgtagatggccgcggtgtagcccgcgggccccgagccgatgatggtcaccttgttgatcttctcctccgccacgactcctcccaaatctcgttgatggccccaaggtaccagagcgcctcgggcgcgtgatacgaagctggcctcatggatgccgcagtcctcaagaaggttgcgctgttcgagggtttgacccagggacagctcgccaaggtcgcccagattggccactcccggacctacccggcgggcgcctttctgttccgtgagggggaaaccggccaggagatgttcgtaatcgccgagggcaaggtccgcatctccaagtccgtgcccggcatcggcgaggaggcgctcgccatcctggagcccggccagtatttcggtgagatggcggtcatcgaggattcgccgcgctcagcggacgccatcgcccacgtgagctgctccgtctgggtcatcgagcgctcccggctggaccagctgatgttcaccgacaaagacctggcgtacgtgctgctctggaccttcgtccgcacgctgagcgaacggctccgcgagacgaacgagaagatcaagggcttcttcgccctctcccgcttctgacggtccgtctcagcacccgagaagccacctggtgcagggatgtccgtccggcatccgagccccttccgacgtgtcgggacgggtacgcaccccactccccaggtagcacaagcaggcacacggattgctttgtccccgccccgtggagggcggcgggatggagcaggcggcggcgggagcggcgtgggcgggcgaagggtcggtgagggcgcgaggggtgggaggcgcggaggagtcgcgggagcgcctcttccggttgggggcggcggcactcaccgacccggagctgttgtgcgtggtgtggagctccgggcctcgcgcgcctggagcgtgggcggtggcgggggccctgctgtcggagggcggtgggctgaagggactggtgcagcaggagcccctggcgctgagtctgcggcccggcgtggggcctgtccgggcggcgcaggcactggccgcgctggagctgggccgccgctcgcagcgtgcccgggagcgcaggcccaggctgcgcacgccgaaggagattgcggcgtacctggcaccggtgctgggggcgctgcggcgcgaggtgttccacgtcttgtgcttcaacgcgcgcaacgtgctggtgcatgacgcacgcgtggcggagggcaccatgaacacctgcccggtggacccgcgggaggtgttcgccgcggcgctcacctcgcgcgccacgtccatcgtgctggcacacaaccacccttcgggagacccggagcccagcgtccaggacctgggcctgacgcggcatctggtcgcgggggcgcaactgctcaacatcaaggtgctggaccacgtggtgatgggagacggcggctacgtgtcgatgctggaacgcgggctgatgccggacgaagcacaggagaaacggcgggcgtggagcgcgaatggaggcggcggatgatggtgagcatggtggggctgtggggagcggtgcaggtggagctgctggaggacgtccgggcgcaagtggtgcggctggacaccggacaggcatgcacggtggagcgcgcgtcgctgcccaagggcgcgcgcgagggtgacgtcgtggtggatggccggctggagccagggcaaacggaggcgcggcggcaggacgtcgcgcggatgcgaacgcggctggctgttccggttccaccagggctcgacctgtgagtggaggccgcgcggcggcctcgtttccgttgacggctggaccaggatgatgaacatgcgcgcgatgccgggtggccctgccctacctcgaggaagcacagcaggggctggtccgccacttcggcctgtcccagttccggccggggcaggaccaggtcatctcctccgtcttgagcggccgcaacacggtggtggtgatgcccaccggcgcgggcaagagcctgtgttaccagttgcccgccacgctgctgccggggctgacactggtggtgtcgccgctgattgccctgatgaaggaccaggtggagcagctcaccgcgcgcggcatcccggcgaccttcatcaactcatcgctgtccgacctggagcgcgcggagcggatgcgcaagctgcgcgcgcatgagtacaagctgctctacgtggcgcccgagcgcttccgcagccagagcttcctggagacggtgtccgcgctgggcgtggacctgctcgccgtggacgaagcgcactgcatctcccagtgggggcacgacttcaggccggactacgcgctgctcggacaggtgcgaaagcggctgcgtccgccgcgcacggtggcgctcaccgccacggccacgccggaggtccgcgcggacatcgtgcgtgtgctgctgatgaaggacccgcaggaattcgccatgggcttcgaccgccccaacctcttcctgggcaagcaggaggtgggcggcgacgcggaccggcacgaggcctgcgcacgactggcgtccgcgggcgggagcggcatcgtgtactgctccacgcggcgcgcggcagagggcatcttctccgaactgcatgggcgcggagtgaaggcggtgctgtaccacgcgggcatggacgatgacgcccgtcgccgcgcccaggacaccttcatgtccgcgaaggaagcggtggcggtggccaccaacgccttcggcatgggcatcgacaagccggacatccgcttcgtcggccacgccaacatcccgcgggcggtggaggcgtactaccaggagattggccgcgcgggccgcgacggacaggccgcgcgcgcggtgctcctcttcaaccactcggatgtcttcacccaggagcggctcatccagagcagccacccggccgaggccatcttcggggacgtgtggaacgtgctccagtcggtggaggaattcgagagaggcgtgcacgcgctcgcgggcacggtgaacgccagcgagttcgaggtctccgcggcgctgcgcatcctctaacgcgagggaaaggtggagcgcggtggccgaggcgagggcgagcacggcatcaccctgctggagaaggccgcctcggcgcagccgcactcgccggacgcacagcggctgctcaagtccttgctggagacattccccgtgggccggcaggtcaccacggagctgcccatcctcgcgcgccgcatcggtctgtcggtggacgaggtccgccacgcgctgggcttgttggagaaggcccacgtggccaaggtacggcgccccttcgccggccgctccattcgcgcgctggagcgggtgcccttccgcgagctggggctcgacctgagccgcgtgcgggagcaggagcggcagaacctggcgctgctgcgccggatgaccgagtacgcctatacggaccgggacaagaagtgccggcgctcggccatcctccgctacttcggccaacgcgacacccacacgtcgtgcggcaactgcgacgtgtg

SEQ ID NO: 1069 - DNA, 14158 bp, Myxococcus xanthus
  unsure (1)..(14158): unsure at all n locations
gctctcaagcgtgtcgtaggtcgacacgcgggacatgtccaaggcgaacaacccctggccgcgcgcggagttcgtgaagcgcgcgcccggtctcgcctggaaggagttctttgacgccgcgggcctgggcacgcaggagcaggtcatcgtctggcagccgagcgcgctgacggtcctgtcgaagctcgcccagagcgagcccctgcaggcgtggaaggattacctggccttccacgcggtggctcgcgcggacccgtacctgcccaaggccttcgtcgacgagagcttcgccttcaacggcaagacgctgagcggaacgcccgcccagaaggagcgctggaagcgtggcgtggacgccaccaacctctccatgggcgaggcggtgggcaagctctacgtcgcgaagtacttcccgccggaggtgaaggcggaagcggaggccatggtccgcaacatcatcaccgcgttcgagaagcgcatcgacgcgctgacgtggatgtcgcccgagacgcggacccgcgccaaggagaaggtgggcacgctccaggcaagcatcggccacccggagaagtggcgtgactactcggggctcgacatcgtggccggtgacgcctacggcaacgccgagcgcgccgtccgcttcgagtaccagcgcaacgtcgccaagctgggtcagcccgtggaccggaaggagtggtacatggtcccgcagttggtgaacgcgctgaactcaccgcagcagaactccatcatcttcccggccgccatcctgcagccgcccttcttcgacgcgaacgcggacccggccgtcaactacggcggcatcggcgcggtcatcggtcacgaaatcgtccacagcttcgacgacgtgggcgccaagttcgacgcgcgcggcaagctggagaactggtggacgaaggaggacgaagcgaagttccaggccgcggggaaggccctggcggnccagtacaacgactaccgcccgctgccggacctgtctgtgaatggcgagctgacgctgggtgagaacatcgcggacatggcgggggtggcggtggcctatgacgcctaccagctctccctgggcggcaagcccgcgcctgtcatcgacagctacaccggtgaccagcgcttcttcctcggcttcggccaggtatggcgcgccaagtaccgcgagccgtacctgcgccgcatcatcatgacggacggccacgcgccgggcccgtaccggaccgccaccgttcgcaacctctatgcctggtatggcgcgttcgatgtcaagcccgggcagacgctgttcctgactcccgagcagcgcgtccgcatctggtagacgtcagaggagccgcatgacgcggtcgttcccgccagtcggattcattcgcggccggctggcggttcgaactcaatgccaaacacaaaggcgcttgaaatgtctcacctggcaagcaatggccccgtactcgaaacacagcgtctcatcctccggccgcccctggccgaggacctgtatggcttcgcggcgctatcggccgacccggagtcggcgcgtttcatcggaggggtccagccgcgcgcgatggcgtggcgcaccctgtgtgtgatggcgggctcgtggtcgctccagggcttcgcgatgttctccgtgctggagaagtccacgggcgcgtgggtggggcgagtgggcccgtggcagccggagggctggccaggaacggagattggctggggcctgctccgcgagtactggggccggggctacgccacggaggcgacggcggcgaccatggactgggccttcgaccacctcggctggaccgacgtcatccactgcatcgtgccagagaacaccccgtcccagcaggtcgcgctccggctggggtcgcgcgtgctgggacaggcacacctgccaccgccgcacgacatgctccgcgtcgaccgctgggggcagagccgcgacgagtggcgtgctcggcggaagtaggcgccgcgttgctccaaagcagggttcgcctgtccgtcccctggggtggctggcacccaaatcgtcaggaaagacgggaagttgagggaccgcccaagcgcatgttacgaccggcgacggccagtctctcctcccccgtattggccattcggagccggctttccatgagcgagcgcaacgacgtcccgaggaccactgttcccgtggcccccctgcctgtgtctggcgcgcccgcgagcccgaatgctccggtcacggagacgcaggcccaggccgcgaccaccgccccctcgactgccgccaacacccgcgccgaggatgaagcgcgcgagcgcatcgcatccctggagcgcgaggccaaggccctcagcaccgcggagccccacacggcggcgttgctcttccacgaggtgggcctgctctgggaggagccgctcaagaatccgcgcaacgccgcggtggcgttccagaacgcgtacaagctggcgccgcgctacctcgtcaacatccgcgccgcccgccggctcttcgcggacgtgggcaactggcagatggtgctccagttgatcgacgcggagctggcggccaccgacgacgcgcgccaccaggccgcgctgctcttcgagaagggcatcatcctccaggagcgcctgtcgcgggacgaggagtccgccgcgtgcctgaagcagtgcctggagcgccggcccacggacgtcgtcgtcctcacccagctcgagtccgtctacgccgcgcgcaacgacgcacttgcgctggtggaggtgtaccggctgatcgccgccaccgtgcagcagccttcgctgcgcgcgcactacctcaccgccgcgggcctgctgctggaggagcggctgaagcagaaggaaggcgccgcggccctgttccgcgaggccttcgcgctggaccggtcggacctccagctcctggctgccatgaagcggctggccgagcgcgaaggccgcgtggatgagctgctcgccgcgctgggggcggaggcggccgcgctgggcgcgcaggcggcgcccgcgtacctgcagatcgccaaggtctacgagcgcaacgaccgcaaggacgacgcgttggccgcgctgctcgccgcgcggcaggtgtcccccaacgagccgctggtgctgagcgagctggccggaatctacgagacgcaaggccgcttcgaggagctgtcggacgtgctgctggcacgcgtgggttcgctcaacgacgagagcgagctggtggccaccaacctccggctggcggcgctgtacgaggaggtcctcaagcgcgagtcggacgcggcggcgcggtatcaggccattgtcgcccgcattcccggccacgcggccgcgctggcgggcctgggcaagctgtactaccgcatgcaggactgggagcggctggtcgccgtcttcgacgcggaggtcgccgccgccgaggacgcgaagcagaaggccgcgcgcatgtacaaggcggccgaaatcctggaggagcggctgggacggcaggaggacgccatctcccgctacaacgcctgcctccagttgcagccgggctacctccccgcgcagaaggccctcacgcgcctctacgagcgccagggccgcttcgcggagctggtggcgatgtatgagcaggacctgctccagacaagcgaccgggatcagctcatcaccacgttgaacaagatggcggtggtgtacgaggaccgcctgggcgacctggaccacgccatcgagtgcatgaagcgcatcctcgaccttgcgtcggaccacctgcccaccatccgcaacctcgcgcggctctatgagcgggccagtcgcttccgtgagctgctggagacgcacgacctggaggcgtcgctcgcgggtgacaccaagcaggtgctgtcgctgctgcaccgcaacgcggagattctcgacgagaacctcaaggaccgcgcgggcgccatctccgcgtatgagcgcgtgctggcgctgtccccgtcctatctccccgcgctcaaggcgctgggccggctgtacgcgcaggatggccggtgggagaagctggtggacatgtaccgggcggagtcggagagctccgcctccaccgagcaggccgccgcgctcatctacaagattggcgagctgtacgagcagcggctgaaccaggacaacgaggccatcgcttcgtacaacgaggcgctgatgctggcgcccagctacttcccggcgctgcgcgcgctggcccgcatctaccgcgcgcaggccgcgtgggagagcctggtggaggtgctgcgcgccgaagccgccaaccgcaccgacccgctggagcgcgccaacgccctctaccaggcggcggccatctgggaggagcagctgcttcggcccgagctggccatcgacacgtatcaagaggtgctgcgcctgacgccgggccatgccgccacgcttcgcgcgctggagcggctgtacctggcgcaggacaacgtgaaggagctggtcggcatcctggaccgcgagacgcaggtgggcagcacgtccgcggcgaaggtgacggcgtacctgaagctggcgcggctgtacctggaccgcttccaggagccctcccgcgcggcccagtgctgcgaggccgtgctggcgctggacgccggcaacctcaccgccctcacgctactggagcgcatccgcgcctcggaccggccgcgccgcgccgagctgcgccagcgcatcgccgaccgggtgaacgacccgcggttggccatggccctgcggctgtccgccgcggtggacttggacaagagccccgccgagggcacgctggaggcctacaagcgcgcattcgatgccgacccgggcgatgcgcggctggccttcgtgctggagcgaggcctgcggcaggcgggtgacgccgcggggctggcgcgcctgtacaccatgcggctggcatccgcgcaggacgccgacgaggccctggagatgctgctgcgcaccgccgagctggcggacacgcgcttcaacgacttggagcgggcggcggcgctgtaccggcaggccctggagctccagccgcagtgcctgcccgcgatgcagggagctcgccgcgtggccttgaagcggggcgacttcgcgggagcccgcgccgccctggaggccgaggcccgggtgtcgcgcgatccgcgtggcgccatcgaggcgctcatcggcgcggcgaagctggccgtgggccggctgaatgacgcggacggcgccacggcgctgtaccggcaggcgctggagaaggatccgctgcacgcgggcgctcaggcgggcttggaggaactgctggcgcagcgcggtggctccgcggacctggcggccctgcaagagcggcgcgccgaagcgaagcttgcgcaacgggacggactggcggcggccacggcgttcgtcagcgcggcgcggctgcaccacaccgcgctgaatgaccgcgcgcgggcgctggccctgctggagaaggccctgtccgcgcagccggggcacccggaggcgctggagctgcgtggcgcgctcttgctggaggcgcagcagtaccccgaggccgcggccatgctgagccagcgcgtgcagctcggcggcgacccgcgcgtcctggcgcagttccacatgacgctggggaacctgtacgcgtcgcacctcaatgacccgagccgggccgcggcgcactaccagacggtgctggccaccctgccccgtcacctggaggcgctggagcgcctggccgggctgcacacgcaggcgcgcaactgggcgggcgcggtggactgcctgcacaagctgctccagcaggagctgccgccggagccgcgcgcccgcttcacgctggagctggcgcgtacgtatgacgaagggctgggcgacgcgggcgcggccaccccgctctaccgccgcgcgctggagctgtccccgggcaaccccgccctggtggaccggttggtggtcctctacgagcgcgctcggaacctgccggagctggcgcagttgctggaggcccaggccacgggccagttggccgtggagcccaagcgcgccgcgacgctgcggatgcgggccggggacctgtacgcgggtccgctgtccgagcctgctcgcgccaccgcgctgtaccggcaggtggtggatggtgatggcaccaacctccaggcccgcgcggtgctcgcggagctgtacgcgcgggactcgtcatcggtgccgatggccatcgaggagcaccggcagattctccggcaggacccgacgcgggtggacagcctgcacgcgctgttcaagctctgggagggcctgaagcagctcgacaaggcgttctgcgcggcggcggcgctgcacttcctgcgctccgccaacgaggtggagctggccttctacatggaggcccgcacgcggctggcgcaggaggcgcgcgaggcgctgacgcagacggatgtggactcggtgctgatgcacccgggggcccggggcccgctgctcgaggtgctgcgcgcgatgggcgagcacctggagaaggtgtacccgcccaacttcgaaatcgtgggcgtcaatccgaaggcggaccggctcaagccggactcggccgtgtacaaggccatccgcgccgtggcgcaggtgttcggcgtggaaaccttcgaggcctaccaggcgcggcgcgggctcacggtgctggagaccacggagcccatgtcggtgtgcattggccaggacgtggtgcggcgcttcaacgcgcgcgagcagaagttcctcctgggccgcgcggcgctggggctgctcaacaaaaccgcggtgctggagaagctgtcccagggcgagacggcggacctcttcggcagcgccgtccgcctgcacgcgccgcagttcagcgcgctgggccggcgcaacgacgagtcggtgaagcagctcaagcggggccttcccgcgcaaggcgctcaaggcgctggagagtccggcgatgtcgctgggcgacgcacagaaggtggacctggcgccctggctggaggccctcgactactcggcggaccgcgcgggcctgctgatgtgcggcgatgtggcggtgggcctgggcatggtgctgcgcgaggacccgaacttcgcgggtgcccggctggatacgcccgagcccatgatccaggccgtgcgcgaaggtgagcgcctgcgcacgattctggcgtggaccttcacggacgacttcttccggctgcgccagcggctgggactggggctgtaggcgctttcggaacgcggcgggagccctactcccgccgcaccaccgcgccttccggcaggcccgtgaggatgcgcgtcagggcgtcatccacgggcccgcgctgggcggactccaccgtcaccttcacccggtagtccttgtccgtgtcgaactccgggtaggagccgatggctacgtgcggcatgtcgagcgccacgcggtccagcacggcggcgatgtcgctttcgcccatccggaggtagaggcagctcacggaccacgggcgacccgctcagccgcgcgagcacggtctccaactgcatcctgaacaactgcggcacaccgggcagcaggaagatgtcatccaccgtgaggacggggaaccacatgtcggcctggggaagcagcacggcgccctctggggcatcggcgagccgcagcccttccgccgtcaccggccgctcctcggtggcacgggacatgatgaggtccagcatctcctgcagccgaaccacgttccgtcccatggccagggccaccgcgcgcacggtgacgtcgtcatgggtggggccgatgccgccgctggtgaagacgtaccgcgccttgcgccgggcccgggccaccgcgtccacgatggcgtccacgtcgtcgaggaccgtctccaccgagtgcagcgggatgcccacctcgcgcaggcgcttgatgaggtgcggcccgttcaggtcatggaccttcgccgtcaagacctcgttgccgatgatgactgccgctgcgccggtccgctccataaggggtgggattctagtcgaatccggccggagatggtgatgtacggctcgacccccaccgactccagccagcggacgttcttcgcggagaagtggcccgcgtccgcgctcagctttcggggcacctcttcgagaggggcgacaacacattcgcgacctcgctccatcaacggccactggaccctgatgtcgaagctgcactgcggaatggaaggaagccaggtcatgcaccccacatcagtgtttcactggaaggaccgcgccgaaatgcttgcgttcgtgcgcgctcggagcttcgcgacgttggtcgatgaatccctgcgggtggcgcaggtcccgttcatcgtcgacgaggccgcgagtcgtctgctttgccacttctcacgcggcaacccgatgtcgcgggcgttgccgatgcgagtcgtcgcagtggtcaacggggccgacgcctacgtgagcccggactggtacaagagccacgatcaagttccgacgtgggattacgagagcgtcgagatcgtcggctcgctcacgcccgtcgacgacacgctcctgcgcgatatcctcgccgcgctgagcgcggagcacgaagcacgcatcccggacaaggctccgtggacgatgaacaagctgcgccctgcgacgctggacaagatgctcacaggcatcgtcggcgcggcactctcgatcgagtccatccgcggcacccagaagctctcgcagaacaaatccgacgacgacttcgacggcgtcgtcgccgcactggagcggagcccgtcgcagcacgatcgcgacgtcgcggcgcgaatggcactcgtgcggcgtcgccgtgcggaggcactcactggacgcgcttgaggtacgcatccggtgcgcacggccgcagccgcctgagcgctgcctcggcgccctggcgtgtcggcaggaagctggccaccacccacttgtctcgggtgagccgcgcgaagtcgttggtgtccaccatgagcagcgtcgcgcccttgcagtccgcttccaactgcgcctcggccacgcgggccgccggcaccgagtcctccgtacggaggatgacggcccaggcttcggcaggccgctccaccaccttcttccgtcctgcgtcccagcgcagctcggtgagggcccaacggtccgccgactctcccacgccgatgtcgagtgtgcgtgagaagaggagccggccgtcctggacctccacgctggaggaggtggggccctgcccctcggtcccctcccaggcccgggtcacgcccttcgcgtccgcgaggaacagggcatgctggcggtgcacatgttcgtagccggccgcgtgggtgatgagaagcgccgtcggccctccctggagctccacggcccggagatggaggtcccaggaggtcgactcatcgccaccagtccagctccatccaggcgccgtcgacttcgccacgttgcacgtgagcgcatcatacggctcggacagtgtcgccgtgctcttcgcgccgccgcggcgaacgcgcagcgcatgctggccccccttgcatggcatcgccacggcctcgatgcgcgggtcgcttcccgctgaacccagcacctgctcctgggcgctctccggcgcggctccgctgagcagcacgacggcggcgaggacgaggacggcgcccgaacgtcggcgcatgggactgggaacctggggcatggacatggccgtctgggcctccgcgagaagcgcttcacgggactctgcacgcactccgcgcctcgcaaaagggggcagggagagaacagacacgtcaaagcggagggctgacacgtcatttcccaggtgaagcctgcttcctggccaggggtgagtgagcaattccctctggttgcggtgttggcacctcccctgcatttccagcgagtgggcacgcgggccgaagcccgggaggcccatatcccactcagtatccctgagtgggtcccacaacgccgcagaggacccctatgtcatccaccacccttcccctcaatctctgtcagaaggccttcctcctcgcctgggagtccaacggcgtaggcgacacgccaggcgacgccaagaggctggccaaggcactgcaaaccaagctcaccaccttcctggccctgtcggacgtcaagaaggccatggaggggcaatggtcgctcgtctgggggccggcggtgttcgtggaccaggaaagcccaacgacctacgcggacaatgtcatgtacgtcgcggcgagccccgaccagtccgtctacgtcgtcgccatcgcgggaaccaacgcgtcttcccaatatgacaagaatatcgaggacaacagcgtcaacaccaccaagctctggacgactgcgttcccgaacctgccgtcctacggagtgccttcgggaatcaatccctggcccgttctctcgacggggaccgcgctgggcgtcaacaatctgctgggcatgaccgacacgctgatgacccagcaaaccttggtggaatttctacgctcggtgagcgcgacgggttcaaagacgctcatcttcagtggccacagtctgggcggcgcgctggcgccgacgctcgcactcgccctgttcaatccatcaggcgggccactcagcactggggactgggaccacgtctacgtgctcccggccgccggtcccacccctggcaaccagggtctctccgagttcttcgagcgggtgttcccgccggtcagcctgaacctgccccagccccaatacgcctggaaccagaacatctggaacagcctcgacgccgtgccacacgcgtgggtcgtcgacagcctcaaggagattcccaccctctatcccgcgaactgggagggtggacaggtcccctcggacatcacgaaactggtcaacctcgccgtcgcggcctcggaacttggcggcgcccttcctggcccctacacgcaactccccaacgtcaaggtgccaggcaccttccacggcaccaatcccatcacgaccgaagcccaattctgggccgaagtcgggtaccagcacctggatgcctatcaaatcctcttcggtgtccaatcgctggtttccgaaggctcccagtccgcactccagaagatgttcaagcggtggctgggctccttctcgcgaatgaccacccagagcgtgagtcgcgccgcggctgcacgctgacgggccccacagcgaaactgcgccggggaggagccgcgacttcctccccggcggtgaagcgcacctgtcgaagcaagcggcctgattgcaaccggcctggtgtctcgacaatccggtgcggtacatacccgccaactcgaaggagaccatgaccgttcatcttcatgtcatcacaggcggccccggttccggcaagagcagtctcatcgaggcgctggcggtggagggactcgcgcacatgcctgaagcgggccgtgccatcattcagcagcaggtcgcaataggcggccatgccctcccttgggctgatcggacggccttcgccgagctgatgcttggatgggagatgcgaacccacaaggaggcctgcgaactacgccgtcctgtcatcctggatcgcggcgttcccgacgtcatcggataccttcgggtatgtggtcttccagtgcctccacacctctggaaggccgcggagctgtttcgctacaatcgacgtgtcttcatcgcgccgcattggcccgaaatcttcgcgcaagatgccgagcgcaaacaggcccccgacgaagcgaaggcgacctatcgctcgatggtcgaggtctacaccagccttggctacgagctgctcccccttcccctggcatcgctcccggagcgggtgcgttttgtgcgctcgaatatcgagtaggccacgcgtgctgtctcaacatgggggcggcaagaaacaggttgacgcacaaaatccacccgagaatactcggagtaacaatcaggcatttctactataaggactacaccatgggactcgccgagcgtcggcgcatcgccgccatcaaagactctcactccgcccgatttcagtcggaactcaacgcggcgattggattcgaactgccgtttgagattgatgttgcgagcttccccgaggacaagacgatcctcgactgctacgacagctactacgagtcatatggcccgggcctcgtcgtcactgtgatgaaggaaatctgcaaggatgacatgggccgtgaggccgtcagagccaagttcaacaggattgttttcctgaatgtcgccaagagtgccgacgacccgggcacgaagagtattgaaatcaaagaccaaaccctcttcgtgcgcgagagcttctacggctactcagaccagctttatggcgactctgaacttcagtcggccctcgaggcgatcctctagcagcacccgggctcactggaggtctccagcgttgggctcgggtcaggccggtgcgccgggatcgaccagggccggggcgttcacgtcgataccgtcccggcgcagctcgtccgaggtggccgccaccgccagcgtgccaggtgggttgtcgtaccagccagggtccgcgtagctctccaaccgttcgcgaaccttgagcacggtgaacatgcctcccgccgtgatgtaatcgtgcttgccctgggcccccagcatgggaatgcagttgggcggaatgggcatcgccatctggcccatatccgccatccccgtctggcccatcgtcatgtagcccggtagcagcgtgcgcaccctcgcgtccaggctccccggcttcacgccaatcatattggggaacgcatggcccatctgattcatcatgtggtgcgtcatgtgacagtgcagggcccagtccccgggcacgtccgccacgaactcgatgacacgtgtgctgcccacggggacgagcaccgttccctccggctgctgcgcggactcggggacgcgcccgccatccgtttcggtgatacggaagtggaacccgtgcaggtggatggggtgatggttctgcgggctcaggttgcccaaccggatgcgcacccgctcaccctggcgcaccacgagcgactccgtgcccgggaacgccttcgcgttcatggtgagcacgttgaagtccgtcatctcattcggattgggtcgctccgtgccgacatcgatgcgccattcatgcaggaggatgacgaagtcccggtcgacgcggggccccacaggtcggcgcgggtggatgatgaacatgcccgtcatcccgaggccaatctgcgtcatctcgtcatggtgcgagtgatacatgttcgtactcgcctggcgcagggtgaactcgtaccgaaacgtctcgccaggagcgatggacttctggctgaggccgcccacgccatccataccgctgggcaccaggagtccgtgccagtggatggtggtggccgcgggtagccggttcgtgacgtagatgcgcacccggtccccctccaccgcttcgatggtgggcccgtggactcgaccgttgtagccccagcagaaggctttcagtcccggggcaaactcatgcgccacctcctcggccaccaggtggaagaccttcacgttgtccacgaccttccacggcagcttggagccattgggcaccaccacgggccggtagtcccggtcgggcattccggggcgcaaccagtcctgccgcgcataccgctggccggtgtcagccgcggagccctcgcgaggcccacgtgcgcctgagacggctgactgggcgcgcgcagcggagccactcagcagcagcgagcctcccgtgagcgtggctcccgccgtggcaagcatgctccgccgcgtcagcgttccctcggctccaatcgccggagagtttccaggggcccccctgcgctcccgagctccaggggcgtcatcctcacggcccggtgcgcgctcggtttcagtcgtgcgggtgctcatgggggctctccgtgccatgggtgacatcctgcccgtgccccgagggcgtcccgggtggtgctggctgcgcgggtgggccgggcggcccaggtggtacgcgttgggaaggctgcgagggcgatggcgtgggtgccgcgctgccctcccgcagccggccacccacgagttgctcgaggtcggcccgcgccatccagtagttgcggacggcctcgatgtaaccctgatacgcatc

SEQ ID NO: 1070 - DNA, 14352 bp, Myxococcus xanthus
  unsure (1)..(14352): unsure at all n locations
gtacgtctgacaggccaggacgacggcgccgacggagagtgcactcaggaggggcagcttggagcgcataggcaatgaattccttctgctactgggggacgcgggacttcccgcgcggccgggttctccaaagggggtacggcgtggcgacaggttaccgcgtcattcccgtcgggcgctacagcatcggccgactgattccgcgccgtttggatgccactgcgacgttacagccagagcgatacctgggcggccaagagcggcgtacgtagggcccaagcccaccgactatagggtgagcacccgtgcacccgcggtcagtcgccaaatcgaggccatccccatcacttcatgcagggtgccctccagcgactccggtttgtagccgcagatgcggactgtggtgtcgcaggcgatcagtctggcgcccagcgtgcgcgcttccgccagcatgtgcggcggcgccaacaccccgagtgactccgcgcgtgcgaactcctcgtgctcgcgcgcactcgacggctggccgtaggcgccccccacgagctggcgcagcgcatcgaaggcgaagacgaagtacacctcgtcgcccatggcagcggcggtgattcccatggtggcggcctggaaggccggctcgtacgtggcgtgctgaagaaagaagaggacccgtccggccatgacgcgccgaccataacgggcttcgcatcccgtcgcggcaccaatgacgtataaattggaaacgtccctcttctgtccgggaagccctcatggcgaccaccctccccccacgtcctggcgccggttcctcgtggtccctccgccatctcgcctggcgccccgtggtgctcggaggcttcttgctcgcggggtccggaggactggcccgtatgagtgcttccgccagttcggagcctgccctcgtcaccagcgcgccttcgcctggcgccgacgtccatgcccaggtggtcgcgctcctcgatgcaacgacgcggactggcgccccatcagatgacgcatggaagcgcctgggaccgggagcggcgcctgtcctgtcggcgctcgtcgtggacaagggcacccctaccgcgcggcggacgctcgccgtgtcctccctggcgctggtggatccatcaggcggcgcggtgaccatccgcgacgtgctcgaggacgcgaaggccccggccgtggtgcgtgcgagcgcagcggacgccctgcgccagtgcctggggctggacgccatccccacgctcatctcccggctgcaggacccggaatcacaggtccgggaagccgtggccgtggcgctcgggcgcctgggcgggcagcaggcccggcaggcgctggaggaccgactccccatcgaggagcgcgccctcgtccgcgaggcactccagcgtggactcacgctcgtcgagccctgaggggacacggtccgcctgactccgggctcgcgtcggcccggggcttccattagatgggagccatgcgtcccaccgtcctcctcttcgatatcgatggaaccctggtcaccactggcggcgcggggcgccgctccatggaagccgctttcgagaagctgcacgggcggcgggacgcgtgcgactcgttccccatgtccggcatgaccgaccgggccatcgtccgcaaggcgatgcacatcatcggcgtggaggactcggccgcggccatcgacgcggtcatcgacgcctacgtcgcccacctcgccgaagaggtccacaaggtggatgaccagcgatacctcgtcttcccgggcatgcgcgaggccgtgaaggaggcccggtcgcggtccgggttcgccgtgggactgggcacgggcaacgtccgtgagggcgcccgcgtgaagttggagcgcgtgagcatctacgaccagttcgacttcggcggcttcggctgcgacaacgaggaccgcaccgagctgattcgctgcggcgccaaggccggcgccgcaaagctgggcgtccccgtggaggaatgccgggtcgtcgtcatcggcgatacgcccaaggacgtccatgcggcccagggcgtcggcgccgagtgcatcggcgtggggaccgggaccttctccgtgcaggccctcctcgacgcaggggccacggtcgcctttcctgacttctcgcatccccaggccctggagattctgctcggcgggcgctgagtcccctgcccgtccgctcggtgctcggcgccgggtgtgctatctcccgccgcccttccgaggagccgccgcatgtcgtccacgctcgaatcgtacgagctcatccgcttcgccgaagccttcgaggcccgcctcgccacggcgggggaaatgctcaccggcaggcccggcctcgacgccgaaaagggctggctgaccaccgcgctggaactggtgcgcaccgcgcgcgcgcccaccgagggcgtgctcgaccgtgtgaaggacctccccgagttggaagaggctcgcgaggagtatgcgttccaccagcagggcatgtgggtggacgtgctggagaagctgctcgccggtatcaccttcaccgccagcagccgcgcgcccgtcatcgaggccctcttccctcacctgaagttcccgcaactgcggcgagccccccgcgaagccgtcctcgagtacgcgacgtcctacgagcggcgcacgaagagcgcttatgtgacgcgcatcttcgcccgggatgacttcgcactcgtgcggcccgtcatggaacaggtgctgaccgcccataccgcgtggcgctctagccatgagccgtcgcccctgacgctggaacaggaggccctccttcgtgaggaactggtgtcgctcggccggaagctcgagcagtcgcttcgacaggcgcgactgctggccgaagccgcgctcgtgcccgcccccactgtctatgaggccgccgggctgaacctcaagcccaagcgccgcgcgggacgggggctgacgctctccgacgacgcgctggctggcttcgatgagccgaccgactccatggagcccaccgaggccgaactcgccgaggtcgcggcactggattcaggtggcgacatcgcaagccctgctgccgtggcaccgtcggccgctcgcggcgacacggcggcggagggtggcgactcgtccgccagcgcagccagcccagaggtgctccaggactctggcgcagagcgctcggacaacggtggcgactcgggcccagtgggtggcgccgagctgaaggccgagggcttgtcctccacgacagagaccggcgtggcctccgcgagcactgcttctgagtcgaacgatggcgctgtcgcccagccggaagcagctgccgagggcgcggaactcgcggacaaggccgctgtggacaaggcggcccgggtcgacgggggcgatgcgtcccctcaagccacggatggagcggtgacgaacgacagccggcccgcgactaccgacgaggccgccgcgcaagcccgtaacgaggcatcctctaccgcgccacgcggcgcgcgacggggtcgcaagaaggccgatgcagcggagcctgccgcgaccgaggccaccgaacctccggcctcgggggcggctcaggtgcctcgcatccgaaagaagaaggcttcctcgcagtccgccccaccgactcccgacgcggacacgccttaaaggacaccgggccatggcggacgtcgcgcttcccatcgatcccctgttgccggacatcgtctccacgctgcgtggcgcgcggtcgctcgtcctggaagcgcctcctggcgcgggaaagacgacgcgcgtgcctcgcgcgctcctgcaggccgggctcggtcaggggaaggaaatcatcgtcctccagccacgccggcttcccacgcggctcgccgcacagcgcgtgtccgaggaactgggcgaacgcgtgggcgagtccgtgggctaccaggtccgcttcgaggacgtgcgcagcgcgaagacgcggctgtccttcgtcaccgaaggcgtcctcggccgccggttgctctccgacccgaagcttcgcgacgtgggcatcgtcgtgctcgacgagttccacgaacggcacctgtccgcggacatctccctggccctgctgcggcgccttcaggagacggcgcgccccgacctcaaggtcgtcgtcatgtccgcgacgctggaggcggagcccatccgggcgtacctcggcgggtgtccctcgctccgctccgagggccggcgcttcgacgtgagcgtggagtacctgcccgcgcccgatgaccgacacctggaccagcaggtgctctccggcatcaagcggctcttcacccaaggcgtggatggcgacgtgctcgtcttcctcccaggcgccggcgaaatccgccgcgcacgcgacgcatgcgccgagttcgccgaacgccacggcaccgacgtgctccccctccacggcgacctgtcccccgccgagcaggaccgcgccgtgcggcggagctcgcgacggaagatcatcctctccaccaacgtcgcggagacgtccgtcaccatcgacggcgtggcggtggtcatcgactccgggctcgcgcgcgtcgcctcccactccccctggtctggcctgcccaccctcaagctgtccaaggtcagccgcgcctccgccatccagcgcgggggccgcgcgggccgtacgcgtgcgggccactgcctgcgcctctacacccagcacgacttcgacggccgcccggagcaggacgccccggagattcgccgcacggacctggccgaaaccgtcctctccctgcgcgcgtccggcatcaccgacctggccgccttccccttcttcgagccgcccccggccgcgtccctggacgccgcggagacgctgctccgccgactgggcgcggtcgaccccgccggcaccgtcacggaggtgggcgaacggctcctgcgcttccccgtccacccccgtcaggcgcgcatcatcgtcgagggtgagcgccggggcgtgggcgccgaagccgccgtgctcgccgccctcatgggcgaacgcgacatccgccgcgaggcccgcgccaacctgggccagggaggacgcccggccgccgttgtcagcgggccgtccgacctgctggagctcttcgagcgcttccgcgaagccgagcgcgcgaacttcgcgtcgggccgcatgcactccctctccctggaggccggcgccgtgcagtccgtggaccgggtccagaagcagctgcggcgcgcggtgcgtggacagggcccccggccccagcggcccgaggacgtggaacaagcgctgatgctcagcgtgctcgccggctaccccgaccgcgtcgcccggcggcgtcggccccgtgcgcccgagctgctgatgttcggaggagggtcggccacgctgtcagacgtgagcgtggtccaggacgccgacctcatggtggccgccgacgccgaaggacggcctggcaagggcgccgtcgtgcggctcgccagcgccgtggagccggaatggctgctcgacctctacccggacacgctggaggaggtggacaccctccagtggaacgccgaggcccgacgcgtggagcggctcacccgcctgtcctacggcaacctcgtcctggaggagacccgcacgcccgcgcccgcctctgaggccacggcgcgcgtgctcgtggaagccgcgctggccgcggggcccggcaagttcgcggacccggaggccctggagcagtggcgcacccgcgtggccctgctggccggggccttccccgaggcgaagttccccaccatcgacgacaccttcctgcgcgatgcgctggcgtcgctctgctcggacgcgcgcagcttcaaggacctggaaggcgtgtccctgctggacgcgctctacgcacgcctcacctccgagcagcagcggttgctggccacgcatgcgccggaacgggtgacgctccccggaggccgcggcgtcaaggtccactacgagccgggcaagccgccctgggtcgagtcgcgactccaggacttcttcggcatggcgcaggggcccaacgtctgcgcggggcgcgtcccgctggtgctgcacctgctggcgccgaacatgcgcgcggtccaggtgacaaccgacctcgcaggtttctgggagcggcactaccccgccatccgcaaggagctctgccgcaagtacccccggcactcgtggcccgaggatccgcagcatgcccagccgcctgccccccggccaccgcgccgttgaggccccctcagaagcgcttgtgcatctccaggtgctccatgccggcttcctcgaagacaccgccgaccggcaggtagccgtgcttcttgtagaactccagcgcgtagagctgggcgtgcagcatgatgccgttgacgccacgccgacgcgcctcttcctcgagggacgtcagcaacatggagcccacgcgcgccttgcggtgcgcctggaggacggccatgcggccaatctgaccccacgtgccttcctggttggccggaggctgcgtcaacatcaccaggcgccccgtgccgatggcgtggccgccctggttggcgatgacgtggtaggcgtgcgcgtcctcggcgtcgcgctcgatgccttcgggaaccgcctgttcctcgatgaacaccacctcgcggatggcgagcgcctgcatgagctccgcctcactctgaatctgagtgatggtgacgggcgcggatgtatccgtgggagaggccatgtcgcgggcaaggtacacaaaagcccgcgaggtcaacaggcggaaaaagcaccgtggcacgccggggtttgcgccccgtaccccgcccgcctgccgtcacgggcgggccacacggtgggtccgtgcgccgtgctaggctgcaaggcgccatgcgcttcaaccgactgctcgcactcgccctggccctgtcggccatgcccgccaccgcccagccagagctgttcttcggcaatggtcaggcccccgtcttccgcgaggaggacctggacaagcgcttcgcccggtccaagctgaaccaggggctcaagcaggggacccaggatgccggctgcgcccaggtgctcggggccatgctgacgctgatgggtgaaaccggtgtgctgctgcacaagcgcgatgagaacttcatgctggacccggtgctggtcaacgccctcaacacccagctcgtcaaccagcgctttcccggcaacgccttcctcgtcgccatggtgcggcgcgtgctcatcgaccggaaactgccccaggagtggctggtgacggcgcaagccctcgcgccctactacccggccatcgacatgggacggcttcgcttcctcgccaacggcgtgcagcccctggatagcttcctggtcaccctgcccgccctgcgcgagcgctacgcccaggaagtccagcgcgccacatccgtgggcgcgtccaccgccgaggccctcttccgcgagaactacctggaccacgaggtcgccttcggcgcgctggagctggtggacgtcaagctcgagaagccaaagaagaagcgcctgaagaaggacgaggagccagaggccccctacatgctggcccggctcttgtgggtggagcccgaggcgccgacgacggagcgcttcgagttcaacttcggcaaggcgcccaagcgcccgcgcgtggagatcaccgcgaagctgcaggacacgcagtacacggacctcaacaagctgctcaagggctcccgcgtcctcgtgcggggccgcttctgggagtacaagaagggcctgacgtccatcgagctgcgcgacgcgctgatcttccccgagcgggactggacgaagacgccctccctggcggacccggccgccgtggcctcgtgccccctggccgtcaacgacctgaccggactggcgcccatgcagcccggcgccttcggcacgcaccgctgacgcgcatcccacgcctggacacccgtccacccggcggtaccgctttccgggagacgggctgaggcgcttctcgatgctgggcgctggcacgccccctgctccgctccccgcgcccaccgcacgagggatgccatgaaggtcgacagtcgcgagcccaccagcggctccggacagacgaagtcatccgccgacggagagcgcttcaagaaggcgctcgacgaagcggacgcacgcagcagcccacccaggccccaacgcttgggactgaacccccgaagcgccgcgcgcacgggccccacgcccaccctgctggcccgggcctcggggcccgtgctcaccgcccagcgcggcgctgtctccagccccgagagcctgggactcaagcggcaggcgatgaatgtcgaagtccagcggctgggcaccgtccggagcgagtcccaagccctgggccaggagcgcaccgaacaccggctccacgacctcatcgcccgcgagctgtcgaaggacctgcgccccgcccttccagtccagcccgaagcacggccggctcccgggccgccgcctccggatgagaagaggcctcttcaggaaccaatgggctcggagaacgccacggcggtgacggcgagcgcgggaggcgcgcacgccccggccgaggaagtgacccccgccgcacgcgccgaggccgcaatggcgctcatcgagcgcatcgaggtgttcgtgaagtcccagcggcccgcgctcagcatgagcctgcgcgggcacctggacgccacggtggaggtcgaacgcacgggcccgcgcgaagtgtcgctgcgcatccagggccggcaccgccctgtggcggccgaggacctgagccggctgcgcgacgcgctggaatcgctcgggttgaagctgagctcgctgcgcgcggagtagtcccccgcaacgggagangccctctcgccgtcgggcgaaagggccttccgggacacgcgacggtccgtgggttacgagcccggcgccggatccagcagggagcgcttgccgtccttcgacttgaactcctcggcctcgggcagcgcggacttcttctccgcgatgttgggccacttggtggacaggtcggcgttcagcgccttgtattccttccactgctccgggagttccgtctccgggaagatggccttggtggggcacaccggctcgcaagcaccgcagtcgatacactcatccgggtggatgaccaggaagttggcaccctcgtaaaagcagttgactgggcacacctcgacacagtcggtgtacttgcacttgatgcaagggtcggcaacgacgtaggccattgaaaagtctcctctcggttgaaaccaggcgcgtccgtgggcgcgcagagtagtggttcgagctgacgatggcactctgaatctgtgccaccccttcgccggtagcggggctcagcccaccaagccctgggccaacagcagctcggccacgaggatggcgcctcgcgcggctcccatcttggtgttgtgcgacaccagcacgtacttgaagccgttctccaggacgccatcctcgcggatgcgtccgacggtggtggccataccgccatgcgtgtcccggtccaaacggggctggggtcggaaaggatcgtccagcacttcaatccaacgcggtgcggcggacggcaggttccgagccagctcggcacccttccactcccgcagggtctgggtcacttcggccacagtcgccttcttgtccaatgagacgaagacggactcggtgtggccctccatcaccgccacgcgggtgcaggtgcaggacacccgaacgtcatgcggcgtgaggccgtcacccgctggacgcagcgcgccgagaatcttcttcgtctccacctcgaccttgtgctcctccttgggaatataggggatgacgttgtcgaggatgtccatgccgatgacgcccggcgagcggccggcgccggacatggcctggaggctggtcatcagcaccgccttcaccccgaagcgctccaccagcggcgccagcgtcaccgccaggccggtggtcgtgcagttggggatggggacgatgaagcccttccagccacgccggcgctgctgctcccggatgaggggcgcgtgcgcggcgttgacggggggaatcagcaacgggacgtcgtcttcgtatcggaacgcgctggcggcggaaaagacggggatgtccttcgccagccgaggctccagctcgcgtgccacgtccgcctccacggcggagaagaccaggtcgtaatccttggcctcgagcgcgtcaccggccaccaccttcatgccggcgagctcggcgggcagcggctccgggacgaaccaggccgtcatgccactcgccgttttcagcgcctccgcatacgtcttgcccgccgagcgaggcgaggccgcgagccccgtcagttcgatggaggggtgattcttcagggcggcgatgaattgctgtccggcgagtccagtggcaccgatgagggccgcacgaagcctggccatgggggcgtttctccagtctccagaggaggatgtcgccgctccataacaccgtttgacgacgcaccgcacccaccctggtgctcagcggggaatcgcggcgacgggcgcccgggtgtgccgctccgtggggaagccacctgtgacccacgcgagcagtccgccgtcgagacagacggcctcgcggcccttcatccggagcaaccggcagacacggcgcgcgtcccttccgtccggcgagcagccacacaagacgatgagttcgtcatccgggagcatgtggtggtcgcgggcgatttccgcggacgtcatccgcaaggcgcctgggatgtgcaggtcgtaacgctcccaatcggcagcgtcgcgacagtcgaggacgagcacttcgtcgtcccccagacgcatgtaaagctcggcacagacgatgatgggctccacggtgacctccgcggggtctcttcgggtaacccagagctccaagggcctcttcccacgccgcccccccgcctgccctccacgtgacaggcggggcgccgtgccgcaccgcgctcccgccctacagtccgagctgcttggcgatgatttcgttcatcacctcgctggtgccaccgccgatgggccccagccgtgcgtcacgccagtggcgctggatgtcgtactccatcatgtagcccgcgccgccatggagttggagacactcatccgccacgcggcagcacgtctcggtggccaccttcttcgccatggacgtctgcgccaccgcccactcaccggccacgtgcaggcgcagcgcgtggtaggtgagctggcgcgccgactcgcgcgcggtgaagagctccgccagcttgtggcgcaccacctggaactggtggagcgactggccgaaggcacgccgtgacttcacctgcgccagcaccgtctccagcatgtgctccatggcccccaccgcccccagcgcgagcgacaggcgctcccactggaagttgcccatgatctgcgcgaagccctgcccttccacgccgagcaggttctccgcgggcacgcggcagtcctcgaagaacagctccgcggtgtctgaggcgcgccagccgagcttgtccagcttgcgtcccacggagaagcctggcgtgcccttctccaccaccaccatggacaggcccttgtgacccgcggacggatccgtcttcaccgccagcaccacgaagtccgcgcgcacaccgttggtgatgtacgtcttggagccgttgaggacgtagctgtcgccctcgcgccgagcggtggtgcgcagccccgccacgtccgagcccgcgtccggttcggtgatgcccagcgcgccaatcttctcgccccggatggcgggggccagccagcggagcttctgcgcgtccgtgccgaactgatggatgggccccgtggagatggtgaactgggcccccagccccgcggacacaccgcccgagccacagcgccccagctcctccagcaacaccgcctcatacagctcccccgccgccgagcccccgtactccaccggatacttcaggccgaggaagcccagctcgccaaagcgggtgaagagctcccgggggaacgcctcccgggcctcccactccttcacgaaggggagaatctccttctccaccaccgcacgtacggtgcgacgaaacgcgtcatgctcttccaggtacagcccttggccgtgaagcatctttcgagcacctcgtcctttcgggtgcccgtacgcacgcgcacccggggtggaaccttctggtaacggcatggtaatgggacgcatgcacagcaggcagctgttgcatccttgaccgcacggtggcgggctgcgtataaagccgaccccatcctctcggcgccatagccaagtggtaaggcaaaggtctgcaaaaccttcattccccggttcgaatccgggtggcgcctcaaagacacaaggcccggtgcggaagtcactccgcatcgggccttgtccttttcagggctgagtggacaggtcagcagcccagctccaccgcgccgatgtccggccccccgccgcagaacgggatgccgatgtcgacgcccgagtccagcgccatgggccccggcgcgaacgccgccccgaggtctgccgagccgaggcgtgaggtggtgtcccccgaggtggactggtaggccgtgaggtccacgggcttgccgtccttcttgaactgggcgcctgctgggaagaggttgttgcccatcttcatccccggggccatcggccccatgttcaccgcgatgggggcgtccgcgaagatgttgttctgcaccaccggggactgggtggggccaccggtgccatggccgatgatgagcgccgtgaccgcgcgggtgacggtgttgttcaccactgtggtgcccgccgagttctccaggcggatgcccgtgccctccccgcctccggcctcggtcatgtcgtacacgcgattgcggcggatgacgacgccggtgggcacggcgccttcacgggtgccgcccaccgcgattgcccttcgcgccgtcgtagatttcgttgtcctccaccagcacgttgctcgcggagtagtggatgacgacgacatcaccccgcgccgtggaggtcgggaggaagcggtgcatccggttgttgcggatggtcaccccgtagcacgtcttgatgtccacggcgttctcgcggttgccgtagaagtggttgttctccaccagcaggttctccgcgggcggcaggttgctgaagccctcgggccccaggcactgcacggagtcacccgagttgtcgtggatgtcgttgttgcgcacggtgacgtcgcgcgacgtgggctgcaccacgacaccgtgcgagtcctcgttgtcggtggtcttcacgaagtcgtagatgtggttgttctcgatgatggccccggtggcgttgttgaacgtcgtcaccgcgccgccgcccgtaccaccgtgcaggtccgagttgacgagcatggagcccgtcacgtcgccctcgaatgtgacggcgaagggcgtctggccctccatatcgatttcgaagccgtcgatgatccaatgcggctggcgcacctgcatcagcccgtgctcgccggggcccaggacgatgcgcgggctgccctcgccctggagcgtgattttcgcgtcggccgtgcccggcttcgcgttgtcaccgatgatgacgcgctccgcgtaggtgccgggcaggactcggatgagctcacccgggctggccacgccgatggccttgttgagcgtgcgcagcggctgcgcggcgctgccgtccccggcgtcgttgcccgacgtgctcaccacccactcacgggtatagacgggcgcctcggcggcgacggccatcgccgtggcgttgacggccggttggggcgaagggtcctcgatgttcacgtggtccgtgtggtccggcagcgcggccaccggagtccccgccaccgcctgcacgccgacgggcggacgcgtggcgaaggtttgagtgggcgtgggcgactccgccggcccaggcgcgggtgtgggcacggggcgaggggtcagcctctgaacgggctcaggcgtccctccactgtcggagcccgagcaggccaccgagctcagcaggagcaggctcgcagccaggaacatcagcttcaggcagttgccgtggcggattttcatgagcaggggcaacgccggaagccctgtgcgctattcatcccctcgagtcccgacacgtaccagcccgcctgcccggcgggcgcacgacgaacggtccgtgacagcctggaggtgcgactgtacggtgtcgccccccgtgcgccacgccgtcacacagctcctcgccgccgtcctgctctccgcctgcgtggcctcgaaacccgcggctgacagtccccgagcatccgcga

SEQ ID NO: 1071 - DNA, 12028 bp, Myxococcus xanthus
acaggcagccttgtcttggcaccagtgtgcgcctgctccaaggagggggaggcgagaccctgctgcccagtgccgtcaacgctccgtaccgttcccgactgtgctcaccatgtccggaacgggtgctcaccatgcccggaacgggtgctcacctcgggccggaatcggtgctcaccatgcccggaacgggtgctcaccatgcccggaacgggtgctcacctcgggccggaatcggtgctcaccatggtccggtacacgcaactacggccacagggggctgctgggtgaaggactccaccgtggcagcactccctcagcaagatgggtcagcggcacacgggagcgcgtcgcggcgaccgcgcgatggccgcgctatcgtcgcgccaatgatgagctctctcgacttcacttcctggcgtggcctcgcggcgacgctgaccagcctcgtgctggtgtcgctggtcgtcgtcagcatccgcctgctggtgatgcagaccgtgcagcgccggcgcgaacgcgagaaccgccagatcaacgagcggctgaagacgctgatctccgcatacaagacactcggcggctcattcaccggtgagctcgtcgtggacccgactcatctgcgggacatgcgccgtcggctcgcggctggagagccactcgaacaggagcccgaccagggcctcgtgcttgcgtcgtcgctcgaccacccggcgctcgaacgccgtcggcgcacgcgcgacgcggtcgaggcggcgctgtcggatgtgatgctgctcggcaccgaggagcaggtgcggctcgccgcggaggctgccgcggacatggtcgccgggcgcaaggtcggcaccgcgcggctggtcgtatcgctgcgcgatttcatccgccgggcgctcgatctcgagcccatccctcacggactcgcgattcccgaccagggccccgtgcgtcccagcggcggaggagggggcaagggcggcgacaagggtagcggaagagggggcggcggcggaggtgccggcggtggtggcgctggaggcgtcggaatgggcggggccggcgtccatgcggacaccgacgacactgaagacggccatcgcgcttgaacccggagtcgagtttcatttctatccgtaaggcgtttcttcgtgccgttggaacggataggcgagctgacccaggtaggtctctggaggctggaacttcgtcgttccataccgtgacggccagtgctcgggcagatgcgcggtgccgaaaatcacatcaatgaaggacaggaagacagcgaagttcttgtcgatgccttcctcgtcggacgtgtggtgccagtggtggaattcgggcgtcgcgaacacccaacggagatagggccagcggtggctcacgttggcgtggatgtagacggcgtggaaggacacgaaaacgaggtagccgtagatggcggccgggctgaagcccagcaggaacaccggtatgaaccccgcgaaccggttgacgagcacgtccaccaggtgagagcgcgagctggccagccagtccatctgctgactggagtggtggatggcgtggaacttccacatccagggcacctggtggaaggcgcggtgcacccagtaactcaccaggtccaccaccaggaggatttcgaagaattgcagccacacgggctgcgcggccacatgggcctggaagtccatgcgcaccgcccaggagaagaagacctgcaccggaatcatcaccgagaaggagatgagctgtacgcccacgtgactgacaaagaagtgcttgaggtctgtctgccagccctcgcggaagatgcgctgcgggtggagcccccacagccgctccatggggatgaacaggagccccaacacgaggagctccagcgcgaaatagtccaggcccgcgctcagggcccgcggctggtgggtgagtggctccgcctggctgccgcccagcagcatggccaccagcgcgagcagcatggcgatgccgccatgcgccttggagcgcaaggtgagcacgctgagtgcgcccagcgcgaaggtagcgacgatggcggcctggaggatgccccggaacacgcccaggtgctccacgtagaaggcccggccgtcgttggacaccagcaagtggggaaacagaaaacagaattcgacgcagacgcacagcacgcccagcaggccgccggtgacaccagcgcgcttgcccaggttgatgcgcagggcaggagtcaaggggaggtccaagaggagtcttcctgagagagattgccttggggcaagcctattccacttcccgtccgaggccagcatcggcctcgttggctccggcggtcgcgtgtaccttccacccgaggctaggccccatcacctgcgacgcaccactccatccagacaggaacgaatgttccaggacatggctgaatgtcgcgtgtcgcgcgccacatcgcgttgctgactccgggcgtctgcagttaaagcccgctacgttcgccgagcgcatcgacatcggggcggggcccggctctggcgacagggagcgcacatgcgagtcgcggtagtagggtggacgagtctgtggtgcatcgcgctgttcgcctgtggtggtgcctccggaagcgcggacagcgcggagcggggcgaggacacagccgtcctcgcggctacccggaccttgacgtgcgccagtctccaggtcgaaagcggctccatcggctcggggcagactgtccaggggctgcacacgcagacgttgtcgggcacgcaggaccgctgggcggagtacgtcgagttcttccctggcaccttggccacgtgcacgtacgagctccccgcggacgtgggcgccgccgacgtcgtcgccgccgaggtgggcatcaactatcgagggcccctcaagtcgcagatgcgctggctgttcgaggcgtgggactacacggcgggcgcctgggtgctggtgagcgacaacaccttcgcgcagtcctggaggtggaccgccacgtcgctcgcgctgacgtctccccagcgcttcgtcagcggaggtccggtgcaactgcgctaccgcacgacgtccacggcggatgcgtcgctgctggacctgctcgtggtgcgcatccaggtcgccgcctcggacgcgggcacccccagcgacgcggggactcccaccgacgcggggactcccacggacgcgggcacctcctccgacgcgggaacggggaccgaagccggaacgcccgtgtcgtgggagggcgtccacagcttcacctaccagctcacgaactatccccaggggaagctcgacaccatcgccgactcgaagttcgacctcgccatcgtcgagctgtcgcgcgacggctccgatggctggttcaccgctgccgaaatcaccgcgctcaaggccaagggcaagcaggtgctcgcgtacttcgagattggcgccatcgaggagtatcgccccgagtggccccaggtgcccgatgacttgaagctcggccctgtggccggctggcccgacgagcagtatgtgaagtactgggacgagcgctggtggcccatcgtccagggccgcatcgaccaggcgctcgccgcgggcttcaccgggtgctacctggacatggtggtgacgtatgaggagattcccgcgaactccgcgggcaccaaccgcgccgacctcgcgcggaagatggtggccctcatcgcgcgcatcagccagtacgccaaggcacgcaacccggccttcaaggtgatgccccagaactcccccgagctggtggatgaccccgcctacctgcccgccatcgacggactgggcatggaggacatgtactggtccgacgacaacgcctgcgacgagggctggtgcgaggagaaccggacgaacgcggcccgggtccgcgcggcaggcaagctggtgctctccactgactacgccattcaggccgcacacatcgcggatgcctatacccgctcacgcgcggcgggcttcgtcccctacgtctccgtgcgcgcgctggaccggatgacagtgaacgcggggtgggatccgcagtagcggctctggccgtccggcgctccgccacagggggaaggggcgccggtggcggctgcggtgagcgtcaaggtagatgccgcgtgaagggttcatctgatgcgccggaactcctgcactggaaggggggcggattggattggggccgaggcggacggggcccgctggtgtccggtcccgcgtgtcgcggctctaccgctcggggggcgggagcggcactggtatcgcgcgcggtgtcgtcgcgctgggcatgatgccactgaggtcgtgtatggcacgcctgcttccgccttgtcggtagcgctcttgccctccctggtcgccgcttacagggagacgaagtgggagggaccaccgtgcccttgattagaacagggacgttcccaggtccgtgtagtcctcgaggagcatttggaaacgcttcagttcctcggggcgctgcatgccaatgggcccggagcggcctttcacgcgacccgaagacctcggcgaagtgacggtagtcggctgtgagcggacgaccgaagacgtcctccaattcgtccacgagaaagcccaggtagccttcgatttgaccgctgtggccgggagcgtagcgcccgagcaatgcaaggagttcgtccatggttcaggcgcattccttgccgtggttacacagcatttcgggggggcggacctggcattccttgcaggagggatggaatccctgtccgaggatgataggcattgggtgcacctggtggtgcaggcggtgatgggttcgagaggccgtgatggcctccagacatcaaggcgcgcgcacgcgttggtgcccaagcagggcgatgtctgtggttgacatttgagttcttgaatttgtgcaattggggtcaattagggttttgcggctatgggtctggcttgtcttcgttgtagggtggtgggtgtggacgggacgcgttcacatggcaacgccctcctcaggcgtttcgatttctgaggaagaaagaacaacaatgaagaagctactcctggggttcatgctggccgtggttcctgccgtgggctgtggtgtgggcgcggatgatgcgccgacggacaccgtggagacggtgacgaccgagtccggtgagagcatcaacctcgactacagccctctgacatcggaagaggagccgctggcgtcgatgggtgacgcggacggtgaggtctccgcaatggggccgaactgttgggtcacactcctgtactgcaaggaccctcgctacaacgactgggcgacctgtaagcagaacggcaagtgcacaaccaagcagttcgtcgacaactgcctcgcgctctacaagaagacctgctaggcctttcggagccgcgagcgcggtgtgaagagcccggcacccgcgaagggttgccgggcttttcccttttcgaggggcagggtggtgcaagggggggaaagggccgctggagaggccgcctggcgcgacggttcatgcccgtaccctctgtcacttgaccattattaccagccagtaataacactccctccatggacgcggatgaagggctcgtggcccttgggttcacggaggtggaggcgcgggtgtactgcgagctgctcaagggggcgcccgccaccggataccggctcgcgcaggcgctggggaaggcgcctccgagcatctaccaggcgctcgcctcgctcgaacacaagggggcggtactcgtcgaggagggcgagccccgctccttccggcccgttcctccggacgaagtgctcacggcgctccagcgtggcttcgacacgcgcaggcgcgaggccgcggacgcgctgcgcaagctccacgccccggtgcaagacgaccgcatctaccacctcaagagccacgcacaggtgatggagcgcgcgcgggcgatgattgccggcgccaccgagcgactgctcttcgacctcttcccgccacccctcgcggccctcgccccggcgctcacggaggcgagcgccaggcgcgtgtccgtcgtggggcttgtctatgacgaaccccccaaggctcccttcgcctccgtgcgctcgtccagcgcggacttcgttcgggagcgctggccgggcgcgcaactgacgctcgtggtggatgcccgcgagttcctggtggcgctgctcacgccggatggcaccggcgtcaagcaggccatctggagtgacagcgtctatctctcgtgtctgcaacacagtgggctggccgcggagatccagctgagcgctcctccgtccgcgcgcgcgcggatggcgcggtccttctccctcatcaactcgagccctccggggttgcgccagctcgtcgggcgacagccccgttcctcttccaagcgcggagacaccccatgagagccctcatcgcggttctgctgaccctgcccctcctgtttggcccctctgaagccggggcagaggcgctgcaaccgctcctcgcacgccacctcgcgtggcgtggcggggacgccttcacgcagttggagagcatccatgcgacagggaagtccgtgacaggtggactccagggcccgatggagtactggagccaccgggacgggagggcacgccgggatgtggactacggagtgatgcgtcagtcgatgaccatcaccccggatggtggatggaagctgaacgccagcggacaggtcgaagatgcatcgcccaccgacgcgcgcgatgtccggcaccaggtggcgctcgacttcggggcggcgctgcgggggagcgccggcgcgacgctcgcgctgcagcccgacgcggagcgcgacggccgcgcctggaaggtggtgcgcgtcacctttggcgatgaagacctctacgacttgttcctcaatgaggccgacggagccctccacggtctgcgcatccgcgaggacaacgtcacccgcttcgtgcgactgggagactggcgtcaggtccagggcgtgcgaatccccttcctggaggaggtgctcaccgacaacccggactccgactcacgaacggtggtggaggcgctggagctgaacgtccccattccatccgcggtcttcgaacgcccccaggacgtccgcaaggcgatcttcgcgaaaggtcaccacagcaccggcttcatccccttcgagttcttcgacgagaaccgcgtctacatcccagcgcgggtgaatggccaggcgacgcaggtgcttctggacagcggcgccgagatgacggtggtcgacacggcctatgcgcgtgaactggggctgaagacgcaggggcagctcgcggcggtcggcagcggaggacatgcacaggcccagctcgcgggcggcgtggacatcaccttgggcaacctgcgactgacggggctgacggtcgccgtcatcaacctgtccgaggtcgcgcggttgataggccacccgctgcccgtcgtcctgggcaaggagtccttcaaccaactcgtcgtggacgtggacttccccaaccggcgcgtcgccttccatgatgcgtcccgcttcaaggctccgccgcgagcggttcggctcccgctggtcgaatccgcgggcgggcagcgcgccgtccagatctccattgagggccgtccccccattccggtgctcttcgacgtgggcaatggcggagcactttcgctcttccccgcctactggcagcaagccgggctgctcacggaaaggcgcagctccaggacgctgtccggagccgtgggcggactccgggagcgcgatgtagcgacgctgaaggacattcaactggcgggcatcaccctgaaggacgtgcccacggtgttcgacgacgcgggcaagagtatctccgcctcggaccggctcctcggcaacctggggctcgccgtcctcggacgcttccggatgataacggactatgcgacggacacgctgatgctggtccctgatgcccgcgcgctgcgtcagcccttccgcaaggaccggtccggcctgattgccctccccgcggaggggcggctcgtggtgaagttggtggcccctgggagccccgccgccggctcgggttggaaggagggggacgaaatcattgccattgatggcaagcccattggccccgattacgcgggcacggaactcgcgcgttggcgatatcgcgcagcaggtcagacggtgatgctcactttgaaagacggcagcaagcgtcggctcaccctgcgcgactactactgagccgcagtcgagcacgtcactgctcctgggagccggcccgcccaggcggctcatccatccatcaagggggggaacgcgactgcttgtggcacaacaccccgccagcttcgcgggcccctgagccgcggccagcgaagcggaccgcaggggcagggcaggcggggatacgtcggtgcgcggtggctgctggaacgacatcccgtggattactgctcggtgatgatctccacgtactcgtcagcagagatggagttcctccacttggacgagaaccccagcgcgtgctgcgggttcaccacgcggggcgcggccgtcttcgccacgtccaggcgggtgatttcgttctggaacaggtccaggacgaggccgaactgcttcgcggtgaggaaggcccgcgtcatcaccttctccaccatgtcctcccgcgtcagctcgttgcgagtgctcttgagggactgcatgaagccgtggaaggtctccgcgtccattgcgaaatggccgttgcgctgcatggtgcagcccgggtcctggttcgtcccacagtcacggaacgcgggctcggagtggtgccgcacatgtcggacgggcgtctcgcgcggcgcgacttcctcgcgatactcacggcgctctctgcgctcatgtcgccccgacggcggcggagttccggttcccgacacgttcacctccatgcgagcgccgccaccacgaatctccatgttgacgcccgctgcgttgccatccggggacatgccctccacggaaatgctggtcgacggcatgccaatgtcatcggcatggatgttcatctcgacgtcctgggcgaaggcggaggaagcggcgaacatggatgaggcaagcactgcgcgagcaatcgagttcatcgaactttttctttctatatgagaagccggtgggccgcgttggggcgcggggagtcattcaccgactggcccacctggacgcacctcagggtggattattcacggctcatttgtcgactaaaaagcctcgcttgctcgtgatgtcgtgcccggcgtagggcgccccgagccatgcgtcccggaccgcgatttttgccgacgattcaatgcaacggtgccgcccggcctgtctcatccattcgagaggaggcatttgtggtgttcggtcgctgcgtctgcgccgctaccttggataggcgcagtcaccacatcggttcgctgcgctacgatttcagccatgagcgcgtcctcggtcgtcgcatgaccatcaggcggcctgcgcctccggcgccccattgcagggccctgacgccgcctatgtatacacattggacgagaggcaggaccctcgtaacgcgtggcccgaaggatgaggggaacgctatctgattgcagcgcgagggaacgccctcaattgacgggcgcgtgctgctggaggaaccgccccacctgcgcccgggcgagctgacggccgaagccgccatcccagatgtcgaagccgtgctccgcgtacggcagcgtgaacagggtatggggaacgccagcctgggccagtcgagcggccatcgcttgcgaggcgtcgagcggaacgacgctgtcggccccgccatggagcaggagtgtgggaggggaacgtggcccgacgtggttgatgggggagagcagctcatacagctcgcggtggccttcctgcggcacacccgtgaagcccacgagcggagcaggggcgctcgcggcgtaggccaccaggtcgctgggcgcgtagaagctgatgatggccgccaccgacgtgtccccgggggcgcaggaggacggaaggcgagcatctccctcggtgtaccccgccaggctcgcgaggtgcccgcctgcggactctccgaagaggacgagccggtccgggtcgataccgtaggtggccgcgtgatccttgacccagcggatgccacacttgacgtcccctggggccttcagtccggtggcaggaggaaagagccggtagtcgaaggagatgagcgcatatccccgcgcggtgaggaagtcggcccaggcgcgggcgtagccgcgctctccgccacgccagccgcccccgtgaaagtagagcacggcgggacgggccctggtggcggaggcatcgggaaggaagacgtcggcgtgcaggtcgtgcccctcgaccacggcgaaacgaacggtgtggctcgggagggggcgggctccgacgaggggccggaaatactcacggaggcggagtggagtgtcggccgccctggccatccgccacgcggaggctgcgggccacaccgcgaggatgccgacgagcagtgcgcatgccgccgtcccccagcgcagccatctccaaacgtccacgtgggaaatccagacggccacgagcgccgtgaggagcgccggcaacagcatcgccaggctgtattccctcacgatgcccttgagcaggtggacgagcgtgggcactccagcgggagcgaagaagacggccgcgagcagcacgcagcctacgatgtgcagtatcgccaggagggtcggcatgggcgggagagggctgggcggtgacgtcatccggcaagaggggcagaccgtcacattccaaggaacatgcccccgctgcaacgcgaaacgcgcacggatggcggcgccgcaccggctcagtcgaggcccggcgacgacacgagcgcgtcgagctgctccatcgtttcgcgcaagccgtgctccatgccggacgcgaggacggcctcccgcacttcctttgacggatacagttcgcgggagaccatgtgtgtctttccgtcgcgctcgtcgaaggtgacggtgatggtgaccgaacccgcgtccgccatcggttcgaagacctgcgtgtacacgagccgcgagggcggagtgatttcagcgtactggccggagaaggccacctcaccgccgtccggattgcgcagcacgtaacggtagccgccgccaacgcgcacgtccgcctcgcagctcgccatggtgacgccgagggccttcggcgcccaccagcgcttcaccaggtccgcccgagtccacgcgtcgaacacgatgcgcgcgggcgcattgaacttgcgagaaatgacgatggtgcggtccgactccaactccactgacgtaaggctcatcacttcatcccttcttctttcgagcatgtcgctgcgctgcttccatgtcctgcgtcttgagttcttcgatgagcgagtcgagctgtcccagccgctcgtcccagatgtcgcggtagcgctccaaccacgcgttcagctcgcgcagcggctcgggccgcaggccatagagacgctgctgggcgcgcgcctccacgtccaccagccgggcctccttcagcacgcgcaggtgcttcgacacttgcggctggttcaggttcagcgcttctccgatggcacccaccgagcgagcgccccccagcaggtattccacgatgcgaaagcggttcgggtcggcgagcgccgtgaaggtctcaatcacgaggatgtatattccttgtcggtcatattcccgtcaaggaatattgcgtgtgcaggccgagtcgagagttcgaaccgcggaccatgagctcgggaggagcggccgcgaactcagagcgtgcggccgccgtcgctcagcaaggtcgtgcctgtcatcagcgcgcagtcatccgacagcaggaagccaatctggcgcgcgacctcctccggtctggcatcgcggtccaggggcgtcgccagggcggcgagctcggcgaacgccgcatcgcgctcatgctcgcgccgagtcggccggacgtagagcac

SEQ ID NO: 1072 - DNA, 11963 bp, Myxococcus xanthus
tgtgctctaagggtgagcttcacccggttggcgaaggggcgccaccccgccagcgcggccacctgggccacgccgtagaggaccagcgaccagatggggagctggcccgacaccgccatggaggcgaaggcggacccggagcccaggtctcgcagcaccagcctcagccgcgtgcccttcctcatgccgcctcctcgccaccgcgagggcgctcgtgtcccagccacgccagcgcccgcagcaggcgccgctcctgggccgcgcccgcggcgggccggatgcggtcctccggcgtgtccaggcccacctcgtgaccttcctcgatgagccggtgggccagggcggccacttcctcgcagcggcgctcgagcgcctccgcgtcgagtccgtccgccaccgaaagcacgaaggtgcgccgctcctcgtgctcgcgctccacgcgcagcagcttcccggcggaggcgctcttcatccagtggatgcgccgggcgtcctcacccggcgccagttcgcgcaggccgttcaggtccccattgccgtcattgcggcgggggttgcccgcgtcacccacggggccttgctccggcgcgcccgggtcctggcaggcgtaggtccgccgcgggtagatgagcagcgtgttttccagcggaaaggtgcgcgtcttggcgaacagccccagcggccaggtggtggtgacacgaacgcccgtgagcagcacgggcccacgctggggcgcggtgaggtccgctcgcacgacgtggtccacgcccgcgggcaggtaacccacgccgcccgcgccggtgagcggcgagtccgcctccgacagcgtgagggcgaaggcgtggccctggccgcgggagatggcccaccggaaggcgaagggctcctgggcgaaggccgcgtccgcgcccacgcgccgcaccgacagatagcgcaggcagcgctcggacaggacgcccgacaccaccaccatgctcagcagcaggcccagcagcaggtagaggaggttgttgccggtgttgagcgcacccaggcccacgccgaacgtcaccaccagataggtgcgtccgatgcgcgtcaccctgagggtgcgcggcgggcggagccgcgagcgaagccgtgcccaccatgacggcagccggggcttcaccggggcgccgggacctttcgggcaatctcctccagaaggtgcgccgcctcgtcgcgcgcggacacgccctgcacggcgctgcgcagcatgatgcggtgggcccagcagggcaccagcgccgcgcggacgtcaccgggcgtggcgaagtcccgggcgtcccacagcgcgtgggcccgtgcggtcgcgcccagcgcgagcaccgcgcgggtggaggcgcctcgctccaggtcgccgtgcgagcgcgtggccgtggccagccgcaccacgtagtccgcgaccgacgcgtccaaccgcagcgccgcggcgaacgagcgcagggacgccagctcctcgggctcggagacggtctccaccgcgtccagcggcggtgtgccgtcgcgggtgacgagcagcccggcctccacttccggcgtcgggtggcccagggacatgcgcaccatgaatcggtccagctgcgagtccggcagcgggtaggtgccggagaagtccaccgggttctgcgtggccaccaccgtgaagggcgcgggcagcgcgtgcgtggcgccgtccagggagacctggccctgggccatggcctccagcagcgcggactgggtgcgcggcggggcgcggttcagctcatccgccagcaccagctgccggaagaggggaccgggacggaactggaaggtggccgtctgcgcgtggaagacctgggcgcccagcacgtcggcgggcatcaggtccgcggtgaactggacgcgggcgaagctcaggccacaggccttggccagggcctcggcgagcgtcgtcttgcccacgcccgggacgtcctccagcagcacgtggccgccggcgaccagggacgtcaccacgagctggagttgggaggattttccctgcaccgcgcggcccagctgggtggcgatgcgttccatcgccgagcgcgcgtttgcgggggaaggcaccggggagagggcgcgggcaggctggttcatctgcctccactgtagccgactccctcgattgccaacacgcttcgcgtccgggcttgcagcgcggacgctccctccctcccgaggcggcgaagtacctacgccaggaagacgtcctcgggcgtgtagtaggcagggcgcggcgacgtccctgtgcccacaccgaagtaccggaacatccgctcgtggtgagtggccaggccgcgcagttggacggggcgctccaccaggcctcgcgtcaggactcccacggcgctgtccttgaactcccgcaggtgggcgaagtccagtacgacctcacacccactcagggcgctcagagaggtccggacctcttccgccgtcttgccgtccagcgtgccttccagtcgcagcgtcacggaacctgcggactcctcacggtggatctgtagccccgacattgctgtgctctccaagttggcgcggagccttggttggagcgtcatcgcttccgtccttccacggaggacccgtggggttctcccgcccggcgcacagtgcacagggttcgcgcgtttggttaccccccacatcgcaactttctcgcgactgtcgtgcagccgtcgcatggcttgttgctcagcgctcagctcttctggccattcgtcttctgggcctctcgcagagtgagctgcttctcctgagcggccttcagcttgcggaattccttcacgaccttggcggggtagccggccaggaacttcgtgcgcgcttccttcttggccaggatgcggcgggccagcccggggccggcgttgtaggcgaccagggccttctccacggtgccgaagcgctggatgaggtccgccaggtacgcggtccccagctccacgttggtctccgagtcgaagaggttgctggtgcggcccagttgcaggccggccttgtccgccagccaggtgccggtgtccggcatcacctgcatcaggcccatggccccgacgtgggagaccgcgtagttgttgaaggaactctcgcagcggatcactgccaccaccaggagcgggtcgatgtcgttgcgagccgcctcgcggacgatggccaccgccagccggcgctgctgccgggcggggagcccagaggccttcaccatctccgtgatgcccagggcctcggcctcggcgtagtgggcctcatcctcgtagaggtgcagcttcgccagggtcgccttcaactcggcgtcgcgctcggccagtttcgcgcgcagctccgtcacctccggcccctcgccctgggcgccatccggcacctgcaccggaaacgcgaccgcccccgtccccaccatccaagccgccaccgccaccgtccaacccctcatcccacccctcctggcgccgccgtgccgctcgcgccccgtgcactcatctcgtacggatgtactgacctgccgacggagcaacgcctaagcagcccgcgtgccagaggtcgcacgtggcgtgtttctccttaagagcgcccacgaatttgccgtctctggcgcgctggattccccggcggaactgaaaaaatgcccggctggggaagtgccgttcccaacgggtgactgtgaaaaggaccgggttgcccgtccgggttcctgttcctaggtttgcccgcgccaggctgtggtgcgtgtggaggtgcggcgtgtactggacgatgggaatcatcctgttggtgttgtgggggctggggctgaccaccggctccaccgagggttactgggtccacctgctgctgctgttcgcgatggtggcgctcttgctggcggtggtgtctcagggccgccgggcggcctcggcatgaggcgcggggcgcccgaggtgacgggggtggagctgccccgggactccgtgggcttcacgcgccgcgagtgcccggagtgtcagcggcccttcaagacgcgtccggggcccatggactcgcgcgcggtgctgcacaagctcctgggcttctaccccttcgagaatgcccacgagtgcgtggagggcattcccgtctggggctgcccgtactgcggctaccgcgcggaagcggacgcctttctcacgcccgcccagcaggggcacctggaggccgtggcgcgcggctgggccaaccacgtgcggtacgagcagctggcgcacgtggcgcgcacgctgtccgtcaaccccaggccgacgttcgttgcggtggagccggaggccctgccgggccccatggagccagagccggacgagctgctgcgcgtcatgcccatgctctgttgtggcgaagaggtgaaggtcatctgggagtgggaccaggcactccactgcttctcctgcggcgcgcggcatgatccgatgagcggccgccagcaggtggagctgcgcttcgtctcggagtagcgcccggggtggacgcgggcgggcggtgacggcaggctggaggggacatgacgtgggtctccccccgggccatgctcgcgtgcctgctcttggccgcgggcgccgccgccgcgcacgacgccgacatcctctatattgaagcgcaccgcgcccgggccgaggcacccgaggtccgtcagattctgacgatgacgccggagacgctggccttgctcctggccgacgcggatgggggctcgctcctcacgcggcatggactggacgcgcggcgtgacgccatcgccaccgacatctgggatgcgatgccgctggcttccggagggttgccgtgcgtgcggaccgcgcacgccacggcgccgaggcagtccttcgtggaactgtccgccaccttcacgtgcccgccgggtggaatgcgccagcgcttccgggtgctgacgcggctgccgccggagtaccgggtgattctgggcagtgtgagggaaggggaggttcctggtgccgtgttcgcggatgccacgcggccggaagtggacgtcccggaaggcggacgcggcacgccgctgctgagccgcttcgcgggctgggtgggcctgggcgtgcgccacatcttcgagggtgtggaccacctggccttcctgctggccgtgctgctggtggggggcggctggaggcgggtgttgctgctggtgacgtccttcacggtggcgcactcgctcacgctgggggccgccgcgctgggctgggtggtgttggacggagtccaggcccggtgggtggaggccgccatcgccgcgtccatcatctatgtggcggtggagaacctggtgctgcgcgagcaccggcaccgggtgctcgtcaccttcctcttcgggctgatccacggcttcggcttcgcgggcgtgctggccggctacggcctgggcgagtccgtggtgacggcgctgctgggcttcaacgtcggtgtggaattgggccaggcggtggtggtggcggtgctgctgcccgtcctccgcatggtccagcgccgtccggctttgcacacgagggccgtgaggggactgtccatcggaatcctcgcggctggtgggtactggatggttgaacgcgccctcggttgaatcccgcgctcggcgtccctacgttggcgacttgaaggtagggaacagggggacgtcaatgggtgcgaggcatacccggttggctgcggcgctggccgccgcgtgggaggcggaggtcgtctccgcccggcggatgacggcgctggcggagcgaatcgtggatgcgagggtccgggcacggctgatggtgttggccgcgttctgccgggctcacgcgtcgcgattgctcgcacggctggccgcgctgggccgaggtccactgccggttcctcccgaggacatcgagctggattcggatacgttgctggaactgcgccgcgagggggccttcgcccgtgcgtcggccgcccgctatgagacgaccgcggagctggcccgtcagcaggcggacctctcctccgcgtgggtctgcgagctgaaccgcaccgaggagcaggaccgctcccgggagctgctgtccctgggcgaagggggccctggggcccgtggtccacgccgacgcgccggccagcgccgccccgggtgactcatgagggaatgacatgggtttctcgctctgccggtgacagttaccgtgcattgggcgtagaaatccgttcatggcgaaggagagctacaacgacctcatcttccagctgggcgacctggctcgggacaggttgccgggcaagcccacctgtccccgttccatggaccgcgtctaccgcgccgaagaggcggtggtggcgcgccgggatgaactggcggcgctcgagcaggagatgaatgacgaggacgcggcgtattcggactttctcgccgagcagggggaggagcgggcgaagcacgccgtcatcgtcaagaagtggaagaaggcggtggacgccatcgacggcaaggtgaaggagctgcgcaagacgctcgcgtctcgcaaggccgaacagcgctacgccgaggatggcctggtcaagctcgagaagaagatcagcgacatggagctgaccggcgagccgcccgacaagatcgaactggcccgcggcaacctcaagaagaaccggctccagcagatgcggctcggtcggcaactggaggatctggagtccaacctggccaccgccctcacgcccttgcccggtcagcccggcgcggcaggcatcctggcgcacaagcgcatgctggagatggaggacgaggcggaggagcgcaagctcgaccacgagcaccgcatggcggagctcgaccaggcaatcgccgccaaggaggaacaggtccaggcctcggaggattatctggatcaagcactgttcctcctgggcgaagacgtgtatgcacagcgcatcaacgatgcgcagctcgcaccgttctacccgcggttggatcgcgcgcagtgagagaggcacccgcccgtagtgcttgacggcggagacctgtctgctacattgcgccgcttcctggcgaccgcggggacgcgtgcagtccaggtcattgaacttattgggtttttccgcgccaccagcgcgctggcagtgaggacgacgtgaagggtctgattggcaagaagatcggcatgacccaggtgttcaacgatgagggcaacctcgtcccggtcacggtgatcgacgtgggcacctgccaggtcgttggcaagcgcaccccggagaaggacaactactccgcggtgaccatcggttttggtgagatccgcgagaagattctcaacctggccgagcgcggtttcttcaagaaggccaacgcgccttaccgccgccacctgaaggaattccgcgtcacgccggaggaggctgcctccttcaacgtgggcgacgccgtcaaggcggacatgttcgccaagggcgagctggtcgacgtgaccggcatcaccaagggccgcggtttctccggcgtcatgcgccgctggaacttcaagggctcgcagacgaagacgcacggtacgcacgagtaccagcgtcacccgggcgccatcggtcagcgtaagacgccgggccgcgtgtacccgaacaagaagatgcccggtcactacggcgtggatcaggtcaccacccagaacctgaccgtggtggacgtggacgtggagaagggcctggtgctcgtgaagggtgccgtcgccggccacaacaacggcgtcgtctacatccgccccagcatcaaggcggccatgcgcgcgcagcacaaggccgcgcgcggcgcgtagttcgctgctgagcgtttgaacgctcgaagcgccccgcttccgggcccgattcctcgggcatccgggcggggcgtttgtcttgcggggcagggtgcgtgcggtttccgcgggtgggcaggtgtctgccccgcgtgacgacccgcatgcctgcttcatcacgtcccgtgccgtgggatgccccggaaacgttgaccggtgggcgcccggtgggaacgaccgtgaaaagaattccgactccaggccacctcggcttgtcggtcgtggaagccgtgcgcacatccaggccccacgaaggagtctgagcgtcgggtgacgcggactccgtggctcggggagttcattgcactcccgctcatggcggcccatcccacgggccgggcaggattatgatcgcacgcacgctctgcgtctttgcttcgttggccgtctctctggcggcgccggttgccgcggcacaggacgacgagaacgtcctggacaaggtcgtcgtccgcaaccggctgtacgaaccgggcggcaagttggagatgtccttcggggtcggtctgccgctgcagacacacctgacggcgcactacgtcttcaacgccggggtggcctacaacctcttcaacagcttcgcggtggaggctcgggccggctacgcggccagccgtcatacgggcctggcgcgttccatctccgagagcttcctcaaccgcgaggacaagcgcgtcaccgacgagctggaagacctctggcagatgaacctgcacggggtggcaggtgtccgctgggcgcccatctacgggaagctcagcctgctgtcggacctgccggtccacttccaggcctacgtctgggcgggcgggggcctcgcctcgttcaagcgcaactccgtgatccagtgcacgcaggtggtgaaccgcgagctgggcatctgcgacaaccgcacgtcggtggatgaccgcgggtcggccacccagaacttctgggtgaatgagtcgcgggtcgccccggtggtgtcggcggcggtgggcttccgcttcttcatcctggacaagcacggcgtgcgcctggagctgcgcgactgggccttccgggacaactaccgcgtcaacctggagcgcgatgcgtgggaggcggggcaggcgacgggggagcccgcgcgcagccctggcctcacgcacctggtgcagttcgaccttggctacaccttctccttctaggtccacctgactatgcgaccgttcctgtccctcgcgctccttgtcgccacggccacgcaggccgcgccacgcgtcccggctccggccttcgcgctggcgcaggtccagcaagtgcccgcgcccggtgctgagacgtccgtgccgccaccgtccacgcagtcccagtcgcttccggaggcccctgtcgggcccgcgtcccggcccgagccgctggtgcccgcggaagccacggaagcgttcgcgccgcccgcgggtgtccgccccaacgcggccccggcgcagggctccgacgaggtgcccgcgagcgagccttcccgtgttgacgacaccgcgccggtgccctccgccgagcccgcgcccaccgtggggacggaccccgctcccgcgacgacgggcatggccgggcaggaggcgccgccggttcccgatgatgcaccgatgctggcgtccgacctgggctccgatgcgccgcgcaccacggatgcgcagcagcagcggctggtgaacggagcgccgctctacaaccccaacgtgtcggtgcacatcgtccagaagaagcgcttcgcggacgagggccgtcacgagctgacggtgtacccggccacggtgcaggtgaacgggaagtacaccgaccacgcgggcacggcggcgcactacacctatcacctgcaggagaacttcgccctccaggtgatgggccagtacaactggtactcgaacgagagcgccttcaacctggagctcatcgacaaggtccgtgagcaggcgcaggcggcctcgtcgctgctcctggtgtggggcgcccacgcgggcgtggaggtgacgccgctctacggcaagttcgccttcctcaacaactcgctcgcgcagttcagcgtggtgctcagtggcggcgcgggcgtcggctccacgcgccacctcatccgccccgcggtgacgaacgatgtggagggcgagtcgttccgggtgcccgcgcgcttcggtgacacgggcaccaagttcatgggctcggtggggggcggcttccggctccagttcggcgagtcgtacgcgctgcgcgtggaggtgcgggacctcatctacaccgcgcgcgtggaccgggtggacggctgcaacctggcggacttcgaggcgctcgaagcggcgcgttccaccaaccaggacttcgcctcgctgaacctgagcggcagctgccgctacgagaagttcgacggcatcgacccgaagacgaagaagaactaccgcgaggacatcatcctgggccgagacctggtggtcgagccgtcctcggacgtcctcaacaacgtgagcttctacgccggcttctctgtcctcttctgatgcgcaggaaggcctgaaccgccatgaaacgactgctcagcctcttcgtcgccctggcgccgctcgcggtgtccgcccagcctgattcgggtggctacaaccgcgcgctggccgccttcaacgccggtgacatggacaccgccgcacccctcttcttcgaactcgcggagagcgcctccgacgcggaggtgaagggcaaggcggagtacttcctcggacagtccttggcccagaagggcctgcccgtggccgccttcatcacctatgcggccatcgtcaatgccggaccctcgcacccctcgtatctcaaggcggtggagggactggtggacatgcagcagcaactggatgagcacaacctcatccccagcatcctcaaccaggcctacaccgacgaggtgcgcgaccgctgggtgacgctgcccaaggaggtgctcgcgcgcatcaactacctggtgggcacggtgagccagcgcaagagccgcttcgaggaagcgcgctcgctgctggaggcggtcccccaggacagtcgcgtgtacgcgaagtcccgctacctgctcggcgtggtgctggcggacccgcgcttcccgggccgtcccagcgaggcctccgtgttggacaaggacgcgctggccgccttcaacgcggtactggccgcgaaggaggggcagttggacttgcgcgccacgcagcacctggcgctcatcgccctgggccggctccactaccgccgcggtgagtacaccgacgccagcgccgcttatgagcgagtgccgcgctactcgcgctactgggaccaggccctcttcgagaacggcttcgcgcgctttcagaacgaggacttcggcggggcgctcggcagcctccaggcgctgcatgcgccgcagttcgccggggccttccagcccgagtcgtggattctcaaggcgaccgtctattactactcgtgcctctacgacgaggtgaagacgacgctggcggccttcgacgaaatctacgctcccatggagcggcaactggagcccttcaccggggaggacgtgccgctggtgcagtccttcaacctggtcgcggcggagaaccgccggttgccgcgcccggtatacctgtggcttcgcaacaacgagcgcatccgcgaggtgatgcggatgctggagcgcgtggacgatgagaagcgtgcgctgacgaacggacgctggcgcggtacgccgctggcggcgcagtccaccgcgtcgctcgaggaggttcgcgggacgctgctgcaggtgggcggaacgctggcgcagagccgcattcgtgaggcagcggacaacctgcggaccttctccgaccaggcggaaatcatccgcgtgcagacggccttggatgagaaggacttgttgcaggccggcgttgaccagaaggcgctgctgacgcggcagtcgctgtatcgcccgaagatgccgagcgcggcctggaactactggaagttccagggcgagttctggatcgacgagattggttattaccaatacacgctgaaacgtggctgcccggcgaagaccgctgaacagcagccgtaggttcacgagcgacgctgtcacgcatgcacgtaccttgaggggggccgggt

SEQ ID NO: 1073 - DNA, 17245 bp, Myxococcus xanthus
  unsure (1)..(17245): unsure at all n locations
tcctgctacgtggaggcgctcgacttcacgcgcgaccgcatcgacatgcgcgcggtgcaggggcagtggaacacctttggcatggagcgcgagcgcgaaatcctcatcgcgcgccgcaatggcgtggccgtgggcgccgccgtcctggagctgggccagcagggcaccaatctctacagcctgctcgacatggcacggctgttccccctgagcgacgcggggccgtccacctacgtcgccctggtggatgcggcacgccgttggtacgccgcccgccaccgccgttcgttccactatctctgtgaggacgacggtgggcagtacgtacaggacgccgggattcacgcaggtccggacccgtacatgtggatcatctccgcgaagctgatccccgactatctcgaacacatcagtgaagtctccatcgggcgccgaagcgctcccaacactcgccaggggtaatgaacatgagcaagcaactcgtggaggagctgtacacgccgaacctgactgccacccgtgagcgcatcaagacggacccccggctgaaggtgctgctggatgacaaggcggaccccgcgctcttcgaggcattcctcatcacctggaactcgctgggcgtctacatgacggagccggtggacgggtggattcgccgcgccggtgaggccaccgtaaaggcgggcctggacgacgtgggccagaagctcatcgcccacgccaagcacgaggccggccaccacctgatgatggtcgaggacaccaagcacctggtggcccggtggaacgagcgccgcagccccaagctgaacgccgaggagctcatcgcccagccgcccacggaggcgatgaaggagtaccgggagattcacgagaacaccatcaccggtgagatgcccgccgcgcaggtggccatcgagtacgaaatcgagggcctgtcgacggtgctcggccccgtgattctcgagcaggccaagcgcgtctgtggcgaggaaatcctccagggcatgtccttcctcaaggagcacacggagattgacgtgggtcacaccgcgctcaacgaggtgatgctcaacaagctcctgtcgcaggtgccggacaaggcgcccatcatcgccaagacgggtgccagcgcgctcgacatctacctgcgcttcatgggcgactgcgtggagcgcgccgggaagctggtccagtccgccgccgcggcctgagcctccccgcagccccacttcgcggtcgtagggcgccccggcccgggcgcctgttgtttttccgttcccccgcgtttcagcccgcccgccggacctccgcgccactcggacgcgagtgagggcggacgcggcccttgagcgagcccaggaggtggccccgcttgccaccccctgcgatgccgaacacgtagcggtccggccggagcaccacgaggtcggccgcgtactgcacgaaccaggcgcccagccggccgtccaggtccaccagcgtgtccggcccgccacttcccgcgcggtccgccgcggccacctgccaccagcgtgctccgagttcgtccgccagggcccgtgcctcgcgctgggcctcctgggaagcacctggacgcgtcagcaccacgaagccctcgcccaggcagtcatccagcagcgccgtctccccgtcgggccgctccacgcgcggctgcgggaagtaggagccttccggcacgtcccccttctcgcgttgggcgccgagcatgaagccccggcgcagcggcatctgcggcttcaccttgtagtcgcggatgaagtcgcccgtcaccggcagccggtacatcacctggatgagcgcgttgcggacgcgagccatcacccgcccgcccgacatcatcacccggcccatggcgtccgagccgcgaatcacctccgacacgtggccacgccgctcttcctcgtaggtgtcgagcagcgacgcatccgccgcgcccgcgagcaccagcccgagcttccaggtcaggttcgccgcgtcccggaggcccgcgcagagcccctgccccaggaagggcggcatcaggtgcgccgcgtcgcccaggaggaacacgcggcccacccgccactgctcggacatgcggctgtggtacgagaagatcttgacggagtcgagctccaccgaatccgggtccaggtagtagccgatcagccgccgcacgttctcgagcgagcgcgccgccttcaggtccgcatctggctccaggatgatgtcgaagcgaatctcgttcggcgcggtgcgcgcgatgaacccccggcgcacggggccgcacaggtagctggtgaattcgggctcgggtgagcgcgtcttcacggtgatggccagcgagtgctccagcgccgtcgtccccacgagcttcagacccagccgccggcggatggagctgtgcgagccgtcgcacgcgagcaggaagcgcgcgcgcacgttgacggcacgctcccccgcgacctccttcacgcgggcggtganngctttccacatattggtagaaaggactccacctcgtggcccagccacaggtccacgtgcgggaagcgcttcagtccctgacgaagcaccgcctccatgcgcggctgctggaagaaggccgcgggcacgtagccgaacggccggtccaaccgggtgaagtccacctccgccagcgagcgcagcgagtcattcaggtactgcagccgcttgcacggatagaagcccgcgcccaggtcgcccaccagccccgcggactggaagatgcgctggccctcgtcatccacgctgatggcgcgggactggccatgaggcgtgacttcacgctccaccaccagcgtccgaatcccctgctgtcccaggagattcgccgccatcgctcccaccggaccactgcccacgatgatgacatcaacggactccggagccatctctccctcccgttgcgagtacgtgtgctgagctgcctttgagtcatttcgatatcaaaatcagccacgacctggaatgtcctgttttcactcggaagccggcgtcattcctcaccctccccccgcgttgtctcttcaactcttcaacgtcggctgtggaattccttgcatgtttgagttttgaccttgggagtgaaaggttgcagccgtatcagcaatcacgacgggggcacggcgaggacgacgcaagaatgtccacgtgtcccaggtccgcgcaggaaatgcaggcccctcctcggagggcaggcggccgcgcgggaacacgacatcccggagtggcttttgaaagatggcgaccacgtccgcgggttgagacggcgacccttgtcgggaaatcgccactgaccgccagcttcaacgcgtggcgtcgtgattttcgcgacttgaagaggtcggatgtgcccgaacactgcggcgcgaaggagcacgcacatggaatggcttgagttctcccgttggtccccggaggtcgaaaagcagctggcgatgcaggcggcccgactgggcaccttcgagcaccggggcccgcaggcctcccgtcggtccggggctgccaccaccgtgtcggccacctgccggctgagcaccgtcctgcggcagttcccgcggaccaatccctggggccacccgatctcggagtgctgagacagggcgcccgccccacccccgtgggtcagcggagggcgtgccgtctcaggacggtgcgctcgaccttccccatggcgttgcgaggcagcgcgtccacccacacgaaacgcgcgggcgtcttgaagcccgccagggactgacggcaccacgccgccagttcctcatccccggggtgcggttgcccctggcgcggcgcgacgaaggccacgggccgttcgccccagcggtcgtccgggaagcccaccacggaggcttcctgcaccgcggggtggttgacgagcaccgcttccacctccgccgggtagatgttctccccacctcggacgatgaggtccgtgcggcgtgacagcacggtgagccgccccccaccatccagcacaccgacgtccttcgtgcgcagccagccgtcgcgaaccgcctcctgggtggcctccggacgctgccagtacccggccatcaccgtgggcgcgcgcacctcgatgtcgccctccgccccagcaccgaggacttcgccccctgcgccgacgatgcgcacctcgacacccagcaacgggacaccagcggtgcggccgtccgcagtgtccgggcgctcagtcgtgacttgtgagcaggcctccgtcaggccgtacgtctgaagggctcgcaggcccgcggccctcgctcgtgcgaggaggggcacgggcaccggacctccgcctatcagcgcccatgcaaaggagtccggcatgcgccggtcacctcgggcctccagcactcgctccagcgtcgtagccacgaggctcgcgtgggacacgccctccccgtcgatggcccggttggccgcatcggcgtcgaagcgttcgtgcaggacgaggcagcctccctcgtaggcagtgcgagtgagcatggcgatgccccccacgtggaaaagcggcaatgtgcccagccaacgcggggctggatgcgcccccaggttgcccgccgacgctcgtgaagacgcccggaagttgccttcggtgaggaccgcgcccttgggccggcccgtggtcccgctggtgaagagcacaacccggggcgacgatgcctccaggggctggcacgtggaagcccccgtggagacggcctccgcgaaggactcgagtggccgggctccagggagccgctccgccagggcccccagcgccagcctcaaacggggctggatgtcctccaccatgggcgccagctccacggacgtgaggcgggcattgagcggcgccaacaccgcgcccagccggcccagcgcccagaagaggcacacggaggcgacgtggttcgtcgcgagcgacgccaccctgtccgaagcgccgacgccctccgcctcgagtgcggcaacccatcgggagacttccgcatccagcgcttcataggaccaggagcggcccgcgaacgtcagggcctctgcctgggggtgatgacgagcgcctactcgaatgggacacagcaggaccgacattccgtcaccttgggcttcatcaacggaggccaagccgggggctcccatgcgccgagccgtcacaccagggactgggagctcagtccgagccccggggtgctcgacaggcgaatgacgccttgctgcggatggtacggatgatcttccggctccttcgccagcaagcgcccaatagcgagcccggaggccagcgctccggatggcagtgccgccgcgaggtgtgccgcgccagcccgcgccaccacgccatcaatggagctggtgacataggcctgcattccgagccgcgccgcgcgcatcgcgaccacgaggcacggcaacagtccgcccagcaccatgggcttcagcaccaccgcgcccaccgccgggccaccgcccagcaacgggtccaccgtcagcagcgcccggagcgcatcgggagaagccagggactcgtccgccgccaccgtgcagggggcgcggcgctgaacgcgccagagcgccgcgaggtcctccggcggcgtgggctgctccaccaactccaggccgtaccaacccagccggtccagggcgcgcttcgcgtcgggctcggaccagccgccgttcgcatccagccgaagcttcacgtccggccccaccgcatcgcgcacggccttcactcgcgcctcgtcggcgtccagcggccggccggcgactttcagcttcaacgtgccgaagccctcggccacggcctgccgggcctctcccgccagggcctcgggggtgtcggcgcccagcagcgcgttcaccgccacttccgtccgcgcctcctccgccagcagccagcacagcggaacaccctggcgttgcgcgagcaggtccagcagcgccagctccagcgcgtgttccgcggccggcatggcgcccgctggcgtcacctgacgtgcacggatgcgcacgccgtcgcctcgcgccacggcaggggggaacggcgacaacgtgtcctcgatggcccggaccgagtcgcccaggaactggcccttcagctcggacagccaggcgttcagcgtcacgccacagtcttcgagcgactcggtgccgaacgcgggcagcggcatcgcctcgcccagaccttcgcgcccctcctcgtcgacgacgcggacgaggaagccttctcgcaccgcgtgccccccttgtgacgtcttcaggggctggcgcagctccaaccggaggggaatgagcgaaacctgggcaatccgcatggcctcacatcatcgcaggtagaggcccaacgcgaacagcactccaaacacgagctggagtctggccgtggaccccagcgccggattcagcgcggccccctcctgcttcaacacctgccgcaacgggggaaccgccaggggcaggctcagcagggacaggaacacccaggggctggccagcttcagcgcgtacatcgcgaagggcgtggcgtacgacagcaccaggaggaggaggtactccgccttccccacgcccgtgccgaagcggaccgccagggtgcgcttgccagccttcacgtccgtcgtcacgtcgcgcaggttgttgacgacgatgagcatggtgccgctggcgcccacgggaaccgccgcccaccacgccgcggggtccaccgtccccgcctgcacgtagtaggtccccgtcaccgccaccaagccgaaaaagatgaagacgaacacgtctcccaggccattgtagcccaggggaaaggggccgcccgtgtatgcgtagccgcacagcagcgacgtcaggccgatggcgatgatgggccagccgcccaccgccaccaggtacatgcccacggccgtggccagcgcaaagcacacgcccgcgcccgccagcacagtgcccggcgcgatgaggccactctgcgtcacgcgctgagggcccagccgttcgtgcgtgtcggcgcccttcttgaagtcgtagtagtcgttgatgaagttggtgccaatctggatgagcaccgcgcccagcagcgctgccaacgcgggcagcaggcgccccacgcccgagccgaacgcgagccccgtgcccaccaacaccggcaccagcgccgccgtcagcgtcttggggcgcgccgccatcacccagtgcttcaccccgggacggggcttcaccgacagcgggcccggcgccggaaccgacgtgctcacgacgccacccttccctcgcgcacgggcatggggctgtcgaactgcggggcctcgtaccagggagtctggaggaacccgaggacttcacggacgtaggcttccggcgcttccaggtgcggcgcgtggccacagtcttcgaaggcgtggcgccagaccaccggcagctccgtggccatgcggcgggcaatctgggtgaacttcgaatccgaagcgcccgtcaggagcagcgtgggcagccgctgggcatgcagctccggccagaaatccggctggacacccagccccagacactccagcgcgcccgcgagcccctccgccgtgcaggcgcggcgctgtgagcgcagcgcgtccctacgctcctgcggaagctggcgcaggccgtcgaacagcggcaattgctcccagcggtccacgaaggcgtccacgccccgcgaacggatgaaggccgccagctgtccgtccgcctcacgccgggccgcgcgctcctggcgccgatgcagccctggcgaaccgctctccatgatgagccggccgaagcggtccggcgcgcgcacggccgccgccagcgccacgcgtgccccctgcgaatagcccagcaggtccacgggcccctgccccagcgagtccaccagcgcgacgagcgcgtccaccgtctccacgaaggcctcacgcccccgctggtccggcagcggcgtggccccatgaccggggaggtccaccgccaccgcgcgcacgtcgcggcccaggagcggacgcagcccgtcgaaggccctgcggctgccggtgaagccgtgcagcaacacgagcggacgggagccctcaccccacgtctcgtaagccagcttcacgcccatggtccttctcccagtgaggccgccattcgagcgaacagccgccggtgctcatccacattcgcgttgcggtccacgcgcacttccaccaggtggagcccgccctccaggccctcgcgcacggccgacctgagcgcgacgggcgtctccggccggtggagccgggcgccgcccagcgccgccgcgtgggacaggtccacaccgtgcggcgtaccgaagagcgtctcgaacgtgtcccgcggcgcgacctgggcgatggggaggaacgagaagatgccgcccccatcgttgttcaccgccaccaccgtgagcggcactcgcgtgcgcgacgcggtgacgaaggctcccacgtcatgcagcaacgccaggtcccccgtgagcagcaccgcggagcggcccgcagcggccgccatgccgagcgcgctggagacaatgccgtcgattccgttggccccccgattggccagcacccgcagcggcaccgtgcccgccggagcgaaggcatccaggtcgcggatgggcatgctgctggatacgaagagcggcgcgcccgcgggaagcgccgccaccacctcgcgagcgatacgcggctcggagagcacatcgggctgctccgcgaacgcggcctccagcgccgtgcgcacccgttgctccgcggccaggaagcctcgtgcccacgcccccacgccgcgcgcgagtcctcgcgtcagggcctcacaggccgccaccgccgagccctccaccaccgtggacgcacggtgcgccgggtcgaacaacccgccgccgtcactgaagaggacggtgtccgcgcccgagccgtccagccactgctgaggcaccttcggcgtgagcccgcccccgaagcgcaacacgagctccggacggtgcgccttcgcgaacggcgcatgccgcaacatcgcgtcgtaataggacagcgtgagcgggccgccgccatagcgggcctgcgaggtggactcggccagcacgggatagcccgtggcctgcgacagcgcgctgatggccgccgcgaatccatccatctcatctcgcgggccacacacgatgacgccgcgagtggtcgcggcaatccggcggcgcacctcgtccagggtggacgcgtccggcaccggctcgggcgggacgatgcgcgtcagcggcgcaccggcgcggcccgacttcgcgagcgcgctcagggaggcctcggggaagggctcggcgatgggggccagcggctcgcggaatgggacgttgagctgcacggcgccccgcggcgcgcgccacgcgctgacgaccgcgcgggcaacggtggcacgcatgtgaatcaacgccgcgtcatgcgcctcgggctgaccgaggtccgcgtagaagcgcgcgtgctctccgaagaagcgcgcctgtggcacggtctgcggcgcgccccagccctgaagcttcaggggccggtccgccgtcagcaccaccaggggcacgtgagacagcgcggcctcgatgaccgccgggtagaagtgcgcgcctgcggtgccgctggtcgccaccaccacggccggtgcgcgcgactgcttcgcgagccccagggcgaagaagcccgcgctgcgctcgtcgatgaccgaccacgtgcgcagcccctccgtcccggcacaggccagggccaggggcgatgaccgggaacccggacacaccaccgcgtgacgaaccccaccgcgcacgagctcttccagcaacgcgcgcgcccacaacacgttgaggttagcgtcggacgacatccccgcctcccaaggcccgcaacatggccaggctcttcatctccgtctcccgccactccgagtccgcgttggagccagccaccagccccacgccgacgaacagccgggccttcgcgcccttcacgcgcgccgagcgcagcgccaccatcaagtgcgcccgcccaggccccacccagcccaccggtcccgcgtaccacccacggtccaggccttcgtgctccaccaggaacgacagtgcccgctcacgaggcgtaccgcccacggccggcgtgggatgcagcgcctccaccacctgcgccggcgtcacccccggccgcagctcggcgcgaaaccccgtccgcaggtgaacgacgttcttcaaggccagcagcgcgggctccgcgtccgacgacacctgctccgccagcggcgtcaacgcggtgacgaggtagcgcaccacggacgcgtgctcgcgcacgttcttgtcatggccccgcagcccgtccgcctggccgggcgcggccgtgcccgccagggcctccgtctccagcacctgaccgtccacccggcacagcgtctccggcgtcgcgcccaggaagcacgtgtcgtccggagcgcggaacaggaaggtggcgcagcggggattctgctcacgcagccgcgccagcacgtccaccacatcaaagggcgcgggcccttccgcatccagcgggcgcgccagcaccaccttctggaggtgcccggacgcaatcgcgtccagcgcgcgctgcacccgcacctcgaagtccagccgcgacgcgcgcaactccaacgccacgggctcgccgcgcgcatgccggtacgactccgggaagcaggcacggacgcgctccatcatcgagcgcaccaggtcctcacccccgcggccttcctgcgcgaacgccacgacgcacgcgccgcgcgccgtgcggaacaccagcacctcgggcagcgtccagcgcgtcacaccgtgctacgcccacgccgtgtccaccgtgcccgagtgaccgaaacggatgccgccaaaccaggggcccggcatcgactccggggcttagcccagccagcgcacctgcacgcggcccagcgaggccagcacgtcaggaatgtcggaggcgtcctgcgcctccaccaccgccgcctcaccccaccccgccgccgcgtcctgcgccagcggacgctcccagtagacggtcggaacgcccaatacgtccgcacccgcgagcggatccaccaccgcaaggggcgtcattccggccacccagcgctggctctcaacgggagtgtgcgtcttcatcagcgttcctcatcggcgattgcgtcgcaatcaccttcggttgtcttctaagccatctcggctatacatgcaccaaggagttcaaaacctcttgaactccatgaatgggagggtccgtgggaggcaagcggccagacgaaccagccgggtccggacgggccccgggcgcgctgcgggtgcttcgcgtggagcggcccgaaggcactcgcgtgcgagtgggccccgtggaagtcggaggccccgggttcgtcgtaatggctggcccctgcgcggtggaaggcgcggagcaggtgcagcacgccgcctcggtggtggccgccgcgggtgcccatgtcctgcgcggtggcgtattcaagcctcgcaccagtccctacgcattccagggcatgggtgagccgggcctgcacgtcctggcggaggccgggcgccgccacggcatgcccatcatcagtgaggtgatggagtcggcgcagattcccctcatggaggagtccacggacatcctccaggtgggtgcgcgcaacatgcagaactactcgctgcttcgggcgctggggaaggtgcgcaagcccgtgctgctcaaacgaggcctgtcggccacgttgcaggagtggctgctggccgccgagtacatcctcgacggcggcaacgaacaggtgatgctgtgcgagcgcggcatccgcaccttcgagacggagctgcgcaacacgctggacctggcggcggtggcctgggcgaagcagcgctcccacctgcccgtcatcgtcgacccgtcccatgcgacgggcgacccggcgctcatcctccccatgtcgctggcggccgcggccgcgggggcggacggattgttgattgaagtccacccgaagcccgagcaggccatgtgcgatgggcaccaggccctgacgcctgaacgcttcgagacgttgatgcggcggctgccagccgtgctagacgcggtggaccgacacctttggcggccggaaagcccggcccaggtcgtgagggcgcgatgagtactgaagtccgtgagatgttctcttccatcgccacgaagtacgacgtgacgaatgaggtcctctcgttcggcatccaccggctgtggcgccggaaggccgtccggctcagcaccgcgaaggaaggagaccgcgtcctcgactgcgcttcgggcactggcgacctggccctggccttcaagcgcaaggtgggcgtgtccggccgtgtcgtgggcacggacttctgcccggagatgctggagagcgcccccgccaaggcggagaaggcgggcctccaggtggacttccaggtggccgacgcgatggacctgcccttcgcggccgacagcttcgacgtggcctccatctcgttcggcatccgcaacgtggatgacccggtgaagtgcctgaaggagatggcgcgggtggtccggcccggtggccacgtcgtggtgctggagttcggccagccgacgggggccttcggggccttgttccgcttctacagcaagacggtgatgcccacgattggagggctgctgacgggcaaccgcgccgcgtaccagtacctgcccaagacgtccgcctccttcccggccggtgacaagttcctggagttgatggaccagtccggggcctacgcggcaaagtccgcgcatgcgctcacgttcggcaccgcctacgtctatgtcggcaccgtccgctgaggagcggcggcacctcgttgaacagattctcgcctcggtggatccccggctcgcgccgggactgagggaggcggtagcccgcccgggcccctccccgctccccggctccagtcagacggtggtgctcgccggccaccggagcgcgggcaagtcgcgcctcttgcccatggtggcccgcatgctagcgcgccccgggctggacctggacgcacacctggaacgcctgcacgggcgcccgctgcgcagatgggtggcggaagcgccgcaggagttccgggccgctgaacgccgcgccctgcaaggactgccggccggagggctggtggccgtgggaggcggtttcctgtcgcaccaccccgacgcgctgaccgggctcttcaccctggtcgtccccatctgtttcgacacctaccgtgagcggctgctcacggaccggacgcgcccgcggctgcgcgccgacatgtcgctcgaagaagaattgtccgcggtgttccatgagcgcgaggtgctgcacgcccgcgtccccaccgtggccctggaggacttcctccgaggctgccttgcccccgaggtgcccctgtgacgcccgcccggcgcgtcgtcaccctgccccccaccctgctcggcgaagacgctgtccgcttcgcgcgagacggccagcgccgtggggcggacgtcctggaaatccgcacggacctgcacgcccctgacgccatctcgcccgaggcgctggcggcggtgctgccgctgctcgtctccgagcggggcaagccgctgcccgccccctgggtggccgcggcctggcgcgtggacagggacttgatggacgcgtcggggcagcaggcatcgctggcggcacctcccggaaagctgctcgcgtcgcaccacgcgagccggcagctctccacggaggaagcgctccagttatgggagcgtgagctgcccgccgacgccctggtgaagcatgtggagccgatgacggacccggcccacctcgtcacactgatggagacgcagcggcggatggtggagcgcttcggtgccacgcgagtcacggtgctgggcatgggcgcggtggcgttgcccacgcgggcgctgctcgcccagaacaacgtgttggactacgtcgcggcgggaggcgcctgggtcgcggcgcccggccagcggctgctggacgacgccgtgcgagcgctgcgcggcgcggaccggtacacggtgcctccgccactgcgtctgggcatattggggacgtcaatcgtccacttgcgctcgccccgcatccaccgtcagcccttcgaccgcatcgacctgccggaggacgggccggtggagcccgtggtggacgcgctcctgcctcactacggaggcttcgccgtcaccagccccttcaagctgcggctggcgaagcacacggggtcctcgctggacgccatcaacacgctggtccgccggggcggccggtgggaagccttcaataccgacacgttcggcgcccgcacggtgctcgagcggctcggggctcgcgaagtcttcgtcctgggggacggtggcgccacctcggcgctccggtccgtggcggcggagctgagctgcgacttgcgcgtcttgcgacgcgccgacatccaggcgcctctcacaggggcgggcgtctggacctggcccgatagggtgcccgctcctgacgacctgcgcttcgacggggcccgtgtggcggtcatcgcctacggagccccgggccggcgcatcgccgcggagattgtccaacgcggcggtactccagtcctgctgggtgcggcgtggttcatcgcgcaagcccggcgtcagcgccaactctgggagtccgcgacatgaataccttcggcgaactgtttcgcctgacgacgtttggagagagccacgggcccgctctcggcgccatcctggatggctgccccgccggcgtgcccctgacgcgcgagcagattcaagtcgcgctggaccgtcggcgccccggccagtccaccatcaccaccgcgcgcagcgaaccggaccaggtggagctcctgtccggcgtcttcgaggacaagacgctggggacgcccatcgccgccatcgtgcgcaacaccaaccagcgctcgggggactacgagaagctgaaggccgaggaccggcccggccacgcggacgccgtgtggcgcgagcgcttcaagcaccgtgaccaccgcggcggcgggcgcaccagcgggcgcgagacgctctgccgcgtcatcggcggcgccatcgccgaggcgtacctcgcccgtgacgtgccttccatccgcaccgtcgcctacgtgtcccaggtgggcaacctggtggccgccgtgcccgcgccgggactcacccgcgagcaggtggacgcccacgccacgcgctgcccggacgtcgccatccgcgacgagatgtcccggcgcatcctcaccgcgaaggaggcgggcgacagcctgggcggcgccattgacgtgcgcgtggagggcctgcccgtgggtctgggcgagcccatcttcggcaagctcaaggcgcgcatcgcgcaggccctgggcagcatcggcgccgtcacgggcgtcgtctggggtccgccggacctgctcgagcgcattggccagcccggcatccagttccacgccgtgaaggacgcatacggcggcatccagggcgggctcgccaacggtgagccgatgcagattcgcaccttcttcaagccgcccgcgacgctgcaggagcatgcgaagggcggccgtcacgacccgtgcatcatgccccgggcagtcccggtgctggaggccatggtgtcgctcgtcatcgccgacctcgtcctccacttcaacgcgaggccccacgcgccatgagtgctcttcctcccggggcctaccgtccgccgtccgatcgctggggcaccttcgcccgcctcgccaggaacctgcccgagggcagcgtggcggtggtggaccgcaccgtcgcgaagctccacccctccctcatccccaccctggaggcgcgcagcccccgcgccatcatccagctcaccggcggcgagagcgccaagacgttcaccgccctggagaaggtcctcgccaacggactggcccttccgcgctccggcacgctcgtggccgtgggcggcggcaccatcggtgacgtctccaccgtggccgcgcatgtcctcaagcgcggcgtgcgcctggtgcaggtccccaccacgctgctggcggcggtggacagcagcgttggcggcaagggcgctgtcgacatgacggtgcgcgggcgcgtggtgaagaacccggccggcgtcttccactacgcggacgaaggctgggtgtgccccgagttcttcgacacgctctccgatgcgcagcgccgcgagggcgcgctggaggcctggaagatggtggtcagcctcgacgcgccgctcttccgccgctatgtgcgcaagccgcccgcgctcgagaagctcgtgaaggacgcccgcgccctcaaggagcgcatctgcgcgcaggacccgtacgagcacacggggctgcgccgggtgctcaacttcggccacaccttcggccacgtgctggagagcgtgtcccgcttcaagctgtcccacggtgacggcgtgggtctgggcatgctgctggccctggacgtgggccgtcacctgggcgtgacaccggagcccgtggccgccgaggtcgaagccgccctggccaatggccccggcgtgcagggccgcgagcgcgccgccgccctgctccgccgcgcgccgatgaaggacgtgcgggcgctgctcaccgccgacaagaaggccggcgccaagggcgagctgcgcatggtgctgctgacggccattggcgccaccgaggtgcgtgacgtggacgaatcaagctggcgtgccttgtggcccgcgtggacgaagggggagcgaccatgagcacggcgaaggcttcccgtatcgtggtggacccatccgcgctgcacgccgcgcccctcaccccgccagtgtccaagtcggacgcgcagcgggcgctggtgctggggcacctcacgggctcgtggccgctgccctcggtgcaggccgaggcggacgaggacctccccgccgacgtgcgcgtgctgcgccagggcgtcgaggccctgcgtctgcctccggacgccgtgcgcgacatcgactgcgcggacggtggcgcgcccttccgcatcctggccacccaggcggcggtgacgcccggcgctcaggcgcgcttcaccggcacaccccgcctgggcgagcggccccacggcccgctcttcacgtccctgcgcgaggccctgggtcccatgggcctcacgctcaccgagggcacgccctggcccgtggagctgcgcgcgccccgtgatac

SEQ ID NO: 1074 - DNA, 13027 bp, Myxococcus xanthus
cgacgaccgcatccgtacgcaactccgggagtacatggcggggttcgtggagttcgccgtcgggaaggcgacgtagggcacgccgtaacggccgagaaacgaaaaaatgcgtgcgtcatcattggggggcgctgctaccggagtcgcccaggagatcgtgatgggagcgcaccgagatgactctgggcgtctacgcccggcgcaagaagtggccgcttgaagccgttggtggcgggcatgcgggcggcccctggctcgcggcgccgtgggtgtcccctgcattccgcgggagtcgtgcccacgctccggaagaaccctgtcggggcgtgagctccccgcccgcgaggactctccatgaagacatctattccgtcgcagatgaaggccgccgccatcgaccgcttcggtgggccggaggtgcttggggtgaagacggtggccgttccggtcgtaggcgcgggagaggtgctcatccaagtggagaccgcgggcgtcggaagctgggatgcggcggagcgcgagggggaaatggagctgctcaagcctcgaaagtcatccttcccctatgtgctgggaacggacggggccggcaccatcatggcggtgggcgagggcgtcacgtcccgcaaggtgggcgaccgggtgtacggctccggcttcctcaatgacaagggcgggttcttcgccgagtacgcggtggtgaaggccgatgacacggcgctcgtgccgaagggcttgagcgcggaacaggcgggcgtcctggccgcggatggaatcacggcgctccaaggtgtgcaggacgcgctgaacgttcgtcagggcatgtcgctgctggtgtacggcgcgagcggcggtgtgggccatctggcggtgcagctcgccaggcgactgggcgcgcgggtcctggcggtggcttcgggctcggacggcgtggagttggtgaaacgcctgggggcggagaaggcggtggacggacggggtggtgatgacgtggcgaaggcgattcgggacttcgcgccggacgggctcgacgcggcgctggtactcgcgggcggcgagggcagggccccggcgctgcaagccgtgaagaaggggggccacatcgcctacccgaatggcgtcgaaccggaaccacgggctcccgagggtgtgaagctcaccgcgtacaatggcgagtcgaatgctgacgtcctcgcgcgcctcaaccggctcattgaagcagggcccttccatgtcgaggtcttccaggtgtaccggctagacgacgcgggccgcgcgctcgaagccgcgcgcaagcaccatctgggcaagctggccctgcgcatccactgagccaccgcgcgccacgccaggacgctggcgtgggcttcgcggccgccgccgctggagccgggcggaggggcctgtccgaggttagactccgcggatgaactccagcccatccagccggtcgtccgtcgtcgtggcggagctggggcccacgaacacggggaagacccaccgagccatcgagcgcatgctcgagcacggttcgggcatcatggggttgccgctccgcctgctcgcccgcgaagtctatgaccgggtgaccgctcgggtgggtgagggccgcgtggcgctgatgacgggggaggagaagcgcgtgcccccgcgccccgactactggatttgcaccgtcgaggcgatgccgaccgacaagtccgtcgacttcctcgcggtggatgaaatccagctcgctgctcaccgtgaacgcgggcacgtcttcacggatcgactgctccatgcgcggggacgcaaggagacctggttcctgggcgcggacacgatgcgtcccatggtccagacgctcatcccccatgcctcggtgaagcgcgctacccgtctgtcacagcttcgttatgccgggcatcgctccctgaagagcctcccgccgcggtcggcggtggtcgcgttctccgcggaccgcgtctacgagttggccgagtcgctgcggcgcctccggggcggcgtggccgtggtgctgggcgcgctgtctccccggacgcgaaacgcccaggtggcgatgtaccaatccggagaggtgcagtatctggtggccacggatgccattggcatggggctgaacctggacctcaaccacgtggccttcgccgcgctgtccaagttcgacggcgccgaccagcgcgagctctatccggacgagctggcgcagatcgctggccgcgccggccgccacttgaacgatgggagtttcggcacgctgaacacgttgccggagctgccgccgcgggtggtctccgccatcgagacgcaccgcttcccggcggtccggagcctcatctggcgcaatgccgcgctcgacttctcgagcccagaggccctgctggattcactggcgcgcgcgccgggccacagtgccttcatccgggtggagcgcgcggatgatttcgatgcgctcaaggacctctcgcgtgttccaaccatccaggacctggccaccgggccggccatggtggagctgctgtggcaggtctgccagatacccgacttccggaaggggctcttcggccagcatgtcgcgttgctgcgtgagacgttcctgcaactcaccgcgggggacgggaagctggacgccgtctggctgaacaagcaggtggctccgctcgacgacgtgtccggagacatccacacgctgatggaccggctggcggccatccgcatctggacgtacatcagtcatcggccggggtggctgcacgaggcggaacactggcaggagcggacgcgcggcatcgaggatgcgctgggggacgcgctccatgaacggctcgtcgagcgcttcgtgcagcgcgccgcgaggcgcagcacgcgtcgctttgtgaaggccaccgcgcgccctccgtccggttcggccagtcccttcgccaagctggggcagatgctggaggagatgccgggcgccgagggcttcgcgatgacggaggagcagttcgtccagcgggtggtggacgcgagccatgatgccttccaggtggatgcgagtggcgccatctccttcgaaggcgagcccctggcgcgcctcgttcgcgggacggaccgccgctcccctttgctggcactggcggagccggaggtctggacgggcggcgcgcggcagcggctggagcggcgtctgctcgcgctggcgcgggacctcgtcaccgaggccatgggcggctttccctccgagtccttctccggagcggggcgcaacgcggcggcgcgtgggctcgcgtatcgcctgtccgaaggactgggcgtgattacgcagggcgaggcgcatgagcagtggcggctgttggatgaggaggctcgcgcgcgcttgacggagcaaggcgtctgcgagggacaccgcttcgtctacgtcgccgaggccctcagcccgcatgcgctggagcggcgctgcatgctcacgtcgctgttcctccagcggacatgtcccaccggggtgccacgagaacccgtgcttcagctctccgagttggatcgccgcgacgcacgtgcctatgggtacgaggtgctcgggagcgtggttcttcgcatcgacatcgtcgagcggctgtgcgaggccctgcgccacccgcatgggggccggcaggtgcaggcgctcatgcaggacctccgcctggaggggagtatccgggctcgggtgctgcgcgagctgggaggcgccattggaaaccctccgccgcggcggcgccgtcgccgacgtggcggcgccgcgcaagtgtccggcacgagcggcgctcacccaggttcgcctcggagcggggcctcggagcggaagggacgtcggccccgagagggggcggtccggaatgccacggcgtttcgagacggaccctcggaatcatgaggcgctggcgcacccgtctgcgccggagctcctcgtttgaaggggcggctcgtgcaggtgctcggcgactggacgtccgccgagccgggccccgcccccgccagccttcgagcgctggtggcgctcatccgggagcggaggcgaggcctggtttggggcttcaggggacggaggcgctcagttcgcttcgcgcccgtgcggcttgtttcgcttcgagggcatgaacgtcagggtggccgcattggcgccgccgccacttcccgccggcacgaagacgtcaatgaagttccctgtctttccgctgaagcgcaacaccgtggccgggaggaagtccgggatgtacaggttgccgtcgggaccgaactccatgtccacgaagtcagtcaggccaccgctccccgactcgacgaagacgtcgatgaaggcgcccgtcttggcgttgaagcgcaggacgtcgtctccggccgtggtgccaacgtagagcttgtggttcttgccagtggcaatcgtcaccgcgtcgatgtccgggatgaagatggcaccgggctgtccggcagcggggaagggcgcgccattctcgtcgtagcgcaccacgttgttgccgatgatgctgacgacgaacaggttccccttcttgtcgaacgccatcttctggggaacgagcagtccgccacccgaagcgaacacgtcgatgaaggcgcctgtcgtcccgtcgtagcgcagcacgctgttggtgccgccaaagctgtctgcgacatacaggttgccatcaggaccgaagatgaggccgccggggaagcccagcccgccactgcccacgggcacgaagatgtcgatgaatgcgcccgtcttcccgttgaagcgcagcacctccctgctggcgaagctggcgatgtagaggttgccgtcagggccgtagacgagctcctgcgggttgttgagcccgccggcgccgggcgggatgaagacgcccacgaagtcgcccgtcttcccgtcgtagcgcagcacgctgctgttcacgttgttgctgaccagcaggtcgcctcccttcttcttcttccggaccttcaccttcaccgaatccaggccccactgtttgttggcctcgcctcgaggcgggtccgcgaagcggagtgtcagccggtctccggtgtgccggaaggtgaaggacagggggtagatggcgtaccccttgctgccatcgccggactcgtcccggtacccgagcttgcccttcatcgatgcgccggtgaggcccgggtggctgccttggaggtagggcttcgggtacgactgcccgtagcgtgcgtcgaacggcgcgtcgtcattggagaaggtggcatccagcaggacgggaccgccgtccacgctcgcgacccagcggtctggccccttcgtcgtgtcgttaccgtcccacgacttgaggacgaacagctccaactggacctcgacctcgtcatggtccggcaggccggccaggctgagcgtgacttcctgttcgctgaagggccccaggaactttcgttctccgttcggcgtccgggacacggtgcggtggctccactcggggcccgcgcctttcccgaagttctctgaatagactttcttctccgcgtccttccactgcgcttcgacgctttcctgttcgacagacttcgactccaactccgcctgctccgcgaagctgtctgcctgctcgtcgggtcctcccatgcacccaaccaaccaccacgccgcgagtgctgcacaacccagccgccaacccttcatgagctgcctcccctttgacgcgaggccgagggtgcggacgcggcgggagggctgccattgactgggagggttccacgcgtccgtgcacaggacgcttcaatgcccggcaatccggagccggagcatccgggatgcgtcgcatcatgcgcggggagggccaggcaggggctcgggcgccgggcccatccgctgcgtcctactgggggtggcagggtggacgccgccgcgtttgtctaacgccgcgcggacacgagcaacatcatggggcgctcccgctcctcggccagttccggctgggcggagagctgtgcctcggtcggaccccattcgttgacctggcgcagactgaaaccggtgtgaatcagggcgttcaacaaggtgcccagcgtgcggtggtacttgaggacgcccttggcgagccagtccgtggtgcggggcccctcggcctggtagccattgagaggccatgtcttctggccttgttcatccactcgccagcccggatgggtgggagccatgtagatgggatgctcggtggagaagaccagcgcgccacccggaaccagggtggcgtgcaccttcgcgagcaggctcggcaggtcttcgatgtagtgaaaggccagggagctgtagacgaggtcgaagctggctcgaggaagttccaccgtctccaggtctgcctgggtgtagacgatgtcgcgggtggacgtcagctgccgggcccgttccagcattcgcgccgagacgtcgagcccgtgaacctgcagtgccccttgttcccgggcccaccggcagaaccagccgtagccgcagccgaggtccatcacccggaggccccgcagctcgggcagcatcgcccgcagcgcgggccattccggtgcacctgcgagcccctccatcgagcgccgcaactggctgtagccttcgaagaagccagggtcgtcgtagatgttctgcgccatggtggcttctgagcaccctttgcgcggacctgcaaccgatgcgctcccatccgtcacggcgcggacgtcacgggacgcggctcagtcatcgagtgttcccgtctggagcgcgatgcgggccgtgcccgccatgttctccgccagcgcttgcaccgaacccgacaccttctgagtctcctcggcggtgcgcagcgtatgccgcatctgggcggacaattcttgaatggcctgggcaatctgggaggtgcccgcgtcctgctgcgccaccgccgcggaaatctgccgcacattggtgccggtgtcgtcgatgatgcccgtgagccgctggagctgggtgccggagacgcgcaccgcgtccaggctcgccttcacgcgttgctctccctgttcactcctcttcgcggcctcacgcatgctcagactcacaccgtcgagcacctcgcggatgcgatgggtcgccaggatggactggtcggcgaggctgcggacctctcgcgacacgacgccgaagccccggccgtgctccccgctgcgcgcggcttcgatggcggcgttgatggccagcatgttggactggtccgcaagtcccttcacggtgtccacgatgctggagatttcgcgggtgcgtgcgtccagcgcgaggatgtggctcgacatctcggagacctcctggcggatggcttccagattggtcaacgtgtgggtgatggccgcgccgccatcgcgccccgcctcctcggcggtttcgatggagcccgcgagctgccgcgccttgttcgccgtcaccagggagccctgccggatttcctggaccgtctgctccgcctcgcggagcgccgcggcctgtcggctgacccccgctgtctgaacctcactggacgtgcgcagttgttgcgccaccgtggccagctcgccagcgccgctccccatgtcctgggcgagccgcttcacttcatgacgacgctcctcgagctggtgcgtgtgcgacgcgagcgcgcgcaccaccagcaccgagcggcgcacgacgatgcccaccaatgagagcgtgagcgccaggaagccccagtgcatgagggagtccgtggcctccgccagcccgaacaccggcagcgtggtgtggatgacgacaccgaagaacacgcccaggcccatggagaagattcgcgcgtcggggttgccccgccacgctgagattcccgcgacgatgacgcacccgagcaggcaaggcaccgagtagaggacgaagaggccaaggttccgctgcgccatgcccaggtcggccatcacgatgatgacttgaagggaggccggcacgcacgcggcccaggcgctccagcggaaccagcgcatccggttctccaggacgctgtcggagatgaaccaggcgagcgcgggcaggatgcagtgcgagcccaccagcgtgagctggctccccagcagatagcggccccagagcgcaggaatcaggccgctcgtgcccagaagcagggccgccgagccgctcgtgaagatgacgagcggcaggagcatctgcgtctgacgccgtaccagggcacccaaggcggcggcactggcgatggtgagcagcagcatgcccatgacgaagggcgccagccccgtgcgcgtcaccgtcgcgaggagctgatggtgtgcccccacccgagccgcgcctcccacgccgatgattggaccgctgctctggattcgcagcagcaggcgtgagccttccaccgtgggtggcagggggatgagccgccacgcgaggttgtccgtctcctcctggcccgagggattcagccgtccgctcgcatggatgcggtggccgttggcgtagacctcgaaggcattggccaccgtgcccaggtagagcgcgggctccagccactgcccctgggggacggggaggctcagccagaggacggtgtgcgctccccggcccggcggctcgcggagggctgccacgggctgccacgcctgctcatccccggactccagtgcccaggctggtacatcggcggggcccggcggtgagtctccccagcggtatcgccagccctgattcaagtcgatgctgggccgtcctgtgtccgcccacgcggaggtggaaagtatcaggaggaacggcagcacccagcaccacgacgtgcgtcgtgaagacatgcatgcgccggaaggtgagacaggtgaaacaccggagactgcgtgagtcgccggcgcgtgagtcgccggcgcgtgagtcggaatgcggatgtgacgcatggatgcgtccatcctcgggggcgggaggcgtccgtgtaaaatgggtctgcttcaccccgcccggcgctcgacctctgtccgtatgtgtttcatcgacaggcggtgatacttgggtccggaattactctgtttttgtgtttcacgggcttcgtcggcaggacaaagttccggaggggatgccggatggcgcggcgcgtgtatcactgcgccacccggctgggagtcctggggcggcgaagactcagcgcgaggcgcgcttgacgcggcccaccgaccattcgacgagcttccgggcctgacggtgaagggccgtctgtttgagggcgccgttgagctgatcaacgagttggtgtcgcaggggcggggtggcgatgtgctcttccagctcccggatgcgctgggcctgctccaggagacgatgttccagttcgtggaggcgttgcgcctggaccgggttcgacgtctcgttgacgaggtgtcgaaccggaggcggcgaaggccggcgggcgatgaggtcggcgttgtcgcccttgcgaagaacgaagttcagcgtgttccgggtgagggccttgggtacgcgagcgccgctcttctccacgtatagacgcagcacctcttcgtcgagtgtgacagggaacatgtcgagcacttctggctcgaagcccgtccccaccaacaaggggtcgatgtcccccagcgccagctcgagctcatggtggctgacgccgatgccccatcgggtcagcagcatgggggcgtctttggcagacgcctgggccatcgaatctcggaagttctcgcggggggaacgcgaggcatacggccacccgagttcaggcggcaggaagtggaagaacggcatcagggacgtgtgcgcgtcgaagtacacgagccggttgggcgtatccacgacgacgagcagtcctccgggacgcagcaggtcccagccggtgcggagcgtctccagtcgctcggcgggcgtctgatgttcgagcaccgcgtacagcacgaagatgtcggcgccctgggggttctcctgcctcagttgttccagcaacttcgcgggttccacgacgcgcgtgtcgacgttgcgcaatcccagggccttcatgcggctttgggccgcgcgcacggagggcgcgtggatgtcgtaccccgtgacgtggctggcaacctgggcaaaggccgccgtgctggagcccgtgccacagcccagctcgacgacgttcgccttgcccagcttcgtgtagcgcgcgagccagggcagtacgtggtcgatgcaccggttgtaacggccatccacatggtccgcgatgtccgactggccggccggcgacttcaggaagcctgcatcgaagtccgcgaagtaggattgcagcagggcctcgcgcacattcgccaggagcgtggggtcctccatcctgtaagcctcgaagcccgtcgccatgcctctgtctcctcgccgttggtggtggagcgaactgcgggcacggaaggtaccaaccgaggccgctccgggcgagcaatggcgcgtgcgaatggttgcttaatggcgaagcggcgtgccggtgctggggcggatgttttgattcacgcggaaaaggttgttcgggtcgtagcggtcctttacttccaccagccttgcgtagttgtcctggtacgtcgcctggacgcgttcctggccctcctccatgaggaagttcacgtaggcgccgcccgcggaatagggatgcagggcattccaatagtccttcgtccaggtggtgatgtccccggccttgtcaggagaggggtccactccgacgatgacctccgcccaccgcgcgtcccggaagctgaaggcggtgtcgcctggtgccgcccggtgcgccgctccgtcgatgggatagaggtgcatggtggagtgcatcgtgggcagtcggtgggcgaacgccacgtgtcgggagatggcttcgtcccccagctcccgcacgaagtccgcgcgccagtaccattggaggcccggcggatagagcgcatcgaacatggtctgcagcgcggggtagggcatggtctgcacgccgtcgagcgcgggggccatggcgcgcacgggcgcgaagagcgcgtcggcttgagccgggtctccggtgtagcaccacaccaccgcgcacatcttctgcaagtgcaggtggggcgggaagggcgccgcgggcgggacgaccaggaaggcgaagaagccggtgagtgtctcgggcgcggtggggatgaactcgcggtaccaccgcatcacctcctcggcgcgttccaggggccagagcgtcggccctcccaggatggtgtccaccgggtgggcctggaagaggaaggacgtggcgacgccgaagttgccgccaccgccgcgcacggtccagaacaggtccgggtgctgctgggcgttcgcggtgacgaagcgcccgtccgccagcaccatgtccacggcgagcaggctgtcgatggtgaggccgtagcgacgcgagaggtggcccaggccaccacccagggtgaggcccccgacgcccgtggtggagatgattcccgagggaacggcgagcccgaacgcgtgggtggcatggtcgacttcgccccagacgcttcctcccgcgacacgcacggtgcctgattcgggggcgacccggacgccgcgcatgagtgacaggtcgacgacgagccccccgtcgcaggtgcccaggccggcaccgttgtgcccacccccacggaccgcgagcatgaggccctgctcgcgtgcgaactccaccgccgcgaggacgtccgccacgtcggcgcatcgggcaatcaacgctggccgcttgtgaatcatggcgttgtagacgcggcagtgctcctcgtagtccgcgtcccccgggcgcacgagccggccgcgcaagcgggcccgtaactgctcgacccggcctgggggcagcccgggcggtcgtccttcgcctgttcgcgcaggctcacttcgagggtccaggggcatggctttctcctccgtggggccgtgatgggaaaggcccctacagccaagctagggacgacggtcggcgagcgcgaaggcgcgttcacggcaggtgggcgggagggggcgcccaggcacgcgttggcggagggacgaggacgtggcgcttggtaggcccgataggggagagggggcagaccaggagcttcgtcttccttcagcgccacagggtttgagttcgagctctggagggcccggctcccggatggttgtctggtgatgactatgtccagagcggcagcgcgggatggagattgtcaatccatgggcaagtcgccgtgccatgctggcgtgaaatggacttgaagtatcaagtgtcgaggttcgagtcggtgtccttcgagcttgctgcactcaacttgttgaatacgcagccgggggcgtggttgggagaggggcgctcggtggagtctgacggggtgccccccttgtatgtcctgccgccgctacaggtgcggttcggagtgcgctactcgttctgacgagcgaccgtgatggttcgctgagtcggaagggcgaaccgtcgcggtggtgcgcctggcttacggcgtgaactgcgtggggttgggcgcccacgaccaaccatgcacggcaggagggggcgtttcgaaacacgtgaggccctggggatgtgtacggtccagccaccctagagaatgcgaaagcaggaaagccggtgatgctcggtgtcggttccgccacgggctcatgcgctgggcgaaggggattgtgccggggccatgccccgggtgatgaatccggaatgcgcctccgttcgtggtggtgggtcctggtcctgctcacggtgtcctgcgcggggcgacgctcctcgtccgaggaccttggggggcgagacgctcggtccgaactcttccgggcccgcggtgacgcggccatcgagacgaagcaatgggccctggccgcgggctacttcgcgtccgcgagacacacggaagactcacccacggcgcgctggggacaggtgtgggcggagaagcgcgcctcgtctctcgagtgggcgaagcagatcgagggttcggtgctggcgctggccttctcaccggacggcaggctgctggcgtcgggagggtatgacgcggtcctgcg

SEQ ID NO: 1075 - DNA, 11358 bp, Myxococcus xanthus
tgtgctctaaggggagaaacaccggctgacttccacgcagcgccaaccgcgcatcaggcagcggcgtcatgctcgtggggagctgttccaaatcgactccagcaggtgcgaacaggtcgaggtgcatcacccctcccggaagggttttcgaccaacgaaaactgcgcgttcgctcgtacccccggagcttgaggacctcaggtagacgctccgccccgaattcggtgccatccatgtcgaagagcagatcaggctcgtgggaatagccgcgctcaatcacggcgcctgtgtcggtcgtgacggcgatgacccccgacccacccttgcggagcgactccaacgcgagcacctgcccgccgatgagcacgacgttccaggagagatctcccagttgcagcaggagttcacccagttctcgcagaatctcttcgaactgctcctgctcggtcatggcgcttcctctgagatgggcagcgcctgtgcgaatcgctgcaccaactcatccgcctgttccttgccgcgccccccactttgatggaaatccacggtcaactgaggcaacgccacacccaggccatgaggaagcgttcgtggcgaaaagaagacccctccggcatccgtctcagccgagggctccgcccgcaacacccagaagttatgaggcatcagacggcgcagcccgaaggcttcgacagccgcgtcgatagagcccgtgagatagagcccgtgaggcagccccgacacgaagcgctcttcaggcagcaaggcgctcgccagcgtatagatgccccgaatgccttgggccttcaatcgctcaaggcccttccccaacaactccggcgtggtggaaggtgcgttgaaaccatccagtgtcacggaggtcttctcgccacttgccatccacgccctcagcaggcgcacgggagccctcagccgaaacccactccgcttgccgaccggctcgacatacccatcgagcacgaggtggcggacgacgccgtacgcataggagtaactggtctgcgtccgctccgacaacgcgcggaccgtctgcgcttctcccggcgactgcaacagggtccggacgatgcggcaccccttcccgtggaataccggctcacggggacgccgctgtgacggttcgcgcccctgtacacgaatgaaggtgctgcctgagcgcaggaagaatgttcctcgctgatcgaccaatgcgacgtcttcttgctcgcaggccgcgatgactccagatgacgcggaatccgtcgcaatcatcgggatgcggacaacgggcaggcgctcggcggtcccatcccgctggtccagcgccacgctcgctgcgcgcaggcgttcccgaagtgagtgcacgtccgccgggagcaacggcgcgcggtaggccatcaggaccggcactcggacctgggggaggaccacctcggcgagttcatagatcgcctgcccaccaggccctcggcgcggcaacaagaagacgtcttggcgcaggagttccaccccccgaggtaaccggaggtcctgcttccagaatgcgtctcgaaactccgcagtcgagtccattaactctgtcgataatacgcaatatgcgccaaatacgcgcgcatgtttcgccagaagcgaccattatcgacaaaatttaaagaatcatgcggtccaagggcaccccggctggcctccccccaagcggccccttagttccctgaggtcttcgactgctgcgcgggcacggttaccggcgcgggcccacgcggtgccggcgcctcggggcgcgtgagcgtgccgggcatctccgccagcgcgtacgtcatccacgccacggcggcggtgctgcgcgccaggtcctgcgggtccaccttgtccagcgtgtccgcctccgtatggtgcacgtcgaagtagcggctgctgtccacctccacgccgaagaagggcacgcgcgcgggcatcagcgggctgatgtccgccccacccgcctcgcgcgcggagaactgcgtcacccccagcgccgtcagcggcggcagccacgggcgcagcaggtcctgcccgccctcgcccgcgcgcacgctgacgctcacgggccgcccgccgcccgcgtccatctccagcgcgcccacgtgccggggcaactccgccgcgtgcgcctccgcgtaggcgcgcccaccgcgcaggccgttctcctcgttcatgaagagcaccacccgcaccgtgcgccggggcgcctgcggcagcttcgcgatgaggcgcgcggcctccatcaccatcaccacgcccgcgccgtcgtcatgcgcgcccgtgcccacgtcccacgaatccaggtgcgcgccaatcagcacgatttcctgcggcttctcccggccgcgaatctccgccacgacgttggaggaatccgcgtccggcagctcggaactgcccagcatcagcttcacgcgcaccgggccgcccgccagcagccggtggagcaggtccgcgtcctccgtggccaccgacgccgccggaatccgcggcccctcactggggaagttcgtcgcgcccgtgtgcggcgtgcgcagcgacgccgtggcaagcgagcgcaccagcgcgcccaccgccccgtgcttcgcggcggcggcggggcctcgtgagcgcagccccgcgaagcgcccgtagtccgcggccaccgtcatggtgtggttgaagaagacgaacttccccttcaccgccgcgcccagcgactccaactgctccagcgacgtcacctccaccacctcggcggtgagtccctcgggcgcggtgggcgggctgccgcccagggccagcagcgccagggggtgcccccgcgtgcgctcggaggccagcacctcgccggacgcctcgcctcgcacccagtgcggcaccttcaccggctccaaccacgccttcaccccgtcggccttgaaagaacgcagcgcccactgcacggcggcctcggcgcccggcgaccccgacaggcgcgggccaatgccgtccgtcagctcggcgagccgcgcataggcatggccatccgtgagcgcgggcccaatgagcttctccgcggtcgcctgcgcgtacacgggcgcggcacgcttcgcggtgacggtgggcttcgcggggacggccttgggcgccgacttcgcggcgggtgcggcggccgacagcaactggagcgcgagggaagcgggcaggatgaaggtggcgacgggcaagggtcctccaaggggaggcgctcactctccgtcgagcccctgggcctcgcaagcgacggtgagcgtcaccaccgcccagaagcggacaacgcccgtgcgtcatgcaggcatggaaccgaggggcggagcgagaatcccaggggccaccgcgcgccgagagggggaacgcggcgcgcggggctcaactgggacttccacgacggtgtcgcttttgggggaggcaatcaccgccgccgcgtctcactccgaagaggaaacgtggacggcatgttgaagggcgagcgagcgcccgtcaagcacgcgccccctccgagcccataatcgaacattcacacccggtgaacacagacgattccactgtcactgtccaaatcaggcaattccccagggccgccaccggaaggcgggcatcccgtgcggggcgtgttacaggccggacagaggtaagcgcatgcaatccaccctgacgcggcggccccaggcgacggcattcagcatcgaggatctgctggaccgcgtccagcgcggtgaggtgcggctgccccacttccagcggcccctgcgctgggaggccggcgatgtgagggatttgctcgacagcgtgtaccgcggctatcccattggcacgctgctcttctggaagcgcgaggctcccgccgccagcgtgagcttcggcccggtgcgcatcgacgcgccctcccacagccaggcgctgtgggtggtggatgggcagcagcgcatcaccgcgctggccgcggtgctcctccacccggagcaggagcccgccgcgcgggacggcttcacgctcttcttcgacctggatacacacgaaatcgtccagcccgcgcacggcgagccgacgcctccgcactggctgccgctcaaccgggtgctcgacagcgagcagctgctgggctggctggaccgctacccggggcgcgagaagaacccagagcacgtgcgcgcggccatccgtctgggcaaggcggcgcgcgagtaccagatgcccgcgtacgtcgtcgaagccgcggaggagaagacgctgcgcatcatcttcaagcggctcaacacctccggaaagccgctcaccgacgacgaggtcttcaacgcgctctacggcggcaccgcgggctcgcgactgcccaacctgaaggcgctggccaccagcctgctggagctgggcttcggccgcatcgatgaatccctgctgctcaaggccgtgctcgcggtgcgcggcctggacttcacccaggacttccagaagcagcttcgcgaggaggacgacctcacgcagacgctgctccagacggaagcggccctgcgcagcgtcatcgtcttcctcaagcgcgacgcgggaatcccccacgggcgcctgctgacgaacccgctctacttcgtgctgctcgcgcgcttcttccacctgcacccggagccgtcgccgcgcacgcgggacttgctcgcgcgtgggttctggcgcggcagcctggtggacagcttcctcgacagccgggccctgtcgccacaggagttgctggccgccatcggccccgacgaggagcaatccgtccagtccctgctggcgcaggtgcggcccctgtccgacgaatggctggcccagcacgcgcagcccgcgacgttcggcctcgcgctgcgctcgcggggcatggccctcaatgccttgtacgcgctccagccgcggcacctgcgcaccggcgccctgctggagccgtcccagctcttcagcgacaccgaccccgccagcctcagccccgtgctcaagtccctcaccgtgcaggagcccgacgccgagctgaagctggaccccgcgctgtaccgctccttcctctacacccccgccaactacctgatgcacccgcccctgcccggtcagcccctgctggacgtgctgcgggacgagcccgcgccgccgcccgaggtcctccagagccaggccatcacccccgccatgcgcgacacgctgcgcgagggcggcacgctcgaattcctcatgcagcgcatggagctcatcgatagacacatcatcgagttcctgcgggcccgcacccgctacgaggagtcggaccgtccgtccctccaatcgctggtcgtcgaggaggaggactgacttggagcccacccgcaccacggccggaatcctcgacgtccacctgggcgacgtccacgtcggcacgctgacgctgctggaggacgaacgcatcgagttcgtcatcgcggaggagtaccgccagcgctacccacgcccggtgctgggacagattttcgaggacgacctctcgcgccggcacgtcagccgcctgcgcctgccttcgtacttctccaacctgctcccggaaggctcgctgcgcgagctcatcgccgaacgcgagcaggtggcccgccagcgcgagttcttcctcatcgcgcggctgggtgaggacctgcccggcgccatcgtcgtgcggcccgccagcgtgctgtcactcagcggaatggagccgctggaggagccccagccgccccacgcgccgcaggagcaggagccgctgcgcttctcactggcgggcgtgcagctcaagttctccatgctgcgccgggacaaggcgatgacgctcccggcgggtggacgcggcggcaactggattgtgaagctgccggacaaccgctacgaccgcgtcccggagaacgagttctccatgatgacgtgggcccgcgccgccggcatcaccgtccccgaagtggcgctgctggacgtggccgacatccagggcctgcccgaaggcatcaccctgcgcgagaacgtggcctacgccgtgcgccgcttcgaccgccccgagcccggccgccgggtccacatggaggacctgacgcaggtgctggggctgtacgcggatgagaagtacaagaagtacaactacgagacggtcgccaacgtcatctacaaggtcgccggactggacgcgctgcacgagttcctgcggcggctggtgttcatcaccgtcattggcaacggggacgcgcaccacaagaactggtccctgctctacccggacggcacccgcgccacgctgtcacccgcgtacgacttggtgtccacgctccagtacatgccggcggacacgctcgcgctcaacttcgcgaagtcaaagcgcttcgaggacatctccctgggcagcttcgaacggctggcgcgcaagctggcgctgccccccagcgacgtgctgccggtggtgaagtccgcggtggaagcgtcgctcgacacctggtcctcgcttcacgcgcaactgcccctgccggatgagagccgccgccgcatcgaagcccactggaagcgcgtgcccctgctccaggggcaatgaaccggggcccgccatgagcgaagacgccttcttcaccgtctatggcaacctgccccgtcacggccctggcagcgacgactgcacccgggaggccctgcgacggctgcctccgctgccaccgcacccgcgcgtggtggacctcggctgtggcgcgggcgcgcagacgctggtgctcgccgaggcactgcgcacccgggtcatcgcggtggacctgcacgagcccttcctcgaccaactcaaggcacgagcgcgcgagcggggcctggacgcgctcatcgacgttcagcggcaggacatgggcgcactgtcgctgcccgaggcttcctttgacctcctctggtccgaaggcgccatctaccacctgggcttcggtccgggactgcggcgctggcgcccgctgctcgcgcccggcggcctggctgccgtcaccgaatgcacctggctgaccgatgagcgccccgacgaaatcgcgcgcttctggggtgaggtctaccccaccatgggtacggttttggagaaccgcgccgccgcggaaaccgcgggctacgaggtgctcgacaccttcacccttcccgcctccgcatggtgggacacctactacacgcccctgctccagcgcgtcgcacacctgcgcgcccacggtgatgcgtcattggaagacgcgctctcggccgccgagcaggagacccgcctttatcgccagtacgaacacacctacggctacgtgttccatctgttacgcaacccgtcagcgctttgactccgcgtacgagcgacctcatccataaaatcaggacatgcaatttttccacaaatagtgtctatgtcccggaaagcgcaaaggcgtctacgaacacctcgcatgccatgacccggccttccccccaagccggcgttggctgcgccctggcaacccaagggaagcatgtcgacagagcagtgggcccaccgcttcttcgagctgtccacggagccctacgtcatcctgggccgtgatggcgtgttgctcgaagccaatcctgcctttggccacctggtgggcctgtctttgacgtcactgcgtggcatggccttgcaggatttcatccccatcgaagatgccgccgtcctgttcgcgcatctgggttccacaagccccacctcgcgcacctgccgttggcgccggccggatgggtcctggctgcctctgtcctggcgcatcaccgccgcttcggagtcggagccactctactgcacggtgcagcgggccgaggaaccatccgccgccccctggccggagagtgactacctgcccttcggcctctacctggtcgacatccgcacgcgccgggtccactacgtcaaccaccgcttctgccaactgtggggcatcaccgagttggagggcgccatccagcggggtgagttgtcccatgacgaggtgatccaccattgcctcaaggctggcgacgcggcggagttcctgcgcctgtgcgcggccccggaccagggctgcgtgccgggcctggtggaggacgaagccaggctgtcggatggacgcaccctgcgacggctgtccacgtcctcctcggtcgcgggggacgccatgcgctaccggatgttcgcgttcgaggacgtcaccgagagcaagcgcacgcaggaggcgctgcgccgttcagaggagagcttccgcaggctcatcgaccgggcgcccgaaggcatcttcgtgcacacccagcggcgcttcatctacgccaaccccacgctgctgcgggccctgggctacgacgacccggccgagctgatggcaaagcccatctggagcatcgtccatccggatgacctggagctcgtgaaggaccgcgtgcacaccgcggccgtgaagggcgcgctggccccgctgcgggaggtccgctacctgcggcgcgacggcacctggtacgacgcggagagcgtgggcatccccatcgagttcgacggacacgaggccgtcgtggtgatggcgcgcgacatcaccgagcgcaagcaggcccagtcgcagctcctgcagaacgaccgcatggtgctggccggcacgctggcggcgggcgtggggcacgaaatcaacaacccgctgacctacgtcatggccaacctggcctcggccctggagtccgtgagccgcctgggcgcggagctgacgcgggccggagagcgcggtcccagcagcgtggcgtggcccgcgacgctgcatgacgcggaggccctgctgaaggaggcgcaagaaggcgccatgcgcgtgcgcaacatcgtgcgggacttgaagttcatctcccgtcaggatgaggagcggcgcgaagcggtggacgtgcggcagccgttggacttctccatcaacatggccgccagccaactgcgtcaccgggcgcggctcatcaagaagtacgagtccgtcccccgcgtgtacgcggacggctcgcgcctgggccaggtgttcctcaacctgctggtgaactcggcgcaggccattcccgaaggcaacgccgaggagcaccacatcaccgtgtgggtccgcgccggaccgccgggcagcgtgctggtggacgtgagcgactccggctgcggcatgacgcccgcggtgctctcccgcgtcttcgaccccttcttcaccaccaagcccgtgggcaagggcacggggctggggctgtccatctgccacagcctcatccgcaagcagggcggtgacatcaccgtccgcagcgaactgggccagggcaccaccttcaccgtcaccctgcccacggcgccggacgccgtcccgacccaggccgcgccggtggcgcccgcgccccacgccgagcggcggggacaggtgctggtgattgacgacgagcccgcggtgggccgctccctggcgcgcatcatcggcatgcggcaccgggtgacggtggtgaacaacggcgaggacgcgctggcggtgctgacatcgggcgcgccgttcgacgccgtcttctgcgacctgatgatgccgggcatctccggcatggacgtctacgagcgcgtccgcgagcgcggggatggcatcgccgagcgcttcatcttcatcaccggcggctcgtacaccacgcgggcccgtcagttcctggagcgcgtgccgaacctgcagattgagaagcccttcgacgtggagtcgattcatcagggcctgggacaactcctgggtgcctctcgtggtagcgaatgacgccgggcgtcctcccggcccaactgtgaaaggagtcctcgggtgattgacggcaacttcgtcatcgatgcggtgacacacgcctacaacctccatcccacgaactaccgcgccggcaagtacgccgagtcgctcgcgggactcatctgggggctgcacagcggactgtctggggacacgcaccgcgtccccacggcggaaggcttcctgaagaactggtccgtgaaggagctggcgcacctgctcttcgtggagagcggcgtcgacctggcggtgcaccacgtgctgccgctccagacgctgtaccacgacggactgtgctcctatgagaagacgctggagattcaccgcaactatccccaccgcttcctggtgtacgcgggcgtggacccgctgcgcggcacggcggcgctggatgatttggagcagcagtacgaaacgctcaagcccagcggcctgaagctctacccggcggcgtggctgggcgacaagttccgccacacgggctggcgcatggatgacccgaccatcgccttcccgctcttcgagcgggcgcagaagctgggcatcaagaacatcgccgtgcacaagggcctgcccatgggcgcggtgccgctggagccctacaaggtggatgacatcggcggggcggcggatgccttccccgacctgaacttcgaaatcgtccacggcggcatggccttcctggacgagacgggcatgcagctgtcgctgttccccaacgtgtatgtgaacctggaagtgacgggcgcgctcatcgtgaagcgtgaacgctggttcgccgagtccctggcggcgctgctgaagtgggccggcccggagaaaatcatgtggggctccgggacggtgttcagccacccgcacccggcgctgcacaagttctggcatgagttccagctgccggacgacctagtgcaggtggcgggcatgcaggtgacgccggatgtgaagcggatgattctgggcggcaactacgcgcgctacgcgggcgtggacgtggagtcggtgaagaagaagattgccaacgacacgttcgccaagctgagggcacgcggcgacatccagccgtacggctaccgggagagcctgtatgagtgagcaggccctgcgcgagcgcatccaggacatccccgacccgtgcagctgcgccacgggcgtgccgctgggcatcggggagatggggctgattgagtcggtgaagcgcacggagggccaggtgacggtgcgcctgcacatcacctcgcccatgtgcatgatggccgcctacttcatgcgggaaatcgagcagcggttgctgacggtggacggtgtcaccgcggtgaacgtggagttcgaccacgacctgaagtggacgccgcaggacatcgagccggaggcccgccagcggctcgcggccaggcgcatcaccatgctgggtggccgcctgctgccccaggactcggcgcagcgccgctcctgaggggtaatgcggcgctggcgggaagcctccacccgccagcgcctggccgcgctagctgttctccgcgggcgcgtgcgtcacgaggggagccgagctcgccgctgtagagca

SEQ ID NO: 1076 - DNA, 13904 bp, Myxococcus xanthus
  unsure (1)..(13904): unsure at all n locations
cttcgtggggcgcgggtggggtgctcgcgcacgacatgggcttgggcaagacggtgcaggcgctgacggtgctcctggaccggagcaagctggggcccgcgctggtgttggcgccgacgtcggtggccttcaactggatggacgaggcgaagcgcttcgcgccgtcgctgcggatgacgctgttctcggacgcggcggaccggggccggacgttggagcaactggggcccaaggacgtgctggtgttgagctatggcctgctcacgcgggacatcgagcggctgtcgaagctgcgcttctccaccatcatcttcgatgaagcgcagacgttgaagaacgcgacgacgcaccggttccgggcggcgcgggcgctccagggggacttcaagttcgcgttgtcgggcacgccgctggagaaccacctgggcgagttgtggagtctcttcgccgtcgtcttctccgggctgctcgggagctgggaggcgttccgctcgcgctttgccgcgccgattgagcggggcgtggacccgacggccgcgcccgcgctggctcgggtgctccagcccttcctgctgcgccggacgaaggcgcaggtggaggcgcagcttccgcctcggacggacatccgggtgcccattgtcctctcgtcggaggagtgggcgctctacgaggacgcgcggctggcggcgctctcggatttggagacgcgcaagccgaagatgaaggagcaggagcggcgcatcgagattctggcggcgctcacgcggctgcggctcctggcttcacatccgcggctgtatgacgccgggtcgaagctggagtcggccaagctggagcggttcatggagttggtgcgggagctccgcgcggaggggcatcgcgcgctcgtgttcagccagttcacctcccacctggcgctggtgcgcgaggtgctggacgcggaggggattgattacgagtacctggatgggcagacgcccgcgggggctcgggcggagcgggtgcgcgcgttccaggaaggggacgtgccgctgttcctgatttcgctcaaagccggtggcttcgggctcaatctcacggcggcgaccacggtgattcatctggacccgtggtggaaccccgcggtggaggaccaggcgtccgaccgcgcgcaccggatcgggcaggagcggccggtgacggtgtaccgcctggtgacgcgggggaccatcgaggagcagatgctgtcgctgcacgagcacaagcgcgcgttggtggcgggtgtcctgnaagggaaggattcggcgtggacggttgtcgacacaggagttgctgggactgttgtcccagcggctggctccgcctggggaagaggaggggcctcggactcggcactgattcggactgttgtgctgggccctgggtgctgctgccagaacccaagtacgcatcgaggtgcgaacctcggggacgtgtggacgaccttgccaggaagattgctgcttggcgctaaagcgtgattccaggcgatccatgcgaggacaggtcatcgcccctgatgtggtatgcgccttcactgtgctgatgctggggtgctccagcggcgcggtcagccggcgcagtgctgacagtcgcgacgctaatgcgctggcgtcctgtactgacagcatgtcgtgatgcatccagcgcaatcttggcgtgcccgaagcgtgcggactctcagcggcggaggctgccgtgcacatggcgggcatggatgcggctgcgaaacacaccgtcaaggatgtcagcgaagacgatggttggaagcagcactgtgtcgactcatatgtcaggtgcagggaccagaagaagccgtattgggttggagacggctacgcttgcttccgcaactgcgaaggccagcgtgagtggccgtacgaactctgctaccaacgatagggaatgccatggatggcttgaactggaacgatgttcgagacctctcccgccgtattgcccaaggggagccattcgggctcacggactcggcacgcgcgatactgctcaggacggctcctcaggttgggatcgcccccggtgatgctgcgcaagcgctacagtctgagtctaccgctgaggaactgttggcggaagtgtcgcgacgcatcagcaatggttcgcggcgtctgtctcgcaccttggctgaagtggagcgctgccgggaaactggtgacgtcgacggcgctcgccagttactggacggcgtgctcgccgtggaggtggtgccgcactatcaagacattctgcgcgcgaatcttgctgcattggatgacgagtcctgacggagcaggggcaggactgacgctacgctcccgtcgtgcttttgatgtgccctggaaccagcgctgaatcagtgtgcgtcacgacgacttgctccaagccagccactcaatcgcatcggcggctttgcgcccgatggtgtcaccccatccgggcactggcgtcgaatcgccgagcagtgcttcgagtgccgggatgagcgggggatgtttcgtcgcgccgattgcgaagatcgcgttgtagcggacctcaagtgacgggtctgagagcgcctccagcaacgtcttgaccgcgagttcgaactcaggcgagtcggctttcaccaggtcgaacatgtaggcgagtccctccgcagcctgtcctcgtaccttggggtcctcgttgtcgtcggcgaggattcgcaccatgaggccccatgtcctgaggtcgccgtgccaggagagcgcgtggaggattccctgtcgcggctcggccctgttttcgaccttgagcagctccagcagttcccctgtcgttgttgggtcccccgaaaggagtgtggccgcgttgacgatggcgcgccggtcggaacccacgatgtctttcatcgcggctctgcgtttctcgccggagagtggctctttcttgttcttgctcagtgttgagttccttgtaaggccagttgcaagaggaggtcagttctccatgggaggatgaaactgagggagaagtcatcccaccgcaggctcaggagcgcttgggccttttctgccgaacaggactatggccaagactggcgtcatgccaaggacgacatcggaagttgccgacccgatggaaatgcaatcgccctgtccgccggacgtcgtgtagctccctccgaatgaggtcaccgccgagagtacaaagttcaccacgacggcgacgacggtccaaccgacccagttgccccattccagcgagcgtgccctcagtgatgacgctgcgctcggtgaataatccattcgcggagcatatcgcctttctctaggtgacggagacggacggtccttggcgggtcgcgaattcgctgaagcgaatgccacgcaaggagaggtgctgcactgcggccaccatgcgttcgctcgccacgatgagagtaggccagttgtagagccggaaaagatctcgaggagcgggcgtcgaatgaacgtcgagaattggcggccgaggtaactcgtgtcgggacaccccacatgtcaggcagacagggccctctcctggggacactccatcaaggtgcagtcggccatggagttccaactgcatggcgagcagctcgggcgggttctttcctcggaaccgcacgttcagcgggcagcctgacaggccatgaatgcccgcgccctgaaggcgctccacggcttcacggcggatgtatagcgaccatgggttctgcaggaagaggtcgccaaaggtgccgctgcccgtaccggtgggcgggccgaaatcggcgcctggttccagccgagcccagtcgggcgcgaatggacgaaccaagtccctcaatcgggagaattcctcgaagccgacctgccggcctgggttttcgagcgccttgcgctcctggaggcccgacaggtcgacacatgggtactggaggccagcccagccgcctgcggctccacatgtgtcgcaggggctgacgcctgggagtccccagggcggcacggctcgtaggtttccggtgaacccagcggccctgtcttcttcaaccacgtagaacttcaagagcccagcctcctcagtcggccaatctcaacgcttgtagtagggcatgaccttcccggtcagttcaaagcggaagatcaggtcgccggcgtggcgatagatgacatcggggcgcggaggatgtggatgggccttgatgaactgtgcccacgcgtcattccatcgtcccccgcgcggtccgccaccgtgaatgtaccggtggacatgctccggaatcaccaacgtgaagtcgtgaatcttgatgccggctcgctggaagtagagcgcgaggtcgggggcttggggaaagatgtggtgcctgacgtaccggcctgccgggagttgatagaccggccgaacctggacgtgcgggcgccatgggaatgtgatgaccggctgagctccattgcgtatgcccaggcgcacgccccagcctctgcgcagcggcggccgagcaacgggcatgagcgcaggctcgacccgcggcgccacgtcttcgcagagaaagaaggcgcaccagccctcgtcacaagccagggagacacatggtgcggcttcggtggcctcgcaaagctccgcgtattccagttccgcgatgccacgtggcggatctggtgtgggaggagcggacgcgcaggcgacgagcaaacaactcagcaccagcaatcgcagagttgaagcgagtgtgcgcaagagtatgggcctttccggactcacgtcgtgcaggcgtcagtcggaagctaccccaagccctaccttcaaaggcagacccatgctgcttggcgtaatcgctacccgcgcggagcggcggcacgcgacagcctgtcgcggacagcgatacccaggccgctttccgctggaagacacgccaccagcacgtcgtgcccttgtgtatccgcctcacgcagccgggcgtacagcacacgcgcggcacccgcgggctcatccggcacatcgaagcgcggcacgtcgggtggcaacgcaaggctcgctggtccgaggacacccacgcgcaatccctgtccgcggagttcctggacgcgcgctacagcctgcacaggctcggtcagcaccacgccggcacgcggcgcgtagtgtgactccagcgagcctgacacgcgcaccttggacgaagtcctcaccggcaccttgcgtcccagcacccgctccacgtcctccgcggccagacctccgggccggagaatcgcgggctcattcgagctcaagtccacgatggtcgactccacccccaccgtgcacgggcctccatccaggacgaggtccacgtctccgcccaggtcctcccgcacgtgctccgccgtggtggggctcaccttgccgaaccggttcgcgctcggcgcggccagccctccacccagcttttggagcactgcgagcgccaccgggtgattcggcacgcgcagagccaccgtgtcctgcccacccgtgacggcatccgtggcccgcgccgtgcgcggcagcaccagcgtcaacggcccgggccagaaggcttcggccagcttccgtgcggcctccgggacctcacgtgcccacgtgttcaggtgctcgacgcctgggatgtggacgatgagcgggtgggtggcggggcggcccttgatggcgaagacgcggcgcacggccagttcgtcctccgcgttggcggacagaccgtagacggtttccgtcggcagggcgacgacaccaccgtgccgcagcaattccgccgcgcgttcaagggactctggagcaatcatgcgccgccgcactgtcgccccaggagggaacatgggcaagtcgcatgtcttcgatgctcgcactcggatgcccgtcacggccaaggacctcttcgcctggcatgcccgggagggggcgttcgaacgcctgacgcccccctgggaacggatggaggtactggagcgcaccggcgatggcatccgcaccggcgcccgcgtcgtcgtccgcatgcgcgtgggccccatcccccaacgcctggtggccgagcacaccgcctacatcgaagacgccatgttccaggacacgcagatgtccggccccttcgcgaagtgggtccacacccaccggatgtggcccgaacccacgacgggcacgtccatcctggaggacgaagtggaatacgtcctccccgtaggcactctgggcagcctcttcggcggaggcttcgcccggcgcaccctggagcggatgttcgcgtatcgccaccgcgtcacgctcgaggacctgaagcgtcacgccgccttcgcggggcaggggccgctcaccatcgccgtcaccggagcctcggggctggtgggctcgtcgctggtgccctttctcaccacgggcggccacacggtgaagcgcatggtgcgcggcaaggcggaccccgctcggaacgaggtcgcctggtcacccgacacgggcgaggtggacaccgacgcgctcgaaggcgtggatgtcgtggtgcacctcgcgggcgtcaacgtggccggccagcgttggacccccgagtacaaggatgccatcctcaagagccgcacccagggcactcgcaccctggccgaagccctggcgcggatgaagcgcaagccgaaggtgctcgtctccgcgggcggcagcagcatctacggggaccgcggcgacgaagtcctcgctgaggagagcagcacggacgggaagggctttctctcccaggtatcacgcgagtgggaagccgccgccgcgcccgccgaggctgcgggcatccgcgtggtgcacctgcgcatcggccccgtcctggacgcgcgcgagggtgccctggcgaagatgctgccagcgttcctcgcgggaggcggcgggcccatcggctccgggcaacaatggatgagctgggtgtcgctggaggacctgctcgggctcatccacttctctgtcttcaccgacgccgcgcgcggcgccatcaacgccgtggcgccgggggcggtgcggcaggcggacttcgcccggacgctgggcaaggtgctgcggcgtccggccgtcttcccggtcccctcgcccgtcgtgcggaccctcttcggacagatggggcaagaggcgctgctggatggcgcgcgaatcgcgcctcaggcagcccagcggctggggttcgccttcctccttcctgacctggaaagcgcgctgcgcttcacgttggggcgcacgacgaaaggccctgaataccaccattcttagcgagtccggcgcttgacaatcccctccgctacgccagaagaaacgacgcattcgaaggggagaggacacctgatgattcaggtcgaagggctgaccaaatactacggtgagcatgcggcgatccgggagctggccttcaccatcagccagggagaagtcattggctttctgggcctcaatggcgctggaaaatcgacgacgctgaaggtcctggggtgcgtgctgatgccgacctcggggcgtgtcgtcatcgacggccatgacgtggtgagcaatgcccacgaggtccgccagcgcatcggctacctgccggacgtgcctccgctctatgacgagatgacggtgggcgaatacctgacctacgtcgcacagcttcgcggcgtcacgtcccgggacaccgccagccgcgtgggcgaggccgaggagaagacgggcctgcgtgacgtccacggcgagctcatctccacgctcagtcacggctaccgccagcgcgtaggcgtggcgcaggcgctggtgcacaagcccgccctgctcatcctcgacgagcccaccagcgggctcgacccccggcagattgtcgagatgcgcgacgtcatccgcgggttgaagggcgcgcacacggtgctcgtctccagccacatcctcccggaaatctcccagacgtgtgaccggctgctcatcatccacaaggggatgttggtggcgcagggcacggaggaggagctggcggcgaagatgggcggccggggcaccatcgaactggaggtgcgcggcgacaaggcgcgcgcggtggaggtgctccagcgctttggctcggtggaggtggaccgcgcgtcggacggcttggtggcgctgacggtgcgggcctcgcccgaccagcggccccaggtggcgcaggcggtggtgggcgcgggtctggagttgttgcggctggaccagggagccggtcagctcgaatccatcttcttgcggctgacacacggccaggaggcgcgcgcgtgaaagcgctgctcatcgcccgccgcgagctgtccgcctatctgcgcacgctcagcggctacgtcatcatcgcggtcatcctcgcgttgaacggcttgttcttcaacgcatatgccctggggggcgccagcaagcgctccgcggaggtgctgtcgcagttcttctattactcgagcggcttcaccgtcgtcgcctcggtgttcatctcgatgcgcctgctggccgaggagcgtcagacgggcacgctgtcgctgctgtactcgtcaccgctgcgcgaccgcgacattgtcctgggcaagttcctcgcgggattggccttcctcgcgttgtacctcctgtgcaccgtgtacatgccgctgctggtgatggtgaacggcaaggtgtccttcggtcacgtggcggcggggtacttcggtctgctgctgctgggcagcgcgtcgctggcggtggggacattcggctccgcgctggcgcgcaaccaactgctcgcggcgattacgtccgcggtgatgctggtggccctcatcctgtgctggctcctggcacgcatcaccgagcagccgctggcggatgtcttcagcgcgatgtcgctgtggaatcagcacttcccgccgttccaggcggggctcatccacgtgcgtgacgtcgtctactacctcgtggtcacctacgtggcgttgttcgcggccacgcgggtgctcgaggcgcggaggtggcgatgagcgcgcgtccttcgagcggggggctccccgtgacgctggccttcgtctcgggcctgctggcggtcttcctcggtgagcggctctttggcatcggcacgggccgcactgtcctgtctggcctgggcgtggcggtggcggtgggcgcgctggggtggcgcttcgcgcgcatgcggtcggccagcgcggaccggcgcgccgtcgaggcgtgggtgtcaggcctgtacggcgtgggtctcctggccctggggctctacttcgtccagtcggacgtgggcaccgggctcttcggcggccccttgtcccagaaggcgcctcggctggcggtgtcgctggcggcgctcttcccggcgttgctcgcgtgctgcttgctgccgctggcgatggtggaggtcgccgccgcggcgatgacgcgcgcacccgtgctggagacgggccgtgtccgcagcgcgctgtattccgggctggggctggccttcgtgctcgtcttcgccttcgcgtccatgttcgtcgccacccaggccgatgtgacgtgggacctgtcctacttccgcaccgcgaagcccggcgacggcacgcgcaaggtgattcgcggactcaatgagccgctccaggtgacgctcttcttcccgcccgcgaacgaggtgggcgaagcggtggggcagtacttccgcgacctgtcggtggagagtccgggcctgctcaacgtggtgcggctggaccaggcggtggagccggctcgggcgaggtcgctgggcgtccacaacaacggcaccatcgtcctggcgcgcggcgaccggaaggagccgctcacggtgggcctggaagtcgagcgggcgcgcggccagctccagcggttggaccaggaggtccaacgccgcctgctgacggtggcccggcctcgtcgggtcgtctacttcacgtccggccacggtgagcgcgccgagtcgcgagcggtgccgggcgagacgacccgcccgtccgtggagaagctgaaggagttgctgcgcgcgcagaacgtggacgtgcggccgctcggtgtctccgagggcctgggcaccgaggtgccgcgtgacgcctccgtggtggtggtggcgggcccgacgcaggagttcctccccgaggagctgaatgccttgcgtgagtactccgcgcgcggtggccggctgtggctggcgctggagccggagggaccggacttccagccgctgctggagcccctgggcctgaagtacctcaagacgccgctggccaatgaccaggtgtacttccgcacgtcgcggcagcagagcgaccgcggcaacctgggcacggcgacgttctcctcgcacccgtccgtcacgtcgctgtcgtcgttggcgggacaggcgccggccgtcttcctgagcgcgggcgccctggagcagattcagccgttgccgggtggcatggcgcaggacgtgtcggtgcgcgcgcacggcgccaccttcgcggacgccaatggcaacttcacgttggacgcgggcgagatgcggcggccctggcccctggtcatcgcggtggagaagcccgcgccggccggccaagcggcgatgcgcgccgtggtgatggcggacgcggacgcggtgagtgacttgctgatgggcaacatgggcaacgcgtacctggcggtggacacgctgcggtggctcaccggtgaggagtccatctccggcgccgtgtcctcggaggaagacacgcccatccagcacacgcgggagcaggacgtcctctggttctacgcgacggtgttcctggggccagccctggtgctggcggtgggcttcgtgacgacgcgccggcggggacgacgcgcgccgcgccccgcggtggcgggaggtgagcgatgaaggttcgggacctggccctccaaggggccctggcggcggccgcgttgatcgccgcgttcgttgtctggcagcgcgagccctccgcgggcccgggtgaagtcacggtggtggatgtcccggcgcgcgcgctggacagcatccgctacgaggacgactcccgcttcgtggacgtgttccgcgatgccagtgagcgtgaccggctctgggtgcgtctgggctacaaggcctccagggcggcctccggcggtgcgaacgcgggcgccaccgacgcgggcgtggctccacaggcggcggacgcgggcggtgccaccgcggcagtgggcacggacgcgggcaccggcgccgccgcgggacagccgcccgtagccgcgcgcgaggaaccgccaccgccgcgcgagctgcgcgccaacgaggtggcggacaagctgttctcccgcttcgcgcccatgcgcgccatgcgggcgctgggtgagctggacgcgaagaagcaggaggaggtcggcctggccacgtctccgcgcaagctgacgctgacagtggccggcaaggcgcgtgtgttcgccttggcgtcgcctccgggcggctgggggacgccgtacctgcgcagcgaggaggacggccgcgtgtacctgctgggcccggcgatgctgccggacctggagaacgcgaacagccgtctggtggaccgccggctgcacaccttcgacctgggtgacttcgacgcggtgaccatccgcgcggggggcgccacccgtgccttccaggccacgggcaaggcgcccggcccggacgtcctggcgccggaggacgcaccggagcggccggacgacttcacgcgcaactggcatgaccccgtgtggcggatgatgccggtggacctgctcggccgcgacgagccgcttcccggaggcgagccgcaggagtccttccgcgtggactacctgcgcgcgggccgggccgttggccacgtcatggtggtgaagggcgaggggggcttctacgcccggaccgagcacaccacgggctgggcccggctccactccgggatggacgcgctggcggaagaggcggtgcgggtgacggcgcccgtgtccaccgcttcagggaagtgatgcgtcctcgtcacgcaggcccaggtgcacgtccacgaagctgtacggcgcccaggggccggtgaagcggaacgtgtacgtgtccgagcgcgcggccagggagcggaccttctcctcgaagggctccagccggggccgctcgacgaggaaggccgcgttgagcagcatccgctcgcccacggggggatgctcgcgcatggcggcggctcgggggcgcaggccctccagcagcgcccgcatgtcacgcccggcgcggtcctccacggcggcctccaagcggcgctcgtgctcggcctccggctcatcatcgcgccggagaagctgggcgtcttccagcaccaaccgctgggcgaggtgctcgcggtgccagagcaccttcaggcccagctccaccttgccctccagcgcgtccagcacgccggacagttcgccctgggccgtgcgcagtaaagctcgtacctgggcctcggacgccatgacggtgccgaaggccacgggaatcacggtgtgctcacggagcagggtttcggtgacgcgctggtgccccagcaggtgcgctcgcgtcgggtcccccacgcggcctggcgccccggacaccagggccgcgaggcccgcctcgctcaccgcgtacacctgcgcgggaacaatgcccaatccgatgcgcccgacgtccaggggcgcggtgtcacggacgatgccgtagagataccggggcccgtcgggcgtcaccgtctccgccgtgggtggcgaaggccgggcggcctgggccgggcggctgtcgccgtgagccgcccccttccggggccgtgtcgtccgggacatggtgcgcttcacctcgccgatgcgcctccgtgggtggcgagcacgcggcggacttcatccaccagcgcgtccggcaggcagggcttggtgacgaaggagtcgcagcccgcgcccttggcttcgtcggactgccccgtcatcgcatggcccgtgagcgccaccacggggatggcccgcgtgcggtcgtcgcccttcagtcgccgtgtcgcctcccagccgtccatgatgggcagcgacaggtccatgaggatgatgtcgggccgcagctcgaaggccttgtccagcgcctcctggccgttcttggcctcggcgacgcggaagcccgagaactccaggtactcggcgtacatctcccgggcatcttgatagtcgtcaacgaccagcacgaggggcttcggggtctcagatgggttcatcatgcgcgcctcgcgcgtctgggaaagtgcagggtgaatgtcgaaccctcgccctgggtgctctggagggtgacgcgcccccccagcatggtggccaggcgacggcagatggagagccccagacccgtgcctccataggcccgggtcggagagctgtccacctgctggaagtcctcgaagattttttcctggttcgctgggtcgatgccaatgcccgtgtccgtcaccgagatggtgagcgtggacgtagcagccacgtactccgcctgcacctgcactgagccttcgtgcgtgaacttcaacgcattcgacaggagattgaggacgatttgtttcaccttctgccggtcactgtacaccgccggcacgcgcggaccgaggtgggcgctcaccgtcagcttgctgcgcgcgatgatggggtccatctccgccatcacctcttggagcagctccgggatgccgaagtccgacaggttcaagggcatgcggcccgcttcgatgcgggtgatgtccagaatctcgttgatgacctccagcaggtgtctgccgttggagtcgatgcgcgtgaggttccgcttctgcgccgggttcagttcgccggacacgccctgcagcagcatgttcgtgtagccgaggatggcgttgagcggcgtgcggaactcatgggacatgttggccaggaactgggacttgggcgcgctggcctgctccacctggatggcctgccggcgc

SEQ ID NO: 1077 - DNA, 15095 bp, Myxococcus xanthus
  unsure (1)..(15095): unsure at all n locations
ctgctgcggctgggcaccacgctccaggtgcccatgaagctcaacctcgaaggcgtggaggacgccatcctccccgccgcgccggggctggaggacttcacccagcccccgcccgcgccggggctggaggacttcagcgcgccccccgccccgcccgcgccggcgccctagaagggaccgaagctcacttccaggtgctggcgcacgtacgtgggccgctgcgtggcgaagtcacgcatcgcgtccacgtagtagcgccacgactccacggactccggatagccccaacgctcgatgtgcgcgggaatctccgcggcgatcaggtcggccagcgactccagctgcgccgtcacgcgctcctcgctgaaggtgttgtccaggtgccactggaagcgcgacacgaagcggttcttgaagtccgcgttcgtcatcagctggcggatgagcagcacggaccactccggcagtgcctcgtccgtcatcacccgggccagcgagtcgtagcccgggtcaccgaggaaggcgttgtccaggtcgtagaccagccagcgccagcggccgtccttcgccgcggccccgccggactccggctggacgtagcgccagaacttgacgttgttgtggggccagtccgtgttcgcgaagaagatctccgcgatttgatagtcgatgaagtcgtccacatccatcatcgactccacgtgggccaggttctccggcagcgagaggtcgttgttccggacgaagtccagcagcgccaggtagtgcgactcgtcgccttcctcgccggtgtcgagcatcccatccagctccaggatggccaccttcttgcggtcgatgccgtggcgcgacgcgaggtagtactcgtcatatcgctcgcgcagctcatgcaggccccagtactcgccgttgaggtacaggaccgtggggcggcaagcctgcaggtgcagcgcggtctcccgcagcagaccctggagcgcacagtcgcgaatcttggagtacagcaggtcctggcccgacgtgcggacgatgagccgcgtgtattcatccagcgcctcgccggggaacaccgccgcgcggaacgtcttcggcccgtagtcctccttcgcgtacaggcgcaggctcttgtgcggcagcgccgcgctgcccgagccgtggatgcgcacgcccgccccctgcgaaatcaccggctggccttccacttcgaaccactccacgtggagggggcgctcccagtccttgccactctggtgatagttgccgttgccccacatcacgtccggcatggggtcttccgcgtgaatccgtccggggacgtagatgccgtgctcgaagccaaagaagtgctccgcgtccaccgtcagcgacatcaccggcaacggaccatgtgacttgtcgatgagatagctccgcgtgccggaggcgcccacgggcgtggcgtcctggaactgctggaaccgcaccacggcggcgcggctcaccggcccgcgaggcggcagccatcgccactccaccggcgtctccggcggattcgtggggatgagggacaggggcgtgggctcgccctgtgaacgcatcaggaccaacggcgaggtgtagatgggcgagtgggccgtcggcgtcgagccatccagcgtgtagcgcgtcgtcgcggactcgctcgtgggcagcgtcagcagggacgggggctggtagagcgcgtgcggcgtggcgaagtccaacggctggagcgccagcgacgcgcgggccggagtgcccgagccgtcatgggccaccacctcgatggagtgcatcgccgcgccgggcagccattggatgctccactggtcaccattcacctcggcccagccgagcagcacgccgtccacgtggacttccacggccctgatgtcgccctgcccctggatggtgccccgcaggaagccggacgcattgtccatgccatcgatggacacgtacggaacggactgctcttcccgcgggtcttcaatgggcggaacgaccggcgccggcggaacatcctcacggcaagcggacagtgaaatggtgagccacaacaacgccgagcgggacttgaaacgaaggggcatcaacgcctgtctccctgggaacgagcggccagcgcatggctggcacggggacgtccggcccgcaggaatacgcatctcctgcgacacgtcccacacgcgctcgtgcacggcgcacgccatctgagtccccaggtggggcgccctgaaacgcacaccgtacgacgaccgcggcgcccgctatctagcgcagggaacgtttgaggtccatccagccccagtgcatgtcagggaaaacacgagagcccccgcccggtgtcggacggaggctctgggtaccgcaggggtacacgaagggaactacaggagcttcatcagctccgcgcgcttcgcattgtactcctcgtcactgaggacgcctgcgtccttcagctccttgatttccttcaggcgctgcgcggggctgcgcgtgtccgccgggggcgccgcgggcgcgggctccggaggccgctgctggtgctgctgctggttcatgaactgctgggccatgccgaagcccatgcccatgcccatgccgcccagcgcgttgcccgcaccaccaccgccgccaccgcccttggccatgccctcggccgcgccgagcatcgcctggccctgcgcgtactgctggaagccaccggccagacgcgagtacgccacgtccttgcccagcttcttcagcgtcgcctcgtcctcctccttgatggagacgtggaagttgcccatccgcaccacggtgaggccgtagccgtccacgtggggcttgagcccggagatgacctcggtctcgatctcctcggtgtacgcgccgctcgtcacgtcgagcagcggccagcgcttcttgacgagcagctccgcgatgcggtcgcgcgtcaccttcagcacctggttcttgaaccagccgagcagctcgtcgttgccggtgcggcccatgcccaccaggcccaccaccaggcgctccgggtccgtcacgcggatggagaagtcgccgtacaccatggtgccgatgcccaggcccgtctccgggtcgcgcacgtcaccgatggggccgccgaacttcacgccggcgaactcccgggtggagacgaagaagatttcggagatgaagaggttgccacccgtgaagccttcgatgaggcgggacaggaacgggatgttgttcgtgtccagcgagtgggcggccgggccccagcttgccctccaccttgccgtccttcacgaagagggcgacctcgtccgcatcgacggtgagctgggtcagcatccggacgttgttctccggatacttgtagatgatgtcgcccttcgccgagtccgcccgggcgatgaagttgcgcttcgcctcacccttgatgctgtcgaagatacccattgccgtcagcgcctccgtggccgcgttggcagccggtcaacccgcgccgccaccccaacccttttatttaagagcatggcatcccggacgaaagcgcgcgcgctcgcgtaccgacacctgctcgcaacatgccagttttactggcgaaagcctagccgctcgacaggctggatgccctggaaagcgacggccggcgtccgcgctagccccagcgactcaccagccgctcacggtccaacaggcggatactggcccacagcaggagggcgtccagcaccagcactaccgcgccctggagcaggtagtagccgaagcccgccttgagcacgcccgccacctgcccacccaccatgcccacgatgggcagcaccaccagcgcggacagctgctgggccatgcgcgcctcgctcacccgggcggagatgagcaccgccaccccgttgccgaagaaggcgaacaggggcgcgatgacgaacacgccgaaggtccacagcgcgttgggcatcagcggcatcttcaccagcggccacgcgacgatgtccacgcccacgcagaacaggacgaaggccgtccacgtaatcgccacggacggcaccagcgccgccaggctcttgcccgtcaccagctccgccgccgtcacgggcgaggccaggagcggctccagcgtgcgccgctccttctcccccgccacgctctgggacgcgatgaggatgggcacgaacaccggcatcaccaggaacatgccgaaccagtcggtgagcgtcttgtcgatgaggaagcgcgcggcgctggcgcccaacggcagcgtggggtcgtagaagagcgccacgctgcgcaggtccgcgtggtctggcgtgcgcacgtacgtccacaccacgccaatgggcaccagcaccatgacggccgggagcaccatcatggacaccagcaggcccacgttttttcgcaggtccaggaagtccttccagaacaccgccagggcccgcttcggacggaacgccatgggctaccccctcccttcgcgcagcagctccagatagacctcttccaggggacgctgggtgggcaccgcgctgtgcacccgcgcgcccgcccccaccaggcacgccaccacgtcgggcgcctgcgcatcgtccgccagcatcacccgcagcttcggcccttcggccagcacgttgggcgcgaagggcaactgggccagcgcgagacaaaagcgctccgcctccccttccacgcgaacctccagcgcctgccccgcgtgccgcagctcgcgaaccgggcccatggccagcaggcggcgcttcaccaccgccacgcgctcacacaggcgctccacctccgccaggttgtgcgagcacaggacgatggtgcgcccctccgacgccagctccgccacggcgtcacgcacggtgcgcgcggactccgggtccaagccgctggtgggctcgtccaggaagatgaccttcgggtcgtgcaccagcgtccggacgatggccagcttctgccgcatccccttggagaagccgcccaccggctcctcctcgcgcccacccaacccgaagcgctccaggtagtgccgggcccgaggccaggccgcggcttcgtccagctcatgcagcttcatgaagaagcgcaggttctcccgcgcggtgagcctgtcgtagaggccgggctgctcggtgagcaggcccaccaccttgcgcagcggctcgccgtcgcggtccacccggtggccccacacggtggcctcgccctcggtgggctgaagcagccccgtgagcatgcgcaccgtcgtcgtcttccccgcgccgttgggccccagcaggccgaatacctcgccgggccgcacgtggaaggacaacgcctccacggccacccggtctccgaagcgcttgcccaggtcctggacgtggatgccgctcaatcgatggtcaccaggacgaacttgttgttgatgtcgcggtccaccggcgtgacgaccttgtccgagcccaccgcggtgcgcagcaggttgagccggttgtgctccaccagggcccactcacgacccggccgctgcgccagggcgcgcatgcgcgcgttcgcgtccgacacgcggtactgctccaccgtgttctgcgagtagaacgtctcgccgcgccagttcatcatgtacgcgacgatgggctcgcccgcctgacgctgcgcgtagtagcgccagaagaggtcgcgctgcgtccagtggtgggacaggtccacccagtggctccagttgaaccagagggccatgcccgccgcgagcacccagaaggtgccgaacagcatcgcccgcgctcgcatcagcgacgccaccaccgccatgccgcccgccaccgcgaaggtgaagcccagcgtcttcttgatgttgacgggctccgacagcgccttgagcagcgagtcctccgccgccggctggcggaagccccgcaccgcgaacgcgatgcccaccaccgccagcacgccggccagtgtctggagcgacgcgcgcccctccgcgcccggccgcatggactcccatgccagataaccagccaccgccagcaccgctacgcccaccagcgccttggcggacacctgggcctgggcgctcaccgcgcccagcgtcgccacgccgcccaggagcagcatcaacgccacggcgcgcgcgctcggcgtcgtccgcgcccgccccttcgcggagaaggcatcgaaggacaggtagacgccgaaggccagcagcaccagcgtcaccaaatctcccgtccacagcgagcgcgaggtgaagaacgcgatgggcttcgtcaccaggtcctgcgtataggtccggtcgtagttgtagacgaacaggtcggtgaagatcttcgggttctccgcgatgttcttccccaccaggacgaagagcaggaacccgaagatgaggctcaccgcgtgcgcggagatgccctcctcccacagccggtcgatgaagagcgccaggaggacggccacgcccggcagcaccgggaagacgtagtggtggaacttggtggcgctggacgacagcagccagaaggagaaggccacccacagcaccgcgatgatggccaggtggtccgccgccttctccgagcgaagcttcagccgcgccaccaccgagaaggcgccgggcagcagcgccacccaggggaagatggcgaagcccccctgctcgatgaagtagatgaacgtgccacccggcgtggtggtgtgcacgcccgccgtgaggcggttgaggtggtcgtggacgaagaagcggtaccagaagagcttgccctcatcgtccacggagccgaagagggacagcgtcaggtaccaggggcccgccaccgcgaagaacaccaggatgcccgtgcccaggtgcatcttgaacatctgcccccacagcacgggcatgggctgacggccctcgcgcacgtccttgcggaagcgggactgcgtgagccacttcaggtgtgcgtccaggctgtcgctgtcccagggaatgacggacagggccgcgtacaacaccaggatgacggcgggcaggcccacgcccagcaggcccttggccagcgcggacaggccggcgaagaaatagaagccgtaccaccaggcggcgcggtgcttcgtcgtcgcatccagttggccgatgagcgcgcacgccatggcgcagatgaaggtggtgacgaagggcgtgtccgtcaccgtctgccgcgtgagcaggaagtacagcggcatggtggccagcacgaagccggtggccaaccccgcgcgccgggacaccacgcgtgccaccgccagtgacagcagcgccaccgcggtgatgctcaggagcgcgaagggcatccgcatgccccactccgtatagaggcccagcatcccacccgggttcgccgcgcccaccacgttcatgcccagcgcctgcatccacatcgtgagcggcggcttggagaagaaccacgagctttcccagaagggatacacgtagtcctggcggacaatcatcatccgcgcgacttcgccgtagtgcgtctcccaggggtcccagagccccaccgcgcccaggtagggaaggaagagcagggccgcgaagcccgccgtggccgtcacgacgcgcagactgagggacagctccagccaccgcttcgcccacttcgcctggaagaagtccttgccgaggatggcctcggcgaaagtctgctcccgctgctgttcgacttcgctctccacggactgaagctccttgagtcgttccgggcggtgggcggcccaccctcggcaggacgcggcgttatatccccgcggccccctccggtcgaccaccgccaacggcctccgccgtgagccagactgcgcgccgctgtgcagggagatgtacacgacaggggcgccaaccccgcgaaagcatggctccttggcagaggcacggcgcttgaaacgcccggggccggcggtgcttcccgaggccgacgggaaatggccgccgaggagacatcatgctcgcccccgcagtgtccctggcttgcgccctcttgctcgcgcagccagggaacgaggcccccgtccttcagccgcccaccaccccgcttccagcccaggcgtggcacgcccccacggtgtgcttgcggctgccaccgacgaataacgttccctccggcgagtggcgggcccagtgtgacgacaccgcccaggcgtgccgggtgtccccgttgagggagctggacgccgagggcgtggagacggaccggctgcaagcgcgggtgacgacctgctccatcgcgttcgatgaggaaacagcggagcgggtgaagggttatcgaatggagccggcccgcgcggcggccccacccggctggtaccgcgacgagcgcgggcgggtgatgcagttcaacttcgacctgaaccggcgcgtctggctcggaggcgcatgggcgcctctgtggcatgacggccaggtgcagggtcgcatgcgcgccgacttcggcatcgcggtggaggcaccgtcccaccgggggaagcggctgcaccggctccgcttcctggagacggagctgcacctgggcgtgccctcgctcgacctgacggcggcgcgttacgacttcagcgtcgagcgcgacgacccgctcttccgcgtgacgaccttcttcggcaagccgcggcggcatgacctccacctcaacctgggcttgtggatggagacgctccgcgtggaggagctcgaacgcggcggagaagtggggcgcttcctcacctggggcacgctccacgccacggtggacctgtggcattcgaaggacctggtgtcctacgtgcgcgtgcgcgccggtccatccttcgagcgggactacgcgaatggcttcaacaccttcgtccctggcgcggcgctcgaagcagacctgacgctggaccaggacggcttccaccacctgcggctgggagtggaggcggagaaagtgttgctggccccggccgtcgtgggccgcccgctgaggccggagcggctgcggctccaggccggctacgaggtcatcatcctggccatcaacgaccagccgttgagcctgctcgtggatggccgcggcatgaagcgtggcgacatcgcgggcgtccccgagcagtgggaatggtccgcgtccgcgggcctgcgcttctccctctgggctcccgcgcgccgctccgcgcccatggccacgtccgtgaaggagtaggcctccatgctgatgctcggactggcgctgctgctggccactgccgcggacatgccgcggggcgtgcccgatgacgacgcctgcgtggccctggacgaacgcggtgagcgctaccccatctgcttcgaccctggcgacggcttcgtggtgggcatgcacacgcggctcagcggctcggcgatggcgcaggccgtgcgcacgggcgtgcacatccgaagcggacgcagcagccggagcaagggctcaccctggttcaacaaccaccgcctgctcggtctggaggcgtgggatggagagcagcgtggtctcaccttcacggcgtatgacgggacgctgcgccggcacctggaggaaggcttcatcctggtgcccacggcgcggccagcgcgcattcccttccccttcgacgtgacggtggcgctgcgactgggacacctggagcgccgcgtctgggagggccccggttggaccttggaaacgggacggctgggcctgctgctggacccgatgcgcgcggagacggagcgggtgtggttcggcgtggggcccgtcgccgggcacgcggtgcggcgttcccgggagggcgtctcgcacacggtggcgcccttcaccgagctgatgttcgacgcgggcgtggagtcacgggacggactgtgggccctgcgagcatcggggctcgcgggctggagcatcggaatcgagcgagggctgcacttccgcgccaggacggacgtgggcctggagcgcgtcgtgctcgcggtggcggaccaacccgtggtgctccaggtgagcggggcctatgtccaccgggacgcggggctggaccggcgcagtgagtggaccgcgaacgtcgggctcgcggtccgagttttcggcgcccgatgatgcgaacaacgacttcctgctcaaggacgaagactgaagcctgtcgctcgggcgctccccccaaggagcgcccagcgctggctcacttcggctctgtcggcgtgacggcgccgttcaacacgttcacgagcgtcgcccccagcgccacaggcgggtaaggcaccgcggagagaacagaggtcgccgagtcgatgaccgcgtgcgccttctgcgacggcgtggacgtcgggttggtgaacacgtcccgcgtgttggacaacgaggacagcgtgctgaagacgttcaggaacggcacggccttgcccaccgtcttcgcgacggtcgtcgagggcatcgacgaaggcatgttgccctgcagcccatccttgatgacgcggacgcccgactcgaaggtgtccgccacgttgatggcgttgttcgccgtgccggacatgctgcccacctggctcatcaccgagtgcggcggcgtctggacctgctccggtgtcccgctcttgcctcccacgctcttcgcgccggtcgctccaagctgaagtgcgttgacggtccggtccccgatttccaccccggtggcgcccagattgatgggcggcttgctgggcgaaacagtcggctttccaaaaatcctcgtcatggtgtcccccctctgcgtgtgccttcggcctacattggggttatctgcgacgattctcaggagtttcgcctacattttccgacctgggtttcagcgatgcggcgcagcctccagcaccgtccgcagcgcgagttccgccgcgcgcagtcgggcatcctgagggtccacccggcgcgcttccaccaggcgctccagggcccgctcgacgttgccgcgtgacagctcacagcgcacacccgcctccaacgcgcccgtgtcccaaggcccgtacacccgcgcctccgcggcggcgtgacacccttcctccacgcgcgatgcctccaggaacgcgcgcgccagttcgacacgcgtctccacatgagcgggcgccaaccgcacggactcgctcaacggcgccactgcttccggggcgggcccttagtgcggctcaacgctgttggccaggagcgccacggtgggggggtcgttggagcaatcagcggtgtagcccccgcctcgcgtaggacggacggctcgtcgaagcggacctccgccaccatccggtccaccacctcgcgataggcggggtacgccgcgggccaggtgaacaccagccggtacacccactccccccgtggcacgaagagcgccatcaggtgagtgggcccccctggcccctccaactccgcatgcagccgctgcgcgctccgcccgcccacgcgcgccgccaccggctccgtcaccttcagcgtccgcccctcggggctcggagcgccctgaaccagcacctcctgctggaactgccgcgcctggaccgagccgtctcctggctcccccgcctcgatggcctccgccgagaaggtcgcgcggccacgccccggcagtccgttggagaaggcccgccggccctgcccgtccacgtcgccccgccagtcgcgcggcagggccacggagaggccaaagccgtcatcccgctccatgcgccagacggagcgctccgcaaccacgccccccgtnaccaccaccgccgccaccaccatccccaccgggcgcagccagcccgtgtccgggtgccagcgcggctccaggaagacgccggccagcagccccgcgagcaaaccgcccaggtgccccgcgttgtccacgcctaccgacgtccaccccatccataggaagacgagcaccgtgggcaccgcggcctcgctgggcatccaccgcgccggcagcttcgcccggtgacgccggcccaggacaagcagcgcacccacacaggcatacacgagcccagaagcccccacgctcacgcccccggagctgccgagcgagcccgccatggtggccagccccgccgccaccagcagcgctgcgtagtcccggcgtcggcacaggcgctccaggccgcttcccgccgccaacagcaccaggacattgagcgccaggtgggggaagtcccggtgcaggaagtgggcggtgacgagccgccagacctggcccgcgtccaccaccagaggccccgccttcgcgccccaccgcagcagggtgtccagccccaccggccccgcggctcgcgccgcgccgtggatacccaccagcacggtggcgaggatcaacgtgagccagggcgcccccccaagtcgcattccaccggccgattgaccgatggacaacagcctcggctgcccctcttcctcgggagaaagtcgtgtcttttgagggggatacatggcttgtacagggaaaggccgttctgctatgactgtacgcggatcggacccgtgctgaagctcatcatcgaagacgacgaggggcgcaagaccgttgttcctttcgtgcgtgacgagatcaccatcggccgtcaggagggaaacaccatccgcctgacggaacggaatgtgtctcgccgtcacgcacgattggtgcgactcaatggccacgtcgtagtggaagacctggggagctataacggcacccggatcaacggcgagcgaatcgcgggtcagtcgcccctgaaagagggtgacctggtccagattggcgactacgacctcgcgctccaagcggagggcgcggccaatgccgtaggccccatcaccaccaaagtgcccgcccgccggccggagcccgagccggaggaggacgactccgacgacgacgagccggaggagagcgagcacaccccgccctccctcagcgccgcggacgcgcgccgtcactccacctccatcatccggttggaccaggtggaggcggatcggccgcgcaaggtgctggacgtgcctgccgaggacgctccccgcctgctcgtgctgtctccggacgagctcaagggccaggagttcgcctgcatccgcacggagctgcggatcggccgcaccgacgacaacgacatcaccttggatcatcggtcgctgtcgcgcacccacgccaagctcgtccgcgaggacgcaggcgagtggcgcgtcatcgacatgcagtccgccaacgggatgacggtcaacggtgagagctacgcacaggccacgctcgccaccggtgacatcatcgaactggggcacgtgaagctgcgcttcgtcagcgccggtgacgcgtcggacgacgtggccgcgggtggtggctcgcgctcgaagctgcccctggtggcgagcctcgcggccctgctgctcggcggaggcggcggagccttctggtacatgaaccagcagggcacccagccgacggcgccccccgtcatcgcgcacacgcccacgccccctctggacgaggatccgccgccggccatcgaggaacaggccgcggccaacgacaccccgcccacgacggcagccgcggcggcgcagacgcctgaaacgcctccgcccccacgtggcccctccatggaggagcagcgcgcggttgctgacaaggcgattgcggcgcgtgacttcgacacggccgtggacgcgctggagcgcatcaaggatgccaacggccagcgcccccgtgacgtggagacccggctcgacgaggcgcgcgccgagcagttgatgaagcggcggctcgatgacgtccgcaacgccctgggcgacggcaagctgccggaggccgaggaagccttgcgcgagagcgccgccaccaaggcgttcgccaaggagtacgcggcgctgaagacacaggtcgccgaggcccggaagaaggcagctccgcccgccgcggttccctcttccggcacggagaaggcgccgcccgccgcgcagtccgcggcggccaaggcccaggcggacggcttcgagcacatcaagggtctgcgctaccggcaggccatcgagcagctgaacaagtgcctcgagttggaacccacccgcgccgagtgccacctctacctcgggtccgcctacgcgaatgacaaccagcccgagaagggcgcggttcactacaagcgattcctggaacttgcgcccaatcacgcgtactacgagcgcgtgaagggtttggtcgagagttacgagaatcccaagaagtagtggtctgccggaatcaccctcgccccccgggggtattccggtcccatggcactgaactgcagcgaggagacgctgtgcagattcgcatcctggtagttgatgatgagcaggacaactgcgactacctcaagctggtcctgacccgtgaaggctacgaggtcgtgaccacgacggaccccacccagacggtggaaatcctccggggctccgacttccacctcgtcatcctcgacatgatgatgccgcagatgtcgggcaccgaggtgctggagcagattcgcaagtacgacacggacgtggccgtcatcgtcgccaccgcgtaccccacggtggacacggcggtggcctcgctcaaggcgcaggcttccgactacgtcaagaagcccatggagccggagcagttcatcaccgcggtccgcaacgccctccagaagaagggcttgtcccaggacccggaggcggacctgcaccgcgccattggccgcaccatccgcgacgcacgcaagacgcaggagctcacgctcaagcaactggcgcggcgcacgggcctgtcggtgtcgctgctgtcgcagattgagcgcgcggagtcctccgcctccatctcctcgctgtacaagattgcctcggccctgcaactgcgcatgggcgagctcttcggcgatacctgatgtcgccgtggcagtgccccgccggccgccctgactagcggccggagaagcggggcgggcgcttttcaaggaaggccgcccgcccctccttcgcgtcctcgctcccgaaggccgccgcgcgcaagccgcgcagccgcgcccggtccgcctcctccaacggggcccgagccaggcgcccgaaggactccttcatccccgacaccgccagcggtgcatggccggccagggtggcgcacagcgccagcgcgcgcgtctccgcgtccgccaggcagtcatccaacctggagag

SEQ ID NO: 1078 - DNA, 13534 bp, Myxococcus xanthus
ggcgccgagtagtcactgcgcggcgccgcgctctgggacgaggtgaaggaccggctggacgaaagcgccctgggcctgtccggcggccagcagcagcgcctgtgcatcgcccgcgcgatggcggtggagccggaggtgctgctgatggacgagcccgccagcgcgttggaccccatcgccaccgcgaaaatcgaggagctcatccacgagctcaagtcgacgtacaccatcgccatcgtcacccacaacatgcagcaggccgcgcgcgtcagcgaccgcaccgctttcttctacatgggcgagctggtggaatgcggccccaccgagcagatcttcaccaacccgcgagagaagcgcaccgaggactacgtcaccggcaagttcgggtgagcggaagaaaaaggggaccggacacatgccgtcgatgcatacggacaaggccttcgaggcggacctgagggatttgcgggagaagctgctcgccatgggcgcgaaggtggagaccctcatcgtccagagcatgaaggcgctcacagaccgcgacagcgccctggccgagaaggtcgtcgccgccgacaaggacgtcaaccgcctggaggtggacatcgacgagctgtgccggaagattctggcgctgcgccagcccgccgccagcgacttgcgcctcatcaccacggcgctgaagatcgtcaccgacctggagcgcatcggcgacctggcggtgaacatcgccgagcgctccatggacctgaaccaggcccccccgctggcgccctacgtggacacgccccggctggcggagctggcccagcggcaggtccgcatgtcgctggacgccttcgtctccggcgacgtcgccaaggcggaggaggtgctccggggcgacgacttgctggatgccctcttcctcaaaatcttcaacgagctcctcgcctacatgatggaggactcgcgcaacatccgccgcgccacggcgctgatgttcatcgcgaagcacctggagcgcattggcgaccacgcgctgaacgtggcggagatggtcgtctacatggtgcgcggcaaggacatccgccacccgcagagccgcaacctggcggagtagcccgcgggcgcgggattcaccgccctgtcaccgcgaattgcccggcccgccccgggcgcttcgcggggctgacgtggaaggcctctagcgtggcaaccgtggtcgcgccatgacggcgcaccggccccggggattgcccgcgaatgttgctcgcctccaccgtcctgctgcttgccgcctgcctcggactgttcgttctcaccgtccagttcgcgctcgtgctgcgtcaccggcgtgagccgtcccccaccgcgcaaccgggcacgccccgcccgggcatctccatcctcaagccgctgtgcggcgtggatgacgacctggaagccaacctggcgcagttcgcggcgctggactacgcgggcgcgtacgaggtggtgctcggcgtcaaggatgccagggacccggccttcgccgtggcccgcgcggccgtggcccgctggccccacgtcatgcgcctggaagtccaggacggcgagccgggccgcaacccgaaggtgaaccagctcatcaccctggcggaccgggcgcgctacgacgtgctggtcatcagcgacagcaacacgcgggtggcgccgggatacctggaggagattgcccaggccttcgaggacccggcggtgggctgtgtcacccacccggtggcgggcatgggcgagcgctccttcggctcgctcctggacaacctgcacctgggcgccagcgcggcggcggggatgattgccgccaagcggctggcgggccaggacatcgtggtgggcaagtccatggcgctgcgccgcgaggacgtggacgcgctggggggcttcttctccgtgaaggatgtactggcggaggactacgtcatcggccagtgggtgacgcggaaactgggccggcgcgtggtgatggcgcacacgcccgtgttcaacgtgtcgctgcgcaagagcgtcctgtccttcttccagcgctatgtgcgctggagcgtgattcaccggaccgcggtgtctccggggacgtacctggcccaggccctgctgaaccccacgccgctggccctgttgggcgcgatgctggccccctcctccgacaccgcggcgctctgcctggtggtggccctgggcaaggtcgcggtagacctctccaccgtgcgcgccctgcggccgcaggccctgtcgtgggacgcggtgcccgccgtcttcgccaaggacgccctgctcttcgcggcctggagctacgcgctcttctcccgcactgtgaactggcgcggcacccggctgcgcgtgggccggggcacccggctgatgccggtgcgcacggcaggcctgacgtccgagcccgcgctgccccagggcgaccgcatcctcgcgggctgacccggcgacgcgccctaccagggcctgcctgcccgcatgctgcggcgagcaccatgtcgccgctcgcggagaatgatggcgcccttcagcggcgttcatctcaggtcgggggaggacgattggcgcgactggcaacggataacggcgcaagaagggtattggtcgtcgatgacgacgcggactggagggaattcctccggctcagcctggaggaccttggctacgagacgaccgaggcctcggatgggcaggaggccctggagacgctgaggcgtggcggacgctacggggtgatgctgctggacctcaacatgccgggcatgtccgggctggacgtcgtggagcatctgccgcgcgggccgcatccccgcatcgtcttcctgacgtccgcggcggcgcaggatgtaggcagtgccctgctctcagggccacactactacctcccaaaaggtgcgagccgcgaccaattgtcactccttttgcagtcacttggtgagtgagcagcccgcctctggcgtatagggtagagggcccctgagaggagggccattatcgtcaccgagcttctcatcatcctgttgctggtcctggccaacggcgtcttcgccggtgcggagctggccatcatctctgtccgccggacacggctgcgggaactgattgaagaaggcagcacctccgctaaagcggtggaggccctgcgcggcaaccctgagcgcttcctggccacggtgcagattggcatcaccgtcatcggcgccacggcggccgcgttcggtggcgcgagcatcgccacgcgtctgggtgacttcctcacgagactgggagtgcccgagcagcaagcggacgaagtcgccctggcgggcgtagtggccttcgtttcctacctctcgctggtgctgggcgagctggtgcccaagtcgctcgcgctgcgtgccggcgaacgctatgcgctgctcatcggccggcctctgcgcggcctggcgtggctgatgcaaccggtggtgtggttcctcaccgccagctccaacgtggtgctgcgcctgttcggcgaccggacgaacttcaccgaaggccgcctgtccgcggaggagctccagcagttggtggaggaggcggcgaagcagggcacgttggatccgcacgccggcgaaattgcatcacgcgccttcgagatgggcgacgtgacggtgggcgagctgtcagtggcccgggatgagatggtggccctgcggcggcactccagtccggaggagattcgccgcgtcctgctggagggcggccactcacgcatgccggtgtacgagggcacgctggacaacatcgtcggctacgtcatcgccaaggacctgctgggggtggcctgggagggcaacctcatcatcctggaggacgtgatgcgtccgcccttcttcgtcgtggagacgatgcgggccatggacgcgctcaaggaactgcagaagcggcgcatgcagctggcggtggtggtggacgagcgcggcggtgtggtggggctcgtcaccgtggaagacctcgtggaggagctggtgggcgacatcctcagcgagtccgaggtgccggaggagtacgtcaagcgcgaggggccgaacaccgccctggtgctcggcaccgcgaacatccgagacgtcaaccgggagctgtccctggacctggacgaggatcaggactacgccaccgtggccggcctgtgcatcgccctgtccggcggcgccatccccgagccgggcacgaaggtccagacggagggaggactcgtgctggaggtcgtcgcatcctcgccccgccgtgtggacaccgtgcgcttccacctgccgcagcgcgaggagcccgtggaagcgtgacggcggcacagcgcccgctgtcctatggacgcgcgggctgggtgaagcaagtgaggtcggcggacgacccgaacccgacggcactccgcgcggagatgaagaagtagaggaccctgccgtcgttgggaatgtccgtgaggtggtagctcaagtcagtggtgtaccagtccgtgctgttcccattgacgacagcgttgatgcggtactccgtcacggggttgccgtaatcgaactccggtggctcccacgaaaaggagatccatccgtcgcccccctggcacatcgcattgagcggcatggagggggctcgcgtgggcatggcggcgatgcgctccgagaccccgccccagcccgccgcgttctccgcctcaacggtgaaatggtaggtcgtggcgttctccagttcttccacgagcgtgcccgtcgcggcggtatccacggtgcgaatcacctcgtcccccaggtacaccgtcacccggtaggaggtgatggggctgccgcccgtgtcctcgacgctccaggccaagcgcacccgctgaccactggggaagaccgtgacgacaggcacgccgggcgtcgtatagggcgtcgcctcgatggaggcctcgggcccccgtgaatgcccgttggaggcaacgacgacgaatctcaccgccatcccgttggtcagcgggtgaaaggtcttccccaactcggtcgcgggcaccctcaccatctcgccttcctgcgcgccgaagtagggcgtgatgaagtaactgtccagcggcatgcccttgtcatccgcggcatcccagctcagcgtcacacgttggtcgctctcgacggccaccaggttccgcaccgcaccgggcgtcacatgggggaccactcggtcggagcgccccgaagcggcactgttgccacgggcattcctggcgacgacgctgaaagcgtaggcggttccattcgtcaggtccgtgatgacggcccgggactcggacgcgggcgccgtcaccacgcggacctccgcagcgtccgagtgcacatgcaccgcataatcgaggagcgcgctccctccgtccgaagggacatcccacgtcacggtgacctggccgtcgcctggcaccgcgatcaccaacgagggagcctgcggcactgtcgcctggggctcctgcgagggcggccgctcatcgaagccaccacatcccagtcccatcatcacgccccaacacagcgcagccaccagtcggattcgtccgttcatcttgacactcctccccccggaaaccgggaaatcgctgcgtaccgcaggaggaccgccaccgggaagagtccgtgacgacccagcctcttggaaggacggaaccctacttccaaggtgggcaatcgatgggcggagattccgaagaggggtcagcgcccgggattgatgaggaacaatctcaagaatcccgggcacttccaccagcgcgcgatgcaggattcgaacctgcggcctttggctccggaggccaacgctctatccagctgagctaatcgcgcaaccgacatccggatgaagcggggcgacaagtagccgaagtcccccgccgaagcaagcacgcaatcctacaacggacgccagatgacgtgccatccctccagggcggaatgcgccccgtccgctcacacgcggcgcctccgggcagccatcagcaccagtacgccccaccccaggagcagaaggggcgcactcccccgccctcccgcggcacagctcaatccgccaccgcgggaactgaccgcccggatgatgttgatggagggatccaccttgaaggcgctctctgccgagcgctcgctttcgttccccgcggcatcccgggccaaggcactgaatcggtggtctccctcgctgatggcccgggtcaacgtcaggcgccactgcccggtgggttcgacacgcgcactgccaaagtcgagcccgtcaacgaagagcagaacctcactcccaggctcggcgcttccctggaacgtcggcgtgagcgagcccacgaccgcctcgggcgcgggcgaactcaccaccggcaccaggggaggcgtcgtgtccaaacgccagacatgcaccgcaggcgttgcatccacgttgccagcctcatcgcgagcacgaacctcgatgcggtgctcgccttccggcacgccatcccacgtgtacgcagggggacagttgtcgaacgcagcaccgtcgatgctgcactcgaaattcacgaacgactcgtcggactcgaaacggaagaccgcccgcgccacgttcgtatccgcgacaggcatttcaatgatgttggtcgtcggtgccaccgagtccacgcgccactcgtgcgcgccctgcacatccgcgacgttgccggcgcggtcgacggcacgcaccgcgaacgtgtgaagtgcatcccccaccgtgacttcatgagagttggggccagtacacgacgcgaaggcaccgccatccaggctgcactcgaacgtcgtgcctacctcattcgattcgaactggaagaccgcgcgcggctgattcgtcaggtgtggcggggccgcggtgagtcgagtttccggcttcgtcgcgtcgacagtaaacgttcgaaaggcttccgcaccgtcgttgcctacggcatcggtcagcgagacggccagcacatggggcccatccgccagttgcaccgggctttcgaagctccacgacaacgactgctccgagacctggaacgtgcctacgatgtcgccatccatcttgatgatgaaggttccgcgttcggaaacgcgtccactgaattgaggccactggacgttgaagtagacatcgttctgagcaggaacgttgatgaccggcgccaccggccccgtcaggtcgacggtccagttataaaccgagggcgacgaggcctctcgcccccctcctcgggcccacactctcaaggtgtgtcccccttcggcaagtcccgtatacggcttggtcggcgactccgaggtcgcgcagtcttcctcacgcggctcgtcgtccaactggcacgcatagatcacggtggtcagattggaggtgaagctgaacgacgcgctggtttgccgagtcaccgtcgggggcgccgtctgaaaataggtcaccgggtcccccaccaccaacctccagatgtggttggccggggtctcatcccggttcccagccgcatcgacagcccggatgagcatgctgtgatcaccctccgcatagaccgggatgcctggaggattcgggagggcaaagggactctcgcatggcaagaagtctcgtccgtcatagctacactcgaagcccacgacgtccgtatcgttatcccctccgcggaacgcgaaggccgtcgtcggctcgcccgtcaacgcgtccggcttggacgtgatcaccgtgtccggaggatctcggtccaccgtccatgtcgcaccagcgggcgtggcatctacattgcccgcggcatccacggctcttgcccagagtgtgtacgtgctggtgatcaactcggacgtcaggtgtgaggccccgcaggcctcccagtcctcatcatcttcttcaggcatcgtggtcgacgaaggtcgaaccaggatgcactggaagcccaccacgtctgtgtcgggagacgacaggttgaaccgggcacgcagtgcattgctcggtgaatccaccaaggccaccacttgtgtgtccggacgaaccttgtccgtccgccacgagtaggcggccggcgtcgggtccacgttgcccgccgtatctctcgcccgaaccaggaaccggaacggcgcatccgcacccggtgtctgaacgatgattccactcgtgcacgtggcgaagggcgccccattcaggctgcactcgaaggtggcctgcgggtcgttcgagctgaacgtgaagggcaccgaagtctggttgttcaccggcgcgggcagtggcgccgtgagctccgtatccggaggctccaggtccacccgccactcatggctggcaggcatgccatccacgttccccgccgcatccaccgcccgaacccacagccggtaggtggtgttgtgcgtcaactcgggcgtcaggtacgaggcagcacagcccgcccaacgcgcgtcctcttcgtccggcatcggcgctgtcgacggcgacgccagaatgcactcaaagcccaccacgtccgcgtcaggagagttgaagtcgaagcccgcctgcagcgcgttgctcaagctgcccatcgtggtgtgcaacaccgtgtccggacgaaccttgtccgtccgccacgagtaggcggctggcgtcgggtccacgttgcccgccgtatccctcgcccgaaccaggaaccggaacggcgcatccgcacccggtgtctgaacgatgattccactcgtgcacgtggcgaagggcgccccattcaggctgcactcgaaggtggcctgcgggtcgttcgagctgaacgtgaagggcaccgaagtctggttgttcaccggcgcgggcagtggcgccgtgagttccgtatccggaggctccaggtccacccgccactcatggctggcaggcatgccatccacgttccccgccgcatccaccgcccgaacccacagccggtaggtggtgttgtgcgtcaactcgggcgtcaggtacgaggcagcacagcccgcccaacgcgcgtcctcttcgtccggcatcggcgctgtcgacggcgacgccagaatgcactcaaagcccaccacgtccgcgtcaggagagttgaagtcgaagcccgcctgcagcgcgttgctcaagctgcccatcgtggtgtgcaacaccgtgtccggacgaaccttgtccgtccgccaatcgtacctggcgggcgtcttgtccacattgttcgccgggtccttcgcccgaaccagcagcgtgaacgaagcctccagttccgtcgtcgcgatgctgcttccactcgtgcatggagaaaagcccgcaccgttcaagctgcactcgaagatgacattcgactcgttcgagctgaaggtgaaggtcaccgattcaaggttgttcaccggctcgggcagcgtccccgtgaactccgtgtcggggtcgcgcaggtccaccgtccacgaataagtggcaggagtgtcatccacgttccccgccgcatccaccgcccgaacccacagtgtgttcgcagtgttgtctgaccgagtaggcgcgacatagggattcgtgcacgcggcccatcggctgtcggtctccaggggagccgtcgttgctccaggagggaccaggatgcactcaaaggtggcgttcgcctccgtcgtgaatcggaacaccgggttgaccacgttggaagccccccccggggtgccgttagcggcgaattcggtttcggggcgcgtgcaatccacgagccaggaatatcgagcgggtgttggatcccggttccccgccgcgtcatgagcacggacccacatcgtgtacgtcaatccatccgtgagcgtcgtcgtcgtggtgtaaggactgtcgcaaggctcccaacccgtggagggagccgtcgtgccaatccctgacaccacctggcactggtaagtgatacccgtcagctcgttcgatgcgaaggtgaagctcaccgaggacagcctggagggagaagccggaactccgttctcggcgaagtacgtatcgggggcttctgtgtcgaccgtgaaggcacgcgaggcgctcggcgcgccttgcagcccctgggcttccgtcacggccacgaggtgcgtaatttctcccgtttgcaatggccgggagagcgtcagggagaaactcccgttgctcccaacaacgccgcgtccgtactccaccccggacacaacgcccccctcgagcgcgtagatgaccacttccgagttcgccgtgctgatgccactgagcgtggggagggggttattcgtcacgatggagccagcggggaccgtgatggtcggttgagccggggcaacgaactccgtacccatgagggtcgcggtgcccgcatagggaaacgagctgttgcccggcaccgcgtcatgatggtttcccgccacagcgaggccagcaacaccactcgcgacgttgaccgcgcatgtcgccgtgtttcgggactggaagagcacccggcctccgcctccgcctccgcctggtcctcgcaacccctctccaccatgcgtcgtggccccgccagcgccgcctcggacgtcgaggaagttgctggcaccacatggcgttgcgtgcaggaagcgggcgtgaatggtgccaccggcaccaccacctcccgctccgtcctcgttgctcgcgacgcccgcatcaccggaggcgtccaacattccccctgacaaggattgcgcccggacgaagatgattccgccgccgtgaccaccccgaggcgtcggcgacgcgctccgaccatggcccgcgcctccgccgccacccatgaggagctgcatcaagggtgaagcgttgagcgcagcgcccccttgccccgcggctgctccccgtccctcatcggatgcactgtccgaactccccccgcgccctcccgcgcctgcattgccaccgccgccgccacccgcgcgaagacagacgccgccgccgccgccgttggcgacattgtccacaccccggggtgaattcgcggcggcgttcaggccttcgccgctgaacgctcgcgtcgaatcgggccgcccgctcgcgggacatcccttgatgggttggtcattcccgtcgaccgcgatgtccgccacgtacgtgccaccgtgaaagcccgcgcccttcgcactgagcttgctcccggtacccagcgtgacagcgcccgtcgccaggaaggcaagcacaccgccggtgtacgtttcggggtcccagttcccggcgcgaacgaccgcgttgttggtgagcgtcagcgccgtgtactccggcacccggaccacctgggtcacgtccgcagcgtaggagtacttcagcggccggtccaacgtcagcgtgagctcatcctccacgctgcggttgacgttggtgattcgtgccagttcccaccgccccaccgcgcttccctcgagactgatgggcgcggcgctcccaacggccgctgcgggaaccaagccagtcgtctggatgatcatcaccaggtcgccgtcggtgcctcccccaggcccattgaagtcggggacgttggaccccgactgggaggtgatggtcgcaagtgacgtcttgagggtcgtgtcccctggcgccagcggctccaggacctgggcgtagttgttgatgaccgtgccacccgacccgccgccgatattccgggcgccatcctggccattccccaccagataggtatccgggcccggcagggccggcagggcccagagccccacagccaccatcagcaccttcgtcagagcattcgttctcatcgagatggttctccgcggaggcgcacgtcagcgctgaccgcgctcggacttgtcttgctgtgggtccgccagcaggaactccacgcggcggttgttctcacggccgttcgacgtcgcgttgctgtcgatggggcgctcctgaccgtagcccagggccttcagccgctcgggcgcgatatcccggccgatgaggtactggcgcacggcctccgcacgcccctgcgacaggcggcggttgtcgtccgggaagccccggtcgtccgtgtgcgcgcccaccacgacgagcggaatctccgggtgctctcggatgacgcgcgccacccaatccagcaattcataggagcgcttctggatgcgtgcctgcgtcggctcgaagaagaccttgcccatcaccaccaggcggtccggacgaatctccaccagcggcaggatgtgcagcgggcagcccaggttcttggcgtcccccggctcattcacacagctgtccgcgcggttgggcacgccatccttgtccgtgtccgactccgggcagccattgcgctcgatgggaccggcctcgttcgggcactcgtccttgtcgttgtcgatgccgtcgccgtcggtgtcccgcaccgggcagccccggttgtccgcgggccccgggtccgacgggcaactgtcgatttcgtcggggacctcgtcaccgtcctggtccggaatcgggcagccctggcgcgcggcgggaccgtgctccagcgggcagccgtccaacatgtcttcgattccgtcgccgtccgtgtcctgagccgagcacccctggcgcgccacgtctcccggcaccagcgggcacttgtcgtcggcgttacgcacgccgtcgccgtcctcgtccatgtccgggcactcttgaatcttcgcctcgggcggcagccccatctcacaccggaccgaggactcacccgggccccgcggcggcgtcacgttgccgaaagccccgcccaccatcagccggaacagcggcgtgccgggcgccgcgcccacgcccacgcccgccagcgcgaacatctccagcgacgagcccaccaggtagcgagcgccaggaagcaactccaccgaggtcggctgatccgtcagcggcagcatgccccggacgttgagctcccagcgcaaccgcttgcccgtcgtggccaacgccacgcccaggcgcagctcctggcccacctcatcctcggtttcgcccgtgcggtccgtcagcagcacgcgcgggcgctgcagatagccaacctccaggcccgcgcggatgaagccgaagtgccgtcccaccatcacccgcggcgacaagcggagcccgctatcatcgcgggcaaaggccccctcgctgcccagcggcagccccgccgccacatccagggccaggtccaccccacccgcttccgtctgcctcagcaagccgaagcgcgcgctcaccaccggcgtggacagcgcctgactggcgggcacggcaatcccataacgcgccatgccaacgtcatcgccgccctggaacgccaccatgggaacctgcaggcccacctggagccagtccaacggggcatacgcggcagccagatgcgccgtggtgcgtccagagacgatggccacctcgggctgctcgcgaatgaggttgtccatgtagacgagcggctgatgtgcgtagtgcatcatcaccgtcgcgcggaacgcccccacgggaagcagttcgcccatgccgacgaggagcgaaccctccgcgccgggattcagcttcaggcgcttcaggttgaagccttgcaacacgggtgcttcctgggccccggcggacagaaacg

SEQ ID NO: 1079 - DNA, 12329 bp, Myxococcus xanthus
tgctcgataatcgacggatactggcgacggcccaggacgggcaccggcaacgggagacggtggagctaattcacgacgggctactcacgcactggcagggcttatggaagctgaacaccgaggacctggccttccgccgatggcacaaagactggcaggccaactcggagtgctagttggaagaggagctcgctcaccagcgccaggaggccgagcaccgtctgctgcgaggcgaggcgctcacccgcgcgcaggcgatggtcacgctccatccgtaccaaacgagcgcgctggcccaacggtacgtcctacggggccaagaagcggagcggagccggtacgggcgggcacggcgaaacctgtggctcgccctgggtgcatccgtcagcgcgctggtgggcgtgagcgggttctacctccgggcggtggattccgagaagcaggccgtggccgcgaagaatgcggcggaaattgccgtgaccgccgaggccgcgacctcgaaacagctctccctgcagttgcgcatctcccaagccgattccgtggtgagcctgtcgcgcagccctggccgcgaggtggaggcactcacgcaggccatccaactcgcgggaagcccgccgacaggcgcggacgcagcccaggacgaagtgacccaagcgctgaccgaggccatcgccgcgttcctctactcggcccccctgtccacggagctcgaggcgcgcaccgtcggcgcgttctctccagactcacgtcatctcctcacacgaggcgtcgtgctgactccgtccatgcggttcgtcagccggctctgggacgtccgcaccgccagcctgctgcgcgagttcgagtccgtcgacctgtgcccgaaaggcgcgctcgtggaatgcacggacgcgctgtacgccgacatttcaggggaggacacccacgcctttggcttctcgcctggagatggaacgctttggctgggagggcgccgaggcaccctgttcaggtggagccaccagggcgctgtgccctccattccggatgcccaccaggacaggattacagccatttcgttctcggacagcggcgaccgcgtgctgtccgccagtcgcgaccgcacggtgaagctctgggatgcgaacaccggacggacattgcgcgagctgaccttccaggagccctgcacccaggcagtgctgtcgggcgactcgcgttacgcatgggtgggcggtgaagaactgacgtgcctctacgacctgacctccgatgcgcgcctcatccggtgcatcacgacgcatgacccgggcccctcggtcgccttctccccttcgagcaggcttgccgtgctcggcgaccggcgcggcgaggtcagcctccgtctgctggagctgccctctggccaggaccttcatcgcccgctcacgaaactcgaagggcacgcgctcatgccgtccttcgaagacgaatgcagcctctcggccttcgacgacaccttctcctcggcgctcaccgtgcgcttctgtgacagtgggcctggcaacgccaccggaagcgcggcatccccgcggatgcgaacacgctggaggcccattcccctccatggacgcctcttcgagaacgggcggcgcgccgtcgatttcgccgaaaatcccgtgggcgcccatcccttcatccgggttccccaggcaaccctgcgctggatgtttcgccaggggcctttggagtcccgggcggagcgggccctggtcgcgccggatggacgcacgctcctcgcccaggccgaacccggcctcacgcggaagaccatcgatatctccacctggaacgagtacgtgccgggcggcttcgccgtgtccaaggacctgcgttggatggtggtgagggagccgcaaagcggccagctctcactcgtcgacagggagagctcgagccagacagcactgggcgcgtgtgacgtcgaaggcgtgtatccgcccctggagggcgccttctctcacgacggccagttcctcgccgtccgctgcggcgtgaacgtccggttctgggacgtggcgcaggcgaatcgtggaccgcgcacacagccgccgcccatcgaagcaggaatcaacctgacctccctccccgcgcactggcgatggcggcacgtcacccccacggaggaccacgccaccgagagcttcctggcgtcgcctcgcacccgtgcgcacctccagcggaccgaggtgcctggcgatggcgcatgtcagacgcagaggacgttctcccagagcgccctcgtcgagttcgcccccagcggcagatacttcgcgattggggacgaacgctccgtctacctgggctccgcccgagactgccggctgacgcgggaagcacctctggccgcctctgcgataacatcccagggcgcctcgttttcaccggacggcgagcgtttcgtcaccatctccaacgtgcccgagtcctccgcgatctgggaaagcgccacggggacgaagctggcgccactgcccacgagcctgggagccgtcgtcatggcgttctcaccggactccaagtacttcgcggtcgccaaccatcccgacgtctactggatgggacaggcctacctcctcgacgccaccaacggcgagaagaagcccctggcggccatcgacgggaaggtcaaggcgctctccttctctcctgatacgtcgcggctcgtcgcggtgacagacgatgccatccacctcttcgacccgaactcaggcgcgctcgtgcgcagaatcgacgtgagcacggatatccacgtgaaggtccgccatgcacaagcgcgcttcggtgtctcggacacgtcgggcaagctccacttctggcgaacctccgatggccggcacgtggccgagctgcaccagggctaccgctccggcctggagatggagcccgatgaggagggcacgcgcatcgccaccttcgactcggacggagcctatgtcttctcgctccggccggacgacctgctgcgacaggcctgcgcgctcatgcgcggacggcgcgagtacgcaccggtccagtccatctgcgacaccttccttctcccagcggtccccctggcggacctgcagacgccgtgaggcacaacgtctccatgagcgccacccagcaaggcggtgagccgtagatccgggcactccgctccctgtgcgacctgtcgaaggtacgctaggcgctgcacccagagggcgtggaggcgctagtcgccacgcactatcccccttgctggcgcgtgcccacctccgtcgtcggcaaggtgactgccgacgccctgcgcgacgaactccgtgacttgctggcgacgggcgcgcaggtcctcgcgcggctggagcattcgagggaggacacgcccctctccgaaaccgagcagacggcgctggaaacagtcgtcgccttcttcggacgccctgccctcgccatccggaacggcagcttcggtgcgccgcccgtggggtgggagatgttggagcaacaccgcgagcacatcgagcgaaccatcgacgccaccgggcgcatcgagctggccggaagcggcatgctcggcacgggcttcctggtgaccgatgagctggtgatgaccaaccgtcacgtcgcgcagcacttctgccggcgggcgacggacaagtgggtgctgcggctcggcgtggtgcctcgggtggactggctgggggagcatcagcgcgatgcccaggccaccttccccatccaaggcgtcgcggcggttcacgccgtgcatgacctggcgctgctgcgactgggggctcccaagggggcggtgctgcgtcccgccccgctgcggctcgccacccaagcaccggacgcgacagactcccgcgccttgtactgcgtgggctacccgatgaaggaccacagccggacgccgcccgaggtgctgctgcgcatcttcgaggacgccttcggcgtgaagcgactccagccaggagagctgctctcgctcgacccggcccggcagcagctctcccatgactgctccacgttgggaggcagctccggctcgcccatcgtcgagttggagacgcacgcagtgctcggcctgcacttcggtggcacccggcaggagaaccacgccgtcgcgctgtggcaactggcggacgacccgctgctgagccgcgcgggcgtccgcttcaccacgccgtgagggccgttactgggtcaccacgccgcagtcgcccgtcatgttcgtggccggctgtccattcaccgtgttgccagtgaagacgttgtcgcgggtgatgaccagttcgcccgtattcgacccacggttgcaggtgatgacacctccggccccgccccggttgttcacgaagcggttgcctcgcatgacgacggttcgcgacccgccgatgtcctccaactggacggccgcgccggggcccagcgggatgaagttgccgtcgaacacgttgccctccagcaggtcattgtccggctggaagtagtggatggcggcaccaccgcccaggtcaaagatgccctgggggttgggccacgtgaggatgggccggtcccagaggtcgctcgtcagcgagcctccgaaggcctgcacgaagttgccccggaacgtgttgccgcgcagcaccgtgttgcgaccgtgggtgatgcacaccgctccaccgccggccatcgaataggtgcccggctgtgcgaagcggtcgatttcacggatgcggttgttctcgaagatggttttttccacccgcgagccgtcggtgaacatcaggtccaacgcgccgcagttggcggaggactcgttgtcacggaacaccgagcccgtaatcgtcaccgcccccgggtagtagacccacagcgcggcacgcgtccaatcgcggtcgctgttgtattggttcttgcgcaccttctcgaaaatcgtgtgctcgaacaccgggtcgcccgagcccacggagttggcaccgtagaagttcatcccccaccagccatgggggttggtggacgtcagcagcacgggcgcatccgccgtgccccggatctggatggcgccgtacacgcggacctccacgcggcccgcctggtggttcatcacattgtcgggggcgtccgaatccacgtcccgctccgacacctccggccgaccacggaagtccaggatgacgcccggccccaccgtcagcacctgcccgtggggaatggtgacgaccccgtttgaatccccctccacccggtacggcgagccctccaccgtgagccgtcccgtcaacgtccccctgacaatcgtgccgccatcctcggggacctcgatgtccggacccgcgtccggcgtgcccgcgtcgccgtcactgcccgcatccgtgccgctgtccggcgtgcctgcatccgcgccgccgtccagcacgcccgcgtcctctccgggagcgggcctgtcatccggccccgacgaacaggcagcaagcaccaggaccacggggagcgcgaacagcgagcgcgggaagcgggaggctttcatgtcccgtcgcgctaacacgcgctgctggcggctcgcaaaccgggtccggacgacccggggactcatcgctgggagggacgcgggtgccctgttacaagcgcgcgcatggcgaaagacgtcctcgtactctcttactcgggctgcggcacctgcaagaaggcactgaagtggttgcaggagcaaggtattgcccaccaggtgcgccccatcgtcgagatgccgcccaccgtggcggagctgaagcaatggattgcgcgcagcggtgtctctgtccgcaagtggctcaacaccagcggccagagctaccgcgcgctcggcaaggcgaaggtggatgccgccagcgacgcggagttggtcgagtggctggccgcggatgggaagctggtgaagcgccccgtgctcgtcaccggtgacaccgtcctcgtgggcttcaagcccgaggcctacgagcagcacttcgcttcgcgcggctgagccccgccagcaaggcaggcaacctggcgagcccacggcgggccgcctctcgccgaccggggcgtcgagtgcagacttcatgtcttctcatggagactggctcacgacgcccgctcggcgagattctcctggaacagggagtgctcaaccgcgcccagctccgggtgggactggtgcatcaccatgaggtgcatgtcccgctcgggcgggcgctggtgcgagagggcctctgctccggagccgacgtgcttcgcggactcgccgagcagttcggcgtggacgcggtggacctggaacggaccccgccagactccaggcggctgaaccacatccccgctcgcgtggcgcgccagtatcgggtcgtcccgctgcgcatcgataaggtgctgctggaccagggcgagcgagaggtactccacatcgcgctgcccgcccccgtgtcgttggatgcggtggacgccgtccgcgccgtgtccggaatgccacgcgtcgaagcgcacatcgcctcggacgcggcgctggcccgtgcgctggcggacctctatggcatcgagacgcccgccgagccgcccatgcccccctcactcgcgcccgggggccccctgctgctctatggctggtcgcccgtcacggcagtgctcatcacccggctgctggcgaggaacggcctccaggcccgcaccgccacccccttggaggtgctgcacaccgggccggaggacgtcgtgctcgcgcccctccaggccatggagggcctgctggccggggaggtccacatcaagggcgccctcatcgtccacggcagcgatgacgagagcttcgaccgggtccgcgagctcggcgcacgcggcttcctggccagcccccgggacgaggagctcctgctgcgcgccgtccgccggctgaggccccacccgggctcgcccgactcggccccaccctcgcactgaatcccacctggacgcccatggggctctattcgcgcgcggagtgggacgaagactcacccagttcgagaaaaatccgggcctcgattctcaaaaaatgaagggacgaggcaactggggaatcggttcacggacaatggggacagatggcgtccttccgggcgcccccgaatctcgctggagcccccatgtccccccgcattggcaaccgcccgcagccgcccccgccgccgccgcccccgccgccggctcgcgacacccggccccctgcccagggcggacgtaacggcccgcgcgttgacacccgggcttccgcgtccggttcggtggagcagccgcggcacagcgcgctgagcggccagtccagcttcacggccggtggtgcccgcgccgatgtgagcggcaccggtcccggtggcatcgacacgcgcgcccacgtccagggtccgacgttctccgcggatgcgcaggtggacgcggacatcggcctgtccggcatcgacgtgagcgtcgacatcgacatcgaggccaacctcatcgaggcgggcgccggggcctccaagacggtcgagttcgagattgccggcgaggagtactccgtcgagctggacctggaggcgctgggcaagattggcgccgagggcagcatcgaactggacctgcacgtgggcaccgacggcaacgtgtccatcaacgcctcggcctccggcttcgcgggtgcgcaggcgagcctcacgggctccatcgagctgaagcacgaggacgacacgctcgcgtccggcagcatcaccgccagcgccagcgcgggtgtcagcggcgacgcgcacgccaacatcggcatcgagaatggcaacctggagttcgacgttggcgtggaggccaccgcgggcctgggcctgggcgtggaaatcgagggctccgtcaatcccggcaacgtgctgaaggccgtgggtgagacggccgccgccgccggtggcgaaatcctggagaacgtggtcgacggcgccatcaacgcgggcggagcggtggccgacgcggcgggccaggtcttcaccaacgcggcggacgccgtgacggacttcgcgggcgacgtgggcaacggcatcaagaacgcctgggaggccgtcttctagaggtacccacctcgcgccccccaccgctagaatcggtgcccatggccgtctccaagctggcatcctccgccgcgcgtctcatgaagcagggcctgctgaaggaggcggcccgcgacttcgagcgcgccatcgaacaggacccgaaggatgccagcgcgttgctgggactggcccggttgcggctggcccagcacgacgaaacggcggcccgcgcggtgctccagcggctggtggcgctgcatcccacccacccggaggcgctgagccacctggcccggctggacgcggagaagggtgatgcgcgccagttggacctgctggccgcgctcgccgcgcagcccaaggcgggcttcttcgaggtcatcaaccatggccgcgccctgctggggcatgaccggtacgccgccgccatcccggagctggagcgcgcgctggcgctgcagcccggcaatgcccagacgctgacgtacctgggcatggccctccagggtgacaagcagttggaccgggcactgcggcgctatctagaggccgcggaggccaacaagacggagcacctgccgctccagctcgccgcgcgtgtgcagttgctgcaagggcacgtgggcgcggccatcgtcacgcttcggcaggcgatcctgcgcagccctcgggagacggccctcttccgggagttcgcttcactgtgcctgatggccggcgcccccgaagcggcgatgcgcgccgccatcgagctgcgcctccagctccccgacagcgcggacgccatctacctgcacggcatctccgccttcgtggccggcaaggacgaggacgcggaccgcatcctccgcgaggcgctggccaaggccccggagtccgcgcccgtgcgcgtggcgctggccaaggtgcgccgcaagctgggtgacgacgcggaggcccagacactgctcgaggccgccgtggcgacggacccgtccgaggccggcgccgccaacgatttggcggtgctgcacctgtcgcgtcccggtggtgccgccgccgcgcgcgccatcctcaccgaggccttgaagcatcacccggatgacgcgggcgtccacctcaacctggcgctggccctggcggacagcgacaaggcccaggcgctcacgcacgccaggcgcgcccaggcgagcacccaccgcgacatccgcgagcaggccgagcggctcgtcaccgccctgagcccgcgctgacgcggccttcgccgcgccgctagccctgctggagcaggcccagcacgctcagcacctcggggtacaccttgttggcgaagtaacggccgcccgcgacggtgaagtgcacgccgtccgccatgcgcaggcgcatgggcttgcggaagccatccacccgggcctgactcagcgctcgccccttcgcgtcggtgaagaaggggcgcgtgtccaggtgcaccgcatcctcccgggaggagatgacctcgcgctggagggcgcggatgatgcgcagcttctgctcgaagcgcttgagccccgtggccggcagctccaaccagacaatcttccggccgggcgaggagagcacggccaggaagtcattgatgcgctgacggtaggcggcctcccactccgcatgtccccagtggatggccttgccaccctgggtgtcctggagcgactgcccgtcgttgcccccgaggatgacgacgacgacgtccggctggtgacgctccacctcctcgcggcccacgtccatccagtcgaagaagtccggacgggccaggcccgtggaagacttggcgcggcgggccgactggatgcgcgggtgcgcgtccaactgggcctggaggtactccccgaagccagtggcgatgaggctgtcccccagcagcagcaccttgtgcttgcgcgccacttcgggcgacggagcgggggcctccggtgccgcggcgggcggcggtacggccgtgggcgccacggcggagggcgacggctcctgcacggaagcggcaggcacgggcgtcgcggagacaacgaagagggtgacgagcaatcgcgtgagacggttctgcattggcgcccgaaaggtagcgatccccgcgccatccgtacatccccttatcggcccgacggaaccccgcaccgcccctgccggactgcgtcaggcagcgctgctctccacttcgggcgccgccgccgcgtccagagccgccaaccagggccgcaggagccccgcgcacgcctccggatgcgtgaagtagggcacatgccccgcgccccgcagcaggtgccggggcgttcccggcggcagcgacgcggccaggcgctccaccgtggacggcggcaccagcacgtcccgcgtcccctggatacagacgcaggacacgggcagcctgcgcagctccggcgggggcgcctcgccccggatggccagggcgcgatgccaggtggagctgcgcatccagcgcggtggtgggcacgacttcgggcacacgggagaaagacaccggcgtccaggccgcgagccccgccgccaccgcgcccggccgggcccaccgggcgatggggcccatcatgccaatggcgagcccgcgcacgcccaggtgctcggtgcgggcaaaggcgcccaggaaggccacgcctcgcgccgcgccagccgccgccaggtgcgcggccaccatgccgccgaaggagctggccactaccgcgtccacctcgcccacggcccgcagcacctgccgcgccaaggcgcccgcgccgcacgcggccgcctcaccttcggggtactccaccaggatgggacgggcccagggcaacaactggtgggccagcgcctggaagccggagccacgcgcgcccagtccgggcagcagcagcacccgaggcccccgcccctgcccccactccatccactggacctctcgacgcatgcctctccttcgcgggacgcggcgaggaacaccgccggtgcgccggttctgccggcccgtccgccagcatgcccggcgggccggccgcgatgccagtgatgcgctcaggcccccagggtgcgcagcgcggggacgcggcccaggcccaggaaggcacgcgtgcgctcatggtgtggatttgcgagcacccgggcgggcggcccctcttcgatgatgtgcccgccgtgcagcaccaacacgcgcgaggccagctcgtacgcgaagcgcatctcgtgggtcaccgccaccagggtgaggccgtccgcgagcagttgctccagcaggtcaatcagcgcccccacccgctccgggtccaacgcgctggtgggctcgtccatcagcagcacctccggctccatggccagggcccgggcaatggccacccgctgctgctcgccgccggagagttcggaggggtacgcgtcctcgcggtgggacagaccgaccttcgccaacaacgcccggccccgctcgttggcctcttgccggcccacgcccttcacgtgcatgggggcctccgtcacattgcccaacgccgtgcgatgcgcgaacaggtgccactgctggaagacgaagccgacgcggcggcggatgcggcgcaccttctcgccctgcgcgcggacatcgcccggggccagcgtgtccggccctacgcgcaccaagcccccgtcgaaggactccagcccgttgaggcaccgcagcagcgtgctcttccctccaccggaggggcccaccaacgccgtcacctcgcctggggagaagacggcgttgatgccctccagcaccggccgcccctcgtagcgcttgctcagcttctcgacctcaatcatccgcgctccagcctcgcttccaggtgcctcgccagccgggacaagggatagctcattgccaggtacatcaatgcgcacaacgcgccaggtatcagccagcttcgaacatccaccgcggtaatcgtcatccgcttcgtgagctccaccacggagatgacggataccaaggagctgtccttgagcagcgcgatgaagtcgttcgccacccccggcagcgccacgcggaaggcctgggggaggatgacccgccgcagcgccagccgcaggggcatgcccagtgccatcgccgcctccaactgccctcgcggaacggccagcacgcccgccctgtagacctccgactcgtaggccgcgtagttcaggcccagcccgaggatggccgcgctgatggggtccaaccggagcactccggccagcccgtagtagaggacgtagagctgaagcagcaccggcgtgccgcgaaacaactccacgtaggcggtggacagccgggccgcccag

SEQ ID NO: 1080 - DNA, 14101 bp, Myxococcus xanthus
cggccacgactggcacacggccacgctgaccatcaccgccgatggtttaattttcgtttgacttcaactacgacgacctgccacagctcgaagtggtgccaatctgccggcaaatgggccgatgaattccgcacctacccgcgccaggaactccaggctcgcgtctccatccagcccaggtgccccgaggttcgcgcccgcaaccggtcggccagagccgcgaggactatcgccccaaaacgaaacgggctggagaccttgcgatctccagcccgcttcatgacgtggtcggggagacaggatttgaacctgcgaccccttggtcccgaaccaagtgctctaccaggctgagccactccccgatatgtcgcctcgccggacggtccttctcgggaccggcgaagtgcgggcggtagtacccgagccgcccagccgagtcaacgtcctcggatcaccttttcttccacccctccccgctcagagggagcaggcagccgggcgctgcccgggtggcccccgactccgcttcccaagaccacgaatttcctgtactcccggacagtttccctccctgctacactcacgaggcagcctgcattgttgcaccgcgatgccatgacgccgccccccgtcgtcctcatctccgatgacgaacccctcatcgtctccgccctcgcccgcgaggggaaacgctccgggctgaactgcatctcggacaccacgtccgagcgcgtcctggagctcgcccgcgagcaccggccggccgtcatcatcctggacatcaaccagcaccaggacggccgggacttgctcgcccagctcaagcaggaccccaacacccgcgactgcaaggtcatcatcctcagcgccgtcgaggaccagttcacccgccacgtctgcttcgagctcggcgccgacgactacgaggtgaagcccttcgaccccaccttcatgacccgcgtcgcccggctcgcctcctccgtggcgcgccctcgcacctgaagtccgccgcgcctcacgagcgcagcgagcggatggcctccgcgtagtccttcgagccgaagacgtagctgcccgccaccagcaccgtggccccggcctccaccacccgcttcgccgtggtggcgttgatgccgccgtccacctcgatgtccacgtccttcagcccgcgcgcatccaacatcccgcgcagccggcgcaccctctccaccgtggactcgatgaagctctgcccgccgaagcccgggttcacgctcatcagcagcaccatgtccacgtcgcccagcacctcctcgatggccgacagcggcgtgcccgggttcaacaccaccgccggcttcgccccggcattgcgaatctggctgaagcgtccggtgcagatgcggactggcctccacgtgcaccgtcagcacgtccgcccccgccttcacgaaggcctccacgtagcgctccggctccacaatcatcaggtgcacgtccaacggcttcgtcgccacccgcttgatggcctccaccaccacggggccaatcgtgatgttcggcacaaagcggccatccatgacatccacgtgaatccaatccgcaccagcggcttcgatggcgcggacctcttcggccaagcggccgaagtcacaggacaaaagcgaaggagagatgcgaacggggcggcggctcatgccgcgcttcataaccgcaacccgcgcgctggataaggctgaacgcaacgcggcgacgtccaccagacagccagggacctgccaggtgggtcccccgaggcagtgtgctgtctacccgtgctagaactttgtagcccttcgcggccgctggccgcttctcacggagccgccggtgctcgctcaacccgccccacagcccgagctgaaccgccgcctggcgaagctcacgtccatcctggatgtcgcgaaggcgatgagcgccgagcgcgacctcgacctgctcctgccgctcatcctcttcgaggccaccaaggtggtggaggcggaccgctgctcgctcttcatcctggaccgcgagcgcaacgagctgtggagcaaggtggcccagggctccaagagcgaaatccgcctcccggtgggcagcggcgtcgccggacaggtggcccagacgggcgccgtcatcaacatccccgacgcctacgccgacgctcgcttcaaccgctcgttcgacgtctccagcggctaccagacgaagaccatcctctgcgtccccatgcgcgacgccggcggcgaggtgacgggcgtcatccaggccctcaacaagctggacggcgccagcttcaacgccgaggacgaggagctgctgctcgccctgggcgcccaggccgcgggcgccatcgagaacgccctcctccacgaggacatcaaccgcctcttcgagggcttcgtctccgcctccgtcgtcgccatcgaatccagagacccgaccaccgccggtcactccggccgcgtggccgacctcaccgtggccatggcccaggcgctcgagcacctgtccaccggcccctacgcccacacgcgcttctccgccggggagattcaggagctgcgctacgcctcattgctgcacgacttcggcaaggtgggcgtgcgcgagcccgtgctggtgaaggcggagaagctctacccgcatgagctcgaaggcctgcgcgcccgcttccagctcgcccggaaggacttgcagctccagagctaccgccgccgcttggaagcggtgaagattcgcggccaggcgaacctggcggaaatcgaggccgaggaagaggagcggctcgcccgcgagtcgtggcagttggacgaggtgctggagttcatcctctcctgcaaccgccccaccgtgctcgcgcagggcaacttcgagcggctccacgagctgggtgcgctgcgcttcctggatgcccacgacaaggcccagccgctgctgctgccgggggaaatccagtcgctctccatcgcccgcggcacgctctcccccgaggagcgccgcgaaatcgagagccacgtcgagcacacctaccgcttcctgtcccagattccgtggacgcgcacgctgcgccgggtgccggagattgcctacgcccaccacgagaagctggatggcaccggctacccccgcgcggagaaggacatccccgtccagtcacggatgatgtccatctgcgacatctacgacgcgctcaccgccagcgaccggccctacaagaaggccgtgccgcacacgctcgcgctcgacatcctccggcgcgagtccgacgccgggcagttggacccggcgctctataccgtcttcatcgaggccgacatcccccggaaggtcctccagggaatcaagtagccgctcagccctggatggtgtgcaggcgcaggctgttgatcttgcccggctgccccacgggcgcgccgaacacgatgacgatgcggtcgcccttgcggcccaggcctcgcgccaggagctcttcctccacgcgcttcaccatggcctcggtgtcctgggtgggctccagcacgcgcggcaccacgccccacaacagcgacagccggcggcgcacttcctggttggggctgaaggcgacaatcggcaccgggggccggtagtgcgacagcaggcgcgccgtcacacccgacagcgtgaaggccgcgatgagcgaggcgttgctcgccttggccgcctcgcaggccacgcgcgcgatgacgtccgggaagtggttgggcagccccaccggcgtctccagcacgcgcatcagcgactgcgtcgtgcgcgcggaggactcggccgccaggatgatgcgctccatcatctgcacggactcgatggggaacttgccgctggccgtctcgcccgacagcatcaccgcgtccgcgccgtcgaacacggcgttggccacgtcgctggcctcggcgcgcgtggggcgcgggttatcaatcatggagttcagcatctgcgtggccacgatgacgggcaggccgcgcaggttggagcgccggatgatgtccttctggacggccggcacttcctcggggggaatctccacgcccaggtcgccgcgcgccaccatcacgccgtccgtcttgtccaggatggcgtccagccgggcaatggcctccggcttctccagcttggcgatgatgggcaccgtgcggcccacctcggccatggcctggcgcgcggtgtccaggtcggacggctggcgcacgaaggacagcgcgatgtaatccacgccggccttgatcccgaacaccaggtcctcacggtccttcggcgtcagcgcctccgcgcgcaccgccacgccgggcaggttgatgcccttgttgttcttcagcgtgccgccgtggatgacctgcgtgcggatgagcttctgcttgtccgtctccaggaccttcagctccagcaggccgtcatccaggaggatgcggtcccccggattcacgtccgcggccaggaacgggtacgtcgtggacacgatttcgtccgtgcccgggaccgtttcatccgtggtgatgtggaaggtgccgccttccttcagctcggtgctgcccttcacgaaacggccagtgcgaatcttcgggccttgcaggtcgccgaggatgcccaccgccttgcgaaccttcagcgacgcggcgcgcagcttcgcgatgttctccgcgtgctgctcgtggctgccgtgggagaagttcaggcgagccacgtccatgccgttctccaggagcgcttcgagcatctcctggctctggctggcgggaccgagggtgcagacaatcttcgctcttcgcatagagctcgtgaggatgggtttccctcacggcagcgtcaagcacgctgcatgcgccgcttcgctcggtaaaacggtaaatgagccagcgaacgacgcggcgctcatccgcgcaacagcacgcccaggttctcccgctcccaacgcagtgcggcggcgtaatgcgggaatgttcgctcgcgttcgcggaaggcacgcgggtgatgcacgcggcggccaccccggcccgtgctcgggaagagctggtggagcatctcgtggaagatgatgaactccacgaagaaggaaggcacctcgggggtgtccagcgccgggtggatgcgaatctcacgcgtctggtggtcgtagacgcccaggcggatggacttgcgacggcggcgcggaggcatgcgcccccagccaatccgggcctggatgaggccctggaaaaaatctcggttggtggcgtcgtaaagcgcctggaggtcgaaacagcgcccgcgcgggttgaggtccgcgtcggattcgcggcgcatctggcggatgcgcggctgctgaccgcggatgtactcgtccaggatggcgcccgcggtgcggtgtccccggcccgcgtagtccgccaccgcgcgcaccaccggctccggcgcgtccaggaacatgtggtgcagccgcagcgccagcaccgcggagccccggcggaaggacaccatggtggagcggttgtccgtcaccgacaggcgcaccggcatgcccagctcggcgctcagccgccaggccagcgattcagcccgggaccacagctcctcccgcgtgggcggacgcgtgacgatgcggggtgcatcgtcgggcgggaggttgcgctgcggcatgggcacgggcggcgcgacgggccgcggcgcgggcgccacgggcgcggcaggtcccccctcgggccggggtgcggccgtgccctccgccgcgcggctggcggcggagagacctcgagggaagagcgacgtctggcgaaattgctcgggggacacgcggctgcgcatcgtaccccgcacttccggggactcaagggcggcggtcccctgcccgcctcctcaccgtcagcccgtcaaccgcgctcgcacgcagcgtccactaacaggagggaagggcaggcgagcgtacgacgcgccctcacggtgcgggcggctccgcgtgccgggacttgaggagccgctccaggcgctcgggctccatgcgcaccacgaaggtcttctcgcgcgtgaaggtcacctgccccggcgcgccgcccttcaccttgcgcacgaacttcgcgggcacgtagctcacctcgccgcgcggctcgcccttggccccggagtggtgcagcgccaggtgcgccgcgtccagcaacacctcctgcgccacctcctgccccttctccagcggcagcaccacgtggctgcccgggacaccgcgcgcgtggagccacagatgccagggtctggccaccttgaaggtgagcgcgtcgttgtcctccgagccgcgccccacccagatgcgcgccccgccatggcccacgtactccttgaagggccggccctcccgcgcaccctcgcccccactggggagctgaagcacctccgcctgcgacagcagcgcggcgtcctccatccgctcaatctgcgtgagcgcctgctgcgcgtgcgccacctcgcgcgccagctccgcctcgcgatgacgcgcctgctccacgccccgcagcagccgccggtactggtggaagtgccagtccgcctcctccttcggggtgcgcttcgggtccagcgtcacccgaacctccttcgcgccctcctctgtataggcggtgagcaccgcctcggtggcgccacgcttgaggaggtagaggttctgcgccagcagctcgcccacttcgcggtgcttctccgcgtccgggccgcgggccgcctcggcgcgcaccttctccaacgtgcgggaggcgcgcttgaggcgcgcgcggtacggctgcgccaaccggcggcggatggtctccgagcggctggccttgtcgcgcgctccgagcaggcgctccgcggcctgggaatacggcagcgcatccgagtcctggggagcgagccgcgagggttggctccgggccttctcgcgggcctcgggcggcggcggctccggcggcgtccacgccgcgcccggatgcaggccccggcgctgcgcgaagccctcaccggagagcatcagcacgcggccggtgtcgctgagcagcagcagaccaccgggcgcgccaccctccagaaggaggcgccggcgcacgtcctcgcgctcgaagtcgaaggccaccacgcgctcggcttccatgaagcgggcgccctggagcttgaagcctgtcagctcctgacgcagccaccgctggaagggggcgggctcgcccggcgtggggaagcgatcatccgccacggacacccgggccaggtcaccttccgcgcacaggcacaacaggatggatttgcccgggacgcgaagctccacgtaggcgagcctgggaaggggacaccaggccttctgcgccaccgcgccagtgaggcgctccgccagctccgccaccacctgctccagctccacgggacgcagcgacatggggcactccgggtcctgaaaatgaaaacggcccggcgggtttcgccgagccgttcaccggacgtcaactgccgtccgctcatgacgacgggactgctcaggactccggcgtaaccggggccgccaccgtcttggccttggtggtgcgcttgcgagccggggccttcttggccgccttgcgggtggtcttcttggcggccgccttcttggtcgcggtcttgccagccgtcttgcgagcggtcgtcttcttcgccgacttcgccgccttcgtggccttcgcggtcttggcagccttcttggtcgcggacttcgcagcggtcttcttcttagcggccatcagaatcctccagttcagtggttggccccaggtcaaccgaggccctgcactcttcttgatgggagtgagtgcttgaagtgaatggtacgggcgacatgccagtgtgtcaacgcatggtgatgtattgcatcgcgtgcgaggccgatttttcggcatcgagcgcgtccggaggtgccgaacgccacctcgcggacactcgcgagcgcatccgaggtgtcgcgcgcgaggccgagtttccggctccggacacgtttcggccactttcgagcacgacgttggcgcatgccgcggcgcatgcgcgcgagcgacgcggcgcttttcgtcgtggggtgcggcgtctacggttcgccaccacatgagcgccaccgagcagaccttccccgcggacttcaccttcggcgtcgcgaccgccgcgtaccaggtggagggcggcatcgagaacgactgggccgagtgggaacgcgccgggaagctgaaggagccggacgctcgctgcggccccgcggtggaccactggaaccgctacgaggaggactacgccctggcccgggcggtgggcgccaccgcgttccgcatctccctggagtgggcgcgcatcgagccggaacgcgggcgcttcgacgaggcggcgctggagtcctaccgggagcggctcctgaagatgaaggcccatggcctgcggccggtggtgacgctccaccacttcacgcaccccacctggttccaccgggagacaccgtggcaccagccggccagcgtggacgtcttccggcggtacgcgaagcggtgcgcggcgctgctggaggggctggacgcgctggtcatctccttcaacgagcccatggtgctgctgttgggggggtatctgcagggcgccattcctccgggcctcgcggatggccccaccaccatgcgggccatggagaacctggtgcgctcgcacgtggccgcccgggaggaactgttgtcccggctgggccgcgtggagctgggcatctcccagaacatgctcgccttcgcgccggaccggtggtggcaccccttggaccgtgcgctggtgaggctcggggcccaggcctacaaccatgcgttccacgaggcgctggccaccggcaagctgcgcgtcaccatgccgggcgtggcctccacccgcgtggacatccctggcgcgcgggactccgtggagttcatcggggtgaactactacacccgcgcgcacctgcgcttcgtgccgcgcccgcccttcatcgagttcaagtaccgggacatccacggccggggcctcaccgacatcgggtgggaggactggccggagggcttcctccagacgctgcgcgacgtgaagcgctacgggaagccggtgtggattacggagaacggcatcgatgaccgcgtcggcgtccgccggccccactacctccattcccacctggcccaggtgctggccgcgcgcgcgcagggcgtggacgtgcgcggctacctctattggagcctgctcgacaacttcgagtggctggagggctggggcccgcgcttcggcctctaccacgtcaacttcgacacgctccgccgcagccccacgcccgcgtgtgactacttccgcgccgtggccaccggacggaagctggtagcgccagacgccgtccgcccctcgggcgcttgagcggcgcgccgcccacgaagggcacgggctccctccttatatatagatagagaagcgccgtgccctcagcccagggccgcccggtagtccacgtcctgctcctcaccggggcccgcgaggtccacatgggccgcggcgaagaagcggcgcacgcagtcctccaccgctgacggcaggtccaggccgttcacctccgcacggaaggccgcggcgccgtacaagccgtgggcgtaccacgccaactgcttgcggaaggagcgcacggcgcccagcgggtcccccatgaagtccaggtgcgcccggaagtgctccagcaccagctcgcagcgctcgcgcggcgtggcgggcgggcctccgagcagctcgcggaagatccacgggttgcccagcgcggcgcggccaatcatcacgaagtcacagccggtggtctccagcatgcgcgccgcgtccgcgggcgtcttcacgtccccgttgccgatgatgggcagctccgggaagtggcgcttgaggtcggcgatgacgctccagtccgcctgccctgaatagccctgctcgcgcgtgcgggggtggatggccagccccgcgcagcccgcctcctggagcgcgccagccacctgaagatagttcaggctgcgggcgtcccagcccgagcgaatcttgcaggtgacgggcaggccggtggcctcacggatgcgccggacgatgtccgccgcgcggggcacgtcacagagcaggccgctgcccgccccgttcttcaccaccttcttcaccgggcagcccatgttgatgtcgatgatttgcgcgcccgcctcgcgccccaccaccgcggcccgggccatggcctccggctcaccgccgtagatttggagcgagtagggccgctccacctcggcgtcgtagcgcaggtacttcaacgtccgctggttggcgcgcatcagcccctgcgagctgacgagctcggtgggacagagcgccgcgcccagacggaaggcgagcacacggaagggcatctcgctcaccccggccatgggggccaggatgtacggattcggcagggtgtaaggaccaagctgcggcatgaagggcggggaacctagcggatttgcccgggacatggcggagacggtgagcaagtgcctgcgctcggaggtcctaacggttaaggtccgtccccatgttccgctttcgcctcgggagcattcccgtcgaagtccaccccagccacctgctggtgtccggcatgctggcctggagctccgtccccgcggcccagaacggctggccgttccgccaggtggatggagccccccccctgggccacgccagcgcgatggtggtctacatcctgtcgtggatgctcatcgtcttcgtgtccgtgctcatccatgagatggggcatgcgctggccagccgcctgttcggctaccggccaagcatcgcgctcgtctggatgggtggccacacgctccccaccgatgcgccaggcccccttccgtggaagcgggacttgctcatcactgcggccggccccttcttcgggctgatgctgggggtgacgagcggggtggactacctcctgctctagggcctgtagggccccactggacttcttcctgctcaccttcatgatcgccaacttcttctgggcgttcctgaacatgctgcccgtgctcccgctggatgggggacgcatcaccaccaccctggccacgcgggtgttcggcccgcggcgcggcttcgtgctggcgcaggggctggcgctgctagtgtgcgtgggggccgtagtgtacggcctgcggtcgggttggctcctgctcaccctcatcttcgccatgtacggcatgcagtccttccgcgtggtggcggaggcgctgcgcaacggacaggcgcagagcgtcccactggaagggccgctggcggagaagctgcgcgaggcccgggccgcgctcgacgcgggccgcatggacgaggcgcggcggctgggcgcgtccgtgctggaggccaacgagggcctgacgccgcgggtggccagccatgcccaccacctgatgggctggctcgccttgaaggagggccagggccgccaggcgctggaccacttctcgcaggtgcagggcctgcccgtggagccgcacgcggtggcggcgtccttctccctggtgggcgatgacgcccgcgcggtggagtggtggaagcaggcctggcagtcctcgtcggaccggaccgtgatgcacgagtacgccggcacgctcatccgcatgggccgcgagtcggaggccctgaagctcccgggcctggacccggaggcggcgttctcctgcgcggagcgggtgctcttcatccggggcgcgtactcggaagccgcggccgtgggcgaggcggcgctgcaacacgcgcccagcgccacgctggcctatgacgcggcctgcgcccatgcccgcgcgcgcaacgtgcctgacgcgatgcggctgctgcgacgcgccacggagctgggcttcgccgatggggcctatgccgcctcggacgaggacctggctccgctccatgggtaccccgcattcgaggagtggctgacggagctgcggcaatccgccgcctcctgacagagggatgacaggcgggggtgttgatgcggggtgaggctgagcacgttccagctcggcccacccagcgcacgaggctcccttgcagacaccgtctccagccctgcccgcggcggatgagcgcctcaactggctctcctccatccccttcttcgcagtccacctgatgtgcctgttcgtcttcgccgtcggcgcgaagccggtggacgtggccgtgtgcgtcggcctctacgtcgtgcgcatgtggggcatcaccgcgggcttccaccggtacttctcccaccgggccttcaagacgggacgcgtcttccagttcatcctcgccttcgtgggcagcatgtccgcgcagaagggcgtgctgtggtgggcggagcaccaccgccaccaccaccgctattcggaccaggcggaggacatccactcgcccctgcagaagggcttctggtggagccacgcggggtggattctctccgacaagtacaacgacacccgcatggagggcatcaaggacttcgcccgcttcccggagctggtgtggctcaaccgcttccacctggtgccgtccgtcctgctggccgtggcgctctacttcatcggaggcttctccatgctggtgtggggcttcttcgtcagcaccaccctgctgtggcacggcaccttcaccatcaactcgctcagccacatcttcggcaagcgccgctacaagacgacggacaccagccggaacaactggctgctggcgctcctcaccctgggcgaggggtggcacaacaaccaccacttccatcagaacaccgccaaccagggctggttctggtgggaggtggacctcagctactactcgctgaaggtgctctcctggttcaaggtggtggaggggctgcggcttccctccgaggccacgaagttcgcgttccagaagtacaccgacgaagagcgcgcggcgctggcggcccctacccgcttctggggtgcttcgggcgcgcgggcccagttcgtggccacgaaggccgcgggggatgcggcccgggccgccagtgatgcggcgaaggccgcgggcgacaaggtgcgagaggccctgacgaccgccgcggaccacctgcccacctccgcgccgccaccctccgccatgctcaagcggcgatagccgttcgaagctgaagcgaaatcgtgacgcgcctgtcatgggcgcgacccgacggctggccgccctgcacacgtccgcgtcacgaaccttgagtggcgcctgacccactgttagtgggacctgcaatgagtgcaggggatgtacccgcatcaagcgcgacggcccagcgcgccatctgggctcaactgcgcgcggcgatgggccgcttcgtccacgccgcgctgagagcgtccaaccgcctgcggcttcccggcccctctgtcctaccggtagcgggcgcggtggtcggcctgtacagcgggctggcggccggcatcttctccaacctcatcgggttggtgagcgggctcaccttcggggcggcgtcgctgaagcacacgcttcgccaggaccagttccagtcgctcatggaggcgttcgccgcggcccgctggcatccggagtacgccttcatcggcgtgcccctggcatccggcgcgctgctgctggcgcgcatcatcgaacctggcgggccccgtgacgaggtgaagcgccggctgcgcctgctggccctgctggcgctgggcggactgtcgctctactacccgctggtggcgctgtccgcgctcaacagcgtgttcggacacagccacaacctgcccgaggcactgccccacctgccctggtggctgatgctgctggcgcccacgctgggcggcgtggtggtgggccggctgctgcgggacaagcccgagacgcatggccacggcgtccccgaggtggtgcgggcggtgaagagtggcgccaacgccctgccggcggaccggggcctgctgaagctcgtggcgtccgccatcaccattggcagcggcggctcggcgggccgcgaggggcccatcgtctacggcggcgcggcgttcgcttccaccgtgggccgggtgctgggcttcagccgcaaggagctgtccatcctcgtggcgtgcgg

SEQ ID NO: 1081 - DNA, 10992 bp, Myxococcus xanthus
gccgtacttcttcgcaccgttgaacatcatgtgctcgaagaagtgggacaggccggtgatgccggggtactcgttccggctgccgacgcggaaccagttgtagaggacgacattgggaatgtcgtggtcgggccagacgatgaccttgagcccgttcttgagggtgcgggactcgatgccggcgccgagcttgggcgcggcggacacggcggacttcgccaccggcttgccgccctgcgtctgcgcacaggccacggggccggcgagcagggccagacacgaggtccagagtaacgactgacggaacatccgtgctcctgtcggaagagcgcccgggaacgggcggcggcgcacgatattccagttgccaccctcctgggttgaccaggagggcggatgacgcggcgactcaggcgccgagcacttcgcggagcacttcctggaagtagttgatgctgcccgtgtgcgtctggaagtgcctggcggactggtggaggcgctggatgacggcctcgaactccgcctgactgacgtcgcgcagggacatgtagaggcggacggcgccctggaggtgcgagaagagcgggttgcggtcggtgccgtcggggcggcgcaggaggtggcggtagagccgctcgaattcctggtccgtctcggtgttgcgcacggcgcggcagtagccggcggcggtggcctcgatgaggaggaagaagggctggtactccggcggcggcgccttggcgaagctggggggcttcacgtcgcccacgaagagctgggagatgggcttgagcgttacataggccagctgctcgcccgcgcgaatctggacgcgctcccccaccggacgcacgtgcttgccgtcctcgtcccactccaccgccacgtacaggcgctcgggctggtccaccttcacgcccgccttctcgagctccgccactgcgttcgcgtccatctcgtttcgttcctccggctccctctctaccctgctccgggcagcccgtgcacccggcatcgtggggcaacgtcgggaaggaggagaaacgagggtgcctttctcgcgccctggaattactggtatgccaaggaactccaagagcatctgcggccactggtctccagccgctgtgcgtcacccctgagtccctgccccacccatgttcgagaacttctttcgctcacgcgatgccgatgcgcttgaggtcttgggaaaagtcgacacggtccgccgacttcacggcctcatcgatgaagcccaaaagcatgtcacgctgatcagtccctacgtcagcatcgagaaactgcgagacattgagcgcaagattcgtcaagccctcgaacgggaggtggccgtgaccctggtcatccgcgagggtgacgagagcacacggggcccctcacagcaaggcgtggaactcctggtcagcctcatgcaagcgggcatgcgcctgttcgtcgtcagggacctgcacgccaagctctactactccgaacgccacgctctcatcacgtcgctcaacctcattgagtcttccttcaacaacagcattgaagtcggcatctgcatctcagccggtcgcgccgagtacgtgagaatcagcgacttcatcgagagcgaaatcaccccacaccgaaaggaagtccccttcaagccggccaccgagccgcgtcgcaggagcgccacgcccgtcccccggcacgccacgcagggattctgcatccgctgccgcgacgcaatcggcttcaacccggagaggccctactgcgacagcgacttcaacgtctggcgccgatacagcgaccccacctacgaagacaaccattgccaccattgcggcatggacttcgccgccagcaagaacaagcccctgtgccgtaagtgctacggaatgctcaggtagccttcagcgccccgtgacgatgagctccccgttcctgtcagtccctgaatcgcagtgggtcgcggccaacacgttcgctttcgccatccgggatggcttcccggtgagcccgggacatacgctggtgattccccggcggcaggtcgcgacctggttcgacgcctcgaccgaggaacagcgcgccatcttcgagctggtggacgaggtgaaacgcgggctggatggcgagctgcatccagacgggtacaacatcggcatcaacgtgggcgcggcggccggccagacggtgctccacctgcatgtgcacgtcatccctcgcttccagggtgacatggacgaccctcgcggcggagtccggcacgtcattccaggcaaaggcaactacctcgccgggcgaaacaagcccctggccacgggaggcctcggcgacccgttcctgcaccacctggagccgctgttcgcggatgcggtggagatttcggtcctggcggccttcgtgcaagacagcggactggagctgctgcgcgagtccgtggaagccgcgctcacccggggggcgacggttcgcatcctcacgggtgactatctggccatcacccaggcggatgcacttcgacggctgctcgactggatggaagaggacgccgcgctccaggcggagccaggccgtggccgttttgaagcgcgtgtcgtggaggtggagaagctccaactcacgtcattccacccgaagtcctggcgcttccttggcaccgggctcgcggtggcctacgtcggctcgagcaacatctcgcgcgccgccttgaagacgggcgtcgaatggaacctgcgcgtcgagcgggaccgggacccgcaggcctggaacgaggtggtggatgcattcgagggctggtggagccgggcctcccccttggacgcaaattgggtcgagcaatacgctcgccgcgcaccagcggcccgactgcgcctcccggcaggtgagacggaaccagaagcccccttgccccgtcgcgagccacacagcctgcagcgtcaggcgctcggtgcgctcgcgcgtggccggcgcgagggacggcaacgcgcactggtcgtcctcgcgacgggcctggggaagaccctgctcgcggcgctcgacgtggaacagttcaaccaggaacggggacgggcgagccgcgtgctgttcctcgcgcaccgggaagagctcctcgtccaggcagcggagacgttccgtcgtcagcagcaccacctccgattcggctggtacgtggggcaacgcgcgcagctcgtgggcgacgtggtcttcgcctcggtgcagaagctctcgcggccagaagaccttcacgcgctccgcctcgcggccgcgttcgactacgtcatcgtggacgaggtccaccacgccacggcggcgagctaccggtccatcctcgcctgcgtggagcccgcattcattctcgggctcacggcgacaccggagcgcgctgacgagggcgatgtgctcggcctcttcgatgaccacctcgcctggcgctcggaccttggagaaggcatccaggagggactgctcgcaccgttcgagtacttcgggctcaaggacaccgtgccctacgagaacatcccctggaagagccgccgcttcgacgtggcgctgctgacccaggcggttgagacggaagcacgtatgcggacactgtggcgtgcgtggcagaagcatcccgcaagccgcacgctcgtgttctgctgctccatctcccatgcccacttcgtccaacaatggctgggaggccaggggattcgcgccgtggctgtccacgccggggctggctcagcggaccgcgcccagtcgctgcgccagctcgcgaatggcacgctggatgccatctgcgcagtggacctgttcaacgaaggcgtcgacgtcccgagcatcgaccgcgtggtgatgctgcgccccacggagtcccccgtcgttttcctccagcagctcgggcgagggctgcgaaaggccaagggaaaagagcgggtcatcctcatcgacttcgtcgggaatcaccggctgtttctcgaccggctccgaaccctgctggccgtgggtaagcctccggtctccctgcgtgactttctcacctcggaccggcaacccgcgctgcctgctggctgcaccgtggaagtggagctcgaagccaaggagatgctccggcacttcctctccggaggggggcaggaggtcgagcgtgtctaccgcgagctgcgcgatgcacggggactgcggcccaccatcggagaactctaccgtcgtgggtattcacccgcgacgctgcgcaaggcgcacccggggtggttcgatttcgtgaggtcggagggcgacctgacggacggcgaggctcggaccctcgacaaaggccgcgactggttcaaggagctcgagctcgcgaacatgagccagtgcttccagatggtcgtactggaagcgctgctcgaagccgatgccctggaacaggggctgccgctgcccgagcttgcccggcgatgcctggccattctccaacgctcccccgagttgctccgggacctcgaagcagtcaaggccctgggcgacccacggctcccgaatcccgcccggttcctcacgtactggaagtcgaaccccatagaggcgtggacgaagggcgggaagtggttccgcgtcgaggaagagcggttcatccctcgccttcccatggccccatcgacccagaagtccttcgaggcgatgactcgcgagctggtggactaccggctcgcacagtatcggcgccgccaacaggcgcaggcgcaggactccgcctttgatgcgagggtcatctcgaacagccggggccccatcctcaagctcccggagcggagtgcgcgctcggacctgcccctgggaacgacagcggtccggctcgacgatggagcgcgctggcatttcgacttcgtgaagattgccgtcaacgtcgcgcgacccgatggcgcgaaacagaatcaactgccggacctcttgcgccaatggtttggccccaccgcgggaatgccgggcacggcctttcgcgtccggttcacgctcggccctgacgggtggagcgcggccccggttcaggccgagccgagccccctcgcgccatgggggacactggtcgcatttcccagcctgcgcgcggccgcgggcgccgtggagcaccccatctcaatcgaccaggctccggaagcggcgagggtccgccttccgagccgagtgcaaggcgaagggctgttcgcggtgcgcgcgtctggtgattccatggacggaggcgcgcaccccatccgcgatggtgactggctggtgatgcgcgacgcgaaagccgcgggggcggggcgcctggatgggagggtggccctcgtccaggtccccgacccaatcacaggcttccgctaccaggtgaagcggctcgtccggcaagacgggcactggctgctccgctccgacaatcccctgcgtgagtccttccaggctggtgaagcgacctcccccgtcgccctggtcgtcgaggtcattccacccgaacggctggcacctcctctgggcacgacgctcacggaggagcagctcagctcccacttcggattgagcacggcgcccagaacggggcgccatgaaggccacctgttcctgttcatcaaggacgcgcaagccttcacctcacccggccgcctggcgctgcgcgtcccagaccaccaccccagtgaaacagccttcgtgttcacacaggagaccgcgtccggtgactggacctaccagggagccgctgtctggcgagacgatgaagaccggtgggccctggagctccccaggtccgggtgagcctccgtccaagcgcggggggccgccgagggtacgccccatcacgcacctccagccgcgccgaagcgcagcagcgccagcgattcccgggccccgcgtccgtgtcccgctcgatggggacgacgaagcgagaacaagaggactcgcggctgcccagcagcccgggaagggcagcgcgtagaggctcagagttccgacaggcgattctccacgggcgcgcccgtcagcgggacgcgcgggcccgcgtattgggcgccggaaacgacaaaggcctctggactttgggtccagaggccttcatctccgctaagtgcccaggggcggaatcgaaccaccgacacggggattttcaatcccctgctctaccgactgagctacctgggcgtaagaggcaccgcgcggaacggcgccttcatagcgagcccctccctcctccgtcaacagcattctccgccacctgggcaggcaggcgtcaggccgccagggacatcgcctccccgtcccaggacgtgagaccggccgtcagcctgtggcgcagcttcacccgcaggccctgttcgatctgccggatacgcaccgccgtcaccccgaagcggcgtgccagcagctccgcgctcaccccatcctccgcaagcatccgctcttccaccagcgcacgctcccgggcatccagctccggccaggccgcgtccacgctcgcccggagccgccgcgcccacttcgcccggtccacctggtcctcctgcgagtcggcatccgccatcagcccctccagccgcgtggcctccgagtccggagacaccggcgcgtccagcgacacgtcccgcgacagcgcctccatggcgagggccacctcgtcctcccgcttccccaaggcctcggcgaggcgcttctccacctccgggtgaccctccccccaccgggcctccagccgcgaccgctccctccggagctggaacaccacccacggcgcccggccgcccgccatgctccagttgcggcccacgtaggcgcggatgcgcgcacggatccactggctggcataggccgcgaacggcaccccgcgttcctcgaaacgtcccgcggcttccatcaacccaacgttgccttccgccaccagctcttccatcgacaggccggtccaccggtacttccacgccaaccgccgcaccaacttcaggtgctcacggacgcgcgcttcagcgacctcagccggaaccacgagctcaggggattcaaaggacacgttcaggttgatggcttccatggacctcctccggttgggcgcgcccacacggcggcgcgacgcagaggaaattaaaggccggggctctataagaaaattaggtagtttaacgacaacacttcgactatctctatggatatgagctggctcaactaccatcacctcctgtacttctggacggttgcgagggcgggcagcatcgccaaggcaggcgaggagctgcacctggcgcagcccaccatcagcagccagctcaagctcctggaggagtcgctgggccacaagctgttcgagcgccagggccgcaagctggtgctcaccgacgtgggccgcacagtgatgcgctatgcggacgagatcttccgcctggggaacgagctgaagaacgtcgtctccggcttgccgcccgggcagcaactgcggctcaacgtcggtgtgctcgacgtcatccccaagctggtggccgaacagctcctcaaacccgcgctcgaagcaggcccgtcgctgcgcatcatctgccgcgaagggcccttgccgcagctgcttgcctcgctggccctgcatgaactggacgtggtgctcgcggatgcgcccagttcggagccggtgagcgtgcgctcgttcaatcacttgctcggcaagtgcggcgtgtccttcttcgcggcggggaagctggtcgaactcagggagaacttccctcagtcgctggatggcgcgcccgtgctgctgccgtcagtcgagtcctccgcgcgccgctccatggacctgtggttcgagcgcaagggcctgcgccccgtcatcgcgggtgacttcgatgacagcgcgctgctccaggcctttggccagcgcgggcacggggtcttcgccatgcccagcgccatcgaggccgaggtggagcgtcagttcaactgctccgtcatcgggcgcaccgacgaaatcgagacctgcttctacgccatcactgtcgagcggaagattcgccaccccgctgtcgtcaccatcgccgaggcggcgcgctcgcacatcttcggcgagtgagcccaaggcgccgcgctcaggcccgaggtggcgcgcggtacacctccgtgcccgcgaccacggtggcgaggacctgcgccttcaccaacgccgaggcgagcgcctccagcggctcttccgacagggccacgaagtcggcgtccatccccggagccagcctgccgcgccgggcgtcgtcgaaggacgcccaggcgcgtgcgcgtccacgaggcccggcaccacggtggcggcccccaggtccacccggcgcgcagtcgggcccgcggcggcctccgcttcttcgcgagtccccacggccagcagccgcccatcccgcaccgccagcgcttgggcccgtggccgcgccgcatccaacgtccagacccgctccgccaggtagactggcgcctgcaccgtgactccttccgcgtgccgcttcggacgcgaactgtgcgggagtcaggatgcgctgtcactgtcacacgtgtggcgacgaataccgtccgggcggcggactactccgccggcgtctcctgcgtctccggtgtgcccgcgtcggtctccggcaggggcgtcgcggggcccgcgggggtatccggcacggtctgcacaggctcgcgaatctggtccgggcccgtcaggggctgacggtcctccgttccttcgggctgcgtggtcttgcaagcgggcgcagcaactgccacgcccagggcaatgagaacggcacgacgcatgtagcctccttctcgagttgcggacggcccccagggagcgtgccctccatcgacaatctgtcgacgacagcgaacgtccaccagcggatgcccgagcacaccttcgagcgcctgcccccgatcccggacagcagcccggcagccacgcggcgcggatgatgctgcttcccatgcgcaccgttgcctggagcgttcacctgggaggccgaggccatgctggacgtcgtggacatcggcaagcgttcgcttgccacctatcgcgggattgctcccgacgaaatcctcgacgaactgcactggctctccgaggacttgcgcggcgcccggtgcatgcacctgagctccacgccctacggcggcggcgtctccgaaatcctccgctccctggtcccgctctacaacgacctgggcatcgtcacggactggaagctcatccacggcgacgacaccttcttccaggtcaccaagcgcatccacaacggcctgcaaggcgctcccggcgaactcaccgagcgcgagaaggccacctacctggccaacgcccagctcaatgcccaccggctggtcacgaattcggagaactacgacttcgtcttcgtccacgacccgcagcccgccgtgctcgcggcgctgagtcctcatctcgatgcgcgctggatatggcgttgccacatcgacacctcgcaccccaacccgaccttctgggacttcctgtcgccctacctgcacgcctacgacgccgccatcttcaccatgcgggagttcattccaccgcaactccccatctccgacgtccgcatctacccgcccgccatcgacccgctcagtcccaagaatcaccccctgccggaggccctcgcgcgcgacgtgttggagtggattggcatccgcacccaccggccgctcgtcacccaggtcagccgcttcgaccgctggaaggacccgctcggcgtcgtccgcgcctaccagcgcgtgcgtccccacgtccccgacctccagctcgcgctcgcggggtcactcgccatggacgacccggagggctgggacgtgtacgaggagctccgcgccgccaccgcgggcgacagcctcatccacatcctcaccaacctggtgggcgtggggaacatcgaggtcaacgcgcttcaggccgtctccgatgtcgtcgtccagaagtccctgcgcgagggcttcgggctcgtcgtcgcggagacgctgtggaagagcacgcccgtcgtcggtggccgcgtgggcggcattcccatgcaactgccagagggcactggcggagccctcgtggacaccgtggaggaatgcgccgaggccatgctccacctgctccgccgtcccgacgaggcccacctgttgggcgcgcgcggacacgagcacgtgcgccagcacctcctcatgccccggctgctcgtggaccacctgcgactgctcaagcacctggcggccgtgcgccccctgccgcctcgcggcatcgtccccgtttccttcaacccggccagcctccagggggtgtgagatgcaccaacgggcacgctggcgactcgcggcccccgcactcctgtgtgtcctcatggcggggctgctcgcgtccgcggccaatgcccccacgaggaacggccagcccaccgtggctcgctgcgacctggagggcgtggtcgacgccggcaccggcggctacctgtccgactgcgtggcacgcgccacggccgcgggacatgacgcgttgctcgtgcggctggacacccccggtgggtcgctggaggccacgcgccacatcgtccgggccttcctcgcgtcacctgtcccggtgctcgtctgggtcggcccctccggcgcgcacgcgggcagcgcgggcgtcttcatcgcgctggcatccaacgtcgcggccatggcgccgggcacgaacatcggggccgcgcatccggtcgtgggcccctccggccagtccccagaagccgtgggcggggagcaaatggctcgcaaggtggagaacgacgccgtcgcgttcgcggagagcatcgcccagcagcggggccgcaatgtgcagtgggccgcctccgccgtgcgagacagcgtcagcgtgtccgcggacgacgcgcgggcactgcgcgtggtggaatacgtgacgcccaccgaggcggacttcctcgcgcaggcggacggacggcaggtgacggtggcgggtggcgaatccgtgcggctctccacccgggatgcctgtagagcaca

SEQ ID NO: 1082 - DNA, 13648 bp, Myxococcus xanthus
cgcgcgccagcccccgcccacgttcggaaggcaggctccccacggcgccaagctggtagcccgtcacctcccgcccttcgagcaacaaccgcatccgcatcaccgaggcattggccagcacccggccgtcatccaccaccgcgaacgtgcggtagtcgtcgttccattcaccccactgcgtccaacgccggaagtcggcgcgggtgaagactcgcgacacgtagtcgcagaacgcggcatggagcgccgaggtgccgggcccgatttcagtgacggtgggaacacgcttcgatgccatccatccaccctacgcgattcccaccagcggccaacagacgcgagcccacaccgggaatccctaacgtgctgcgtattgtgagccttcacccgggagccgacccgtcgcctgttgtcaccatgccaataagcaacggaagggatgcgcgcatgagctacctccccccatccgcgcatcccctcgcctccctgccttgctccccagcagcatggcgaaagtcgagtctgagcctcgctgaagcgatgcggctcgtgaggaagagagggagcgggctcccttccttcccaggacttcagcgtctacgggctgaacatgccggtgagcacgctggcgcggcctcgaggcagcgagcgcttgaacgggctcgtcgcgaggttcgagccgggctggtaccagctctggatttccgcgaagtacgtcccgcccgcccgcagcacgtccgggggcaggtacacgctttggagatccgtgtgcagcatcgccacgcgcgtcgcggtggtggagccgttgctcgtgccgagccggtagatgttcaccacgtagttcgtggccgtgccgatcagcggcttcgaccagcgcagcgaggcgtcagtccccacgcccgtgaggttctggaacgcgccgcgcgtgttcaccaggggcgcctgcaccggcccgacgaggggctccacgggcgcggcggtgaacgcgctcgcctcttgctccacgcggatgtccacgttcatggtgtagggcgtcgcggttcccagcgcgtagctctgcgtgaagcccgcgacggcggtcgccaccttctgccacgccgccgggagcgggttgttgtaggtcatgctccccgtgacgatgtcggtccgctgcgcgtcaggattgagcttcacgagcagtggcggcccgctgatggacgcgaacgctgagctcagcgcggccggccgggcggacatccagatctcgttgtacgtgctgaccgcgcccgggttcacctgggtgcgcatggcttcgaaggccgagcgtctccagtccacctcgaaggtgcctgtcgcgacgggctgggtgaaggttccgttgacggtggtgggctggccctccacctgcgtcatgctcgcgttgagcaccttgtgcatcgcgcggtaggacactccattcgcgctcgtctgcaaccgcatctgagcgagcgagaacacatccccgcggctgctgtcgagcagcaccgggttgagcatgtgggcgtaatcgaagctcagcccggagagcgacgtggcgcccgccagggggcgccccgtggcggcgccgcccatgtagccgaacgcgcccgcgttcaacgaatacatttccaggaagtcccccggatgccagggggacaagccggtggcggacaccgtcaccggagtgggcagcgaggcgaaggtgccatcgcggccccactccgtggagcccagatcgaacgcgcggctggtgctcaccaggtagcgcgagcccagcttcaggtagatgcggccggaagggacgttcggcacggagatggtgccgtccgcggagcccgtgcccggatacgccgtgaacgccccggtcgttgagtttcgcgtgtatgccaccaccgacgtggcggactggtcgtaaggcttcgtctcgttgcccgacgtggcgacgaaggtgaccgggctggtaccggtgacatgggtgaccaggtcttgggtgacctgggaggtcgcgtccgtcgatacggagtccaccgcctcggcctcgtcgagccccgcgcagccgacccctgtcatgccgaccaaaagcccgagggaaatcaatgacatattcattatgaaggcaaccctttcggcgacgccccgaatcgcgccgcgcagggagattcatacagggtcggtctgacttttccgggagcgcttcgactccaactttccctcggggaaatgaaagcaaacgcgcttgtctgcaggtgagcccggcaacggactccgtgatgactggcgccattcgcctggcgactgcggtcaccgccggaggcctggagcgcgatgcgtggtgccatcccctcgcctccctgccttgctccccagcagcatggcgaaaatcgagtctgcgcgcgggcgccggcctcctggagcacccgccaggaggccgcggcctccgcgtcacaggaagcgtttgaagaggcccagcttccccgtgtagggcgggtagcgcagcttcaggtcgagcaggaagggccgcttcaccacccccttgcggtggctgaaggcgtcgaagctgggctggccgtgataaccgccgctgccggactgcggcactgcctccgaaagacaggtccttcgcggcgaagtggacgcatacatcgttggccaccgcgccgccgctcgacgtctccgtgaggacgcgctcgttgaccgccgcgtccttggagaaggtgtagagcgccagcggcttcggcctcgcgcggacgaagcggatggcctcgtcgatgctcggacagtccaccaccggcagcaggggcccgaaaatctcctcctgcatgagcgggctggacagcggcgcatcgatgatgacggtgggcgcgaagaagcgactgtccgcgtcccgctcaccgccaaaggctacggtcccgtcctgcgccagcttcgagacgcgctcgaagtgccgcgaactgatgatgcggccatagtcgcggctctcacgcgtgttcgccccgtagaagtcggtgacagccttctggaccagctccgtgaagcggcccttgagctcgggcggaatgagcacgtagtccggggcgatgcaggtctgcccggcgttgaggtacttgccccaggcaatgcggcgcgcggtgacttccaggtccgcgctcttgtcgatgatgcaggggctcttgccgcccaactccagcacggtgggcgtcaggtgcttcgccgcggcttccgccaccacccggcccacctggggaccgccggtgaagaagatgaggtcccagcgctcgtcgagcagggcgcggctctcctccgcgccgccttccacgacggcgacgacatcctcggggaaggcttctttcagcatccgcgcgagcacggcggacgtcgccggggacaactcgctgggcttcagcacggcggtacagcccgcggcgagcgccccgatgagcggagcaatcgccaactgataggggtagttccacggggagatgatgagcgtcacgcccagcgggtccgagtactgccagacgcgcgcgggttggatggcgagcggcgccgcccccttgcgcggcgccatccacgccttcacgttcttcagcgcgtccttcagctccccgtagatgctgcccacctccgtgaggtaggcctcctcggggctcttggagaggtccgactgcagggcggcgagaatctccgcctcgtacttgcgtgccgcccgttcgagtacctgcaactgctcccgtcgccacgccagcggcagcgtggcacgggtctcgaaacgggctcgctgtttctcgacgagcgccttcgcatcgaacgaaggtggaacggcggcgagacggctggagccctgcgtcatcggacctctccttgtgtgagctgctacttcaagaattcgcctctttcggccatctcgacgagcgacgccggcggctcgaagtgcgcaccgtagcgctgcgcgagctcccgcgcgcgggcaatgaagccccgcggcccgttgcccgtccggccctcatagccgttgatgaactgcgccacgccgcccgtccatgccgggaagccgatgccgaggatggagccgatgttcgcgtccgcggcggagcgcagcacgccttcgtcgaagcagcgcaccgtgtcgacggcctcggcgaacagcatccgctccttcatgtcctcgaaggggatggtgtggccgggcttggtgaagtgctgcgccagtcccgcccataggcccgtgcgcttgccgtccacgtagtcgtagaacccgccgccggtggagcggcccttgcgctggtgctggtcaatcatcgcgtccatcacggcgtagctgcggtgctccacccagggcttgccctccgccaggatggccgccttcgtctcctgacgaatcttgcgcggcagcgtcagcgtgagttcgtccaccaactggagcggggcggcggggtagcccgcctggaggccggcctgctcgacggaggcgggcgagatgccctcgcccaccatggcgatggcctcgttgaggaaggtgccgatgacgcggctggtgaagaagccccggctgtcgttgacgacgatgggcgtcttcccaatctgcaccgcgatgtcgatggccttcgcgagcgtggcgtcgctcgtcttcttgcccgcgatgagctccagcagcggcatcttgtccacgggcgagaagaagtgcatgcccacgaagtcctccgtccgcttcacgccctcggcgagcacggagatgggcagcgtggacgtgttggacccgagcaccgcgtccggggcgaccacgtcctgcactttctggaagacctggtgcttgagcttcacgtcctcgaacacggcctcgatgacgaggtcacaccccttgaggtcggcggcgtccgtggtgggggggattcgcgccagcagcgcgtcccccttctgcttggtggacttgcccttctggatggccttctccaccagcttcacggagtactgcttgcccttctccgccgacgcgaggctcacgtccttgagcaccacgtcgatgccggccttggcgcagacgtaggcgatgcccgcgcccatcatccccgcgcccagcacgcccaccttcttcgcggtgtgctgcgggtagcccttgggacggccgccaccggagttgatgtgctgcatgtcgaagaagaacgcctgaatcatgttcttcgcgacctgcccggtgacgagctcggtgaagtagcgcgactccacggtgaacgcggtgtccacgtccacctgcgtgctctccacggccgtggccatgatggcgcggggcgccggcatgttcgcgcccttgagctgcttgcgcaggttcgcggggaacgcgggcaggttcgccgccagccccggagacgacggcgtgccgcccggaatcttgtagcccttctggtcccacggctgctgcgcggtgggatgggccttcacccacgccttggccgcgggcagcagcgcctccacggagtccaccacctcatggaccaggccggcctccttcgcctcctgcgggcggtagcgctggccctggagcagcaccttcatcagcgcgtccacgatgcccagcatccgcaccgtgcgcaccacgccgccaccgccaggcaagaggcccagcgtgacttccggcaggcccacctgggcacccttcacgtccgcgatgatgcggtggtggcacgcgagcgcgatctccagcccgccgcccagcgccgcgccgttgatggccgcgaccacgggcttgcccagcgtctccagcgtgcgcagctgcgccttgatttcctgccccagctcgaaggcctgcttcgcgtcctccttgcgcaccttcagcaggtccttcaaatcaccaccggcgaagaaggtcttcttcgcggaggtgaggatgacaccggcgacggtgtccttctccttgaccagccggtccaccgtcgcgcgcatggacttcaggtacgcggcgttcatggtgttcgcggactggttcgggtcatccaacgtcaagacgacgatgccgtcggcgtccttgtcccagcggatggtgttctgctcgctcatggggttcgctcgaatcctgtcgaagtgttggaagagaagctcagacgcgctcgatgagggtggccacgcccatgccaccaccgacgcacaaggtgatgaccgcgcggcgcgccttgcgtcgctccagctcgtccaccatcgtccccagaatcatcgcgcccgtggcgcccagcgggtgccccatggcgatggcgccgccgttcacgttcagcttctcgtccggaatgccgaggtccttctggtacttgagcaccaccgaggcgaaggcctcgttgagttcgaacaggtcgatgtccttcaccgacaggcccgcaatctccagcagcttctgggtggccggaatcgggccggtgagcatgatggtggggtccgagccggacgtggccaccgcggcgatgcgcgcgcgcggcgtgaggcccagcgacttgcccacctgctcggagccgatgagcaccagcgccgcgccgtccacgatgcccgacgagttgcccggcgtgtggacgtgctcgatgcgctccacgaagtggtacttctgcagggccaccgcgtcgaagccgcccgcctcgcccatgacggagaaggacgggttgagcttgccgagcgacgccacggtggagtccgggcgcatgagttcgtcatggtccagcacggtgaggccgttctggtccaccaccgggacgaccgagttcttgaagtacccgccggcccacgcctgggccgccagttgctgcgaacgggccgcgtagcggtccacgtcctcgcgcgtgaagccctcgatggtggcgatgaggtccgcggagatgccctgcgggacgaagtaggtgtcgaagttcgtggccgggtccatggcccaggcgccgccgtccgagcccatgggcacgcgcgacatgctctccacgccgcccgcgatgaccaggtgctcccagcccgagcgcacctgctgggcggccatgttcaccgccgtgaggccggacgcgcagaagcggttgagctgcacgccacccacagtctctggcagccccgccgccagcaccagggtacgggcgatgtcggcgccctgctcacccaccggcgacacgacaccgagcaccacgtcgtcgatgcgctgggggtccaggttcgggtgacgcttcttgagcgcgtccaccagcccggtgagcagcgtgatgggcttggtgccgtgcagcgcgcctttcctgcccttgccgcgaggggtccggacggcgtcgaagatgaatgcttcctggctcacgaagagcctccttgggacggggatgtgggtctacggggaacgggcgacgagctctttcatgatctcgttcgcgccggcaaggattcgcagcacacgcgtgtccgcgaacaggtgggcgaaggagtactccttcatgtacccgtaccccccgagcaactgcaagcaacggtcggcgacgatgcacgcagggtccgtcaccaatactccgccatcctgtacgccgggggcggcgccagccagcgcagcgagaggttgaccggtggggacagcggcaggatgtacggatgcgacgccggggcgctagcgttgttcgcgcagaaatcgatgccgccaaagcgcgccgcggcctcgtccacggcgcgccgcccgtccgcatcctcccacacgtctcccaccgccgcgagcgcctggccccccgcgtcctggatggcctgcgctaccgtgtgcactgtcccgggcagcgggggttgggcgtgtctgtcttttccagcagcacgacgttggcgcccaggcacactccagaatctgctcgcggcgttcgtcaggctccaaccgcttccagcggggtgcgtcggccgagttcatggcgacccctcccgcaatggcaggaacgagggcacatcatgcgccacggtccgggtgaagcgaggcggccgtttctgcaggaaggccgtcaccccttcttcccgggacaggcccgctcccaggtgcggccatcctgacgttcgcgtctgtgcaagtcattccagaatggggcactgttgacccataagccgcaagtgctgcttttgaagttttccctgtcaaattagatactgcgggtgccgggacacacttcgtggtccggccacccgtcgtcgtggagtcaccatgaacctgctttcgaagacgctgttcgtgagcgccgcggcccttgtcacgctctccccgctgtccgcgtcagcgcttcccccagattgcgacgtgcagtgtgccgacgaagcgccctgctcgctcgtttgtgcggtgccctgggggagtcgcatcatcacctgtgagcggtggttcagcgactacgagctgggcggcacgtgcacgccggacgcccagattccttccgaggaggaggaggaactgtcgtcggtggagccgcgccagagcagcacgcccggcatggcggcggcctgcctgtccgcgtcggtgagcgccccgtaacacgcctcaccctgggccggcccgctccgcgcatgctggcgtggggcgggttccatgacacccaaggaagaggccggattgcgcatctatcaagtcgaggcgccgcgaccgtcgcgctacacggggaacctgaatgccgcgcatcgatggagcctgcctggactcgcggactgtcccggcggtggtgcaacttggagcaccgccgggcttcactatccatgcgtggacctgacatcgctcccgacacggcacgagtacgaagagccccgccctgagccatacgaggagtgggctcgattgcgcgaacaggtgcggccccaggtgccccccgggttcgcgttgatgcccggaaccaagtttggcccgatgaccggacgcgcctccggaacctttggacagctacatcttcaagcgtggtccctgagcctccgccgtgaagcgctggaacaactgcggcaatcaggattgcaagggctgaacggctgcccgatgcaactcaagggaagcggaaggaacccgcccgagctgctcgaactccagctgacgccctgtgggcgcttccacccggactgccttccatccgaccgggagcctccgtgccccacatgtggcgttgagagctacggtctccccgccccctatctcctcgacacgacctccatccccaccactgtggacgtcttccgcctcgcggactggcccacgctcatcctggccacgcagcgcttcgtggacgcggtccagcgcctggagctcgacggcgtcaccttccgtcaggtcgcggcccgctgacccacggccacgaacaacgatgcatcaggcaaaccgctccctgcccccagcgaagcgcgggaggtgtggatgcatctggcggacagccatttgaatgagccgggcgttcggggacggcccggggacaacccacatcgtcagcctggatgcggcggccaccgcgctcggacaggctgggactgccatggcatcctcccgaggggtaggaggaaaggccgccactgcgcgcggcacgggggcgccgcgaagacgtcagcgcctagcaggcgccacagtccgcggcgcagctgtccggcgtgttgctggtgccgcagctctcggagagctggcacgtcccatcaccgcacttgtagatgtcctggggacggatacgcgtggtgagcgggcggtacgtcacgccgttgtacgtgcagcgcgtgtagtacgtccgcgtggagtcctgctggcagtacgtcagggcagcccccacgtgggtgatgacggccgcgcagtccgggtccccgctccacgacgacaggccgcacgcgcgcaccgtgctctcgtcgtaggccagatagggcgcgtcattggccgcgaagagtccctgaccattgaagaggttgccgaagaagacggcctcattctggttgtaggtctgcacctcctcggccgtcgtcggaatgacgacgccctgcgagtccttgccctgcacggagatgttcaggtgcacaccgtacttgttcacgtgtgccgccaggcagctcgacaccaactgctgctcgggctccggggcaaccggagcgcccgggctcgacggaggcggaggcgtggggttcgaccacgtcggcgccagccccagggaaccctgccaggtgtgcgtggtgcccgcatgcgtatacgtcagggattggccggaggcgagcgcgcaccggacgatgtatcgcatcacctcctcggccttgacggggtccgcgctgaaccacgtgctgaaaccattcgtcgacaagccgttcgtcgacagtccattcgtcgacaagccattggtggacaggccgttcgtcgacaagccgttcgtcgacagcccgtttgtcgacaagccattggtggacaggccattggacgacaccaacgcgtccgactgggtgcccagcgtctcgctcgccgtatccatcggctccgccgggccacaccccacggcggcgacaagaagcaacgctggcagcagctcccaccggtgcgcacaacggcgtccggcgtaggtgaccttggagctggaacaggtcttcgaggtggggtggtgatacatggctgcctccggtttttgggggtagccgcgtttctcgcggccaagataaccggtagtccttcttttcccctctgacaggtgccctctcgggcagttcgcgcacgtcggtcatgcggcaaacacgtagtccgtgcgccggctgacgctcagcgttcaatccgcccagccgccaacgttgcagtcacacgcgatgtctcacgcccaagggtgcgggctcctgcgactgtcgcgcgtctcgtggcattttcaccgtgaaggtcgttccctctgcctcggaggaggacacgcacacagctcctccgtgcgcctggacgatttgtttcacgatgaagagtcccagccccaggccaccagcgccacgacggtggcccttcccaggagcagtgcccacctggcggaacgggtcgaacaatgtctccatctgttgaggcggaatgggcgtcccggtgttgtggacctccaggacctgctcaccgtccacggcgatacatttgagccggacgggcgtgtcctcggcgccgtgctccagtgcgttgcccaccaggttgctgagcacctgcgccatccggtccgcgtcccagaagccctccgacgcgccctccacgtccagggtgatgtgccggcccggatgcgcggcggacagctcctccaccaccatccggcagatgatggccaggctgaccgtccccaggtgcagggggatgccgcccgccagacgcgcgcgggtgaggtcgaggatgtcggaaatcatggcgcccatccgcgcggcgctcgcctcgattcgctgggcgcactgctgctgctgggccgccggcagcgtgcgttgcgccatggctcgcgcggacagggcaatggcattcagggggttgcgcaggtcgtgcccgaggatgccgatgaaccgctcacgaaactccgcctcctcggtcagccgctccagcgcgaggtggcgcgcgttgccatccagggcctcgcgggtcagccgggccgtcgcgtgctccagcgcgccctccgcccggtggcgggcctcacgctcacgctccagcgcctcacgaagcgcctgcgcgtcgtccgtgtcatcgggcagcagccacagcacgaaggcatccaacgccttcatgcccacggcccggaagcgcgcctccatgccctctcgggtgatgcacagcacgacggacaccggctcgcccgtgtccaccacgcgcacgcagtcctccaagcgcagccctcgcacgccctcctgctcccagcgcgacacccatggaggcaggacccaatcgtgcgccgtcggctcggcggacgcatcgagcgcggcctggcgcaagtcgagcacctcccccgccgtccctcgcaccggctcgaagcgcaggcagggcgctgcgcctcccgcatgcgtcgtccaggtccaggcggagccccacttcgacgacagacacacccccatcgacgtccccctggcacgccctccagccccgatgctcgacgctcggtcgcggaacgcacacgggacaagagtgacaaatctccgggagcgcgaacttgtacgtgggtaccggcgcgaccttcagtgctcactccgcgccagtgccaacgcgccacgcggcccggcacccgccgcggtgtcctcattccgcaatggccctgcgcgaacggccagggccccggcgcgctcgcccaggactccggctcaatacatgatggcgatgtcacgcagctcgggtccggaggcaccgccgaggaaggcctgctccggcgtcatggcggcacctgtcatccggttgacctgatacaggacgtatgggccgtcaccgttgaggtctcccacggcgtagagccaatcgatggacgggacgggcgactcagcccgccgcacgcggcaggcgcacggtgaaggtggtgccatgctgctcggaggacaccacctccacgccgccgccgtggccgcgcacgatgtcctgcacgatgtagagccccaggccgatgctgcgggtggactggccctccttcaacgcgccccgtgtcagcggctcgaacaggcgaggcagcaactcacgggggatgggggcgccgccgttgaagacagacagcagcgcggcctcgccctccagccgcgtgtccacccgcaccggggcgtccgcggggctgtaggccagggcattgcccagcaggttcgtgagcacctgggcgatgcggtccgaatcccattcgccgcgcacctcgccctggacctccacctccacgcgacgcccggggttggccaccaggagctcatccaccacctggtgcaccacctcccgcaaatcggtggtctgacggtgcagggcaatgccgccgcccagccgggccttggtgaagtccagcaggtcgcgaatcatccgggccgcgcgctcggtggcctggccaatgcgccacaccatgcgcttctgcggctccgtcaacgcacccttcttctccagcagccccgccgacatggagatggccgccaggggattgcgcaagtcgtgggagacgatgcccaccagttgctgttcgaactcggcgcgccggcgcagttcctcttgcgaccgctgctgctccgcgaacaggcgcgcgttctcgatggagagcgccgccttcgccgccagctcctccaccagctcctggtcctcctgggtgaagctccggcccgggcccatgcgccccaccgacagcgtccccaccaccctgccctgcgtcctcagcggcacgcacagcaggctgcgcagcgcctcgccctgtcccagctcccgcttttggtcctccgacagctcgggcacgaggagcggccgtccgccacggagcacgaagtcgctcagcccctcgccggggagcagcggtgccccatcctccccctgattggaatggctggccgccacctccagccgcgtcccgtcgtcggacagcaggcatagggtgcatgtgtcccccaggaagtaggcgacctggcgggtgatggtgtccagcagcacggacaggtcgcggttcgtcgcatcgaaggcgtcggacgcttccgtgagcatctgcagccgggcggcggcggcccgggccacggaatgggcccg

SEQ ID NO: 1083 - DNA, 13805 bp, Myxococcus xanthus
cccgacgacgagcacccggccatccggcaggcgcgtcccggtgtgcaggtgtctcgcgcgggtgagtaaccccgcggggctccaggtgttcgtggtcggcgaatagcgctctgccgagttcagcgtgccgcctgcgttcgtgccacccacgacgagcagctcgcccgaggccagcgtcgtcgccgtggcatcggctcgcgcggtggagaggcccgcggtcgcggaccaggcgttcgtcgtccggtcatacagcgaggcggacgccagcgcggtgcccgctccgtcacggccacccgccacgaggacgcggttcgtgggcagcagcgccatcagcgggtcaatgcgaggaccgcccagggttcccgccgcggcccagccctggacgccagggtcatagacctccgtgtccgcgtagaacgtggttgacggattggagtggaagcctccggcggtgaggaccttgccggaggggagcagggtcgtggtgctgttctcccggccagtcgccatggagcccgcgagggtccacgtgccggtggcggggtcgtagagttcggatgccggttgggcatctcgcgcggcgttggagccgcccacgacgagcacccgaccgtcgggcagcagcgtggcggtgtggccgttgcgcgcgaaattcaggccgccggtggccgtccaggtgttggccgtcgggtcatagagctcggcatgcgtggtgacgataccgcccgaggtgaatccgcccacgagcagcacgcggccatcggggagcagggtggcggtggcgtagtgccttgggaccaggggcggcgcggcggcggtccatgttcccgccaccgggtcgtagaggtcggcgcccgggacttcgtcgttcacgttgttgaagccgctcaccgcgagcacctgcccgctccgcagcagcgtggcggtgtgggcgcgacggacgctcaggaggcttccggtggggaggaacgtgttgctcgcggggtcatacagttcggcggtcgcgagattgctgccgcccgcgatgaggaattgaccggagccgagccgcgtgagggtggccagggggcggggcgcggccatggggcccgtggccgaccaggtgtccgtcgcggggtcgtagatgcgccccgacgtggagccgtccgccagcacgagcgcacgcccgtcggagaggcgcgcggaaagggtgacgttgcctgaaatcccggcggcggccgccgcgctccatgtgtcggtttcggggtcgtagcgttcggacgaagccacgaagcccaggcggttgacgccaccgacgaccagcaactggccggtgccgagcaggaggccggtgtgctgagcgcgggcttccgccatggcggcggtggaggaccagcctgggtcgacgacgagcggcgcggtgagtccggcgagcgagacctcggtcgtgatgcggacctgcgcgccgtccacgtcgaacacctgggtgcgcggattcatgcgtccacccgcgagccgcgtgctgcccgcgcgcgagtgaccgttggcgtctcgcaccacggcgggatggaagcggagcacggggcgcgcgctttcatccaggaactggaggtagtcgcccgtgtcctggatgtgccggacggaggccggcaacgtgacggtgtactcggcgcggtgcgacggcttgtcgccgcgcgtctccggtaccgcgtccaggatccacgcctcctcgacccgcgaggtgcgccagccctgttcggtggtctgcgtgcttcccgcgggccaccagaggtgccgctcgccctggaacgcggcgaagcgctcgcggtggagcgtgcccggggtggaggccgccggctggacctggaaggtcagtccacgcgtggtcagcgtcagccctccgtcattcctgagctgcgcatcgagcagccgggccgagggcgccgaaggggccggacccgtttcaaggtcggggaagtaggccagtgccagcgccagggcggtggtggcggaaggggcttgtttccactggggcagggcctggcctcgtgcggcggccagcgcgtcgtcactcggaggcgtcaatccctccttcccgcatgacaggaggatgacgctccccacgagtatcaggcgcctgctccagaccgcgcgatgtgactgcatccaggaactccggtttgaaaggagcggcgggacggctcgagccgtgaacccgacgctgtgagtcattttcagcggattatccgctgcagggtcggatgggcaacgtcgaccgtgtctcagttgtgcattctgtgcgtctccaggctcacggcgctggaagcttccgttccccctgtcgcttgacggggtgggggtggattcaatacagcacggcgggatgctcacctgtagggtgggcctgctttcccaggaactggcgctgtccagcgccaccgtgcgtcaggcgggtgaaggccacatggaggcctgggtcggcgctgctcacggaggcgaagcggctgcatccgccacgcgtgggcttcgaccccgacgccgtggcctggatgctctacagcacgtggcagggctcgatgctggtgggcaagacgcggcagcggcccgaaatggtcatcgagaacctgcgccagatgcgcacgtacttccaagcaatccaagcgcgcctgacgccgggcgcatcctgaacagaggagaacgcaccatgcagaagatcacgcccttcctgtggttcgacggcaacgcggaagaagccatgaagttctacgtgtccgtcttcaagaaggacgcgaagattctgagcctcaaccgcgccggggactcggacacggcgccggtcgtctctggcacgttccagctccatggacagcagttcatggcgctgaacggagggcctcactacaagttcaccgaggccatctccctgttcgtggactgtcagacgcaggaagaggtggatgagctgtggtcgaagctcctggagggaggaggccagacgcagcagtgtggctggctcaaggaccgcttcggcctgtcctggcaaatcatcccgtccgtgctggggaagatgctgaatgacaaggacccggagaaggcgcgccgggtgatggaagccatgctgggcatggtgaagctcgacatccagggcttgcagcgcgcgtacgacggtgcggacccgtaggctgcccgacggcacggtggtgccgccccctgtccgtacggggcagggggccgctttcaacgcattactgccgcacgatccggattccgtgccaactgcagccgaccctggcgcggcccaggaagctgccggccttcatgtcgtacgagtacgtgctctggccgaccgccacgttccagtcgaaggtccaactgttcttgtggctgtagccccggtgcttctcggcctttccgagcgtgatgcggaaccggttctgctctttcagtgagttgaccttcttggtgtattccgcgtaccggctgatgtaggtcgggtcgattgcgttgatgattcctcgttcgatgccagcccacacgttgttgagttggcctccgatgaattggttgagctggttgttcacaaaggagttgatctgcgcctgagtgaggttgaagcggagggcgttgatgttgacgtcgatgttcatcgcgtcgaacagccagttgcctagcttgaacttgacgatcttcgtgaagttcggcttggcgagcgtgttgtaggtgtgcggcgtggggaagatgtagctggtatgcaggtccatgttgtcgatgccgacaacgatttcatccgcatacgacgggccccagtacttcacgaagagcgccttcttcctgcgctggagcttccccttgatggagatggagcggaacagaaagaggttgagcttcttcgtcttgaagatgaagcgccggtcaccgaactgcgcggtgccttccttgttgaacccgcttcccaccgtcagcaattgataggcgggcagcggcgggttgcacttgtcgccacctgattcgcccttgagctgctcctgcgccaccgcggtggcgaagggggagttggccacgcattcgaactcgtcggtgccgtcgtagtcgtcgacgatgaagccacagccggccgtccgccaggcgttgttgggcttcgaggagacggcgaccctggcggatggcggtggagcccggccagaacttctggcagtaggagaggccgccgatgttgcagcccgaggtgcagtcggggtccgccggtccaggtgccccctggagactggtggctgttgaccttgccgcagtagcgcgagaagcgccccaggaccgtttcagtagggtccggggtggtgtcgctgcccgccatcttctccttgagcatgtcgatgcgaacgacgccggtgctcacctggtagcgcccgtcgccgaggtcgacctcccccgggactgtcttgaagtttggatcgaagtcgatgcgctcctggttcgccgcgagccatgtcttgaaccaggccaggttgttgaggtcgacctggaacagaccgatatccgtgaactgatagagcttgccacctgcgagcacctgcatgtccgggttgacgagatactggagaccctcgtccgggatgatgtggaacttcaggtcgcgcagatactcggcccggtcgacttcataggtggtttcgttgatggggaactggctcaggtggcccttgaggtggttgaacccgttgggcagcgaagacgcggccgcgggcgtggcctcgagggcatggtagagcgagttgaaggcctcttccgtcgcgaactggagcacgccagtcgggaagtctggagtcgttaccagggcgggggccacgcagtccgcggcgcacgtggcgtgcgtctcgccgttgttgcaggcaccgtccccgcaggcgctcgaagggccgcagtcttccgagcacacgatgtagttctcaccgttgttgcagacgttgtctccgcacgtgccgcagtcggcggcgcaggtcgacggcgattcgccattgtcggtgtgacagatgccgtcgccgcagtagggctcgacggtacattcgaactcgtcggtgccgtcgtagtcgtcgacgatgacgccacagccagccgtccgccaggcgttgttgggcttcgaggagacggcgacctgacggatggcggtggagcccggccagaacttctggcagtaggcgaggccgccgatgttgcaacccgaggtgcagtcggggtccgccgtccaggtgcccccaggagactggtggctgttgaccttgccgcagtagcgcgagaagcgccccaggaccgtggctgagctggacaacgcggtgtcgagcccttctgtggatacgtcctcggagacttcgttcgcctcctcaacctgggctgtgaagccagcctccgtggacgccgtggaggtgggaggctcgctgggcgtgccacatccgacggccagggcggcccaggatgtcaggatgagtgtgtagacgtcaggtttcctattcatggatgttctcacgttcggggcgtgctggaggccgctgcgctcatggttttgatttgaggaccaactgtgggtttgtttggcttcaagccccacagttcgaatctgcacagtttgtcaggagtgcgcaatatgcagttaattctggatatgttgttcttgagtagtgcttgcgctcggcttcggctttactggcctgctggtgacgattgagcccccgcacgatgggctggcggactctgtcttccacggcacggtgcgcgcgtcgttggatgtggaaatcgctggggcgctggcgtcttcgacgtcagtcgacacctgcgcgtcagccgtggctgttcgcagggccgcggctgccgctcacgcggcgggccacccgtgcgcggaggttgaagggcacgccccatttgcgcgcgagctgcccggcgcgtgccagcaatctcgcacggaggagcctgcgcgcatggggcagccccacgaggatgcggttgtccgacgcctgcacgtcgaaggcgtagagttgcgggaagctggcctgccacagcgggtccatcagtgagccgggccggcctgacttccggagcacgttgcccaccaccaccccgtccggcgtcagcctggcctgcgtggcccgcaggaactcctgcgtcgccagcgccggcgggatgcttcgcgtgccgtaggcatccaggatgatgacgtcatacggcgccccgggtgattcgatgaaacgccgcccgtccgcgagatgggcgtgcagggcctcgtcctcgcggaagtcgaagtagcgccgggccatgtccagcacctggggctggatttccaccgcgtcgatgtgcgcatgcgggagcaccgcgcggaggaaggtgggaatggtgccacctcccagtcccacgacgagcaggcgcgagggctcgggcacgaaggccagcgtcgccaccaccgctcgcgtgtagtccagctccaggcgcagagggaagcccggccacatcgcgctctggaaggcgccaatccacccgaactggaggtagcggcggccctcgtcgtcttcactgacgatgatgggaccactggcggacttcgcgacgtgcagaatcgtgcggggaaactcgaaggcgcgggagacacgcgccagggccaagacgcttcggtggcgctgcctcgctcgtgaaggctccttcggttgccaccgggaggaactggcgagtgccatcctccagggccccgggccccacgcttgtcctgcctgacgcatccacctcacgccccgagcatacgggctactcggcgcaggggaaggatgtgtcgagcgtcttgctggccttgagtccgccgcccgtcagcgtggccgtcaccttgaccgtggaggcgcagtggtacgggaggatgaagggcacctgcgtgacgccattctccgtgagcaccgccaggtcgcgcgtctgagtcaccttccaggcaggccggtcacccgccgcttcggaggactccttgggcgcgctgaccagcagcttcagcttcagcggcgcgtcaccctcataggtcccttggattttcacgacgatgaaggcgtccacgttcatcccgtaggggtcggaagccgcatccatcgcgacgacggcgccctgctgccggtcgtagacctgggcctggatgtcgctgatggtcaccttcggtgcggcggagacgctgcctgcggggcccgccaggaacagtaccaggcctatggagagggaccgcaggtggaatcgggttgtcatggccgcgcactgtagtcccggcgcgaagccctccagcaaggcaggctggaagtggcattccaagagtattgatttttctttaattgcttctatttcgcggagacgctccaaagcctgccctcggtgtttcccggagacgtgcgactccaggatgcgagggccctgcgcggcgcggtggaggatggcatcgcccatgccgagcgtcacggcatcacggacgcccgggaggtgacgttgtacgtcttcttgttcatcgaattcgggcccgggttcgagaaggcgccagccacccgctggatgggagacctgctcacggaagctcagcggccggcttccgagaagctcaatctcatctatgcgcgtttggagctggctcaggcgcgccagggggaaggatgaatctcgccgccgccctgaagcccccggagaagaccgcgtcgcccgtcgaggggacttcgacgcttccctgtgtcctgcaccggacggggttgttggtgctcgtctatcggacagacacccaggagatgctggggcaggtccaggtgtcgctgtcgggacgtgccatacggctcattcccccgtgtacgatccgcaccgcaacaaggccatgcagcccaagggccgcgtcctgcgctacgccgtgaatgacatgacggccgcgacgcaaggcgatggcgtggctcggttcctgcccttggatgcggggacctacaccgtcacggtggatggcctctcggcggtggacgacctgctcctgaatccaggggcccgggagcagccggtgatcttgaacacctgcccggtgtgcctggtccctgtcgaagtgggggcgcgccccgagttcctgcttcaatggaagcacgatgccgcgggtgtcagcggcgtggaactcacgctgggggatgcccatcccctggcacaggccacggggacctcgggcctggcgggatggagcggggagccgctggtgcccgggccctatccgctcgccctgcgcttcgcgggaggcggcaagttccagctctattccgccacgggccagttgctggacgccgcacctgtgctgaacatccccgcgggccggtttcgcttccactaccaggtccagcaactgggacagctcaagctcgccgtccagctccagcagcccgacgggacgatggcgcccatcgaccggccgcacgtcaccgtccaatggccgccgagtgcctcgccaaaggagtgggtgctcgaccagggcgtcagtgaggacattcccctggtgaatggacctcagaccgcgttgacgctcgacgcactcgaactcgaggacgacggcgcccccgaagtcttcgagttcatggccttgaacccgtaacggagggcgtccatgcctcctgtcttcgcccgccggtcggactccaacaagattgatgtgacgcaccggcagacactgggtgagttgctcgacacgaacggtctcaccggccggttgaacgacgtggccctctacaactggggcaccctcgtcccggcggaaatcaaccgcgcgctgatcgaactcgtgggttgcgccagtccggagacggacccgctcgcgtcgctgctcgaccccgcgctgggaccgaagcctttcattcacaaacccgagccgtggaagcccgccgcaccgctcgccctggacacgtcgcacaccgtgcaggtgcggcgacggtttcctgctccggcggtgtccatccgcaagctcacccggtggttcctgccttcctccggcacctgcgaaacggagtacatgctggaaggtgtcgcctccagtgccgacaaggtggacttcgaggtccacgcccacgggtatcactcgctttcgcctcagggcgggcaggtggcctgcgacacggatgctacggaggggggctccatgcacttgtttcgccggcgcaaatgctacgaggtcgctgacaggcggccgcccgctgtggcccagcagctcccggactggaaaggggagagcgaggccacgcagggcgtgctgaagcgggagggcacggggaccttcatccaccacggctgcgcgccctatgacgtgctggtgcggtactacaaggatgaccgggacaacgcggcgaaaatcctcctgacgccgttcgctccacgctggaagcccgtcaagggcgcggaccccgagctcgacgaggacacgctgagtgtctcgtgggagctgcaaggcgaccacggcaagctcaagcgggggcaactcgtcgtctgggacaaggacgacaacgtggtgttcttcgcgcccctggacgagcagcagctccggacccggaaacgctacgagttcctgaaggatgcgcggaagacgtgggacaaggccgcgattcgccgcgaccagttgccctaccgggtgcagctccaggcgcacagtgacgaagacgaaccgcagggcctcgcgctggccgtgatgcccacccaggtccgtgccttcgactatgcgcaggtgcagttcattgccttcaacgtcaagccggggacgaagcctcgcgtgcctggccccggaatcgactacctgggcgacgcggacccggacgtcgacatccagacgcgctgcgatgtgatgaaggatgccattcggctcgcggcggcggatggccacatacgtcccgaggagaatgtcctcaagttgttcatggcgccagagttctacttccgaggaaaggacggtggatatccggtcgagaagctctgggacgtcacgcggcagctccggcaggagacggacaagctggagtatgcagactggctcttcgtggttggcagcgccatcggctatctcccgcacgaggagttggatgcggtgacgggggcacccaccgggacgccgctcacgcatggtggggagggggaggtccactcggtcctcctcgaggccgatacgtccggcgtggatgacgtcctcaaggtcaggctttcgcgccctcccgacacgacctggaaggtgcgtgagcgtgggaagaactacgcactcaatgccgtcgcgacgacgctcacgcccggcgagtaccagctcaccgtggacggcaagagcggccttgctccaggccctatcgttttgtccgaacccgtggcttggattgacaccgttgaccagacgggggcctgcacggaggtcgtggtcaactccagggtgtgctctcgcatcttcattccgtcatcgggcgccgcgcctgctgcgccgtggaagctgcgcacggggtctgaagaggacgacatcaaagggtgtgtgccgctgggggcgggccgataccgcctcacgcttgcgaacaagaaggtgggcttcgccagcgggtcggcggagctcgtcgagcccaggtcgacggaagtcttcaacgtcgtcatggtccagaagggctggccagcaccactgctcagccaggggttgaaaggggccgccgtctacaaggagtacgtctccgccatcgatttcgtgggacccaactcccacaatgccaatgcctggttcgacgcgacgggcttgggccggcgtatcgagatccatggcgccacggacaggctggcgcttcccacggaaggctccacggacgtaccggcggcgagccccaaccgggtggggctgggagccacctggttgaaccggccgaaccgcgtcgggtcggaaatcaacctgtcgggcgacggaggcggctcagtggtcacggtggatggcgtcaccctgggcctggaagtctgcctggaccacgccatgaaccggctggaccttttctatcacggggggaacagccccgttccccccttcgggccgcaggctcctggcgccgtggctggcgaccctcgggtacaggtccagctcatcccgtcgttcggtatgtccattggtcgtgggaagctgtgcaccttgattgggggcccgcggcccggcctggtgttcaacgtcgatggtcagcggtgcgcatcggtggctcgcgtaacggatggcgcttactcctgcgatgaccatccggccatgcacgcgaccgcgccgggcttttgcacccatgacaaggaactgcggtggtgtgtcggctgtaacaagatgcggagcgcgcccggggactgcccgactcacggtccgaccgaggcgcggcatctgtgcggctacccttggcaaaggtggcagtgtggggtggtcggctgtaccaataccatgccctgcctcgcacatccctatcccccagcgcctcctccgcttggcttcaactggtgtctgaaatgtagcaaggaattccccatgggcccgccttgcccaacctgcggtggcccgcccgcgccatgttctgagccttacatggcaggggcgacctgccccaggcacgctccagcgttcgctcagcgatgcaatgcgccgctggtctccatggggcagtccatcgccacggtgagtggtcccacccaggtgaattccagccacgacccggccttcttcggcgaagggggacacgtgctcgtctatcccgcgcaagtccttccgcgtcccgacgtcttctgacgccgtggtgggagcctcgaacttcgaggctccccatggctctactggcctcgcgccgggtttcgcctccggcgtcccaggatgccgagaatcgcgaacgccagtgggccggcgaagctggcgccagcggccgcgcagccacccgaactctcggcgtcgtccggctgcggcgtcgtgcccgcatccgtgggggttcctgttcccgcgtcgggctcggtgcccgtgcctgcgtccggtgtctcggtccctggctcggaggcatccccatacgcgccgatgtgggccgggctcacctgggcgcgcggctcacccgccgtgtgtttcacgtactgccaggtgacgggctcgctgctggtctcggcggggagtgccaccgcctgacttctcagggcggaggccgcggccaggcggaagtcctgtccggcgaggctgatgaacccggggtcggttccggtgagattccctcccgcatccaccacggcgcccgtgagcgtgccgaaggtgctcacgtagccgggcttgtaccagttgcccccatgtcggagcgtgcccgcctcgtccgtgagggacagcgtgttgccattggccgaggccaccagcaccacgttgttcgtcacatgtgccgtctggttctggtgcgacagccgcaacagcgtggtccggtccgtgcggctggacaccacggtgttgtggaagaagtagagcgtgccccggtagttggccgtgttgccggagtcgccaccgaagtggacgatttgccggttgcccgcgccctcgggctccaacaggacgttgccgtagacgaaggtccgcgcatacgacggcgccgcgcgcagcgtgccgctggacgagtccaccaggtcgagctgccggttacctccctcaatccagttgtaccggatgagactgcccgccgagcggtccttcaggttgttgcccagacatccgctgcagagcgggccgaagcggttgaactggtaggtgatgcccagcgcttcggtgtacgcgttgtgctcgaggatgctgccggtgttgccgttgcccaggatgtagctgtgctcgacggtgacattcgacgcctggttggcgacgaacaggccgttgccgctgtcctcgagcacgcagccccggatggtgatgtgttcgcccttctcgatgaagatggcggcggcgttgtccaggtaggtggacgcgccgttgcggccggtgaaggcgccgcgtgcccggcgcaggtggaggttctccaccaccaggtgcgcgggcattgtgtccgcgggccggttggagccaccaatcttcaggatgccgcgctcctcgccccaatagttgagctgcgagcgcgtggtggcgttctcgccgacgatgacgggcaggttgccctgcgcgtccttcacgccgcgcacggtgatgggcgcggcggctgtgccccggcggcccaggacccacttctccgcgtagggcgtgggccgtgcgtggacgaagacggtgtctccgggctcgagtgactcccaaggcacgtcacccaggcgggtgtactgctggtcagggcccacacggtactccgcggcctggacggccagcggctggagcaggacgagaagggcggctcgcgagaggttcatgtctcgcagtctgacggctccgtccggtccaggtccacgagggctgacgctcctcgaggacacgggtgaagtgcaccgggaagtttgtaggcggagcgctcgccaggctcaggcaggggggcgcgctgagtcgcgagggctggcccgcgtagggggggacaaccgcgtgctacaacggtagcggcgccccgccgggccctggtagggtttccctcggggcggccctgggtgtgcttccttctcactctaagcgaccgcttgtaattctcgaacgatctcatgctgcgcgtcgagcgggaccggcgcgcagcagcggactcgcagtctgctgagcgttgcgagcttccagataggcatccacctcggcaatgagcgccgacatcttcttgcaccggtggttgcgggtgacgttggcatgcacg

SEQ ID NO: 1084 - DNA, 9035 bp, Myxococcus xanthus
cattgcccgccaggtccttcgcccccgtggagagtgttccggtgacgagcgcacccggcgcgggcagcggactgacgcggaaggacaccgactggctcggagcatcgtaggagatgacacccgtgagcggcgccgcggggttcgaccccagcgcctgctcgaaccggagcgtgtcacccgtgagcgtgcgcgggtccatcggctctaggaaggagagcgtgtacaccggccaggtcggcgacacgccactctcaccactgcggggccgcgtggccagcacctccggcggcgacgtgtccgcctccagccccaccgtgaaaaccgattggtagggcgccggcagggacttgcccgacaccagacgcagcgccgtggagacgcccaccgtcaccaacgtatccgccgcgaagggacgccccggcgtgaaggtcagcgtgcgcgtggcggggtcatgcgtcaccgttcccgccaccgcgacgccgttctccgacaccgtgaggacctccgcgctcacggtggtgacatcgagcgcctcggcgaaccccacgatgacgcgcgcgttgcgtgggacggcttccgcgttcgacgcgggcagcacgtagccgatgaagcccacgccatccgacgtctgcgtcccaccatcgccagtcccaccgtccggaagtccgccatcgggcgcgggctcgtggcccccatccggcccgcccgcatcgggctcgcccgcggcatccggcggtgtatttccatcaggctcgctattcttacagccagggacgaatgcccagaggccgaggacggccagggcgcatcgcagccaggagagtttcaaggtcataggggagttcgcgagacaaccacaccacgaggtcgcacgtcctcgcgtgcattcagagcccccggtgcgtcaggggccagatgtctgcggtgcttcgacgcggacctgggccgtgcgcgcccatcccacggatgctgactgcatcgacatacgccatatcgttgtcatcgcctggcgtaaatgctcgattccagaacagatgtatcccgagtgtctgacgttcctccggcccgtgaaggcgcgcgtggagggggccctggcaatcacctcatgtaagactcgcagggtctctgtcgccgacgcggtgaagctgttcgaggcgaacgcgcccctcttccccgaggacgacaacacccacgacagcctgggcgagggctacgcggcggccggaaggacgaggccatctcccgcgacaagaagtcgctggagctgaacccgaagaacgacaacgccgtgaagaagttgcgcgagctcggcgcggcgtcggccacggcgaagtagcgcgcggcgctcgggggcctacgccatctcgtcgctcagccgcgcggcctgggtcagcaggtagtcgcgctcgggcaggctcgtggtgcgctcggccgccttccggtagtggaccaccgccgcgcccgtcttccccgcgcgctccagcaggtgcgcgcgcacggcgtcgagccggtggttcccctccagccggccctccctggccagcccctccagcagcgacagcccggcctgcggcccgtgcaccatcgccgtcgcgatggcgtggttgagcgccaccatcgggttgtccatcagccccatcagcaccccgtagagcgccagcacctgcggccagtccgtgtcctccgcgcgcgacgcctcgtcatgcaccgccgcgatggccgcctgcacctggtacatccccaccgagcccctcgacagcgtcgcggagatgagcgcgatgccctccgcaatcatccccgcgtcccacaggctccggtcctgcgcgtcgagcggaatcagctcacccgcgggccccgtcctcgccgccctccgcgcgtccgtgagcagcatcagcgccaacagccccgccacctcgccgtcctccggcagcagcgtgtgcaacatccgcgtcagccgaatcgcctcgcccgacaggtccgtgcgatgcaactccggccccgaggtggccgtgtagccctcgttgaagatgaggtagagcacgtgcagcaccgcgcccagccgctgcgcgctctcctccggcgtgggcttctggaacggaatcccggagctcttgatgctctgcttggcccggctgatgcgctgggccatggtcgcctcgggcacgaggaaggccttggcgatttccgccgtcgtcaacccgcccaccgcgcgcaaggtcagcgcgatggccgacgccgtggacagcgccgggtgacagcacatgaacagcagcacgagcgcgtcatcccggcccgccagctcgtcgccatccagggacatcacgagctggagctccggcggcaccaggctgaccaccagctcctcacggtggcggcgcgcggtctccgcgcgcacgtggtccgtgattcgccgcgaggcgacctgaatcagccaggcgcgcgggtcgtccggcacgccctcgcgaggccactgcaaggccgccgcgagcagcgcttcctgcaccgcgtcctccgaggctccgaagtcccgaaaccgccggatgaccgcgccgagcacccgcggcgcgtgttcgcgcaacaggtgctcgatgcgaatgtccctcgactccgtcatcacatcaggtcgggcggaggaccgctcatcacctggcggacctcgatgggcatgttcatcggcttgccgccgagcccaggcgccgctgaggcctccgcggcgatggcgtaggcccgctccgggctgtccacctcgataatccagtagcccgcgaggaactccttcgactccgggaacacgccatcggtgatgggcttgccgtccgcgcccgcgcgcacgcgcttggcctggtccggccccgccagcccctcggccgccaccagctcccccgtctccccgagcttcgtcgcgaagcccgccatgaacgcgatgtgcgcctggaggtccttcttcggccagctcatcacctggtacggaccgccgctcggggtgttcatcatcagcatgtacttcatcttcatggtggctctctcttctctgggcctccgcgccccggcattgggtgcgcgttcattgggatgtcggagccacgcgcgaggtctcgacatcgtcccgtgaagataatcggcgggcctcgcaagtcagcggaacaactgtgttcttccgctccgggggccgcctgcgacgcgccgcattatcggcagaatttcagatgaccttgcccggacgcagcccctcctccccaagcacagcgggacgacgcattggcccgcgagcggcgcttcgcggagattcttccgctctgggacgcctttctcgcacgcaaccccgagcatgggctcgcctacttcgaacgaagcgggacgcactaccacctgcgcaagctcgaggtcgcgctggccgacttgaagaaggcgtgcgaattcggtgtcaacgaggggtgttcccgggcgcgccagctcgagcgcgtcaaccccaaggctcgctgcgccgcgaccgtcgacgacgcacggtcgcatcgggcatcgccgctgcgccgtgccggcacgcaggcgatggggcgccccgaacggaagccccatcgcgcgcagcccacgtctgcctcaagcagcctgcgcgcctgcgaggtgctccttcatgatgcggtgccgcgacaggtagcgctcgaaagcctgcagcaaggcgtccggctctctcagcttgctcaggcagatggagcggcggctcttgaagcgcccttccccggggacttccaggtccaggtacttcttgaacatgcggtccgcggtggtggccgaggcgatctgctcgaacaggatgggcgcctcccagtccccgtagctcacctgcgcgtagtccatctggacatcgaagcccgcctccttgccctcgaacacgagcggcgggaagtgcttctccacatgcgctcgctcctcctccgtggagggctcatagcggtacgcgagggacaggtcatgggcctgagcgaaacgcgcctcataggcgccccacagccgcgcctcgatggcgtccgcgtcctgaacggtgtccgcccacgacgacgtcaccggctccagcagcaaccgcaccatgtcctcgggattgaggtgggcccccacgttctccatgcgcgcggccaacggcgggtgggagtcgaagggatgcggcgtcacggccccctgcaggtcatcatgcacggtgtccgactgggcatacgcggagaagccgtgcgccacccggtccgcgatggccaccgtctggtgctgctcgtcctgggcgaagagcttcgcctccacacggtcgcggaagctcgcgtacgcgcccaccttcaccagcgaacgggcgatgtcctgccccgaggtcacccccgccgccaaccggtccgccgcgagttcgctggcgcgccggctgcggcccagcgacagctcgaacaggccgcggtaggccatcatgaaatagaagacgggccgcgtcatgccaccgtcgtagagctgctgcaggtaatggccgaagtgcgcgagcttgggcgccagccgcttgctgtgccccgtgtcgccgcccagcaagtgccccatctcgtgcgccagcaccgcctccgcctcggagcgctccagcaggcgcagcagtgacaggctcacgaagagcgtgcggccggtcagcgtgcgctcacccacgcgcacctcgtgctcggtcacgaagaagttggcatcgatgccagcgaggatgttgtcggggggcgccgtctggagccgctcgcagaggcgccgcacgcaagcccacagctccggggcgcgagcctcggtgattgcctcggcctccacgtcgaagtccgagggcggacggcggaagatggccaccaccaccaggaacaccgcgccgccggccagaagggccatgatgccgatgagcttcgggtagtagcgctccatccatagcgccgtcatccaataggagagccacacgagcagcgcgccctgtcccagcacctgaatcgcactggtgacgcggagcacgagccagcccaccacgaagctgccgaactgaaagggacgcgagacgaacgcggccagaccacagagaagcgcgaccacggtggaggcaaggcctagcgccaacaacccccaggatgccagggacgcccaattgaactggttcaggtccgcgcacgcctttcccaggctgttgcggtaactcgccagctccgggtcaccgctcaggcaggccatggacgcgggcaccgcgcggtagaagtcgagcgccgcctgacggtccgcttcgctgaccgcggtgtcgcgtccaatctgctgctcgacggccgcgaggacctgtgtgtcgaagcggcccatggcatggccggagaaccagacaccgaacagcggcagggcgaaaagccaaagagccggcagcacatagctgcggagaaaaccgggagatttctgggaggacataggacgtgtcgacacattctagcgcaccccgcgtgagcgtcgcgcccctggatgaaggcccacatgccggtactcgcggactgacgacgacccacctggtgcctcagcaatccagtgcgatacaccccgcaaggtccgtgtcgcgagttcccgcgcctgaaccgtccaaaccgaggggagccaatccaacatggccttcacgaccgctcctctccgtgcactcggcatcgttctggtgacgacgcgcgcgctggcggccacgcccccggctgcgcccacacctcgtgcgctcgtgttcgcccagaatcccgtccggacccctgttcccagcgagcaggagctcccgcttccgccctcggggggacgactggcgcatccatggttcgaggcactgtcctgtgtcgtccccgaagcccatccgcttccaccggaggacgcgcgctttcctcctgagcgcgtctgctctctccagtccaccgcccggcctgatgcgcgcggcctcttcgccacaccgccccgccaggacgtggacgggtcctctccggatgccttcgcggaggcctcgctcttcttccacgcggcagcgaccttgaactacttccgttccctcgggtgggagcgcccctggcctgacgagaagccgccgctccggctcgtggcggacgtgcggatgccctcacgggacggaaaggtcctcctcccgtggggcgatgcgctcttcgtgcccgccgccgaggagggggatgcgcgcgcgcacgacaccatctggttcggacggggccccggggtgaacctcgcctatgacggcgacaccatcgcgcatgaggtgacccatgcgctcctggagcccttcctgccacggagcgcctggcggctcgacacattcggcgccgacggctcgcctggcgccattgatgaggggctcgcggactacttcgccgccgccatctcgggagaccccttcctcggagaatacgccgtgcgggctgccgaaccctggcgctcgcgcaacatccacacgctggcccggtgccccgaggcactcgtgggacagggccacaccgacgccctgctcctgtcctccgcgctctgggcccttcgtgagcccgcgagcccgtcccagcgtggtgtactggaccgcgcggtgctcaccacgctccagaccgtccagccggcctccgcgctgtccctggagcgcttcctggaagcacttgtcaccacgctcacccgagaggcccccgagctcgcccgctccgcccaggagacgttctcccgccggggcctccttcctgcctgcccgcgcgtgctggagctggagccggggcaaagccttggagggagcgctggagccttcgtggctcctggcgggcgctccctgcggatgaagggactggcgcccggcctcctccagttccatgcccgtgtcccgccggggaccacggccatgtccctgcgtttcaggagcggcgccccccggcccccaccggggcaggagctgacgccattccaccccgtggtcctcgccaggcgccaccgccctcttcagtggcgccatgacggcccccaaagccactccgacgcggacatcacggcggtcccactgcccggggcgtggagaagcgcacgcatcgaaacagagggcgcctccgacgtcttcctccaactcgccaacgcgggcgagctggatggctggtacgaccacctctccctcgagttcgagagtggccctcccgcgccagccgccccgcccgagccagccccccgcctcccatcttcctgctggggatggatgggaggcgcgggcgccggcctgggagcctggctttggcggaggcgacgaaggtcgccgagcgcctagcggcaactcctgtcgagcacgtagccgacgtacatggacgtattcgcgctatccaccacgagcccgcggagatagccatttgcgccacagccgaaggaatactcgggcaggttgcccaccgtgcagccgtcgttctttccgcccaccttgggcatcacggtgagcgtccccgtcttgagattccggcacgacagcacaatcgtcgacaggttttgcgcactgcaccacgtctgattgggcgctccactggcccaaccgttgattccggtgaccttctggacaacttcgccggctgcgcagtccagggtgaaggaatcaccattcgtgcccccaatcgcgggggcgctcgtggcggcaccgatgatccttccggagtcgaagcgggcacagcgcatcccgagcgcgtccaaccaggcgccttcccgcccgtggattccgaccgccacctcgtcgtccccgcacgtgaggacctggacggtatcgttcttctcgcacttcgtccccgtggcatcgcgcagatacccgggcttgcaggtccaggggcagttggcctgagcagccgtcggactcgtatacaccgcgttcgcgggtgcgttcgtgcaggcgttacgagcattggagttcgcgggagaccaatacccgatgcccacgtcgacacagacaccattggagaggtactggcccgcatcgcagaggaacgacacacagcggtggggactggtcgacgtatcacactccagacccgcggcgcagtcgctctgctggagacacacctttccgcgagagcatggagcgcagggtcccccgcagtccacgtcgctctcatcccagttcttctcaccgttattgcactgcgcgccaaagcagaccggaccgatgacggggattggagcacagtacatctggtacccctcctgctgcagcacacagtcggagttctgcttgcacttcttgccgctcccgcaacgtgcacagatggagccgccgcaatccacgtccgtctcgtcgccggatttcatgcggtccttgcagcgagtcgggacacagaaggtgccgtcgcttatctcggactcgcagtcccccgccaccgcgcatcgtgctttcaccttgcacttcgcgcagtcatttccaccgcagtcgatgccgctctcatcggcgtccttgacacccgtgttgcagtggttctgcacgcacgtcccaaaatcgactccggacgccacgggcttcttgcaatacccggatgcacaatcctcggggcgaatacagccctgcttgttcccgcagggcttgcacttcgaaccgccgcagtcgatgcccgtttcgtctccgtccacgacaccattggcgcagtggttcgccgccgagcacttgcccgcgttgcagtacccgagcgcgcagtccgagttgaccaagcacttcttaccctcggcgcaagcgctgcatgagccgccgccacagtccaggcccgtctcactcccgtcccgtaccccgttgccacacgtgttcgagcaatagcccaggccgtcgttcaggctgaacttcatctccaagagcttgaactgatggttgtagacctcgaggggaccaatgtcccagccgaggtccacaccggaagagcccaggtagctggttcctggaggctgaatccgcccccccacctggacaccgaggttgccgtcgagccccagcgtgatgtccgccttgggcttcttcgcctcgcagcgcgactttagag

SEQ ID NO: 1085 - DNA, 14807 bp, Myxococcus xanthus
ctgtcgctgggaccagtcgcggcgtgtgcgttgggcaggatgcgcgcgctcaggtcctgaggcggcgcggggggcggaatcgagcggatttccggtgggggcggggcgggtggcgcggcgagccccgcgggggctggaatcgacaccggcgcggcgggacggtggggggcggccggctccggggggcgggcctcatcggtcggcaccgtcgcattgggatgcctgtccaggtgggtggcgagcccggtctggcggatggcggggcgggcgggccgttcggaaggcttggagcccgatggcgacgacggtgatggcgcacgggccgtgggccggttctccacccggatgggctcggtgggaagcgtgtcgtcatcaccgcgccccgccgtcagggtggatgtgtccgtcgagatttcctgcgcgacggcggtgcgctgcgccgccgcgccaggcggcgtcacccgcgccagcaactgggcgcacttgcggcaaccttccgcatgtctgcgcaatggattggattccgaagcatgaagctgtccagcggcgagcgcccgcgcggtgatttcgtcaaagcaggacacggaggcaacgttctcccacgctccgtgtccccgagaaaggggggctttacattccaaacggtcctttcttggactctctgcttcacgccgggggccgcgcgtgctgccatgcggtacgtctggctgcgtcatcctggagtcccaacgtgtcaaacacttcgccctcgctcgagctctcccagcctccgctgctcgccaaggaattgctgcgtgctgccgtggcacgccggccctcgcggcccggagaggtgccccgcctggatgtgcgggtgaaaggcttcaccccggacgccagacaactggcccgttaccgggaggtgtgtgggtttcccgaggatggctacctgccgctgcctttccctcaggtgctcgcgacgtcgctgcacctcacgctgctcaaccacccggcgttcccctaccggttgctgggcatggtgcacgtgcgcaatcacatccagcagcatcaccgcctgcacgcaggggcccggctctccgtccatgcctgggtcgaaggccagcgtgaggcacggcaggggcgcgagctggatttgcacaccgtggtggaatcggacggcgcgcaggtgtggagcgccgtcaccaccatgctccgccgcctgcctggaatgggggagcggccgcgtgaggcggggcgtcctccctccaccgacgtggcgcaagtcttcgccaacagtcgtccggccaactggtccgtcccggagaacgcgggccgccgttacgcccgggcgtcgggcgactacaaccccatccatctgtatggcttcacggcgcgccccttcggctttccccgcgccatcgtccatggcatgtggaccgtgggccgctgcgtggcggagatgggcgaggcggcggaggctcccgcgctcacgttgtcctcggagttccgccgtccgctcctgctgccctcccgggtcatcttccagaccgccccacagccagagggcgccgttgcctaccgggtgatggcggaggacggccaactccacttgctgggccgcctgtcaccgggtgcgtcgccggcgcggtgacgatgcgcccggcgtgggactgaggacgtcactgcggcaggagcaccacgtcatccaggtacagcgccggctggtccgtgccggagtcgtcctggaagtagatgtcccgcagcgtgcccgtggtggccccgatgctggagaggggaatcgtcacctgctgccagactcccggagcgatgggcgcccccagcgcggtgtccaggcgggtggtgccaagcatctgcgtgccatcatggagcaccagccgcaccgcctgtcctcccgcggtaccgccgtggacccagacgcggatggattgatactgcgccaggtccagcccatggtggtggaagagcaggccattccacgtgtccggctcgaagcggatggcggccgagcccgcatggaccacccccgtctcatcgagcgagtggtccgcccagctccagttggcgaagccattctgcagcgcgtcggtgtagacgaacaggcccgcggtcaggtcgggttcggtgcgcccctccgtcagggccaatccttcggccagcgtcacggtgcgcacgccgcgcgtcttcacgtagtcgaggatgtccgcgaagtgggacgtctcgtactgggtgtcacgggtcggcgtgccgttgacgaactcgtggaagacgaggatgagccagctcttctccgcgatggtctggtccacccagccctggacggtgctgaccggaacggtgcgggccacgtcattggcgcgcagttcgtagacgagggtgtcgcggaagttgcggcccgcgttcaccgtgcggctgctggcgtaatgctggcggatggcgtcgagcaccgggccgttctgcaggccatacggcacgacgagattggggacggcgggcaggcccagcgcgctctccagccaggcacgagagtcctggagctcggccgcgagctgcgtcggggacagcgacgtcaggtctgggtgtgtcagcgtgtggctggcgatgtcattgccgtcggtgacgagcgtctgggcttgcgccagcgacatgtagccgccccatccttcgtggatggccagggtgacgagaccgtaggtggcggggatgttccgcgcgttgagttcggggcgggccagcgagaactgcgtggcccagccgtcgtccagggtgatggtgaccatcccctcggtgaagggcgccgcggcgaacgcgggcggcgccagcgacaggaggagcagcgagacgaaccttcgaaacaccccgtgcggactggacatggatttcccccaccgcggcgagtcagcctcgtgcggcatgatgaattcgataccagacggaacggacgccgggcaaccggccaggccccgtgggcaagcaacttggagctggcagatgcgccacgccgacaccagggcggggcaagggattcgaataggggtgccccgtgttcgtctgggccaccgtaggcccttggaaaaggaactcgctgcatgaagaaggtcgccgcgctcgcatgtctgttggccttgttgggggcgattccctctcaggccgccgagctgaaggacgtattcggccgtgaggtccccgtcggcaaggggcggcccaccctggtgctgtacgccaaccggggctctcgggccgagctgcgccagcacgcctactcgttcatctacgagctgcgcgaggagcggcccattgtcctgattcacgtggacctgcgggacgtccccggcctcttcaagggcatggcgcggggcgaaatcaagaagagccaccgcgagtccatcgagcacatgcggaacatcttccgtcagcacggtgaggcgccgcctcccgaactggagtcgtcgctcttcatggtggcggacgccaagggcgagccgcaccaggccatggggctgaagaaggggttcggccaggtcgtcgccaaggtactgagcccgtcggggcgggagctggcgcggggccccttccccgagagcgcccgcaagctcggccagacgatggcctcggcctcggagagcctttcgacgctccgagtcgtggacatgtcccgctgacgcctcgcgcccggctcagctgccgggcgctgggggttcggtggggggccgtgtaatccacgcggcgatgaagacgtccaactcgccgcgcaggacgtccttcacgcgcggggtgccggcgccagtgcgcgggtcctccacccgggcgccccgtcccaggtagtaacgccgtgcctcgtctgtgttgctgccctggccgtagacgacacgcgcggcgatgtccttcagttcgtcgagctccgtggcgccagtgagcgtgagcacgcgtccggaggactcgtccttcaccgtcacctcggtgcggacgcgctggaggtaggcgccctcgtggctcttcatgggccggccctggacctccaggtaggccagctcctcctcggagagcgagccgccgcggtggacgcgcacgtaggcgcgctggcgcttctcgtcctccagccgccggtgcatgcccgcttcgcccgcgaggaagccataggctcccgggccggcgattcgcacgacgacgcgcgagggctcctccgcctcggcgaccgcgaccgcctcgtagccgcgccgctgggcccagcccaggtacatggtggccagctcctgcacccaggttgcctgggcctccactgagtcactggcgcagatgtccaccagtgcctatgtgttctgggcggtggttccggaggcgcgcaggggcttcgtcatatggagctacggcgccacgacctacacctgccgctccgaggagcccaactgcaccttgatcttcgccttccggaccaacagccgcgcgaacaggcccggggactacaacctctgcagctagatgaggtgctcctacacggcgctgaaggcgcagatgacctcggtggcacgcgtggggtcgtaccagatgctgggcgcctgcgtctccgccagcagctccgcgcggcgctgctccaactgcggccggccggcggagtccgccagggcgcgcgccttgcccaccagtcggtccatctcgaacaggagtgacttgcggtccagccgccgcttcaccggcgccgcgcgagcggacggcagcagcaattgcgcggtgggggagggcggcggcgcggcgggctccgccacggcggtgacgcggccgcccaggcgggcctcgacgcggacgggcgtgcccggaggcagcggcctgcgcgcaatctccacggccagcgccgcggtgagcgtcttctcgatttcacgctgcaggtagcgcgcgccgaactggggcgagtaaccccgctccacgagcaggtccaccacggcgggcgtcacctccacgtccagggcgcgcgcgcggatgccctcgcgctccagcacgcggccaacctcgcgctgcgcaatcttccggatgtccaccttggacaggggccggaagtggcagatggcgtcgaagcggttgaggaactccgggcggaacgcctctccgattcgccggtcgacctcggggaccatctcctccgcgcggcgcgcgcccgtgaagcccatgccggactcgcgatacacctccgcgcccacgttggacgtggcgacgatgagcgtgttgttgcacgacaccgtctcgccggccccgttgacgaacgtgccctcgtcgaagagctggaggaagcggtcgtggacgctgcgcgccgccttctcgaactcgtcgagcagcagcacggtgaacaccttgccgtccagcagcgcgctcagctctccccgccgtgtctccagtgccggggcccaggtggcaccgaaggggacgctctcgtcaccgtcgttggggtagtccgccatgttgaggcgcaccagtctgtccgccgagccgaacaggtactccgccagcagcttggccaactgcgtctttcccacgcccgtgggacccgcgaagaggaacacgcccagggggcggcgcggatcgttgaggccggccttgagcagcgccaccgagcgcaataccgcgcccactgcgtccgtctgtcccagcagccgctcgccgaagaagcgctctgtctcatcgaggtccaacggcatcgcgtcgtcgacgacgaagcgaggcagccgcgtggccgcgcagaagcgggtgagtacgtcctcgggacccacatggtccttggccgcgctcgccgcctccgcggctgtctccttcagcagctcgatggccttgcgcggcatgcgctgcgcgagcaggaacttggacgacaggcgcaacgccaggtcgcacgccgccgggtcgatgggcagccgcagctcgcgctccagttcctccgctacgcggcccagcacccagcgggccttctccgtcggaggctcgtgcaggggcagcaggtggagccgctcggccagcgcctcgtcggagcgaagcagctcctgcacgcgcttgggctctgtctcgaagatgaagcgcaggcctccggtgcgcagtccgcgcacggcgacgggcgcgagcgggccaccgagggccgcgggcaggtcccggatgtagacgatggggcgggggtgccgggagaggtaggccagcagctcctcgaagctctccgccgcctggcgctgggtgctgcgcgccaggatgttggcgacggacacctccaccacccgtgcgttcgccagctcggcgtccacgcggccttcggcgatgcgccgggccacctcctgtaccagggcgctcttccccacgccgggctcacccgccagcaggggatgcttgccgccccgcgtgagcaggcccagcacctccgtcacggcggcatccacgccgtgtgcggccggtagctttccctcccgcgccagcgcggtgaggtcgcggtcgatgagccgctcctggtcctcgcttttcctcgtcgccatgtctcgtctgccgccccctcgccgggagcgcactctaacccccttgaaccgcgggggtgagcgcgcaatcccggtcaaatgcgtgccccgaaggggacgcggccgtgacggccccgctcaaggggctggcggcggggccattcctggctgggccggggggatggcccggagatattcgtagacggccttcaggtcctggtcgcgcatcttcgcgtaggtgggccagggcatcaccgggatgatggctccgtgttcacggcctgtccgcatcagcgccaggaacgcctcgaaggtcatgccgcctgggagaccctgcgcatctggggtgatgttggaggagacgaggcctggaccgaacggctttcctcccgcgaggaagttcgtggtgttgatctgctcgggttcgccctgatgcgggtcgcctccggggagatagcccggctgggtgtgacagtcgctacagccggtctgggcattgaggatgtagctccccaatcccaccaggttccggtccaggccttccagcttcagcggcacgggcgagattcgaagcccgatatcgatgcgctcctggtcctcggcgcccacgggaatctgggcctgctctcctccgggaggctccttctgggcggagtcattcgacccgcagcctacgccgacacctcccgcgacgcccaggaggacccagcccgccgtcacccaccgtcccatccgcgcatgcatcatgtgtccgtcctcttgtttggccggtggctccggtggcgggagcgtagggatgcccgggggcacggccatgctgcgtgccggtgtcgcatcacgtcacgctgcggacagtcccgtgtggcctgaggaccggcggggcatgcatagcggaagccggaggactcgaacctcgggccgaagagcggctcgcacccgttagcagcggggcctggcgccatcgccagttcagcttccagaaaaaccgccagcagcgacatgccgcatgctggcgcgcggggcggctgtcggggtgggagccgcctctggcggactcccggacctccgagtgcatccaccgccggggcggaacactcaggaggcggaagccacctcgggtggctcccctttcccccacggccttactcctgcagttccacgtgccagtaggcgacgtccctgaggaacttcgcccaggacatgggcatgcccttctcgaacaggaacgtcaggtgcattgcctcgggcaccttcttcggcttcatgggcgccgtgcgcagggccatgcgggcctgctccggcgtccggttgcccttcttctgattgcagggcacgcacgcgatgacgatgttctcccagctcgtcttgccaccttgtgcgcgcggcaggacgtggtcatacgtggcctccgggcgcgtcaccttgatgccgcagtactggcagcggcagtggtcccgcagatagacgttctcccggctgaacttcacgcccttgggccgccggcgcaggcctcggatgaagcggatgacggagggcatgcgaatctccaccgtcaccgagcgaacgacgcggtcctcgtactcttcgaccacttcgaccttgccctggacgatgagcatcaccgcgcgttgccagggaacacgtgcgacaggttcgaaagactgactcaggaccagcgtctccatgacacgatgcctcgtgggttatgccggaagcgggagtcgaacccgcaccctccaggctctcgacctggtgcctctgccaattgggctactccggcgttggtgaagtggattcgccgggattcgaacccggatccctcgggtgcaagccgagtgctctccccttgagctacgtacccatgtgctgcaagagcaggccgccagggaatcgaaccctgcatgcgcggatttggagtccaagctgctcccaaagcgcggcctatgacgaactgctccccaaggagcgcgcaaacgctctgagggggtgaaaggtggaaccggaggcaggctttgcacctgcacctgcggagtcagagtccgccatccttgctggttagacgactccggtatgtgctgctgcttcagatacctccggagggattcgaaccctcgccgtctgcatatgaggcagatgctctaccaatgagctacggaggtgtgttgtgtgccgccccaggaaagagcagacggcatgcattcatcacgacgattcagttgtcagatagcctgtctgtcggggtactcggactcgaaccgagatttctcgcgtatcagacgagtgccctacccttgagcgataccccgtgaggtgtgtgcgactgggcgtggcgggccacgctcgtgctgcatggggacgctgggagttgaacccagcgggccctgtcgggctcgggctctacaggcccgcgcgtctcccctaacgctctacgtccccggaggagcggggccctgaaagccgagaggccgggtcccctggatgggagcccggcctctgcgtggcttggcgcgccggtgacggagcgcgagcttcagcagggtacgggcggatggccgccaatccggtcaaatcccacgatgcacttcgaatcgaagctcacaagggagctggtggcggcgtcgagctgggaccagaggttgctgcgatagctgcgcttcatccgcttcgtatgcatcctcaacgtcggcatggtcgccgctcctttcgaggagaccttacgtccggtgattttcgttcctgacaaggctcggtggcacagagtgtcgcatggtgcttgcgatagagctcggtgcaccttcatgctgccgatgcagaaccccattgtcggttctcaaccagaaaggtcgccctccatgcgtggtgcatttggcaaatcctcgtgggccggcggtgtcgtcttgttggcgggtgcgctcgcctcgtgcacgcagcaggcgccaccgacatcaatgaaccttcgagaattgaacattgtggacgcgcaaggacagacgcgcgtccgcatcggggcccccctcccggggccacgtgccgcgcctggttatggacttcagttcctgggcccgtcgggccaggagatgggagggattggaatgctggacgagcgaggcttccacggactgtgcttcgacagctcggagggctatgaggccgtgtgtgtctcaaccatccacgggaggccctcgattcaacttcgctcgaacgatgggaactctccccaagagcgcatcaccctcggtgtcaacgagaggggcgtcgcgaccgtggagatccgcgacgcggctggcaagacgcaagtccgattggaggtcggaaaggacggtcatacgcgcatcgagggtgtcagcccgcccctgacaagccaggagccctagactccacgctgacgaccctcgtgccggtcaagtcccgagtcgtgtggagtcggtgaagaggggcgagcaggaacgagggacgcttctcggtgaaaccgtccgagaaggtccttcccagcagccccgccgaatccaatcccgacgtgcgctccttcgccgactccgccgcgccatcgggcgggcggacgtggacgctcggaaagacgttcgcgggggaatcagcgctgaacgagcgactcctcactcgcgaggtccgaccgtcagtgccgcctcgaggcgtttctccaccagggcctgcgacgctcgtgcgcatgccgtgttatgcggctccgctcaagaccttccgacacggagcgagtcatgcgaagcctcattctctggaccctgctgttgttctccacgacggccctggcagccgagacacgactggtcgtgagggctctcgctcgggacggcaagttcgtcgggacgtcaatgggaggcgtgcgggtggtgctccgggatgcgcagtctggccaggtactggtcagcggcgtcacagccgggtcgacaggcaacacccagacgctgatgaagcagccacaagtgcggggagcgccgctcgcggatgagtcatccgcgaagttcacggccacgctggacgtcaccgagccgcggctggtgaccgtggaggtgtccgggcccctcgcgcagcggcaggcactcgccaccagcacgacccaactctggatgctgcccggcaagcacatcgagggcgatggcctcatcctggagctgcccggcttcgtgatgaatgtggtgaccccgtcagctcacgagttcttcaagctcccggccgacaagaagctcacccttcctcttcgcgccaacctcacgctcatgtgtggctgtcctaccgagcccaaggggctctgggactccagccggtatgagctgcaggccacggtgaagcacaacgggaagccgctcactcagctccccctgaagtacgccgggaagaccagcaccttcgaggcagcgctgtccgtccagcagcagggtatctacgaggtcaccgtgactgcatacgaccccatcaccggtaacaccggagtggactacaccacgttcatcgttgagtcgtgacagaggcgcctccgagtagcccgagcgtcagcaggactggctggaggggctggcggaggccttccggcacttcggcggcgtgccgtgcgtcgtgctcggcgacgatgcccgcgcgcacgtcgagggtcgcaccggcttcctgcttgagctgaaggagtagggcgcatggccgagaggtgagagcacgcctggcctcgccacgcgtgggggcaggcgtccgcgctttccgggtccgcgacgggccattggagtcgccatggcagccctctccgctctctccactgccagcagatgccagaccccgggtattgccgcaagcccccccggtcgtgctccaccctcgcccgtttcaatccaggagcgggagggccgagaaatgcacgcggacgtggtgacacagcacgcagtggtgattgctggagggggcccgaccgggctgatgctggcggcggagctggcgttggcgcaggtggacgttgccatcgtcgagcggcgcgtcagtcaggaggtcgccggctctcgcgcgcgcggcctgcacgcgcgcagcctggaggtgctcgatcagcgcggggtcgtcgagcgcttcacctcgcaagggcaagcggtccagaatgtcgcgttcgggcaggcgcatttggacctcagcgacttcccgacgcgtcacaaccatgggctcgcgctcttacaggagcgcttcgagcgcatcctggcggagtgggtgggtgagctggcggtgcccatctaccgtgggtgcgaggtgacgggcttcacgcaggacgacaccggcgtcgacgtcgagctgtccgacggacgtgcgttgcgggcgaagcacctcgtcgggtgcgacggggggcgcagcctcgtccgcaaggcggcaggcatcgagttcccggggtgggacgcgtcgatcagctacctcatcgccgaggtcgaaatgaccggagcgccggcgttcggcattcgccgggacgagaagggcacctacgccatgggcaagctggaggacgggcgcgtgggtgtcgtgttgagagaggagcgggtcggcacgggcgacgcgccgaccctcgaggggctgcgcgaggggctcgtcgcgctctacggaacggactacggcctgcgcagtgccacgcacctctcgaggttcaccgacatgacgcggcaggcggcgtcctaccgggaccggcgggtgctcctggctggcgacgcggcccacgtgcattcgccgatgggcggacaggggctcaacctcggtgtgcaggatgccgtgaacctgggatggaagctggcccaggtcgtgcgcggcgtctcgccggagagcctgctcgacacgtaccaggccgagcggcaccccgtcgcggcccgtgcactgcggaagaccatggcgcagaccgcgctgagtcgcggtgacgcgcggatggacgccgtgcgcgagacgctggctgagctgctggggatggacgggccacgcaagcagtacgcggcgatgatgtcggggctggacgtccactacgacctgggcaacggacacccgctgctcgggcgccgcatgccggacctcgacctggtcaccgccgacggcccgcggcgcgtgttccacctgttgcacgacgcgcggccggtgctgctcaacctgggcgagcccggcactctcgacatcacgccctggggggaccgggttcggagggtcgctgctcgctacacgggggagtgggagctcccggcgctcggcgcggtcacggcgcccgttgcggtgctgattcgaccggacggacacgccgcgtgggtcggggagggcacggaccaggggctgcgtgaggccctggcccgatggttcgggccgccgcgtgcgacgtaacgcgtttcgcttgcctcctgggagacacggagcgagcgccgggagtcccaggaggagcatgtgctccgtaggcctgttccggaagacctcccgggtcagtattgcggtcgcatagggggccgcagtgagtgtctcttgacggggcctagggggggcgacctcccgaggggcccggcagctccacgagggtcgggcgctctgcggagtctttgcgctctgggggctctcaggagcggcatgacgggtgcgctgtctgcttcgccgctacgggaactcgccagcctcgtgctcactcgccttgacgtacgcatgacgcagcgaccgagttttgggtaggcacaggcactcatgacgcagcgaccgaattttgggtggatacaacccatcgacggtattcttacgtagtgcgccctcttcggtactccatcaacgtcacattggacggatgctgcgatcatcgtgagatatccccggacaaagacctgcatcgtcacgcgcgcgagaatctcgaccaggcggatgccctcctctttgggcgggtgacctacgaaatgatggaggccgcatttcgaccgccgacgcgaacggggcgatgcctgactggatggaccccttcgctcggacgattgacgcggcaaagaagtacgtcgtgtcgaccaccctggagcgggtcgattggaacgcggagctcgtgcacggggagctggagaggccgttcagcagctcaatcgggagccaggtaagggattattggtgggaggcgtgaagctccctctctgtatcagggaagaagtcgcctgggcggactcgccgagctgttgatgtcctctgcgcgcgcctccctcattcgctgtgacacgctagagcgggtccgcaaaccaaaaatgctgcggccgggttcgctcaggaggccgcggcgacgcccagttgaccgagcgcattcgtgcagccaacttgaaggcgactggtccgaggtgcctccgcttccagacgagggtcgtcgcgacgaacgccatctgccgggctactaaaagggatctacccatgtcggattcatctcgctccgtattctttggcgccaatgctgcgcggaccggacacttcgagggaacggggccgctcgtggtcaagcgagcccgctggaagttcaagccgggcacgcttgcgaccacacgcaacacgcctgcaatccacgatggcgtgctgttcgcgaacttcgacaatgacaagctctacgcgcttgacctcgcgaagggaaaagagctctggagcgtgcgggtcggggggcgcgtttctgagagcatctcgaatccgatggttgcgcatggtttgctcttcgtcgtcggtggcgggcagtgtcacgccgtcgatcttggcacgcacgccatccgctggagcgtctcgtgtgactccgaggcgacctcctcgccaatcgttgtcgacgacgacgtctacgtgggagcgcggctcggtggggtggtcgccatcgacgcgcgtacgggagtagagcgatggcgcgtgcagctacgctgtggtgagagtgtggggtccgcggtcagcgtgacgcgcgatcaggtcgtcgtcgggaccagacgcgacttcgtcgagggccacgtcgtcgcgctcgaccgcgccacggggggcgagcgatggtcggcgaaggccggtgcgatggccaacggcggagcgcccgcgatcgaaggcagcacggtttatgccctgtccggtctggggcagtgccttcgcgcgctcgacctcgccagtggcaaagagcgttggttgtatgagacgggcggcgcgctgtggggaacgcccgccgttgcggacggcgtcgtgtgcttcaccggctatcacgggattctccacgcgctggaccaagataccgggaaagagatttggtcggtcgcgctcgacaatcccccgaaggatacgggctcacccgacgaatcgcaggggggcgtccgtctacatgggggg

SEQ ID NO: 1086 - DNA, 15172 bp, Myxococcus xanthus
taggtgacgatggtgccgcgcacgaaggactgcgccacataggtggtgggcagcggatgggacagggccgcgtcccacctcctcgtcgctggccaccttgaaggtgttggcggcgcccacgcccacgtccggcttgagcaccagcgggtagcccacgcgcgcggcgaacgccatcacctgcgcggcgtcccggacgcggatgaggtccgggtgtggcacgcccgcttcgtggaacacctccgccatgccggacttggagcgcagccggtggatgtcctcgggctgcaggcccggcacgttgaagtccccacgcaagcgcgcctccacctccagccaggactcgttgagcgagtcgatgcggtggatgcggccgtgccgccacgtgaggtagcccgccgcgcgggtgagcgcatcctcgtccatgaggctggggacgaagtagtactcgcgcagggacgccttcaactcgggacggagcgactcgtaggacgcgtcaccgatgcccaggaccgtgacgccccgctcccgcagcgcggagatgaagtgaaagtaatgcggagggaagtggggggagatgaagacgaagttcatggctcctcggggcacaggcgaccatatcgcgccgcgcgcccgcgcccagttcctgactgaacgcccggaggcgggaagtcactccttcccgccccgggtgcgcctggaatctgggcttcccaactccccgcccgtcactcagcggaacgactaggcgttcggccggaccatcgacacctcgaagtgccgctggacgacgttgccgttggtgggaccctcccggtagaggttgcccgtgtcctggtccacgtagaagcggttgttcgggttggtgtccgcgccgcgctgctggtggttcgtcgccgggtcgtggaacgtgtagtacgtgcggccctgctcgtccgtgccgcggcccgtaatcaccacgaagtggtcggtgatgccgtccacgttgtccgagttcctgccggagcggtggtccacgcccacgacgacgggcttgcccgcgtcgagctggccatcgatgtactcacggccccggcgcgccgccgcggcgttcaccgtgacgccgccgttcgggtcatcccccgtggccacctggatgcggttgtccggccccgtcacggtggccccggcgcccgcggccatcaccaccgcggcgcggaagcaggccttgtcaccggcgcgctccaccttcgacgcgttgtactggctgacccacggcgtggccgtatgcactgccgggcggtccgccgcgggcgcaatctccgccgtgtcgttcaagtcggtgggcgtcgcgcccccggtggtgttggaggcctggaggttctccgggcgcgggcgcgggatggggacctcggcgggcagcgccgtggtgcccgccgtgaggttctccgggcgcgggcgcgggatgggcgcgttctcgaccgcaccaccaccaccaccaccgtcgcggaagccgcgcgcgtccagggctcggaccagcgccgtctcacgccgcgtctggtcggcgcgcaggcgctgctcgttgtggtcgaagccggaggcgctgatctgcccgttgtccgtgcggaacgcattcacgcgcgcatcgacgagcgcctcgggcgtcacgccacgcgggtcctgcgccagcctgggcagctcgcggttgaggaagttctgcgccgcgcggggcgactgcgtgtgcaggtcgtagaaggtggaggccagcagcgcgttgttcgggtccaggcccgcgcgctcggcggcgcgctggtactgcggcgtgacgcggcccagctcgcggttccagatttcgtccgcgtgcgacggggagttcgcgccgcccccctggtaagagaacgagccccggttgtgcttggcattgcctgggtcggtgtggcccccgtagctcgccgtgaagccaccgttcggcgtgcggttgccttccgaggtgccaacgacaatggcggactcggagttggacccgccttggcggaaggccgtcaggtcgacgttgcgatagccattctgggtgccagacaccccagcggtgcccgccggcgtgacgccctgcgccacggtgccctgcgcggtaccaggctcaaagctgtcacggttctgtgacgtccccgtcggccggttggccgggcgcggcatcggacgaggcgcattggcctcgaaaccatcgttggcgcccgggatgaccagggtcttcccggcgatgatgcggtccgggctctggaggttgttcgctcgcgccagcgcatcaacggtcgtgttgttgcgccgggcgatagcgctgagcgtatctccctggcggattcgataggagttgctaccagtcatcagcggctccatggaggagaagtaagtcagacgcctccatgattttccggatcaatgtccgaaagttgcgcaagccaccaaacaacagccagggtgttcaaatccagcacccatgaacaaagcctgacgcgctgcaccagtcacaggactgtgacagccccccgcggcagcatccagcattgctcaatagttgacctggagctggatgcgcgtcacgtgtccctgctcctggatgtacggatagcgggacgaggtgcggtccgagatgaggtaggtgcccgtcagctccaaggccttgttgagctgccactcggcccccatctccagctcccgcacgtcgtagagcggcgcgttcgtctcgaacttcttgccgccgtcgtagagggtgccccggatgtaggggatgagggacacgcccagcacgccgtccagcttgtacatgagctgcgcataaccaccccggagccggcggctgtcgatgagcaggccctcgacgggcccctcgcccagcgagggaccgcggcccaggttgaactcggccaggagccccagcggctgcggatagataaccaggctgacgatggcgcgtgcgtccaccatgtcggagccccgggcgagcgcgtagggcgcgccgtcacgcggcgaggcattgaggttgaagcggccgtagtagccgcccacgcccgcttccacgtactgcgagccgaacaggaagggccacgtgacgcgaacgacaccatgcggcgtgtcattgcgctcggcgcggttggccgtctggccgttgaagacgccgaggccgaccacgccgtagtcgcccagagcccttcaggttgttgtccacgaggaacttgaagcgcttccggatttcgtcgggcgcccagtagaagaagacgccaggtcgcgctcgtccttgagcccgctgttgatggcgtcgttgcggtccagcgcgaggcggttctgactggactggaggttctcgaagccgtacggcaccttcgactggcccacgcgcagacggaactccttcttcgcgtccaggaagatgtccgcgtaccagtcccgcatgatggtgacgttgtactggtccccgatgaccgacgcgaagtccggctggaggtagatggacacgcggtcgtggacgtcaccgaacagcacgaggcgcgcgcgccggatgccaaagccggtgttcttgccgaggaagcggtcgccctggtcgttgaccagttcgtcattcacccggaagctgggcagccggttgtagcggaactgcgtgtagccccgaatgcggatgcggtcgtaccaggcccgctcctccttcttggcctggggcttcgtctccggctcgggcatcgccgcctcgggaaccggcgtcggcgtgggctctgacgcgggaggcggctcggtggcggacgagggcgcggcatcgtcctgctgcgcgtgggcaaggggcgccagaagcagcgcggagccggacaacaggacctggagagcagcgcggaacgaagcagtgggggtcatgacggcgcggaactgccagcagcgcgcgaaagcgcgcacgaactcgagtttgcagtcccgttacaggacgaaatgcacgaccgcaacgcacgggccttcgttgttgcctcaccgtcacaggtcccgtcgccgcgtcacaaagcagcccggcgcatgtcacctgttcgtgacatgcgccggggtgacgaccaccgcgctcgcgtcagcgcttccagctgccgtccatcaggcgctggatgcgcagctccagcggcgggtggctggagaagagcgccatcatcccgccgccccggatgccgaacgcctgcatgttggacggcagcatggccggctccccctgctgcatgcgcagccggttcagcgctcgcgccatggcgcccgggtccaccaactgcgcgccgccgtcatccgcgcggaactcacgccggcggctgtaccaggccacaatcatgctggcgccgatgccaaacacgatttggagcacgatgctggtgatgaagtaggccggccccgagccgccgctctcctcgccatcgtcggagcggctgaggaagcggtccacgaagaagcccaccacgcggctgaggaagatgacgaaggtgttgagcacgccctgcagcagcgtgagcgtcaccatgtcaccgttggccacgtgggccacctcgtggccgagcacggcctccacctcgtcccgcttcatgccatggagcaggccggtggacaccgcgaccagggcgctgttgcgcctggcgcccgtggcgaaggcgttcatgtccgggctgtcgtagatggccacgtcaggcatgccgatgcccgcgtcgcgggccagccggtgcaccgtctccaccagccagcgctcgtcctccgagcgcggcgacgtgatgaccttcgcccccgtgctccacttggccatgggcttggagatgagcagcgagaagatggcgccgccgaagcccatcaccgccgccatgatgagcaggcccgggaggttcagccccacgccgcggcgggcgagcaggttctccaccccgatgagctgcccgacgatcgccagcatcgcgaccaccgcgaggttggtcaggacgaaaagtgtgatgcgcttggcgaagcttcccttcatgactctctctccctagaaaaaaccttggggacaacattcagcagcgtgggacgaatgcaagcttcgtcggccacttcttgtcccgacccgactagaacagccttccggcggggcacttcccaaggttgttccttcaggaacctgagattttctctatgaaacggcctcgacgggcgtttccccagggcttgatcggccgccgggttgggtgcctggggcttgcgcgtacggctccacaccaggggtgcgtcccgggcgccacacatgcgactccatcgccccctcacgcgtcagccaataacaaaccagacggcgaaggcagaatatttccacaacaatgaatgccacgaatcccgtctgcccactgtcaccttggcgcaaattttctgtcacgccacaaaacgcagctcaatcatgagcgcgcgcttggattgacacgcgttcttgacggaatcccaggcaactttctctgagcggttgggaaaatggatccaactccattcttctttcaagggaagagccccccatggtagccattgcccgctcctccgcggctgcgtccagcagcgcgtctcgttccgcctcgcccacgctgcgcagcggagcgcgcggtgcggccgtgacgcaactccagaacaagctcagggccgcgggcttcaacccaggcgcctcggatggcgtgttcggtccgaagacgcagtcggcggtgcaagccttccagcgtgcgcgtgggctccaggtagacggcatcgtcggtcccaagacgtggagcgcgctcaactcggcgggcggagcgggcggctcgggtcccacgctgcgcaatggcgcgcggggtgagccggtgcgtgcgctccagcagcggctcaacgtgctgggcttcaagtcgggcacggccgacggcgtgttcggtccgaagacgcagtcggcggtgaaggccttccagcagtcccgcggtctggtggcggacggcatcgtcggtcccaagacgtgggacaagctgggcatcaacgtgcagggccccgtcaccaacccgggcggtggcggtggcggtcgggtcgtcacgggctatgtgaacgggaagccgcggcagatttcgctctcgtcggtcccgaacgggaaggagatgcgctcggacgcggcggcggcgtacaaccgcatgtacgcggcggcgcgcgcgcagggcatcaccctgaaggtgaacagcggcttccgcagcatggcggagcaggaagcgctgtaccgcgcgtacaagaacggcaccggcaacctggccgcgcctccgggctactccaaccaccagggcggcatcgcggtggacgtcaacacgggcggcacgggcacctcgacgtaccggtggatggccaacaacgcgaagaacttcggcttcgtgcgcaccgtcccgtccgagccctggcactgggagtaccggccctgacgcaggagagcgacatgaagaagctgctcatggcgttcgcggtgctgaggtgaagcgccgtcgagccaccgcaccttgcaggtacggtggctccggacttccagcggctcagctcttcgtaatcgggcggtagcggatgcggtgcggctccagggcctcggggcccaggcgcttcttcttgtccgcctcgtagtcctcgaagttgccctcgaagaagaacgccttgctgtcgccctcgaacgccaggatgtgcgtggcgatgcggtcgaggaaccagcggtcgtggctgatgaccacggcgcagcccgcgaagccgagcagcgcgtcctccaggctgcgcagcgtctccacgtccaggtcgttggtgggctcgtcgagcagcaagaggttgccgccgctcttgagcatcttcgccaggtgcacgcggttgcgctcaccaccggacaggtccttcacccgcttctgctggtcctgccccttgaaggcgaagcccgccaggtacgcgcggctgggcacctgccccgccttgcccaggtccaggtggtccagcccgccgctcacctcctggaacaccgagttgtcgccgtccagcgcgtcgcggctctggtccacgtaggccagcttcaccgtctcgccgatgttcagctcgccctcgtccggcttctccacgcccgtcatcatccggaacagcgtcgtcttgcccgcgccgttgggaccgatgacgcccacgatgccaccgcgcgggagcttgaagttcaggtcctcgatgagcagccggtcgccgtacgccttgcgcagccccttggcctcgaccaccagccccccgagctgcgggccgggcgggatgatgacctcgcccgtcgcgtcgcgcttgtcctgcgtctggttgagcagctcctcgtaggccgcgatgcgcgccttgctcttggcctgacgggccttcggggaggcacgcacccactccagctcgcgcttgagcgtcttctggcggtggctctccgacttctcctccagctccaggcgcttctgcttctgctccagccagctggagtagttgcccttccagggcacaccctcgccgcggtccagctccagaatccactcggccgcgttgtccaggaagtaccggtcgtgggtgatgcacacgatggtgcccttgtactccttgagcgcctgctccagccacgcgacgctctccgcgtccaggtggttggtgggctcgtccaggaggagcaggtccggcttctccagcaggatgcggcacagcgccacgcggcgcttctcaccaccggacagcttcgtcacgtccgcgtcgcccggcggcaggcgcagcgcgtccatggccatctcgatggtgcggtccagctcccaaccattcaccgcgtcgatggcgtcctgcagccggccctgctcggccagcagcttctccatctccgcgtcgctcatgggctcggcgaacttcgcgctgacctcgttgaagcggtccagcgtggcgcgaatctccttcaggcccagctccacgttgcccttcacgtcgagcgaggcatcgagctgtggctcctgcgccaggtagccaaccttggcgctggggtccggcttggcgacaccgaagaactccgtgtccacgcccgccatgatgcgcagcagcgtcgacttaccggagccgttggggccaatgacgccaatcttcgcgccggggaagaacgagaggtagatgcccttgaggatctccttgccgttcttgaccttgcgcaggtcctgcatcgtgaagatgaaattctgggccatctgggccttcctgcttaaggtggagtgaggggctctgcggataccagggtgcaacagcgcactcaaggcgagagcgtcccccaaccctgtggggctcgaacgaccggccccggcaggtgggggcagcccggaacaagccgtcgcccccttggcccgcgccgcaggcgtggaaaagcgaacggtgccgccaggccccccctgggcctcctccgtcgtggcggccagctccggctgctccatgacggcgtccatcttctttcaatccctcttgaacgcgccggcatcgagcgcgaagtacaggaacagcggcaggcccgccgaaacgccggcccccagggtgaggcccgtgacgaagagggcctggttccgctggatgaaccggccggaatacgcggacaccagcaacacgaccgcggacaccacgacgtccagccatgcgaacgcgctgatgcgattggccgtggcctgcgcgacgagcagtggcacatccagcccgtgctccacgacgaagggcacgaaggccgcgtaggggatggccactcccgccacggtcagggccaggagcacggacttgaggtgctgggtcttcaccgcgtcagcataacaagcgtgccgtcacgccatgtcgccgggctcactcgagggtggccaggaacggcgcgctgttcgcctcgcaccagcggcgataggtctggagacgctcctcggacgtgacgcgcttggagacctggccatcctccgtcaggtattcgatggccccgcgcacggtgatgagcaagaccgcgggcgcgtcgcccgtcacccgccagctatcgacattgccgggcggctcgtagacgtagccaccgggaccaatcacctcccccgtgtcgagcagctcgcgagttccggagaggttgaagccgtgcgcctcgccggtgtgacggtgccggggaatgacggtgccgggctccaagcggaagaggtacatccagccggagccatcctggaagaagcgcagcggcttgaaggagaggcccgcgggccccatgggaatccagggcatgcgctcggggtcgaccgggcgcgaggacacagaggacgaggacgtgtcgttcatgcccgtcagattgcgctctcactggccctcccaccgggccagaattgacgaatctcactgggccaaactagaggggcgtctggcatggaccttcacgtcgacctccaggaccgcagagacgtcgcggggcaaatctaccgagggttgcgcgcgaggattctcgacgggcggctgcgagacggtgagcaggttcctccatcgcgtgagctggcccagcggctgggcgtctcgcgcaacacggtgggcgtagcctacgaatggctgaccgccgagggcctgctcgtgggccgaggccgcgcggggagcttcgtccagaacgcgccccgggaacgaggtgcgcgcgcggcggcaacgcgcggtgtgaagctgcgtccgcgcgccgtctggagcgagctgcacgtcccaccacccgccgagccgccagcgccgtatgacttccgcgtcggcaaccccgacgccgcgttgttcccgttcgaagcctggcatcggctgctcgcgcggcacctgcgcgccgccgcgatgacggcagcctacgcggacccggccggccaccccgagctgcgcgaggccgtggcacgccacgtgggcgtctcccgaggcgttcgtgccgaagcgtcggacgtgctcatcacacatggagcgcagcaggcgctggacctcgcgggccgggtgctgctggagcccggagaccgcgtcgccgtggaggaacccggctacccacccgcacggctcctgttccagtcactcggagcccacgtggtgccggtgccagtcgacaaggaggggcttgacgtgcaggcactgccggatgacacgcgcctcgtctacgtcacgccgtcccaccagttcccgctgggcatcgtgatgtcgcccgcgcgccgcagggccctgctcgactgggcacggcggcgcgacgcagtggtcatcgaggacgactacgacagcgagttccgcttcggcggccggcccttggagacgttgcacagcctggatcgttcgggtcgcgtcctctacgtgggctcgttctccaaggtgctgctccccgcgctgcgactgggattcctcgtcgcgccgccctcgctccaacgagagctccggctggcgaagcaggtgacggactggcacagccagcttcccgcgcaggcggcgctcgcgcgcttcatcgacacgggagcactggcccggcacctgcgaaagacgcggcgcgagtacgagcaacggcacacgcggctgtcggagaagctccgccaccactttggagacgcccttgagcaactgccctccgtcgccggactgcatctgtgcgtcaccttcacgcggggcggcgctcggttggagcgggagctcacgcggcgagcccgtgacgcgggcatcggcatcgaagcgctctccggctacttcgccggggcgcccacccgccatggctgggtgctgggctacggcggcgtgacggtggaccgcatcgacgagggactctggcgcctgcgaacgcgcctcgccggagccctctgaggccaccgcacactgccctcccgtcagtcccgaagcaccgtccccgtccgcgcccgcgactcaagcctgaaccggaacggaaaccgccatgttctcctcccagacgttcttcttcgccgtggtgggcgacgtccacgggcacatgcaccagatggtgagtcacctcactgcctgggaggaacgcagccgcaggccgctcgacttcgtgctccaggtgggcgacttcgagccccaccgtcacaacgccgacctggccaccatggccgcacccacgaagtacaggcacctgggggacttcgcggcctaccaccagcgacgacgccgcttcccctggcccgtctacttcatcggcggcaaccacgagccctacggccacctcgacctgtaccccgagggattcgcgctggcgccgcactgtcactacctgggccggagcggcgtggtggagttgaacggcctccgcgtggcgggcctgtccggcatccaccgagaagccaccttctgcaagtcccgcccgccgctggcctcgatgggcgacgtgtccaacaaggacttcaccttcttcaacgaagaggacgtcgagcgagtcctggcgctcgggcgcgcggacgtgctcctgctgcatgactggccctccggcatcatcccgcccgaggaggccgcggacttccagggacagcgccgcggcgcgagccacgacctcgtcggcaacgcgtacgcgcggctgctggtggacgcgctccaaccccggctggtcctctgtggccacctgcaccggcgctacgcaggcaccgtccagcaccccggcggccagcgttcgctcgtgcggtgcctcgccagcgtggagcagggcgcggaagcgttcgcggtcttccagtgccgcgagggcacgctccaggaaatcgccatgtgggagtgacaccgggtggacaacgcgacgcgccaccctgcccgacttgcgctggcgagtcgccggggacggacaccacgcccgcacacaagccgagcgccgcgcgaccggaggtgttacaggaagggccccatgtccgtccccgccctcgaactccagggactctccaagcgttacggagagttcacggcacttcacaccgtggacctcgccatccgtcccggtgaaatcttcgccctgctgggccccaacggcgcgggcaagacgacgatgattggcagcgtctgcggcctggtgaagaagtcctccggcagcatccgcgtcttcggcaaggacctggaccaggacccggtgggtccgcgctacgacatcgggctggtgccgcaggaaatcaacttcgaccccttcttcaccgtggccgaatcgctgcgcatccagttgggcttctacggccgccccgcggatgaggcgcgcatcgacgaggtgctcaccgccctcaacctgcacgcgaagaaggacgcgtacacgcgcgcgctgtccggcggcatgaagcgccggctgctcatcgccaaggcgctggtgcacaagccccgcctcgtcttcctcgacgagcccaccgccggcgtggacgtggagctgcgccgtgacttgtggacctacgtgcgcaagctcgcctcagagggcaccaccatcgtcctcaccacgcactacctggaagaggccgaggagctggccgaccgcgtgggcatcatcaacgaaggccgcctcctcatggtggaggacaaggccaccctgctgcgccgcttcggcgagcgccgcgtcatcatcaccttcgagcagccgcagcccggcctgtccgaggccggcaagcgcttcgccgcccgcctcagcgaggacggccgcaccctcacctacgtggagcgcgacggctgcgcccccgtccggcgagctgctccgcgccctctatgccgaagggcagctcatctccgacgtggagacgcgccgctctcgcatggaggacgtgctcatcgaaatcctccgtggccgcccacagcaggccgcctgagccctcatcatgaacgtccttgggatgaagacccttctggcgaaggaggtccggcgcttcatgcgcgtgccggggcaaaccgtcctgtcgcctctcatcagcaccacgctgtatttcatcgtcttcggcgtctccatctccggccgcgtccagacggtggaaggcctgccgtacctgcacttcatcgtgccggggctcgtgttcctcggcatcgccaacaacgccttcctcaacagctcctcctcgctgttcatcaccaagattcagggcaccgtggtggacctgctggtggcgccgctggggcccggtgagttgatggcgggcttcatcggcggcgccatggtgcgcgggctcgtggtgggtctgctcacctgggccgtggccaccttcttcaccggattcagcctggagcacgcgggagtggcggcgtacttcctcatcctgtcgtcatacgtcttcagcgtgctgggcatgctcgcggcggtgtgggcggagaagttcgagcagatcaacttcttccccaccttcgtcatgctgcccctcaccttcctgggcggcgtcttctattccgtgcgcgagctgcccgcgccctggaacaccgtcagcctcttcaaccccatggtctacatggtggaagggctgcgctacggcatgctcggccgcagcatctattcgcccctgggcgccggaagcatcctcttcgccgtcgccgtggcggccaccgcgctcacctacgccgtcctgcgctccggctacaagatgaaagcctgactcaccccggaaagccgggcaggccgctcacgcctgcctgcctgctcgctcccaaccctgtggggtaattcgcgactgagcaattcccacgagctaagaaagagcgatatcctggcgggcacacatggctgtgccattcggtaagtacgagctgctacgcaagattgcctctgggggaatgggtcaggtgtttctggcccgcgaacatgggacggggttcgagcgacttgtcgtcctcaagctcatccttccccacctcgcagaggatgatgagttcctctccatgttcctggacgaggcggggctcgtagcgcgcctgacgcacccgaacctcatcaccatcctcgacctgacagagattgagggccgccactgtctggcgatggagtacgtgcagggcgacgacgtgcgccgcctggaaaagacgtcccgcgcgcagggcaaggcgctgccggtgggactcatcctccgcatcatcgcggacgcggccgccgggctcgactacgcgcaccaggcgcgtgacgcccagggcaagccgctgcggctggtgcaccgcgacgtgtcgccgcagaacatcctggtcgggttcgacggcggggtgaaggtcatcgacttcggcgtggcgaaggcggccaccagcagtcagaacacggccaccggcgtcctcaagggcaagtacccgtacatgtccccggagcaggccagcgggctcgccatcgacgcgcgcagtgacttgttcgcgctgggcgtcgtcatgtgggagctgctcaccggcaagcgcctcttcaagggcgagtcggacatgatgacgctgcggctggtgaaggactgccaggtgccgcggccgtcgcagctcaacccgcgcctgccgccgggcctggatgaagtggtgctcaaggccctggcgccctcgccagaccagcgctacccggactgcggcgccttccggctggcgctggaggactacgcgctcaatctgcggctgccctccagcagcgcgcacctggccgccttcctgcgggagctctacgcggaccgcatcgcccatgagacggacccggcgaagctggaccagctcgcggaggacgcggacctggactcgcgctccaactcgtcgctcagcggcgtgccggggctgctgggccccgcggggcgctcctccgcgtcgcgggccatgcgcggctccccccatggcgccgtccccgggacgcgctcgcggcagaccgccgccgcgccgcagccgaaagagaagacgcgaggcaccgcgcccctggcccgtccgcctccggagccggcccgacgcatcccctggctcccggtggccaccgcggggctgggcctgctcatcgcgggcgcgggcatcgtcttcttccgctcgcccgcggacgccaccccggcccgtccgccggtggaagtggccgtaccgcaccagccggaaatcgcgccggaagcgcagccgcctccaagcatggaccccgagccggcgcgccacgtgaagctgcccgtcatcaccgagccccctggagcccgggtgagcgtcaacggcgaggagcgcggcgagacaccgctgcgcctggagctggaggccgggg

SEQ ID NO: 1087 - DNA, 14823 bp, Myxococcus xanthus
  unsure (1)..(14823): unsure at all n locations
ggcactggtcttgaatggttctccgcacgcgacgcgctaccgggatgaagccttcttcgtggacgcggttctcacagcgccgggctcgccggtggaggtggccacgcgcgacgcggaggtgggcctgcgcgaggacttctccgcctacgatttggtgctgctgctcaacgtacccgcgccgagcgccgacgaggcgcagaagctggcggccttcgtggagaacggcggcggcctcttcatcagcatgggcgaccgggtgaacccggaggcgtacaaccagcggctgggcccggtattgccgcgtccgctgcgcctggtgcgcaccagcgccgagcgcgacgatccggacgcggacaccaagagcgcgcggctggcgcaggtctccgtggagcacgtcctcttctcgcccttcacggggcaggcggaggaagggctcgtgggggcgcgcttctacaagtacatgctgctggaggcggactccccgggcgctggcggcgccagtcaggtgctggccacgtatgaggacggcgcgccggcggtggccgtggcgcgcaagggcaaggggcgcgtggcgctgcttaccagcacggtggaccgcgactggagcgacttctccatccgcacctccttcctgccgctgatgcagcgcttcgccgcgtacctcaccggctccctggacgagcgcgaggaggtgcgcgtgcgcgtgggcgaaagcgccacgctgcgcccggagggggcccagaaggtgtcctcggtgcgcgcgccggacggcaccgaggtcaccgtgaaggagcagccggaaggcgcgctggtcgccgggccggtgacggagccgggcgtgtattcggtgctgggcgcggacgggaaggtgcagccggacctgtccttcgccgccgtgctcgatccttccgagagcgacctgggacgtgtgccgacggacaccctcaccgcctacttcggagaagagacggtgaaggcctccacgggtgacgcggacaagccgacggtgccgctgtggacctggctcatcctggccgcgtgcctggcgttcttcttcgaaggcacgctgctgcgcaagtagccgtcaccaggcccggagccggcgaatcacgacgccgcccgcgacgtcgctggacgggttggagttctcacagcacgacccgccgcaggagacgttgaagggcaccaccacccggtcgcccggcttgaggtggatcacgccccgggcccacctcctccacgacgccggcgaactcgctgcgtgcgcgcatgccagttctgctcctttgtgggcaaaggagcgaggaccacgcaccgatgcggcaaggcgggagtggcgctcgtgtgtgtgccccctgtcctggctggccgctctgacgggggaatgcccggaaccaagcctgaaaccagacccgccaagtccgctcaacgcactcaaattgaaatagtcgatatccgtgtaactgatacgcgtgcgtataaatttaagtaattctatggattgtgcacaaatccaacttacctaaaaatcgtgacttgcctgtgacgcacccggccggccggcgtgcctcgcgggcaatcaccccgttgccctggagcacaccttgaagcgttccaccttgaagctgacctcggccgtgacggccttcatgaccttctccaccttcggcatcggctgcggtcccgcggatggcagcagcggcccgtcggccggcatcacccagaaccaggccctgtccgggcagaacctgttcaagggcatggccttcggcctgggccccgcggcgcactacttcgacgacctctggcagcgtccggagatcaaggcgaagctgggcgacgagacgctggccaagcgcgaagaggccgccgaggccgtcatcgcgaagatgagcgcgctggacccggcgttcttcgagcgcttcggcaacgacctgcgcagcggcaaccacctggtcatcgaccagctgctgacggacacgcgggagctgacggttgcagcggcgaacgcgctgcgcaaggacgcgggccaggcgggtgaaatcaacgccgccgccctgcagcaggtcgaggcgggcctgtacctgtacgtggagacggccgtggccgtcgccatcgtgctgatcctcatcctgacccagatcgacatgaccccggtcatggaaggcccgcagtccagccagctccagcgtgacgtgtgggtggacatgctggcgaagcggttcgccgccgctgagtagtcggagcactccggggagtgtccatcgccctcaccggtgggcactccccttcttcctcttccccgagcacggccgtgaccgagtccactcctccctctccccagacctccccaacgcgccgcctgggcctgctggccctgggactcatcctgggctggaccacgctcacggtctacgccctgcacgcggcgctgccctacaaccccatcgagctgcccttcgagaagcacttcaacatcaagctgctgctgccagaggggtgggccttcttcacccgcgacccgcgtgatgaccggatgctgccctacctccgcaccccggacggccagtggacctggggaagcgacacgcccaacttccagttgaagaacgccttcggcatcaaccgggccgcgcgggcacagggcgtggagctggggttgctcctccacgacacagcgacccttccccgggaggactgcaaggaagccccctccgtctgcctggagcgcgcccccgtggccaagacgctccgcaacaccagcccgcggcccacgtactgcggccagctgggcatcgtcttccagcgggccgttccctgggcctggagccgcaccaaccaggggaagcccatcaccatgccctcgaaggtcctgaggttggacgtcgaatgctgacagcgcttggaaaccgtgcccgcgcctgggtggcgggcccctccccctggagcaacgtctacggcctggcgcgcacgctggtcgcgctggggacgggtggcacgctggccttcagcgacaccacgacgctgttccggcccgtcgcgggcatccccgaggcccccgtctgcgagggcatccgcgcggcgtccttcttctgcgtgctcccctccggctggctggaggtagcgcggtgggcggcggtgctactgctgctcgtcgtcgcctccggctggcgcccgcgcgtcacgggactggtgcactggtgggtggccgtcagcatgccgtggtccgcgtcgctgacggacggcggtgaccagattgccgccatcctggcgctgctgatgctgcccctggcgctcacggatgaccggcgctggcactgggacacgccccgcgaatccacggggaacgacgaggcgaagcggctcatcgcccggtcggcctgggtgatgctccgcctccaggtggcgggcatctacttccacgcctccgtcggcaagttcaaggtgacggagtgggtggacggcacggccctgtattactggctgctggaccccagcgtcggtgcaccggactggctggccggcgtgatgctccccgtcctgagcagccccgtggtggcgctgctcacctggtccgtgctgctgctggagctggggctcgcgctgggcccgctgctgaacccgtccctgcgccgcgtgctgctgcccctgggcatcagcttccacctgggcatcgccgtgttccatgggctcatcagcttcgtgctcgtcatgtgcggcgcgctcatcctgctgctccgtccgttcgacgagctcttccgcttcgagggcctccgcgcctgggtgcggcacatgcggaccccgcccgtgcccaccgccacgccgtccttggagccggtagcggtgcaggtggcgtcggtgccccccaccgacggcgcatgaagcgctgcgacgtcgccgccgccctggcgccccccaaggctgcggccttcgcgtcacggtgagcgggccacgagggctctctcgctctcctgccctcaggcaggcacacgtcgccacgggcagggcctggatgtccgtccgtcctgggtccaggagccttccgcgccgcgcgggtccaccgccggctcgcggaggctttccgctacgctggtgtaccctcccctgattcggtgggaggactctccagcggaggcagcggcagcccatggacatccatctggcggaggagatccgcaagcaggtcgaagaggccttccgcaagcgcggccgggtcaacatcgtcatcgcgggccgcagcggcgtgggcaagagcacgctggtcaacgcggtgttccacggccgcatcgcggacaccggccagggccgccccgtcacgaaggagacgcgcgagtacacgaaggacgacatccccgtcagcatcctcgacacccgcggcctggagctgggcgcctttcaagagacgctgaagctgctggaggagttggtggccgcgcgcgcgaaggacgcggacgccacgcgccacctgcactgcgcctggttgtgcatcagcgaggactcacgccgcgtggaggacggtgacgtgaaggcggtggagatgctcgcgcggcacatgccggtggtggtcgtcgtcaccaaggcgcgcagcgaccagggcttccgcgcggaagtgcagaagctgctgcccatggcccgtaacgtcatgcgcgtgcgcgcgctccaggagacggacgacgagggccatacgctccagcccaagggcctggtggagctcgtcgagctcaccatggagctcgtcccggaagcccagcgcaacgccttcgccgccgcccagcgcgtgagcatcagccagaagcgcaagcgcgcgcacggcatcgtcgccagcgccgcggccgccgccggcctcattggagccgtccccatccctttcgccgacgccgccctgctcgtccccacgcaggtcggaatgctggcgggggtgagtagcgtcttcggcctcccgctgacggaggccttcctctccacgctggtgggcgcgggcatcaccggcctgggcgccaccttcaccggccagtccatcgtatccggcctgctgaagctcgtccccggcccgggcacggtgattggcgcgctcatctccgccaccaccgccaccgcgctcaccacgctgttcggcgaggcctacgtcgccgtcctctccaagttgatggagaagcgctgtggcgagttgcccacggaggaggaggtcatccaggccttccgcgaggagatgtccctgcgcggcgccgcgtagacgcccgggctacttcacgcgctcgattttgtaccggcggcccttgatgcggccttcactcagccgctggaaggccacccgcgacacgcgccgggcgacggcgacgtaggccacgtggtcctggatttcaatcttgcccacgtcggtcgcttcgagcccgcccgcctcgcccgtgagcgcgcccaggatgtccccgggccgcatcttgtccttgcgtccggcggagatgtagagcgtgtcccacgtggactccagggacaccgcgttgcgaggatccgccgagggcagtgactccacgtccccacgctccagcttcacgccggtggccagttggatgtcgtccaccttgcggccatcccgaggcgtgacgatggagacggccaggcccgcgcgccccgcccggcccgtgcggccgatgcggtgcacgtagggctcggcctgcatgggcaggtcgaagttgatgacggcatccagcgcctccacgtcgatgccgcgccccgccacgtccgtggcgatgagcacccgcgtgctctggttgcggaacttcgccatcacccggtcgcgctcgaactgctccaaatccccctggagcccgtccacgctgacgcccgacgcggagagcgacttcttcaactccaccacggttgccttgaggttgcagaagacgatggcggacgccggctggtagtgccggaggatgcgcagcagcagggcctgcttgtctcccggctcgcagtcgtagcgcacctgctggatgtcgggccccgcggtggcggcctccaccgtgacgcggacgggctgacgctggaaatcgcggctcaacgcctcgatgtccggcgggaaggtggcggagaagagcaccgtctgccgccgcggcggcatggctccgaggatgcgctccatgtcctcgcggaagcccatgtccagcatccggtccgcctcgtccagcaccaccgtggataactgccgcgtctccagcgcctcgcggtccagcacatccatcacccggcccggcgttcccaccgccaggtgcgcgcccttctccagtgcttccagttgcgggcggatgggctggcctcccgcgagcaccagcacctggagcccgggcagccgccgccccaacctgcgaatctcgcccgccacctgcgcgcacagctctcgcgtcggacacagcaccagcgcctgcaccttgcggtgctgcaactggaccttctggagcagcggcagcgcgaaggccgccgtcttgccgctgcccgtctgcgcctggccgaccaggtccctgccctggagcagcaccgggatgctctgcgcctggatgggcgtggccgtcttgaagtccagctcctccaggacctggagcagggggggagatagcgcaagcgcggaaaagtccattcggggcctcgatgagcggaggcacggaaggagcctcgggttctgcaggccccatgtcacacccagcgaaggcaggacaagtgaagccgccgacctcgcccgacagctcgcaccggattgcccggcgcaccctccgtgaaaaatcaagctttacctgaaatcacaccccgcctggagcctccatgtcctccctccgcatcggactggccatgcggtccacccttgtgctcgccaccgccggtggcggcatgaagagccgtccgccgtgaaaccgcacgctccctgacagggcgagcggccggcagcgcatgcgcaaggaagtcctgttaagtggtctatccaaatcttctggagagcccatatggagacgcctgtctggaagtccctgaccctcgcgttgccgctgatggcggcctgtggcggagcgcctcagcagcaggaggagacatctgccaacgccatggagttacagcaggcgccgctcaccgcgcccaccgccacggtgcgcttcctcaacggctggacgcactcgcagcacggcgccatcgtccgcggcggcacgctcgtcgtcgactacgacctgtaccggatgacggactgtcaccacagcacctacgccggccagcaggcgtgggacacgctggcctatgtccgcttcctccccagcggccagctcttcagcggcagcgtgaagcaggccacgggcagcacctcgttcgtgaacaagcccttcgaggtgactgtgccttcggacgccacgagcgtggagacatggttcttcacctccggccgcacctgcgcgccgaagtacgacagcaactacggccagaactacgtcttccccgtggaggcgcagtcgccctccgccgtggtgtgggccggtgactggggcggcagcttcgctcgcgactgcgagcaccgcgacgggctggcggaccccatcgtcatcgacagctacgtcatggagcgcgcctgcaagttcgtggacgcggacgtgtacgtgcccggcgtgacggatgccgccaccgcgcgtccggagctcatccaggcgcaggtggagttcagcgtggatggcgcggccacgcagcaccggtggctggcctatcagggccgggtgggcaacaactaccggtaccgctggaacctcgccgcggaaccgctcgcgtatacgccgtggaacgcctatgcattcgggttccgatattcaacggatggcgtgagctggtatcgcatcgcgagcggcgcgggccccacgggcggcaccgcgcggaccgtgcagcgtcacttctgagacggtccacctctgttgaatgccgctggggcccgcgcgattcagcggcatctcggaagaggcgctgtggcaagaagtgttcccctgagaaggcgagcgcactgctcccatcattccagcggggccacacccgggccaggcccaggaaagggaacgcgaaatgaccgaaggcactccacgcgtggcggagcggatttccacgggcattccaggcctcgacaccgtgctgcacggaggcttccgcaaggcccgcacctacatgctgatgggccttccgggctcggggaagaccatcttcgccaaccaggtgtgcttccaccacgcgaagcgccacggcgggcgcgtgctctacctgacgctgctggcggagtcgcacacggagctggtcggcaacctctcctcgctgtcctacttcgaccccacgctgctgcccaacgccatcacctatctgagcgccttcacggtgctggagcagggtgggctggatgcgctggcggagctcatccgcaaggagacgaagaatcaccaggccacgttgctcgtgctggacggactggtggccgcggaggaggtggcgccgtcgcagcaggccatcaagaagttcatccacggcctccaggtggtgacgggcctcatgggctgcacgacgttgattctcaccaccggccgcggacaaggcctgcgcgccgagcacaccatggtggatgggttgatactgctccggcagcgcatgttcggcgcgcgtgccgtgcgcgagctgttcgtgcgcaaattccggggcagcccctatctgctgggcaagcacagcttcgacatcacccaggacggcatcatcatctatccccgcctggagacgctcgcggagtccgggcctccgccggggccgccgcaggatgcgaagtgcgcgtttggcatccccgggatggacgcgatgctgaccgggggcatggcccagggctcgacgaccatcctcctggggccgtcgggcagcggcaagacgctgctgggactgaacttcctcgcggagggcgcccggcgaggcgagcgcgtccacttcttcgccttctacgactccccggagcgcatggtggcgcaggcggcgggcatcgggctcgacctcaagccgctcatcgaccggggcgacttcgaggtcagcttccggccgcccacggagaacctgctggacaagctgggcgtgcagttgctggacatcatccggacccgcggcgcgcgtcggctcttcctggacggctacgacgcgctccgcagggcggccgtccggcagtcccgcgtgtcgcgcttcctggccgcgctggtcaatgagtgccgcatgcgcggcgtgacgctgctctactccgtcgaatcggtctccgcgtttggcccggaggtgaccttcccgatgaggggcatctccatggtggcggagaacatcctcttccttcgccaggccgagctggactcccggctgcgccgcttcatcacggtgctgaagctgcgcaacagcccgcatgacacctccctgcgcgagctgtgcatcagcacgaaggggatggaggtgaagggtgccttcacggatgtcgaggcgatgatgaccggcgtgccacggtcgaccacgtggtccgagccccggcatcctcccggcggcgggcgccaggagccttaggcatgggccccatcctcatcgtcgatgacgagttcggcatcgtcgaggccatgcgcgacctcctgagcgacgaaggctaccggaccgccatcgcgctcaacgggaaggaggccttggagcggatggccgaggagcacccctgcctggtgctgctcgattacatgatgccggtgatgaacggcccggccctgctggaggccatggagcgcaatcccctgctgcgtgacatccccgtcgtcatgatgagcgccagcccgccggactactggaagcacctgcgttgcgcggccttcctgcccaagcccttttccctggacgagctgctggtgatggtgaagcgcttcgcccagggcgccatcctccagtagcgcgcctcatcgccctgcggcctgacaggcagccgacgcttccaggagaaccgcgttcctcccgagcgcccagcccctggcttctgccagactgcgcgccgtgacgacctcctccagcctctaccgcgactgtgcccgcctcttcatggtgggctttcccggcactcacatcgacagcgagctggccgcgctgatggatgacggcatctacggcgccatcctcttcaagcgcaacgtgggcagcgccgcggacacggccgcgttgtgccacgcgttgaaaacacgcgcaggccggcccttcatcctgtcggtggaccaggagggcggccgcgtggcccgccttcgcggcgcgcccttcaccgcgctgccgcccatgcgggagctggggcagcgcggcgacgcggcccaggtggagcgcgtgggccggctgctggcgtatgagctgcgcgcgctgggcttcgactgggacttcgcgccggtgctggacgtggacaccaacccggccaaccccgtcattggcgaccgcagcttcagccgcgaggcggaggaagtggcgcggctgggcgtagcgctcgcgcggggactggaggcgggcggcgtggcttcgtgtggcaagcacttccccggccacggcgacaccaccaccgacagccacctgacgttgccgcggctgccgcacgacttggagcggctgcgcagcgtggagttggtgcctttccgcgccttcgcccaggcggggctggcatccctgatgacggcgcacgtcctcttcgacgcgctggacccgggggtgcccgccaccatgagtcagcgcgtgctccagggtgtgctgcgcgaggagttgggctttgacggggtgctcgtcagcgacgacctggagatgaaggccattgccggccactactccgtggaggaggccacggtgcagggcacgctagcgggcgtggacctgttcctggtgtgccacaacgcggacgtgcaacgccgcgccatcgaagccctggtgaaggcggtggagtccggtcgcgtgtcacgggagcgaatcgcgcaggcgcaccggcggctggacgcgctcagtgcccgcttcgcgcacccggcggaggaccggctcgccctgctggggagcccagagcatcacgcgctggccgaggggctcgtcagcaccttcaccggccgcgacccgaccgaggtgatgctggcctcccgctgaaggcgcgggggccggggtgccacgcacgctcccggcgccctgcaccgggagcggctggaaggggcggcacgagaagcccgccccggtgtgacttcagcggcggtaggggccactgcggtcctgccagcccagcgggctgtagccgctgtggtggccgccgcgcttgccgcccagcgtggcgccgtcctcaccacccaagccatgggccgcgggcgagtacgcggcgccgccctccacgtggtaccggtcgttcatcatcttcccggcgtcgtccacgatggagcgaccctgggtgccgtcgttcttcggcgtgcgcgggtcgatgctggagccaatctggtcgatagtgccgttgtagccccggttcgccggcagcgtccaaggcggcagcggcttgttggtgttgccgccctcgatgttcttcatcgaatcgggctggtcaccgcgctgggcgacgaggctgccccgtggctcatcaggctgactgccaccggtctccggaagcccccggcagcctacggccagaaccgcacccgccaccaatgccgccgccgaaccccaccgccgaatattccgctcgcgcatgtcgactcctccgagtcccttcaatctgttgctcgtacttcccgaagatgaggcacgccgggcatggagaccacggggtgactccatgtccgcatgacgccggaccgcccgaaccccacatatagccccagcggcgaccgggagcagccatcttcggcgctcccggcgcccgctccactgagggcttcttcttcgtcgaggaagcccacttcgaggtcgcgggctgcttccccacccggagccgccggtccccatggcggattgcttgctggaagacgcctgggccgacgtcctcccagcgcgctacttcctggaggccttcttcgccgccgcggacttcttcgccaccgcggacttcttcgcgggcgccggcttcttcccggccgaggccttcttcgcagccgcgggcttcttcccggccgaggccttcttcgcagccgcgggcttcttcgccacaggggctttcttcgcggtcgcggccttcttcgccgcacggggtgccttggcggccggagccgacttcttcgccgtcgccttcctggtcgcggcggacttccccgagacagtcttgcccgccggcgccttcttcgcggcggccaccttcttccccgcgggcgccttcttcgcggcggacttcttcacagcaccgcccgccgccggagcttcacccttcagcacggccagcacctcggcgacgtggccgttcaccttcaccttgggccacacctgcttcagcacgccatccgggccgatgaggaacgtggcccgggtgatgcccaggaacttgcggccatagagcgacttctccccccagacgccgtaggcctcggacaacgtgtggtccacgtcggccagcagcgggaagggcaggttgaacttggtcgcgaacttccggtggctcgcggtgctgtccgcggacacgcccagcaccaccgcgcccgcggcctccagcgccgagtgctcgtcacggaagccacacgcctccacggtgcatccgggggtgtcgtccttcgggtagaagtagaggacgacactccggcccgcgaactgcgcgagcgataccgcgtttccatcctggtcggcgagttggaaggcgggggcctggtcaccagcttggggcatgggcatgcgggctcattaaccacaaagcccgcgccactcaacgcccagcgacagcgtcccgctagtgcgcggggtgccccggctcaccgccatggtcatgaccatgctccccgggcggatggctgtgggcctccaaccggaccagctccttctggcagtccgtcagggcctgatgcaacggctcccggtccgcgccctccggcgtctggcccagccggatcgccagggcctcacacgcggcgcgcttggtgtccacctccgacgtcccggggcccgtggcgcccggcgtggccagggggcgcggcggcagctttccccgcaggcgacggatggcggcgatccgctgctccgcttccgggcgaaccttggagtccttgggaatcgcctcgaaggcgttgatgacggggtcccatgccgggtccaggggggacacgcggcggtcaatcaggtcgcggtaggacttctctgcgtcccggagctggtcggggcccttgtcgcagccaggcgacagaagcagacagagcgcgagcggcatgacggcggacagccgtcgggtgatcatcctcatgaagggtcggttctcctctcctgctggcctcccgattgaagcacggctagggtgccgcgtcgtgcagcccattctcctcgccttcctgcttggcctgtcccaaggcatgctccacgccgtgggcccggaccactgcgccgccatggccaccctcggaaccctggggggaggccggcgccgcgctgccatcgccaccaccgtacggttcgcgatgggacacgccgtgcatgctgggcggcatcggccgggctctgcattcttggggggcgtgggcctttcagaaaccttcgagcgctgggccgagattttcggcggcgccgtgctggtggccctcgcggtggccgccctgctgttccccagcagcctggaccacggacacccgcacctgcccggccacacccaggagccgcaccagcacgtgcacacggtgagcaccaccgctggcgcgctgatggccgtcagcggcgtgcgctcgctgctactggcactgcctccgctgctggtgggtggcagcatgagcgcggccgcatggatgtacctgcccggcttcgcgctgggcatcctcatcggcatgggcgtggtggggttgattttcgcggagggcatcgcccggctgaacgcgcaaatcacccgctgggtgcagcgcgtggtggccgtgggctccggcgcgctggggctgttctggattggctcgcggctggtcggcggctgagccccggcgtggtgtccccgcccatgacggcggggacggacggcgcggcggctacccgcgcttgtccaggatgcccagcgacatcatcgccaccaggaagccgtagacgacgtgctcggggcggttggcgaaggccagcagctccgccacggtgcgattgccgtcgattttcggcagcagctccgcctcccaccgctccagctccacttcgttgagctggtaggccggggccacggcggggatgaggcggtcctccggctggagcaggcgccgcaggcgctccggcttgtagagcttcttgatgccccggacgatgaggttggccgggtgcacgtccagcttgatggactccgcgctcgccttctcccggaagctcagcacgtacgtgccttcatcccacgcgaagagcgagtagatgacggccttcacctgctggcccacgtagtagaggcgctcggtgtccttgagcagcccgcgctccaccagcacgtcaccggtgcggcggttggactgcgcggccaccgccgacgcgtnctggagctgctccggcttgatcttccccacgcgaacgaggaattgaccgaagcggtccgcgagcaggttggagagggcgaacaccggcgtgcccttctcgaagtagacgaccttcttcaccttgcccttctgcacgcccaac

SEQ ID NO: 1088 - DNA, 11566 bp, Myxococcus xanthus
  unsure (1)..(11566): unsure at all n locations
ggctcctccttcggcgtttcagtggactccccgtcgaaccagtcatcccccacgcccgacgcctgcggttcctcgtaatcctgggacgggcctgaagcagattgcagctccgcctccagcaactcccagttggacgcggagaccgccgccgcgtccggctccggcgtgtccgcgggctcaccgagcgccgcctccgtgccccacgtgtcttcagtctccgatgacggtgattgcggctcggcgtccgccgccagcttgggctccgtggacggcgcctcaccgggtacatcgcccgcaccatccccccccgagcccacgcgccctgcgtgctccatctcggggtccggaggcagctccgtccagggcgagccctccgtgctcacggagtcgaaggaaggcccgccgcgcatggcagccagctctgcctccgccgcggagagggcatcccccgccggggcctccggcgtgtcgacgtcgaagaacccctcatcgcccaaccgaggcgccagggccgccgtgcgcatcgaaggctgagaaacagcctcctccgtccaagccagttgtcccactggcggcgcatcctcggccggcgcggcgtcctctccctcaagccccgcggacgctccctgcgcgtcgtctccggccgtctcagcgtccacggccgagccccagtcctgcccctgcgaaggctcgccccatccatccgaagaatccggagcaagcgccgagtcgatggaggccatcgcctgggcttccacctccaggtgggcccgctccatggcggtgtccaggtcgcgcgtgctctgacgctcgcgtttctgcgccgcctcgtgagcggagcgctccgcgtccgtcatggccgccagctcccagtccgtctggtgcagcggcgccaggtccccaaagagcgcattcgccagcgcggagtcgcccgccaccgagggcggtggggtcgcgtgccaggactccgtctccgcacccgtggccgccgagccaccaccagacggaggcagctcccggttctccaccacgtgccatgcgtccgcatccgcgggggcattgaccagcgaatccaccagctcgacgaaggccgccccttccagcggcagttgggccacgggggcgctgaagccggggatggactcgcccaggagcagcacccgggccgacttgccatccgggtgctggagcaactcctccagcacgagatggccccggccactctccacgccgggcgcgagcacgagcagcacgggcaggtggtgcccgtacgcaatgagggcatccgcggcggaggtggcgaggatgacctcgtacccttcacgcgtgagcaggcgccgcacggcggcgatattggcgatgtcgtcgtggacgagaaggaccggtgcgcccatgggggggcaccgagtctacagcatggcccccggatccacgtcgatcacgaccttcaccgcggaaggaacatcgaccagggccgcttccagccgggcgagcagcggggcgagcgccgtatgcgttggccccttcaagaggagctgccagcgcgtcttgccacggatgcgggagatgggcgccagggccggccccagcatgcggacccccgcggacgcagggggcatgtgccgggagacgatgttccccagggagcgcgccacactggccgtctgttcggggtgctccccctccaggcggacggcggccatgcgtgaatagggagggtaggccagcgccttgcgccactccagttcttgattggcgaagccgtcgaagtcatgggccagcacgcgccgcaccggctccgcgtccggattgtaggtctgcaccagcacccggcccgggtccttgccccggcccgcgcggccggacacctgggtgagcagatggaaggtgcgctcggcggcacggaagtccgggatggagagggacgtgtccgccatgacgacacacaccagcgtcacgcctggaaagtcgtgccccttggccaccatctgcgtgcccaccaggacatccagttcccggcgcgcgaacgaggccagcatctccgtcagccgctcggcgctgctggccgagtcccggtccaaccgggcgacacgcgcggtggggatgcgctccagcacctccgcctccacacgctcggtgccgatgcccagcttgagcatggggcccgtgcactccagacactgctccggcaccggcatggccaggccgcagtagtggcacaccacccggttctgcgagcggtggtgcgtgaggcacacgtcacactcgctgcacttgagcgacaggccacacacctcacacagaaggacggtgctgtggccccggcggttgaggaagaggatgacctgctgaccgcggccaatcgtctccgccatcgcctccagcaacggaggactgaggatgggcgcctcttccgtcaccacgccctcacgcggacgctccacgcgcaggtccaccagctcgatggtgggcatgggccggtcatccacgcggtgcttcagctccaggagctggtagcgcccgcgcttcacgttctccagcgtctccagcgcgggcgttgccgaacccagcaccaccaccgcgccggcctgcttgccgcgcacgacggccaggtcgcgcgcctggtagcgcagcttctcctcctgcttgaaggacgggtcgtgctcctcgtcaacgacgatgagccccaggttgtccaccggcgcgaacaccgccgagcgcacgcccacggcaatcttcacgtcgccgcggcgcagcgcctgccagtggaagagccgctcccggtccttcagcgccgagtgcagcaccgccacctccgcgccgaagcggctgcggaagcggcccaccagctgcggcgtcagcgcgatttccggcaccaggatgaggctgcccttccccagcgacagcgcatgctcggccgcgcgcaggtacacctccgtcttcccgctgccggtgacgccgtgcaggaggaagggctggaaggtggccgcgtccagggccgcgcgcagcaccacgcccgccgcgtcctgctccggcgtgaggtggtccggacggccctgaatcaggccctccttcacgctggcctccaccgtcttctcctccagccgggcgaagccgcgcgtggccagcttcttcagcgtctcgcgcgcgcctggaatcgcgtgggcgacctcttccagcggcgcgctgcctcccacggccagcagatacgcgagcgcggcggactgggcgggcgcgcgagacagctccggcggcacctcgttgacgagcgccaccgcgaagtgctgcacgtccggcctggcttccttctcatccacagccttcgacaggccaggcggcagcgcgccgcgaatcacctcacccagcggatagcggtagtgcacggccgcgaagcgcagcagcgcgatgaggtccttgggcaaggacggagagtcctccagcacgcgctggacggccttgagccgcaccttctcgccagtcggcggagacgcgggccccaggtagaagcccagcgccgtgccccggccgaagggcaccagcacgcgctgccccggctccaggcggcccgccagctcgtccggcagggtgtaggtgaactcgccccggacggggcggccaacggcgatggaggccaggacgggagtgctcacttcggcgcgcactgtagcggcggcggcgggctcggacagttcccggcggcttttcacaccggaggtgcgcaccgccctggaaccccgcgtcgtgggggccttcgcgggcgccgcgtccgccccgctccacaagggtcgctgttccatgacactcccttcaaccaccaccccggccccatccgtcctgctaccggggtccacagtgcgcgaagggtctgacattccccaccgggtcccgccgtgggacggaacccggagtgtcaggaggtcacttcggggctcaggccccggtgaccttcttccacgaaggacggctccggacgcgctcccaccaggccgccacgttcgggtacttaccgacgagctccgcgccgcccgcggcgacgaagaaatccatgtagggcatccacgtcacctcggcgagcgagaagccgtctcccgccaggtactgctgcttgcccagcaccggctcgatgatgccgaagacgcgctcgacgccctgcaggccctcgctgatgcgcgcctcgtccggcgtgccgccgcccatcaccttcttgaagaggcgctcccagatgaccttcatcgcggagggcgagaagtaacactgctccacgctgatgaactgctccatgcgcgcgtacgcatgcacgtcggacggcgtcagcgagggccccggcagcttgcggtccagatagcggatgatggcgcgcgactcgtagagcttgaagccgtcatcgtcctcgaaggcggggatgacgccgaaggggtggtgctccatgtacgcggggctcttctgctcccccttcgtgaggtcgacgacgacgagttccgcctcctggcccttctccgccagggtggtgaggaccgaacgcgtggcagtgctcatcgggaggccgtacaccttcatgggacattcctctgcgtggcgggccggggaaagtcccggccaggcggggccagactcttcatggccgccgccagcgccgcaaggaattcaggaaagtggcggcattgactacagggtgaagagcgagtcgggcaggctggcccggttgtcccccttcaaggcggtgaagcgcaggttgcgctgaccgccgcgccacacctcgatggtgcggggcagccactcccccgtggcgggcgagttgtagtccaggaagcggacgtcccaggccgtccccgacgcgtccgagtaacgcacccgggccgggcggaaggagtccttgtagacccagaactgcgggcggccctcggccatgtcgccgatgacgtaggccacctcgccgccgaagcgcgccagtccggtgcgccccgtgtcgatgcccaggccctggaggtggcgaatcaccgcctccttcagttcctgcacgttgccgctgcccgtggcgagcagcgggcacacctgcgagacaagcgccgacatggagggaatctcggtcccctgcacgcgacggcggccacccgactggaccacggaggactgggcattgccgtcgggcacggaggcctcgaagcggcagcgtccgggcacgcggatggacagcacgccgtcaccctgcacctccgggcggtccgtgggcgtccccagcgcggcgccggcctccttgacggccggacctccgaagctgagggagccttccacgcgcaacgtggacagcctcagctcggcgcgctccgccgacatgcggcggatgatggagctgccgggcagcacgtaggccgccgcggcgaaggagaccaggacagcgaggagtgcaacggtgcgcttcacggcttctccgtcttcacgacttcacgcatgtactcgagcagcccggcacgcaggtccggacgcttgagcgcgtaggcgatgttggccttcaggtaccccaccttgtcgcccgcgtcatagcgctgacccttgaagcggtagccgagcagccccttcgactgctggagcgtggccaggccgtcggtgagctggatttcgccgcccacacccggcgtctggttctccaggatggggaagatgtcgggcggcagcacgtagcggccgatgacggcgaggttggagggcgcagtgcccttcttcggcttctccacgatgcggtcgatgcgcatgacgccatcacccaggtccgtgcccgcggcgatgccgtacatgtgcgtctcactctccggcacttccatgagcgcgatgaccgcctggttgtactggcggtacacgcgagcgagctggcggattcccggctcctcggcatcaatcatgtcgtcgcccagcagcacgccgaagggctcgtcgccgatgacgctcttggcgcacagcaccgcgtggcccagtcccttgggctccttctgacggatgctgacgacgcgcacgaggtccgcgatggcgcgcagcttgtcggcctcggaatccttgccgcgcgcacgcagcgtcgtctccagttcgaagccgatgtcgaagtggtcctcgatggcgcccttgccgcggccattgatgaggacgacatcctcgatgccggcggataccgcctcttccacgatgtactggagcgtcggagtatcgacgataggcagcatctccttgggaaccgccttggtcgccggcaggaagcgcgtgcccaggccggctgccgggatgacacacttgcggatgaggggctctaccttcgaggttttggaggccatgagggctgggaatctattgatggcccctgaccccatcaagctggataggatggacttgtcatgttgctccgcgccttggtgctgattgccctttgtgtgtccactaccgctctggcgcaacccgccgaggaccttcgcgatgtcatgagcgcacgcgcctatggcatgggcggcgcctaccgtgccctggggctgggcacggacgccatcatgggcaatccagcggcgatggtcctctacccgtcctaccgggttgaaggcaccggcgcgtgggatacgcggcggaaggaagggttgctgggcgtctccgtcgtcgacgccgccacgagccgcctggggatgggcgtggactaccactgggtgagcgtggggcgcggcggcgcgcgcgccagcgcccacctcagctcgatgggcgtgggaatgcccatcagtcaggcgctcatgctcggcgccacggtgcgttatctgcgcatgagcggccagtcgcggttcgccaactccgtcaccggcgacgcgggcctgatactccggctgtcgccgtcactgatggcgggcttctccgcgcacaacatcgtggacactggcaatgaggagctgacgcgctactactcggcgcacgtcggggtgatgacggggctgctgacgctcgcaggcgacgtgcgcgcggacttcacgacgaacgacaccaagacgttcacgtaccacggcggtctggagtacatcctgggcgagctgttcccggtgcgcatgggctactcctacgacggcttcacgcggacgtcgcaaatcagcacggggctcggcttcatgtccgagggcggaggcggcctggacttcggctaccgccacgacctgggcggccccaaggggcgcatgctggcgctcaccatcaagctgaacatgaactgagtcagcgcggcgcccggagcggcaggtagcgctccgacgcggcgaagcgcagcagctccaccagctccgcctcgttgccccggcgggtccgcaggacggacagcgcggggccaatgctcccgcaggccaccaggcccgcgcggttggcggaatcccgcgcggcatccgcgagcgccgaagccttgaagttctgggtgccgggttccagcaaggccatcgcgcgctccagggcgcgcggcgacagggactcgcgcaccacgcgggcctcggctccggacgcacgcgggtccttcagcacggtggccagcagcgccagggcgcggaggagctggccccccttgagggcccggagcgcgagcaggtccggcgacagggacagcaaggcgcggcccacgtggaagcgcagctccgggagcggcatgggctcacgcagcaggagccggcccacgaggaggcgcgggtggcccgcgtgcacggcggtgaagggcgggccgtcgtcctctgcgagcacgagttcgggcaggtggacgtccagcatccgcgcggcggtgtgcagcgcgtcgagcacggcgggcgcgcaggggcccgcggtggcgcgcatcagctccgaggagccggcggcgcggccctccgctgggaacaggcggcagagcgcgattccggtgcaggccagcagttcgcccgagggcgtgcgcagaccggggtgacgcaggccagcgcgttcgtcggaggtcagcggtggacgctggccgcgcggcgcgggcgtttcgagcccgtcgagcgcattggcgatttcgcgcatgagcgaggcacgcgccgggtctcctcgctggtcgaagtactcggcgaggagtcgatagggcttcgcgtcgagcggacgctcgcggatgtgccggaaggcatcgggctcggtgtccggtgacggcacataggcgggcgcgggtgattcgcgcgggtccgtgacgccggggacaggccgaggaggctcgggcgccgcgggtggcttcgcgatgaacgtgcggcccggcgccggggcggaaaccgtgccctccgggcgcgcgcggacaacgcggcgcaccgggtccatccggccggggggcgcttcccaggagatgacgcgggtctccgggacgggggcatcaccgaggtccatgacctcgcctgtgatgaggtcggtggcccgagggcgctgggctcgagcctccgcgtcgcgagaagcaggcccttgctccacttcgcttccgnacncggcggcgcgtggcgcggccttgtctccgcgcgagggcgcgggggcgcgttgagcagccggcgccttgggggcaacggcggcgtccgcggactcagcgggagcgcgtggcggcggagcggctgtgttgcccggggatgaaggcgggttgcgggcctcgcccctgggggaggacgcggctgcacgtgcttctgccttgggaggcgatgcggcgaaggcttccgatggaacacgcggttcaccttgcgctggcgagacggtggcgcgcgccgcgcccttgggaagcggcgcatccgcgtcggaacgggcctcccgcctccccttccgccccgaagaagggacgggctccggcgaagccttgcggccctgctccaccgcggcgcccggggcatttctcccgacttcatcgcgggttggctccacgctttcggacgcggatggagcaaccccgatgtccgtggtggacgcatcctcgttggcgaggctctggaggtttccggacgattgcgtcagcaccgggggcgccgcgatgagtggcgcacgggggccgctcgactcacggcgaggagccgcggagcgcggcggctcggggggcggcacttcacgctctgcgcgtgcctgccggattccctccgcccggcgggcgtagacctgcgcgcgctcgggattgcccatcacctcgcgccacagacgcgcgagccggtcccaggtgcgctcccgctccgcctcgtcgtccatggcggtggccgcatgttccagggcccaagcggcctcgcccaggaggtcacgagcgaggagacgctccacgagcatcagccacgcttccttgtggcccggctcgtagcgcacggcctgacgcaactcctcgagcgcggcatcggcgtcgccctgggcatccaacgtggcgaccagctccagccgggcctgacgcgcggcgggccctcgggattcgcgggcgagctgcgcacgcagaagccggctgagcaccgtcgtgtcgccgagctttcgcgtcagcgtcgtgagctgcacgcgcgcctgctcactgtcgggactctccgtgagcacctcgctccaggcccactgcgcgagccgccaatcgctcagcgactcctccgcgacctgagccaggacacgcagcgcttccacgcggtccagcgcacggcggggtgccgccgccagtgccacccggagccgttccgcgatggacggacgttccgcgtccgacacacagcggagcatccccgcgagcacgggaagcagtcccggcgcggaggactccgccgcctcgaagtccgcgcgagccttcttcagctcgcccatgtggagccagcgctcgccccgtgtgagcagagcccccgcacgtgcgcggccagcgggcgcgcgccggatggcctcgtccagcgcacggcggacgagggatgcgtcccctctcgcggcgagcaaccgcacctgatctcgaagcgcggcgcggtcccccgtcagctccacgatttcccggtacatgcgagcggcgcccgcggggtcgtggagctcgttctccatcacctccgcgaggcgcgccaacgcatcggcgcgcagggacgcgtccttcgcccggtccgctcgcttgaggtagagctgagccagctcggcccaggcccgtcgagcgatgagctgagcctcgaccttctgcgagcgggtcagctcctcggtgtcttcttcacgaggccccgcgctcgcctcggaagcgcggcctttcttgttcgatgcatcgccagaagccgaggcgagcgctgcctccagctccgccaacgacacctccatggtgcctgagcgggcatccggctcgggtgcggcactggacgtgattcgaggtggcagcgcctcggacgggggcggggtcttccgccgctcgctcttcgaagaggcaggagtctgctggcgcggtggaggactcgatacatccgcgccgacgagaaagggctgtgcctccgaagtgacttcactttcgtcggcatcgtcaaagcgagcgacaggcgcaggcgcgaccgcgtcgtcgtctggggcatcggcccaaggcacgggcagtggcgcgcgccccggaacaaacgtcttggccacacctgaagacgggggcatggcgacgtcccctagcgcgggcatctccacttccgtcttgcgcgcctcgaagtcagatgcccccggtggaacaaccaccgccggcatttccacgacagtcctgggtgcttcggaagcagaggtaccgcgcggagtcaccgcgggtaattccaccgccggcatctccaacaccgtcttgagcgactcagtgggtggcgccttcacgggcggcggacgcgcatcggtatcgggcagcgcttcgccccccttggacgaagccgtcgcgctcacatcagccccaggcggtggaacggaaatcgacacaggcccacgttgttccgagacgggcggagcttccgcctgaagcccatccgcgccgcgcgcaggtgacacggccgcaggcgctcctccacccaccgctgggaactgcgacaccgaagaccgcgaacgtgcctccaccgcaccgaccgtggaagctgatgccgagaccgccctcgcggagagcggcggccccaccaccgtttcgatgaggtagacggcgtcgtcattctcccaagaggccgcggcctgcgcgccttctctccgcgctgggagcttcgccagcacaccctcctcgtcctcatccaccttcggggcgctcgcaccagcgtcaggcaccgccttgcccccgatgcgcgcacgcaacacctggagcacgcgccgggcacgccggtcctcgggccattccaccaggagggcttcgagcgcggcggcggcacgcggcagttggtccacccgtcgcagcacccgcgcgagctgacgccggaccgcgcgcctgctggagaccaccgtaggcgccacctccagcaaggtgatggccgccgcctccgtgcccgccagcagcgccatgcgcacaattccggcggccaggcgcggcgtcatcggcaaggtccggctggcgcgcgcaagctctccgaacgcacgcgcggcggagccctctcgcaactgccgggcc

SEQ ID NO: 1089 - DNA, 13346 bp, Myxococcus xanthus
gacgccgcgtccagctgccactccatgttcgatgtcagcagctccaccggacatcgtattccacttttcagcgacctgaaccaatcacacatcgccagctccaggctgcagatgcacgtgctctgacagcaggatccacttgtccacgcactccatcatggagtggggcgtctcgcgcgaaggaagccgggaggccagcggagacgtccaacgccaaatgggcggcgccgcatccatcgcataggtctggcccgggacgggggactccagcgtcaccgcctgggagctgtcagtgggccggccttgcgctcacctacacgcaggtcgcggacgaggcgcacaggctcgcggaggagctcggcgcccggctcgcgaaggccggctggcccgagcggcccgtcgcggtgatgctggagcgctcggaagccttcttcgtcgttgtcctgggcatcctcgagctgggccaggcataccttcccatcgaccccggactcccgccggaccgaatccgactgctcctgcgtgacagcagctgcgcggtgttcgtcacgcgagcctcgctgctcgccggcccttgccccgaaggcatcgagctcgtcgacctggatacgcagggccccgtcgcgccacccgggcggcgagaggagcggcctccgcgaggagccagtccgctggcctattgcatctacacctcgggctccacggggcagcccaaggccgtcggtgtgacgcgggacaacttgagcaacgccgtggcggtgtggcgccaggactacgggctcgttcgccctgtcgtcctgcagttggcgaacttcgccttcgacgtgtcggtgggggacctcggacgctccctgctcatcggcggcacgctggtcatcgccacggacgaggaacgcgtgagtcccgagcgcatcctgtcgctcatcgaacgccaccgggtgacgttcctcgagacaacccccgtggtggcgaatgccatccgggtgcacctcgaagtcatggaccagccgccccctccgctggaccttctggtggtgggctcggacacctggcggatgggagacctgcgcgccctgcgccgtcgcctccacgccagcacgcggctggtcaacagctacgggacgacagagaccacgattgacagcagcttcttcgagctcgacgccacggcttcgggaagccccatgagcgacgacgccatggcccccatcggacgcccgatgacgcacgtggagttcctcgtcgtcgaccccgcgggccggatgctgggcatcgggacaccgggcgagctgtgcatcgcggggccgtcggtgtccctggggtacctcggccggccggacctcacggcggaacgcttcgtcccgcacccgcgccacccaggtgagcgcatgtacaggacaggagacctgggcgtcctccggggagacggcaacgtcgccctgctcggacgcgcggaccagcaagtcaaggtccggggctaccgggtcgagctgggagagatagagcgcgtgctcctccagcacccggacgtccacgcgggggtcgtcctgttgctgggcagcggagcccaagccaccctggtgggctgcgtcatcggcgtgcccgaagaggcgctggcgggactcgagtcctggctggcggcacggttgccacactacatggtgcccacgcagtggctggcgcaggagtccttcccggccagcgccaatggcaaggtggaccggcgcgcgctccaggcggctgctgcgcatgcgcggcgcgcgcgtcaggcgcaggtgatgccgagcactccgcttcagcaggtcctgctcgaaggctggcgcgaagtcctgccgcaagtgcggagcctgagtgtcacggactccttcttcagcctggggggcgactccatccaggccatccagctcgtgctggcgctccgccgccgcggactggagctcagcgccgcggagctgttccgccaccccaccatcgagagctgcggcgcctacctcgagaccaggcaaggccagccggcgcgggcgctcgacctggcggcgtccgaggtcgacgcggtggtgcgccagcggctgctgcgcccgggagaccaggaactctacccggccacggcggtgcaggtcctcatgctcgaggcccatgcgcaccaccgccccgtggacgccgtctacctcggttacaccgtctgggagttcgaagacgaacggctggagctggccatcctgcgcgaggccctgctgcgccagctctcgcgccacggcgcgctccgcacgaccttcacgcgcgacaccgatggccggtggtaccagcgggtccggcccgtagcggcggtggagctcgcggagctcgacctgtcggaccggcctcgctccgcccaggacgccgacctcgacgagcgcgcccagagggagctggcgcgggacattctcgccgacgtcgatgctcccgcctgccggattctcctggtgagacgcggaccaggggcttgcgcgctgctcatgacgacgcaccacgccgtggatgacggctggggattgacggccttcgagaatgccctgctccaggactacgcggcgctgcgccgcggcgtggcgcttcccgtcccgccaccgcttccaacgggacgccagctcgtcgcgctggaggcagagcggctgcgcgacgagcgcgcacgcgcgtattgggcagacatcctccagcggctgccacctccgccctacgccacccgcgctcccgtccctccgtcccgctcccgcttcgagggcttctcgctcaccgtccccccagccacgcaagcgcgggcggcgcagagggcgcaagacgcgggaagctccctcaaggcgctctacctgtccgcgctgctccacgcactcgccgaggaggcgcgcaccgacacgtcgagcgcctgggtggtgatgaacggacgctcggaacgcctcgatgccgcgttggacgcggtaggcctcttctggagcctcgtccccgtcatcggaagcaacgtgggcactccgcggacacgcctcaaggcgatggatgaacagctccgtcaagcggagctgcacggcgcatggttcttcccggacctctttggggactgcctgggcgcgggcttccccgtctgcttcaacttcacgcacttctggaacgaacagccctcccctgagggggtccgcgtggccgcgcggcacatgcacaacgtgtggcacttccctttgactgtcacgctctcgctgaactccacatccggcaccgcgacgctccacgtcatgcatgacgccacgtcgctgtcccggccccatatcgacgcgctcctggagcgggtgctccaggctctcgccgaccgggagtcctcgccatgaaggtgatacgcgccctcctctcctcggatgccgtcacggcccacatccggcaggcctattccctggcggaacccatccaggcgcagctcctggccaccggggacaatgactcctatttgattgagtctgccggctggcgcggggtgtgccgtgtctactcactccggctccaaccgggcttcagccacgatgagcgccggtgcgagctggcctggctcctccacctcgccgagcgaggcgtccgcgtgtccacgcccgtgccacggcgggatggcgcgctgctcggcaggctcgacgccccggagggaatgcgagacctcgccctgttcacctgggcggagggagaaagcgccgcgttctccaacctggaggggatggagcgcttcggacagcggctcgccgagctgcacctggcctcgatgcgctttcagacgcgcctcccccgcatggccattgaccggaagcggctggtggacacgcccctggagcgaatcacgggcctcctccaggagctccggctggaaccggagctggcgcggctgcaggcgctcgccgagcccatccggcgccggctggattccttcccatccgatgaggcgagccacggcttcatccatggagactgcaacggtgagaaccaccacctcaccccagacgggcaggtggtgttcttcgacatggacctgagcggcccgggttggtttgcctacgacccggcggtgttgctgtggacgatgcgccgggccggcgtccccgcgcccgacatcgtggagagtggagcccggtgtatcgcgggctaccagcgggtccgcccccttgcgtcctgggagttggaggccctggatgacctggtgctggcgcgccacttctgggtcatgggcgagcacatcgtcgacatccccagcctgggcgctctcagggtcggccccagctactggcggctggccatcacccgaatcctcgaatggcaacaaacgcccctcgtccccttgattcgcgagcggctctcgcgggaaggcgctccatgaacgacccagtgaataccgaagcgacagcgcaccagaccgaagcgttccgaagggagggctacgtcgtcatcgagcaggcattgagcgacgacttccttgacgtgctgcgcgctgacttcgagcaggcgttgcacgcgaaggtcgcacgcttcgacctgaagcccgcgccccgggatgcgcgctgcgaggcgaacgacggcgttctgaatgacttccagcccgacggcggcaaccacgacttcaaccgctggaacatgcacctgccatcccggcgcccgtacttcgaggccatgctggttgacaaccctcgaatcaccggcgtcatcgaccaactgctgggaccggactgggtctactacatcatcgcgtccgacacgccctttccgaacgcgggcttccagacggcccatcaggactacacgcgcttcagcatcgccatcaacatcccgctcgtcgacgtcacgcccgacaacgggccgatggaggtctggcccggaacgcaccagccaccgtcggagggacggctcgcgccgttcaccaccggggcacaccgcatcgacgagcccacgctgaagtcgcttgtccggcggattccgtcacgcaagctggtgatgcgccgcggcgccgtgctgattcgcgaccaccgcatggtccaccgaggcacaccgaacctggcggacgcgccccggtacatgctctcgctgtactgcatcgccgcggagcaggtaccctaccggctcctgtccgacgccggcgccacgctggcgctgagcctgcgccggatggggcggggaagcggcgccgccgtccggcatcgccgcctcttcgacctgggcgccgtcctggggcgcgtggtcgaggagtgcagcctgagcgaccgggactaccgccgcaccttctccgcggagctctgggccagcctgggtccacgcgcccgtcaccacctccggttcgcgcgggtccagggcgaggaccgggtccgtggccagggcgacctgaaggggagcggggcattcctcaagcgctacgcccagtccatttccgaggccctccagcgacccgacgggcgcccgcggctccctgaccactacgcggaaggacggcctggaacggacgcaccttgaggcccatgcctctccgcccgtgggcacacctcagccctggcggacaagcacctcgttccccatgaagagcgcgtccatgtcgacggcggcgaagaagtcccggcactgcgcccgggtcgcgaagatggggctgccgcctgcgttgagcgacgtgttcaggagcatcggcaggcccgtgtgctgctggaaccgctccaccagccgccgggcggaggtcggcgcatctcgccccaccgtctggacccggcaggtgccgtcctggtggacgatggcgggaatctcccgctggcgctcagggcgcgtgggcaccgaacgaagcatgtagcggctctcctccgccaggtcgaaccactcgggcgtccgctccagcagcacggtggcgccgtagggccgccacgtctcacggtgcttgacgcggaagttgagccggtcctttccatcatgctgccgcgggtccatgaagatggagcggttgcccagcgcgcgcggtcccacctcgccccgcccctggaaccagcccacaatcttcccctgggccagcaactccaccgcctgcgcgatggtgctctccgtgggagcgtcctcgcagtcgtcctcctgccagtagggaaagccctcggtggagaagcgcggcagtccgagctggatgcggagcagctccaggcaccccagcgacagccccccgtcatacccatggggaggaacgaccagccggggatagcggaggaacagctcctggttgatgacgacgttctgcgcacagccccccgcgtacgcaatggccatgtccgggcgcgcgaagcgcgcgaagtgcgcctgcgtgtgagccgccagcaacgcgtggacggtcgacagccagtcccggaagctcgggttgtcgaactggaagaagtccggggtttcgatggggaccctgccgcgccaggggaccttgtcggtgaagtcatacaggcgctctccaagcgcctcgacgtcgaccgaacgaacgaagtcctggtccacctcgccatacgcctgcgcgcccatgaccttcccggccaggtcgctctcgtttcccggggtggcgctcaacttcatcagctccccgatgcgctcgaggagccgcccgaaggagcgcgtggcgttgtggtggacgagctccgggttccgcgctcccgggcgggcgatgaccgtcttgcgtgcctcgttgtctccccggccgtcaatggcgaagcccagctccagttcagccgtgtcggccacgggccaggtgctcaagatgtgcgcgtaatgatggtccacgcagtacgtgggggcgctccccagctccgccacgggggagaccttcttccagagttcgcccagcttgcacgcgccgagcccattgcggtccccatccgagaaggcaatcccatccaaccgggtgacgccccagcgctcgcacatctcccggacgaacgagagcgccgagcgatggtgcttgatgcccgtgagccgctcggacttcgcatagcggacccggccatccaccgagagggcaacgttgctgtcgtgaagaccaatatagacgccaagtaggttcatcgtgccgtagcccctgtcgggaaaaccccacatcgctggagcagcgcgcgcggagcacgcgccgaggaaagcggcctgacaccggcccagcgggccacctcggcctcgatgacgctcgcctgggcctggcctgagggaaaccgcagacgcagcggatccgagagaggcgcctgcggctcgaacgtcaagaaccggcggtagaagccacccatgatggcgtagtcccacgtccgcgtccccgaggcgatgccgtggagcaccgaggccgtcaccagggaatggaccgtggccagcgagctggcgccccgcgccatccgcggagggctcgccgtgaagtcgatacaccaggacagccgctcgtccgggaacacgacctcgagctgctggacgacgccatgttgctggtgaaggcgccagcacgtcgcgtcggcttcctccaggaagcgtggcaactcgacgtccatcactcgctccacggaggcgcggatggccgccgcttcatccggtgcgcagggcccatccaccaggcgcccatcgaagtccaccggacggtagtccagggacacgcgggcctccgggagccgccgcacgaaggaggcgcctcccgcgtcgaggcgaaaccctgccgctccgaactccagcacgtcccccgggtccatggggaacaccgcacagtccccccgggcccgcttcacgtccacgcagaagcgcgcgcgggacacggggaacaccacctggttcagccacgaggagatgccacagtagcgaaacccattggcgcccggaacgactgcccgcggctcgagcgccgccacgtgcccgagcagctcggcatagcgctggactggaaacgcgaccggcctgttccactggaagtccacctccagcatcggctgccaggaggccagaaacacgtcgagcgtcggagcgacctgccggaccgccgccacggccgacgcatccagcacggtatccacggcgttgaagcaggtgcccgtctcgtcctgaatcaccaggccgaactcacgcaccggcgcccgcgacggggtcgtcacgaagcgcgtgccccccacgaagaactccgtgagcggagccagcgcatggacctcctcgaagccgagcgcccgcaacgacttctcgagcaacgggtcctggggaacgacgacctgaacctggcggggcaggtgcgcgaggctccggatgtcgaagtggtcgagatgccgatgcgagatgaccagcacatcgagaggagggagccgtgcgtgcagcacctcccgggcgggatggacgtggaacagtccttcctggtgaggatcccacaggacagggtccatcaggacgcggcagtccgccgtctcgatgaggagcgatgcgtgcccgatgagcgtcagcctcatgaaggcagccctccgcgcccaggaaaggcgtccggcgggagctccttctggttgacctggaggtcccagtaccgcgcgtaacggcctcctcgtccaaggagctcctcgtgcgagcccgactcggcaatccgtccgcgttcgagcacgtggattcggtgcgcgtcccggaccgccgacaggcggtgggcgacgacgatgacggtgcgacccgccaggacctcggaccaggcgcgcaacagttgggcctccgtcacggcgtccagcgaggaggtcacctcgtcaaggatgaggatgggcctgcgcagcagcagggcgcgggcaatgccgatgcgctggcgctgcccacccgagagcttctgacccagctcgccggtgtgcgacgcatagccctggggtagctgcatgatgaattcatgcgcccccgccctctgagcggcctcctggatggcctcgagccccacgtccggcatgccgaaggcgatgttgtcccggatgctgccattgaagaggaagatgtcctgcccgacataggcgatggcccgccggacgtcgcctcgccgcagccccgcgatgtcctgctcatccagcaggatgtggcccgcgtccgcatcatggaagcgcagcaggagcttggcgagcgtgctcttgcccgaacccgtctccccgacgaaggcggtcatcttccccgccgggatatccaccgagaacccgtcgagcaccggcaggcccgggtgatacccgaagcgaacgtcctccacgcggatggcgccacgaacggcgcccgcgtccagcgcggcaccctcgtcccggcgctcgcggggcagctcaaaggccttgaacacacggctgagcgaggccagcgtcgacaagatgtgcggaaagtcgcgggccacgctgagcatcggcagggacaaggaggtgctcaggatgaccagcgagacataggtgcccggcgtgagatgccccctggacgcatggaaccccgccgccagcgcggtcaccatgcggagcgtgttcgccgcggcgagcaccaccgggttgtatgaggaatgaatttgggtcgccgcgtcctgctccccccggaagcccacgctcgcctcatccacccatcgggccgccatccgctcggcgccgaaggcgcggatggtgggaatcccatcgatgttgttgttgagcacgccctgaagcacgccggcctgctgccgcagcgcggcgtaccgggggcggatgcgcttctccagcgactgcgccaggagcagcagggcgggcatcggcactgcggccaggcccgcgaacccggggctgaccaggaagaagcccaccgtgctgcacgtggcataggcgacctcgttccagacgccccacgtcgaggagaagagcaactcgattcggttgagatcctcgttgagcagggtcaggtagttcccgcggctggtgtcggcgaacgccttcaattcaaggctctggacatgctcgtacagacgcagccgcaggtcatgggtgatgcggtgcgcggcgcgcatccagaggattcgggagacgtactcgaagaacgagcagccggcgatcagcgccaccaaccccgccgcgaccttccccagtccgagccgcccgatgggcaatcgccgcccgaacaacatcacccggtgcggagagagcaacgaatccgtgagcacccctaccagtgccacgtagcccacctgcatcgccctgctgaccaccgtggcggccatggcgagcaacaacatgcggtgatagggccgcgaggccttcagcaactctcggagcgcatggtcacgttgagtccgggtctcgtcctcgacgtcgtcgtccgccgcgtggatgaccgcggcgctggtaccgagcaacgcgccaatccctccccacacggaccagcggggaaagatgcgcatcgccgacccgaccacggagtgcacgacatacccactggcgctcaccgcgagcgccacgaccaggacacggatgcgtgggggcgcgttgcgcgtggactccagcgcacgcgagtccgtgtccggagcgatatcctccagcgcctcgcgaatggccgcgtcaacgaggtcggcgatgtgctcggcgcgcaggcccgctgcgtgctcgactcgcacgcgccccgtccaggagttggcttgcgcggaaagaatgtcacagcgctggcgcaggtagagctgcgccttccgcgccaacgcgcgattccggtggagaacgggcgtgtcccataggctccattccggagcaatgacataggccgaggtgacgtagttgcgcacgagccggtccaacccctgtcaagatggagcaaggaaggcgcgtccctgcgaaagcctcacagggacagcgtccacacgacctcgcacagtcctgactagccggaggacttcgcgccccctgcctgcgagaccgcgcctgccgactccacctcctgcttctgcgtcctctccagctcctgctgagcatcctcaatgctcttcacggcggagaccaatgccttgcgagcggcgttctggatgtagggacgcgacacgagcgccgcgacaccaccggcgacgaaaagaaccagcggacccatcataacctcactttcacgcgaatcagcaaaaaccacgaacctgacaacccatcctgtccagcaagaccacacaacaaacacaccacgacaaaccactgctcacgggatgactctcatcatccccttgagcagaagttgatccagcagcccccgttcggagagcgagcacccggcgagcaggggcccataggcatgcggttgcgacaagcgctccagcagcgccgagttcggacgattccagaggatgcggacggtatcctgatggtccccgtcctcgaagtagaagcgaaggcacgggctggggcgtccgaagcgtggggcgacctcgtgcgcgtgccgctccggcgactcccagtaggggccgtggtcgaatgcctggggccgagcgtccagcttgtcctcggcggagtcagcgatggggtgctccaacgtgacgctctggcggaacttcacattgggcatcaactgcacgagcgcgtcatccgcgggccgcaggcgctgcaactgagcgaaactcgtccgccaggcgcccgtctcgctcagcgcctctaccgcatcgttcccctggctgatgacatgcaacaggtcctcatccagagaaccattgaccaggtaatggaaggttgcgttccggacctcgaacgtcgcccgctcgctgcgctcacgccagtagacgctgccggggtgggccagggaaatctcgttgtaccactggtcgatggcgagcgagaacacctgcgcctgtttgcgcagcatctggtcatagtcatgccagaggtcctcacgatgctgctcgggcatggcctcgtcgaaggcagcccgcacgagcaccgccgccgcggccgtgtggtgcagggcgaagtggacgcccgtggagaacaacgggtccacaaagaaggcagcgtcgcccacgcgaatctcacgattctcccaggagcacatctggtggctgattcgcgagtagttggccgttgtcctgaactcatcgtagatgagctcggcgtccgccacgaggtcgcaaaggaagggcaccttccgggcggtctccatgaacacggagggggacatgtaatcgcgcttgctcttcaggccccgggggtcggtgaccaacccgagcgagtggacgacctccctcctgccgtccacctcgagcgggatggggatgtaccagaaccacccgtcctcgaacgcgaagcttcctatcggcgatacgccggactcgcggaagatgttccagtcccccgggagcgactgcgcgggcttgcccttgcggatgtagctccagatagcgatgttgcggtaggacgacaggaattcgcgcggccccccaagggatgtcaccgagtagcggcccgaggcattgacgaacaccttgcagcgggcactgcccttctcccccaggtcgacctccgtgaagccgtcgcggcggtagacctgcttgacgggcgtcccctcgaagacctccgccccgttctcctccgcatgacgcaagaggatgtcgtcgagctccgcccggttggcatggaatgcccagcggcggtacccatcccgttcgtaggctttgtgttcgaagaaggtggaccaggggcgcaccgcgtcccatgagtagtacccaccgcccttcttgatccaacagtcgctggacagcacgcgcccgagcgccccgctctcctgcagtgaggaaaccgcggaggggacaaaggactctccgatgtgctcacgaggaaatcgctcagattcgaagatggccaccgagaggccggggtccttccgcagacgcgcggcgagcgtggctcccgcgggtcctccgcccatgacaatcacatcatacagcttgccttcccaggctccgctcatgagcaactccatgcaccgaacacatccattggattgaagagggcgcaccggaaacaagagcgctcacgcacaggagcgcccctgaccaccgtgcgcctgcacgattgaccacacttcttcttccgtcagtgtcgacgccgcggacttggccctccggaggatctcctcgcagagctgctcattctcttgcaggccacgcaccatcagccaatacctgacgccgctcatcccgctcatcggcccgagttcgagctgctggcgccggccaaactcaccagcgggaacggatgaatagatgtggtcggcaagccaatcatccccccgctcgagcgccttgatgatggcggcagaatgaacgcccgtggcagtgcgaaacgcatcctcccccaccagcggatagttccgcggaatcggaacccggcagggctgggcga

SEQ ID NO: 1090 - DNA, 14462 bp, Myxococcus xanthus
gactcgtggttttggcggctcctggcccaggtgtcacggacgccggaccgggtggcggtggaggatggtgtccggacactcacatatcgcgaggtagaggtgctgtcggggcggctggcccggcacctcgtgtcgcgaggcgtgaagcggggtgacatcgtcgcgctcgcggtgtcgcagccggcggacgtggtcgcggggttgatgggcgtgacccgggcgggggcggccgtggtggtgctcgacgtggaccacccggcggagcgtctggccggcatcctcgcggacacacgggcccaggcgctggtcgcctccgagtcgtgccgtgcccgggttccctcgcgtgaggggctgacggtcatccccctggattccctgcccgaggcgaccgaggacgtgtgcggccttccggaggggacggatgcggcgtgcgtcgtctacacctccggctccaccggccggccgcgtggcgtggtgctggagcaccggcacctggtggccgcgacccaggcccgcgccgacgtgtacggcgagccgggggtggtgatgtccctggcacctttcaccttcgacgcctcgctcgcgggactgctgtggtccttgttcggaggcggcacgctgcgctacccggacgccgaggaacatggggacccgcgccggctcgccgagcggatcgcgcgctctcacgtcacgcacctcgtctccgtgccctcgctctacgggcagatattggcggcggcgccggtgggagggctgaggggcttgcgcgcggtgagtgtgggaggcgagccgtgtcccgtggagttgacgcgggcgcatcatgaggcgctgcccgcggtgtccctgttcaacgagtacggccccacggaagccaccatctggagcacggtgcaccgggtgcgtgtggacgaagaggggcgcgtgcccatcgggcgcgtggtgcctggggctcgcgtgtacctgctggacgcgcaccgcaggctggtgccgcggggtgcaccgggcgagctgtacgtgggcggcgcgggcgtggcgcgaggctacctgggccagcctgggctcacgtccgagcgcttcgtgatggaccccttcgacggccgcttgggcgcgcgcatgtaccgcacgggcgacgtggcgcgctggcgggcggacgggacgctggagttcatcggccgcgtggaccatcaggtgaaggtgcggggcttccgcatcgagccgggtgaggtcgaagccgcgctgctcgcgcatccggcggtgaaggaggccgtcgtcgtcgcgcgtgaggatgggaaggggccgaagcgcctggtcgcctacggggtgctcgcgacggaggggccgggtgagaaaccagacgcacaggccctgaaggagtgggtgcgttcgcgcctgccgccgtacatggtccccgcgaccttcgtcgcgatggactcgctgccgcgcacccggcacggcaaggtggaccgccgggcgttgcccacgccggatccggcctccgcggcggcgccggccgcgcctcattcggaggtggaagccacgctggtgtcgctctggcgggaggtgctgggcgtcgaacgcgtgggcatccacgacgacttcttcgagctggggggcgactccatcctgggactgcagattgtcacccgcgcgcgcgcgcagggcatcgagctgtccccgaagcagctcttccagaacccgacggtggcgcggctcgcctcggtcgcgggaacgcgcttggcggtgcaggccgagcaaggccccgtcgtggggccggtggcgctgacgcccatccagcactggttcttcgagctgggactggaggcgccacaccactggaacatgtccttgctgttggaggcgagagccgccctggacgccaccttgctggagcgcgcgctggcgcacctgctggcgcatcatgacgcgctccggctgggcttcgtgggcggggaggacggctggcaccaggccatctgcgagccaggcgcgcgcgtcacggtggcgcgcgtggacctgtccgccgtgccggaggcggagcgcccctcggcgctgtcgcggcatgcggaggctgcgcaacgcgcgctgcggctggatgggccgctcgtccaggcggtgttgctggagtggggcgcgggccactccacgcggctgatgctggcggtgcatcacctcgtggtggacgcggtgtcatggcgcatcctcctggaggacctagcgacggcgtacacgcggctcgcggcgggggacgccgtggtgctgcccccgaagacgacgtcgttccaggcgtgggcccgtggcctggaggcgctggcgcgctcgcaggcgctgacggcggagcgggcctggtggctggagcggccctggcgcgaggcctcccggctgcccgtggacttcacggggggcctcaacacggaggccaccgcgagcacggtgcaggtgacgctggagccagagcagacgcgcgcgctgctgcaggatgtcccgaaggcctggcacacgcagcctcaggagcccctgctgacggcgctggcgcaggcactgaccgcgtgggcgggaggggccgtcgcgctggtggacgtggaggggcacggaagggaagaggtgcttccgggcgtggatgtgtctcgcacggtgggctggttcacgcgggtgtttcccgcgctgctcgacctgcgggggacgacggggccgggcgaggcacttcgcgccgtgaaggaggggctgcgcgccgtgccgtcacgaggcatggggtgggggctgctccgctacgtgtcgagggacgcggcgctggcggccttgtcgttggcggaggtgggcttcaaccacctggggcagctcgacggtgtcgtgggcgagggggctcccttcgtcctcgcacccgaggcggccaccttgcggcagcgagccccgagcgcgcggcggccatacctgctcgatgtgacgggcatggtgcgtgacgggcggctggtggtcctctggacgttcagcgaggcggtgcaccgccgtgagacggtgacgcgtgtcgccaaggacttcctcgcgcgcctccatgcgctggtgcacgcatcgcgcgcgccggatgcgggagggcactcgccctctgactttccgctcgcgaaggtgaaacaggcgcagctcgacaagctggccgcacggtttggaaagaagacgcgatgagcgacaacatcgaggacctgtaccccctgtcgccgttgcagggcggcatgctgttccatgccatcgcagagcccggccgggggctgtacttcaaccagctcgtctgcgagctgcgcggccacctggacgtggcgctcttcacccaggcgtggaacacggtcgtcgcggcgcacccggtgctgcgcacggcgttcgtctgggatgacgtggacgagccgatgcaggtcgttctgcgtgaggtggacctgccggtccgcatcgaggactggcgcgacctgtcgcccgaagcacgcgagtcccggctggaagccttgctggcacaggaccgtcgcgagggcttcgacctgtcctgggcgccgttggtgcgcctggcgctgctgcgcgtcggcgatgatgcgcatcgcttcgtcttcagccattcccacctgatcctggacggctggtccgtaccgctggtgatccgcgatgtcctcgccctgtacgagggctcgtgtgcggggaagcagcctcgcatcgcggcgcctcggccgtatcgggactacatcgggtggttgggcgagcaggacctggcggtgtccgagtcgttctggcggcaggcgctcgaaggcttcgacgcgcccacgaatcctcgcgtcgagcccggtggcggggaagggacgggtaaggcctcgcgggagctgttcctgtcggaggcgctcacctcggagctgagccgcttcgcgcggaggcaggggctcacgttgcacaccctggtgcagggggcctgggccttggtgctcggtcacctgtgcggggcggaagatgtcgtcttcggcaccactgtctccggacgtcccccgggactggccggcgtggaggacatggtcgggctgttcatcaacacccagcccgtgcgagtgcggttgcctcccggtgcatcgttcgggccctggctggggcaaatccaggagatgcaggtggaggcgcggcagcacgagcacgcgccgctggtgaaggtccagcgctggagcggcgtgcccgctggcacctcgctcttcgagacgttggtcgtcttcgagaactatccgctggatgccgagctcacgtcctccgccagggccttggcggtgcgcgatattcgcgcggtcgaggcggaccacttcccgctgacgctcatctcgacgaacggccctcggcttccgctgtgcttgcggtacgaccgggcgcgcttctccgcggccttcgcggatggacagctcgaacgcattcgcctcgtgctggaggcgatggcggcaaggccggacggcgctctggggacgctgtctctgatctccgagcccgagcgtcaccagatgctcgtggcgtggaacgacacgcgcaccggcttcgcaccctgggccagcgtgcaagagcgcttcctggcgcaggtcgcacgcaacgcggacgcgccagcggtccggtgcgaggagaaggaggtgacgtacggggcgctggaagcgcgtgccaatcagctcgcgcaccagttgagagggcagggcgtgggggcggacgtgcccgtggcgctgtgcctggcgcgaggtgtggagtgggtggtggggatgctcggcatcctgaaggcagggggcgcgtatgtgccgctggacccttcgcagccagagtcccggctgcggatgctggtggaagaggtcgacgcaccggtggtggtgacgcaggcgcgatacgccgcgatcttcgaagggactcgcgcgcgccgagtggtggtggatggagatgccgcgctgctggagcagtggccttcagcggcaccgccgctcgtgacggtgcacccggagcagttggcgtatgtgctgttcacgtcaggcagtaccgggcggcccaagggggtggcggtcacacacgggcagttggcgaattatgtgcaagcggccattgagaggttgggtttggccgactgcgccagcttcgcgctggtgtcgacggtggcggcggacctggggaacacggtgctgttcccggcgctgtgcaccggcgggctgctgcatgtgttgacgcaggagcgagcgagcagtccgacgggcgtggcggagtacttcgctcggcatggggtggactgcgtgaagctggtgccctcgcacctcgcggcgctgatgagcggcgcggagccgaggctggtgctgccgaggaagcggctggtggtgggcggggaggcggcgtcgtggatcctgctggagcaggtgcatgcgctggcgcctgagtgcgaggtgtacaaccactacggcccgacggaggcgacagtgggcgtgttggcagggcgcgtggagctgccgcgtcggccgacgtcgccggtggtggtgccgctggggcggccgatgggcaacacgcgggtgtacgtgctggatgggggcctgcgtcccgtgccggtgggagtagcgggggagctgtacgcgggaggcgcccaggtgacgcgagggtacctggggcatccagagctgaccgcggagcggtacgtgccggacccgtacggcggggagcctggcgcgaggatgtaccgcacgggagacaaggtgcggtggctggcggacgggcgtttggagttcatcggccgggtcgatttccaggtgaaggtgcggggcttccgcgtggagcctggggaagtggcgacggtgctcagagcgcatcccgaggtccgggatgcggtggtggtcgcgcgcgaagacgtgcccggaaacaagcgactggtggcgtatgccacgccctcctcgcagccagcgcctgacacggcggcgctgcgcgcgttcctccagcagcggcttcctgggcacatggtgccgtcggcgctggtggtgctggacgccctgccgctgacacccaatggcaaggtggactggcgcgcgctgccgccgccagcgctgcccgaagaagcagcgcgagtcttcgaggggccgcgcaacgcgaaggaagagacactcacggccatctgggcgcaggtgctcgaccggccgcgggtggacatccacgagaacttcttcgagctgggtggcgactccatcatcgccatccaggtcgtctcgcgggccgagcaggcggggctgcacctccggatgaaacagctcttcgaccacccgaccgtggcggggctggcggcggtggcgggggaggcccctcccgtcgattctcagctcacggaggagccttcgtccgggcccgcttccggctttccgttgtcgggcctctccccggagggcttggaggcgttctccaagaggctggccgcgcacggttaccatctggaggacatcgaggacctttacccgctgtcaccgctccagcatggaatcttgatctcccatctccaggagagtgagacccagccgtacttcaatcagatctccttcgagctcgaaggcccactggatgcgcgcgccttcgtggaagcgtggcggcaggccgccgagcagtacgccatcctccggaccgcgttcttctgggaggggctggacacgccgctccaggcggtgatgcgcgaggtgctgcctcccgtcgacgtcgaggacttgcgccacctgtccgaggccgaccagaaggcccgactggccgcgttcttcgaggaggatcgccgaagggggctggtgctcacccgcgcgcccggcttccggctgacgatgcttcgcacgggagcgcgtgtgtggcgcgtggtgttcagcctgacgcacctgttgctggacgggtggtccacacaggtggtgctgcgggaggtcctcacccggtatgaggcactgcggcgaggcgtgacgctggcacgaagcgccgtgcggccgtaccgcgactacatcgcgtggctggggcgtcaggagcttggcgccgcgcgtgacttctggcgcggcgcgctggcgggcttcacgcagcccacccgcttggagctcggaagggcactgcgtgatgtgacgctcctgggtgaagtgctgctccggatgagcgcggaggagacggcggcactggaggccttctcgcgccagcagggcgtcacgggaggcacgctgttgcaagcggcctgggcgctgttgctgtggcgctataccggagaggacgacgtcctgttcgggttgaccgtctccggcaggcccccggagcttgccggcatcgaggcgatggtgggcttgttcatcaacgccatccccgtgcgagtgcgcctgcccgcgtcgagccccgtgggcccctggctgaaggggctgcaagcctggctccaggaggcgaggcagtatgagacgtcgcccctggtggaggtgcgccgctggagcgaggttccccctggccccgcgttgttcgagagcctggtcgtcttcgagaactacccccgggatgcgggcctcaccacgatgtcggacgagctggtggttcgcgacccgtacatcgtcgaggtggactcacatccggtgacgatgatggccgtcccggggcgtgaatggcagctgcgcctgacctacgacgccaggcgctttgatgcatcggcggcgaagcggatggtcgagcaggcccggcagctcctgcgcgaactgtgtggttcggagcgccggaccttgtctgagctgtcgttgatgtcggtggaggagcggcgcgtccttgtggaggagtggagcgggaggcgagcggagtacccgagggaggcgtcgctggcggagctgtttgaagcgcaggtggagaggaccccgggcgcggtggcagtggagtgggcagggcagcaggtgagttacgaggcgttgaatcgccgagcaaaccagttggcgcaccacctgaggggaatgggagtgggccccgaggtgcgagtgggattgtgcgcggagcgctcgttggagtgggtggtgagcgcgctggggattctgaaggcggggggcgtgtacgtgccgctggacgcgagctacccgctggagcggctggggtggatgaagcgggaggcgggggtggcgctgctggtggcgcaggagaagctggcggacgaagtggcgtcgggtagcgagttggtggtgtgcgtggatacggagtgggacacgcagattgccaggcagccagagacaaacccgggagcccgagtaggaggaggccacctggcgtacgtgatgtttacgtcgggaagcacggggaatccgaagggggtggcggtgccgcagcgtgcggtaacgcggctggtgttgggcggcggcgtggcggacttcgggccggaggaggtgtggctgcaattggcgccgacgggcttcgacgcgtcgacgttggaggtatggggcgcgctgctgcacggggggaagctggtggtgtacccggaagggccgctggagttggaggcgctggggcggaggctgaaggaggcaggggtgacgtcgctgtggctgacggcagccctcttcgagcagatgcaggcgtaccagccggaagcgctgagtggagtgaggcaggtgctggcgggaggagacgtgctgtcggtggggcgggtgagggagagagtgaggagtgggggcatcctcctcaacgggtacgggccgacagaggggacgactttcacgacagtgcaccgcgtcgcagaggaggaggtggggttgacggtgcccattgggaagccggtgggaaatacgcgggtgtacgtgctggacgaaggaatgcgtccggtgccggtgggggtgaggggagagttgtacgtgggaggagaggggctggcggaggggtacgtggggaggccggagtggacggcggagcgtttcgtgccgtcaccgtttggggagggggagcgggtgtaccggacgggggacgaggtgaggtggcaggagggtgggctgctggagtttctggggcgtcgggacgagcaggtgaaggtgagggggtaccggattgagttgggggaggtggaggaggcgctgaagcagcacgcgcaggtgaaggaagcggcagcggtggtgaggggagaggggcaggagaagcgggtggaggcgtacgtggtggcgccgggaggagagggaggggcgctgaaggagtacgtgaggcagaagttgccggagtacatggtgccgtcggtggtggtggtgctggaggcgctgccgctgacgcccaacggcaaggtcgaccgcaaggcattgttggcctccgacgcggggccttccgagccccgtcagcacatcgagccgcgtacggtcaccgagcagaagctgagcatcatctggtgtgaagtgctgggcatcgagcgggtgagcgcggacgctgacttcttcgagttgggcgggcactcgttgctggccacgcagctcatcgcgcacatccgctccgctttcggcgtggagttgcccctgcgcacgctcttcgcgtcacctgtgctcgaagggctcgcgctgcgaatcgaggagtcggcgcgggaagcggcggcgccgagcgtgccagcgctgacccgggtacctcgcatgggcgcattgcccgtgtcgttcgcccagcagcggctctggttcatcgaccagctccatccgggcagtgccagctacaacgtccccatcgtcctccggatcgagggctcgctcgatgtgagcgcgttgcagcgcgcgttctccgcgctggtggcgcgccatgagtcgttgcgcacgacgtttgcctcccacgagggccagcctgtccaggtcatccatccggccatggacgtccagctcgccttcgaggacttgagcacgctgccggaagtggagcgcgaggccgaattccgcgcgcgtgcgactcgaacagccctgcggccgtttcatctggagcgcggccccctggtgcgcgtggggctgtcgcggctgtcgccggacgtgcacgccctggtgctggtgctgcatcacatcgtctcggatggctggtcgctgggcgtgctggtccgcgaggtgggcgcgctctatgcggccttcctcgaaggacggtctcccgggttgccggagctgcccgtgcagtacgcggactacgcggtgtggcagcggcaatggctgagcggcgccgtgctggagacgcagctcgactggtggcggcagcagctgtctggcgcgcctcctcacctggagctacccaccgacaagcccaggccggcgacgttgtcgcaccgcggtgcatgggtgccggtgcggttgtcacggccgatgagcgacgccgtgacggcactggcccatgcggagggagccacgcccttcatggtgctgctggcggccttccagctcctgctgtcgcgctactcggggcaggaggacgtgctggtgggctcgcccatcgcgggtcgccggtacgaagagacggaggggctcatcggcttcttcgtcaacaccctggttctccgcgcccaggtccagcctcatgccaccttccgcgaactgctggcgcaggtgcgtgagcgcacgctgggggcgtacgagcatcaggaccttcccttcgagaagctcgtggagcatctgcaacccgagcggaacctggggcgcagcgcgctcttccaggtcctcttcgtgttgcagaacgccccggtggggccgttgtcgctgccctcgctgaccgtgaagccgatggggttgattgacaaggaggcggctcgcttcgagctttcgttgagcctgggggagactccacggggtttcgagggcttgctccagttcagcaccgacctcttcacggcggccacggcggagcggatggtgttctacctggagcaggtgctgaaggccgtcaccacgcggcccgaatcgcgcctctcccagataccgctgctgaccgatgcggagcgtcatcaggtgctggtggaatggaacggctcggcccaggctctccggtgggaggctgtccaccggtgtgtcgagcaccacgcagagcggacgccagaggcgcccgcggtgcggtgcgaggagcgggagctgacgtaccgccagttggaggcgcaggccaaccaggtggcgcaccagttgaggggaatgggggtgggcgcggaagtgccagtggcgctgtgcctggagcggggcgtggagtgggtggtggcgatgctggggattctgaaggcgggaggcgcgtacgtgccgctggacccctcgcaaccagaatcccgcctgcgcgcgctggtggaagaagtggccgcgccggtggtggtgacgcaggcgcggcatgcggcgactttcgagggactgtccgcgcgccgggtggagatggatggagacgcggcgcggctcgaggcgcagccgacggaagcaccgcgggtagaggtgcaacccgagcaactggcgtacgtgctgttcacatccggaagcacggggcggcccaagggcgtggcggtcacacacggacagcttgcccactacgtggaagcggcgaatgcgcggctggggttggcggagtgcacgagcttcgcgctggtgtcgacggtggcggcggacctgggaaacacggtgctgtacgcggcgctgtggacggggggactgctgcatgtgctgacgcaggagagggcaagcagcgcggcgggagtggaggagtacttccagcggcatggggtggagtgtttgaaggtggtgccctcgcacctcgcggcgctgatgagtggcgccgcgcccgggcaggtgttgccgacgaagcggctggtggtgggaggagaggcggcctcgtggagcctgctggagcaggtggcggcgctggcgcccgggtgcgaggtgcacaaccactacggcccgacggagacgacggtgggtgtgctggcggggcgagtggagctgccacgtcgagcggagtcacccgcgacggtgccgctgggacggccgatgggcaacacacgggtttacgtgctggaccggagcctgcgtcctgtgccggtgggcgtggggggagagttgttcgtgggaggggcgcaggtcacgcgagggtacgtatggcgcccggagttgacggcggagcggtacgtgccggacccgttcagcatggaggctggagcgaggatgtaccgcacgggggacaaggtgcggtggttgggggatgggcgactggagttcatcgggcggacggacttccaggtgaaggtgagagggttccgggtggagcccggagaagtggcggcggtgctcagagcgcatcccgacgtccaggacgcggtggtggtcgcgcgagaagaggtgcctggagacaatcggctggtgggctacgccgttcgtacggccagggcggctccggacatcgcggccctcaggggcttcctccagcagcggcttcctgggcacatggtgccgtcggcgctggtggtgctggacgccctgccgctgacgcccaatggcaaggtggactggcgcgcgctgcccgtgccgaacgtgtcggcgcgtggcccggctcccgcctatgaggcgccggcttcccccatggaagagtcgttggccgctgtctgggcccacgtcttgcgggtggagcgggtgggccgggaggacgacttcttcgcgtcgggtggtcattcgctactggccacgcaggtggtggcgcgtgtgcgtgcggtcctgggcgtagaggtcccgctacgcgccctcttcgaggcgcccaccttgcggtcctttgcccagcaggtggagcaggcgactcgaagtcagacgctgctcgcgctgcgtccgatgcctcggggggaccgggtgccgctgtcattcgcgcagcagcgactgtggttcctggatcggctgaagccgggcggtaccgagtacaacgcaccgtatgtgctgcgggtggagggccccctggatgtttctgccttggagcgagccttctcggagctggtgcgccgtcatgaagtcctgcgtacggccttcccggatgaaggcggagcacctgtccagcgcatcgcttcgccatcgccggtccacctctccgtggtggagctgggcgcccaggatgagtccgaggtgcggcaccgggtgcgcgcggaagtcgaccgcgcattcgagctcgcgcgtgggccgctgctgcgccccctgctgttgaagcagtccgagcaggcgcacgtcctcgtgctgctgttgcatcacattgtctcggacggttggtccgcgagcgtgctgcttcgggagttggcggcgctctacgacgcgttctcgcaagggctgccgtcaccattgccggagctgcccgtgcagtacgcggactacgcgctctggcagcgcgagtggttgaaggacgaggtgttggaatcgcaggttcgctactggcgcgaggtgctggcgggcgcgccgcgattcctggacctccccacggacaggcctcgccccgcggcgcagacctttcgaggtggaatccagcggcagatgtggccgaaggcgctgtggcggcaagtggaggcgaccgcgcggcgagaaggggccacgccgttcatggtgctgctggcggcgtatcagacggtgttgtggcggctctcggggcaggacgacatcagcgtgggcttccccatcgcgggtcgcacgcaggccgagacggaggggctcatcggcaacttcgccaataccctggtgctgagggctcgcgtacgtcccgagctttccttccgggacatgttggcgcaggtgcgtgaggtgaccctgggcgcctacgcgcaccaggacgtcccgttcgagaagctggtggaggcattgcagccggagcgggacctgagtcgcagcccgttgtttcaagtctccctgacacttcagaacacgcctgtgcccgaagtgaagctgcgacagggattgtcgctgacggtgatggacgcgcggattcagacgtcgaagttcgacctgtcgatgttcgtcgtcgagctgccggaaggtgccgccgcgtcagtcaattacaacagcgacctgttcgaggcgaagacggcggagcggctgctgaggcagatgtcggtgctgctggaggccgcggtcgcgaatccggagacgcgcctgggcgagctgtcgttgatgtcggtggaggagcggcgcgtcctggtggaggagtggagcgggaggcgagcggagtacccgagggaggcgtcgctggcggagctgtttgaagcgcaggtggagaggaccccgggcgcggtggcagtggagtgggcagggcagcaggtgagttacgaggcgttgaatcgccgagcaaaccagttggcgcaccacctgaggggaatgggagtgggccccgaggtgcgagtgggattgtgcgcggagcgctcgttggagtgggtggtgagcgcgctggggattctgaaggcggggggcgtgtacgtgccgctggacgcgagctacccgctggagcggctggggtggatgaagcgggaggcggggggggcg

SEQ ID NO: 1091 - DNA, 12194 bp, Myxococcus xanthus
  unsure (1)..(12194): unsure at all n locations
cgtgccccgctgaagacggcgcgccttgcccagacgtggggcatccgcgcgaggacggcgcggcgtgggcgctcgcttgcctgcgggcagaatggggtcgggacacaccgcgcggagcttgcatgacttgcactcggcgccgctccacaccgcttcgtagagcgccgtcacccggtcgatgacgtcgaagtcctcggtgacgaagcccagctcgaagttgcgcgcggagtcgcccttggcgcccagccccgcgccggtgaggttggcgctgcccaggtatgcccaggcgccatccaccaccaccgccttgaagtgcacgcgcggacagaccttgagcgacaagccccccgccaccagccgcgcctgccggtcgaaggcggcgcgaaagggccggctcggcagctctgcgtgcaacagccgcagcgccacgccacgcgcggcgagcgtgtccagcacgtccaccagcgggacgaagcggccaccgtgctccacgaacatcgccttcacgttggccgtggccatccacaccgactcccgggcgtggagcagcttctccaacaccacctcccggtacagcgcgctgcccgacaggagctccgcctcgatgggacgcatggagcgcactccatcacacatgtcctcacccagccacctgacggacaaatgaccttcagtcacttgacgaatgaccgtgggtcattcatccatgagccatggccagcacctcagcggcgaaggcgaatcgggccctgccccagcgagctcggaaggacgaggacaaggaagcgcggcggcaactcatcctggatgaggccctggccctgtatcaggcgacgtcctatgccgaggtgaagatggcggacgtggccggccgggcgatgctggccaagggcacggtgttcctctacttccccaccaaggaggcgctgttcctggcgctgctggaggacctgctcttcgcgtggttcgcccggctggacgggctgctcgtggaggactcgtcggcctggacggggccccggctggcgcgcacggtggccgagtcgctggagggcgaggaggccctgacgcggctgctcgcgcggctgcagacggtgctggagcagaacgtgacggccgagcagctccgcccgttcaaggagcggctgctggcggcgctgctccgcgcgggcacgctggtggagcagcggctgcccttccttcatgccggagaaggcccgcgcttcttcatccacctgcacgcgctggtgacgggcctgcggcagatggcggacgtggccccggtggcgcgcgaggtgctggaggcactgccccacctggcgcccctgcgcgtcgacttcaccgccgagctgacgaccgccctcaccacccttcttcgcgggctggagtcccgctgagcctcctttcccatcctctggagaaccccatgctcgaagcagcgtctcaagccaacacgcagcccaccgcggacaccgagcgcatccgcgcggtgttcgaagcccagcgcgcgcaccgctggacgatgtcccgcaccacggccgccgaacgcatcgcccggctgaagcggctgcgtgaagccatcatcgcccgccgcgcggagctggcggacgccatccacgcggacttccgcaagcccgcgatggaggtggacctgacggagctgcaccccacgctggaggagctgaaccacacggtgcggcacctcaagtcgtggatgaagcccatgcgggtgggcacgccgatgctgcttgcgggctcgtccagccacgtgcgctacgaggcgcgcggcacggtgttgctgctgtcgccgtggaactaccccttcaacctgctggtgtcgccgctggtggccgccatcgcagcgggcaacaccgtcatctgcaagcccagcgagaagacgccgcacacctcgcgcttcctggcgcagttggtgaaggacgtgtttcccgagaacgaagtggcgctgttcgaaggcggcgcggagacggcggaggcgctgctggagctgcccttcgaccacatcttcttcaccggcaacacgcgcatcggccgcaaggtgatggaggccgcggcgaagcacctggccagcgtgacgctggagctgggtggcaagtcgcccgtcatcgtcgatgagacggcggacgtcgccgccgctgccgagcgcctgtgctggggcaagttcgtcaacggcggccagacgtgcgtggcgccggactacgtgttcgtgcacgcgtcgaaggagcgggcgttcctggacgcgctcaaggcgtccatcacgcgcttctacggcggcaccgagcaggagcggcaggcgagccctgacctgacgcgactggtggacccggtggcgtggcggcgggtgaaggacctgctcaagcgctcggtggccgcgggagcgaaggtggaagtgggcggggagacggacgagccctcgcgctacatcgcgcccaccgtgctgtccggcgtgacggcggagaacccggtgatggagggcgagattttcgggccggtgctgccggtgctcaccttccagtcccgtgaagaggtctacgcgcacatccgcgcgggcgggaagcctttggccctctacgtgttcagccaggacaagcgggcggtggaagacatcttccagaacaccacgtcgggtggcgcggtggtgaacaacgtgctcgtccacctcgcgaaccccaacctcccgttcggcggggttggtaccagtggcctggggaactaccacggtcatttcggcttcaagacgttcagccatgagcgggcagtgatggttcagtggatgaagtcgctggcttcggtgttcttcccgccgtatcgcgggaaggcgcaggaattggcctcccgcgcgacccggctgatggagtaggcaaccctggccggggcacctccggaaggagccgggcgatgcgcgtggtgaagttggaagaagcacggatgccggacggtgtgcaggaggcgttcgaccgcctccatgcgcatcgctgggaggtggcgcgccgcggcatgaaggaacggctggcccggctggagcagttcaagacgctgctcgtcgcccggcgcgaggccctggccgaggcgctccacgccgacttccgcaagccgcgcgcggaggtggaggccaccgaggtcctccccgtcctgatggagttggcctccatccagaagcacctcaagacgtggatgaagccccggaaggtctccacgcccctgctgctcaccggcacgtccagcctggtgcagtacgagccccggggcgtggtgctggtgatggccccgtggaactaccccttccacctgctggtgtcgccgctggtcgccgcggtggccgcgggcaacgccgtcctgtgcaagcccagcgagaagacgcccaacacggcgcgcttcatcgcggagctggtgaaggatgtctttcccccagaagaggtcgcggtggtggagggaggcccggaggtgggcgaggcgctgctgcggcttcccttcgaccacatcttcttcaccggtggggcccgcgtgggccggcgggtgatggaggccgcggcgaagcacctggccagcgtgacgttggagctgggtggcaagtcacccgtcatcgtcgatgagacggcggatgtcgccgccgctgccgagcgcgtggtgtggggcaagttcctcaacggcggacagacgtgcatcgcccccgaccacgtctgggtccacgcgtcgaaggaagaggccctgctggaggcgatgaaggaggccctggagcgcttctacggccgcaccgaggaggcgcgtcgcgcgagcctggacctgtgccgcatggtggatgacagcgccttcacgcgggtgcgccagttgatggaccgcaccgtgcaggccggcgcgcgcgtggtggtgggtggtggcgtgggcgcggagtcgcgttacatcgcgcccacggtgctcgcggacgtgacgccagacacgcccatcatggccgaggagattttcggaccggtgctgccggtgctgcgcttcgagtccctggacgaagtcgtgtcgcacgtgcgcgaggacggcaagcccctggcgctctacgtgttcagcaacgacgaggccacggtggagcggctgctgcgggagactcgcgcgggcggcacgtgcatcaacacggtggtgctgcacaatgtgaatccgaacctgcccttcggcggcgtgggcgccagcggtgtgggcgcgtatcacggcgagacgggcttccggaccttcagccacgagcgcgcggtgctgcgccaggggcgcacgtccctggtccacctgttcttcccgcccttcacgggcaaggcgcagaagctggcgcggctggcggggcggttgttcgaataggcgtgaaatgagagatgctccggtccgtaatgcctgagacctctctcgcgaaagacgcctgctggtgagccgcacatgacagacccggggtcgccctcccctctgacggtggtccccggtggtgacgggggcttcctgtcgcgcctgcccacggtgctgcaaccgcaccgcagcctgctcacctactacctcgtcagcgcgctgctggccgggcccggcttccccatcctcgggctcatccgctacttcaagtaccagacgctgcgctacacgctggacgacgaaggcatcaccgtccgctggggcatcctcttccggcgggaggtatccctcacctacgcgcgcatccaggacatccacttgtccagcaacctggtggagcgctggctggggctggcgcgcatccaaatccagacggcgagcggcaactcgcaggcggaaatcaccatcgagggcgttcccgcgcacgaggcgatgcgggacttcctctattcgaagatgcggggaagccgcgagcgcgcagtgcctacgcaagagagcgcacgcgccatgcccgccggtgaccatgacgcgctggcggccacgctccgcgagattgccgaggaggtgcgcgccctacggctcagcctgaacagcggcgccacgcgggagaagcaggatgtctgacgccgcgcctgcctggctcctgcgcctgctgaaggtgccccccgcgccgcacatccccgaaggggcggcggttcgcgtgttccgcgccgccccgacccatcgccagctccagttgctccgttggggcctgcggcaggccggcgtcgtggtgggcctgattttcacctgggtggcgatgaagaaccggttcgtcccgcacctgccctacgcgcatgcggacacggtcttcttcgtcttcgaaatgttcgcctggctcgcgttcgccgcgcaggcccccatcaccttcctggtggcgtggctcgactacgagtaccgctggtacatcctctccgaccgcagcctgcgcatccgggaagggctcgtctccatccaggagaagacgatgaccttcgccaacatccagcaggtctccatccggcagaacccgctccagcggctgttcggcatcgccgacgtgaaggtggagacggcgggcggaggcagcaagcgcggcgcgcaggacgcggacgcctcacacaccgaaggactgcacgaggcccacttccggggcgtggacaacccggaggagattcgcgacgtcatcatggcgcgggtacgcatgcaccgggacgccgggctgggtgagccgcagaatcccgagccggcgctgcccgcgccagtggccccttcagccgcgacgctcggcgcggcgaaggagctgctgggtgagatgcgggcgctgcgaagcgccctgacggcccagggccacgtggagcgctgagccgccgtgaagcgcgacgtgcccggcggacgccgggccccttgcggtgcttcagctccgcagaccgggcgcttcctggccggtgcgcgcgacgtactccgtgtagccgccgccgtactggtggatgccctcgggcgtcagctccagcacgcggttggacagcgcggccaggaagtgacggtcgtgggagacgaacagcatcgtcccctcgtagcgggagagcgccgtaatcagcatctccttcgtggccatgtccaggtggttggtgggctcgtccagcaccaggaagttcggcgggtcgaagagcatcttcgccatgacgagccgggccttctcaccaccggacagcacgcggcacttcttctccacctcgtcgccggagaagccgaagcagccggccagcgcccgcagcgagccctgacccgcgcgggggaaggcgtcctccagcgcctggaacacggtccgctcgccgtccagcaggtccatggcgtgctgcgcgaagtaacccatcttcacgctgccacccagcgccacgttgcccgtgtccggctgcgtggagcccgtcaccagcttcagcagcgtggacttgcccgcgccgttgacgcccatgacggcccagcgctccgtgcggcgcaccaggaagtccagcccctcgtagatggtccgcgagccgtaggccttgtgaacgcccttcaggctcaccacgtcgtcgcccgagcgcggcgccggctggaactcgaagagcaccgtctgacgccgcttgggcggctccacgcgctcaatcttctccagcttcttcacccggctctgcacctgcgcggcgtgcgaggcgcgcgccttgaagcgctcgatgaacttcagctccttggcgagcatggcctgctggcgctcgaactgcgcctgctgctgcttctcgttcatcgcccgctgctgctcgtagaactcgtagttgccggtgtacgtcgacagcgagccgccgtcgatctccaccaccttgttcacgatgcggttcatgaactcgcggtcgtgcgacgtcatcagcagcgcgccgtcgtagttcttgaggaactcctccagccagatgaggctctcgatgtcgagatggttgctcggctcgtcgagcagcatcgcgtccggacgcatcaggaggatgcgggccagcgccacgcgcatcttccaaccacccgacagcgcgcccacgtcgccgtccatcatctcctgggtgaagcccaggcccgcgagaatctcccgcgcgcggccttccagcgcgtagccacccagctcctcgaagcgcccctggaccaggccgtagcgctccacgagcttgtccatgttgtccgcctggtccgggtcggccatggcggcctccagctccttcagctcggcggccaccgtgctgaccgggcccgcgccgtccatcacctcggcggcggcgctgcggccctccatctcacccacgtcctggctgaagtagccaatggtgacgccccggtcgacggcgacctggccctcgtcggggtgctcctggctggtaatcatccggaacagcgtcgtcttgccggccccgttgggtccgacgaggcccaccttctcccccttgtggagcgccgcggaggcctcgatgaagagaatctgctggccgttctgcttgctgatgttgtcgagacgaatcatgtgcgtgcggggggcccgaaagcgggtgcggcgcccttatgccacgtagcccgccccagaaagaatgttccgaacccttgggaagcgacttctcttgcatgggagccgacaggcgggggagcccccggtcccaggctggaagtgggacctgcccccactcgggccgtgacatagactgccgcgccgtgctgaccgtcgacgcccacccctccctgaacaccctggccttcaccaccaccttccccggtcccctgggcgggctgccctccccggagtggctggtggccctgctgaagcccggcgccaccgcccccctgtccagcgacgacaccgtgcgcggcgccatccgcgacatgctccgccacggcggctacaagcccaccgggcgtggcaagcccgcgtcggagtacctggtgcgcgcctcgggtgacggctcgctgggcgccatcaacctggccgtggatgcctgcaacgcggtgtccctgcacagcggcctgcccatcagcgtggtggacctggaccgggccaccgcccccttccgcgtgggcgtggccccggagggcgcgcagtacgtcttcaacgcgtccgggcagagcatcgacctggcgggactgctgtgcctcttcgacgcggaaggcccgtgcgccaacgccgtcaaggacgcgcagcgcaccaagacgaacgcggacacccgccgcaccctcaccgtgctctggggcgccaaggccctgggcgagcggaccgcgcgcgccttcgactggtatcgggagctgctggaacgcgcgggggccacggtggagcgcctgccctgagccgcgcggacgcccttgaaacatgccggccgacggggcagacccgggccatggcgggacggcaatccagcaggtgggtgctgctgctcgtgtggcttcatgcggcgagcgcggcggcgcagatcgtcaacgtccaggcgctgttcgacgagaacaccggcccggggcgttcggcggccgtggacctgggcgcggactggcgcacgggcagcaccgacctcttcagcgtgcgcggcgccctgctgggccagtggcgcagcgagaagcacacctggctggccgtcatccggggggagtacgccttcgccgccaatgaggtcatcgtcagcaaggtgatggagcacgtccgctaccgctacggattcacggagcggctctccggcgaggtgttcctccaacacgagttcgacaagttccgccgcatccagttccgggccctgctgggcgcgggcccccgggtgagggtgctgaccgacaaacaggccacgctggtggtggggctcgcgctgatgctggagcacgagcgcatccgccgggattccgaaccggatgccggggagttccgcaccgacccgcgcctgtccagctacgtgctggggcggctggagttcatggagaacgtcttcctggtgcagacgctctacgcccagccccgcgtgacgaaccccgccgacatccgcctgctcaacgacaccatcttcgaggtgaagcccaacgaacgcctctcggtgggcatcggcttcaacctcaccttcgacaactccccgcccctgggcgtccccaagctcgacacccagttgcggacctcggtgggcatccggctgtagccgccttcgtcccacgaagtgggccacccaggcgacagcagccagccctcgcctgcctccccgcccatgccgggcgacgccccggttgttggcaactgtcttgctacggtgcctcgcagggcaacaacagggtggcgaggccggcgatgacggagctgtacgtggagcgcgaggacacggtggcgaaggcagtgacgctcttccccaaggacacggtggtgagggcactgtcactgatgcagcggtatggcctgagccggctgccggtggtggacgacgtgcacggcgagctcatcggcgacgtgacggccgacgacctcacccgggtctggcagcacgcgccgctggcctgtatgtcggaaattctttcactgaaatccctgcgggttgaagacctggaggacgccacccgttgggggccgcgcctcaccctggtctcccccctggtggacgtgtaccagaccagcaaacgctgggtgcagtaggccggaaggcccgaatcccgacggcgctcagccgatgccaggcgtgagcgccttcatccacaccaccacggccgcggcgcccgcgtccggcacaccgacggcgcgcgcacccaggtagctggcgcgtcccaggcgcggctgcatccgggacgtcgcctcctcttccgcctcggncgcgtgcaccgccgatgcccaagcctctcgagccccctgcccgcaacgcaccgccttcgcgaaggcgtcggcggcgggccggagtgcatcgagcatggtgcggtccccaggccgcgcgccgcccagctccgatacggcggtgacggcgaggtcgaaggcctcggcccatgcggcggcatccacgggcccttccgccagcctgcgcgcggcgcgcagcagcgccgtcgcgtagaagggccccgagctgccgccaatgctgcgccgcaaggcattgccaatggccgtcagcgcacgcgcggggctcgtccacgcgtcctccggaagagcgcgaatcgcctcggcgccacgcaccagactgaggcccaggtcaccgtcgcccgcggcgctatcgagcgcggtcagccggggctccgactgctcgaatgcgtccgccacccgcaaggcggccttccggaagcggtccatccccggttgcggcgcctccgccggaagcgatgctggagacgccgtggacgaaggccggtacacccccggctccttcggcagccgtcccgcgccgggccacgcgggcgcatccaccgccgcatccaggcgggccagccgcgcgtcgtccaccttcagcagcgtcaacgagcagccgggcatctccagcgcggagaggaacgtcccgctccacgcgcgctccacgcggatgccgccctgacgcagagcggccagtgcgcgccgggcgacgatggccagctccatgggcggcgtgccgcccaatccgttgaccaccagcaccaccctgtctcccgaggtgatgcgccggtcctcgacgatggtggtgagcagcgtgtccaccaggctgtccgccgtctgcatcggcacgcgccgcacgccctgctcgccgtggatgcccaggcccagctcgatttcgtcctcctccagcgtgaagcccggcttgcccgccgcgggcacggtgcagggccccagggccacgcccatggtgcccagcacctccgccgccgcggtggcctcgcggaggacgtcctggagcgccgcgcccgcctcggccgccgcgcccgcgaccttgtggaccagcaccgtgccagcgatgccccggcgccgcgcgggctccaccgtgtcgtgcagggacacgtcgtccgccaccaccaccgtctccacggggatgccctcggcgcgcgccagctcggcggcgagcccgaagttgagccggtccccggtgtagttcttcacgacgagcagcgcgcccgcgggccccgcgacggcgcggatggcggccagcacggcatcggtgctgggcgaggtgaagacgtcaccggccaccgccgcgtccagcatgcccgcgcccacgtagcccgcgtgcgccggctcatggccgctgccgccaccggagatgacagccaccttgcgcgcgcggacgtcggaaggcgtgtcggcgcggagcaccaccgactccccgtccagcagcacctgcccgggggcgagcgagaccaacccctccagcatctcccgcaccaccgcgcgaggggcgttgaccagcttcttcatgaacgtgtcctctctcagacgccgttgaagaaatcgacagcgcccgtctccagcgagtactcggcgccgacgatgagcatgccttcctcgcggcacagacgctccagcaggcggctgccatggcggagattgtcgcaggagttgcggatgttggcgcggacggactccttcatcaggaactccgggtccgccttcggcccggcggcgctcaccaccgtcgccaccggctcgcggcagcgctccacgatgtcgcggatgttctcggacgcctcgctcttgccgtcacgcaggtagtccagcgtggcctggatggcgccgcagtgcgaatgccccatcaccaccgccaggcgcgtgccgaacttcgccgccgcgaactccacactgcccaccagcgacggcgcgacgacgttgcccgccacgcggatgacgaacaggtcccccaacccctggtcgaagatgtactccgacggcgcgcgcgagtccgaacacgagaggatgatggcgaagggactctgccccgccaccagcgcctgccgggcggagcggccgagcgggttctccatgttgcgcgcgttcaggacgaaccgctgattgccctcccgaaggcgcgcaagggcatcctgggcggagatgggtggcgtcgaagcggtgggcattgcgcgggtcctcgagggtgggtgaatcagaaaggtggcaacccaaccgagcgctatacaccagccgggtgaccaaggaacgagctgtcctcctgcttcgacgcgggagttcagccgtcagacacccagctcgtcacggatgtgcttcacgatgtccgctggcgggcgcgtcacgtccacgctgagcgcgcgcgagggcagctccatggccgccatctgactctccagca

SEQ ID NO: 1092 - DNA, 13631 bp, Myxococcus xanthus
tccagtgtgctctaaagtcctggccatccacccgcgtctgcaactggagccgggccagctcgccgggagagtagcgctgcttgtccggcgtcacctccacggagagctgcgcgcgcggcgccacgtacacccgcccctgcgcgccctcccagtacgtcatcgcccagccctcgaagtcctcgggcagcttgaagcggaccgagcgcgtcgccttgtccaccttctcttccattcgttggttgcccgcctggagcaccagggtgccgggcagcgggccctcgaactgggggccgcgcatcagctcgatgcggacctcctcgccgccgcgcgccagcaccggcgtggcgcgcaggcgcgtaggtggcacctccgccggacgcagcaccagcttcgtttcgcccacgacctcaccgccctgcgtgccgctcaccttcagctcgtagcccaggaaggtggtggcctgggcgacgtcctggtgctccattccggcggatggatgggcggtgaggtacgccacgcccagggcattctccgtccgcgccgattctggcagccggacgcgcgcgaagcgctcctggacgcaaggcagggctgacgcggccagcgagcccgactgcttcggcagcgtcacccaggtcagcgactccaggcctcgcttccccagccgccagctcaaggccgcagacaacggggcttccatgcccaggtcccgaggcagacacgtgcgcgcatcacgggccgcgtcggccagagccgccaccagcgattcaggcgcgccataggccgactccacctccacggccaactccggcagacccgggtccatgacgctcaggcccacgtggaggacccgctctcgcccagcgggcagcgtgcgtgagcgcagcacggaggccacgcaggtgggcaatgagctcgcccctgtcgccacgtccagcaccgcgcccgaagcgctcacgcgcaggccgagctcgacgtcaatctctccctgctcgctcgctacgaagcgcgcacagggctcgagcgcgggcaacgccttctccaacgcgagcagatcctcgagcgaggcctccctccctggcgccagcaggttgcgcgtctgccccagccgcaccgtgggctcgggcagcggcggacgcacgggcatgggcggcaccacgacgttgacgggaggtccggggtcgagctggaagacggccacgccgtcctcgtccgtcatcgcgcgcacgccttcgtcccgcggatcccaggcgcgcttcaccgtcaactccgtgcccggcagcacctgccccgcggccgtcgtcgcgcgcacgtagacgcggttgttgaagcccggcgccagtccgccctccacctccgtcaccgccgacacctgcagcgcgtcctcggacagcagcagcgacacgccgccttcgatgcggtctcccgccgcgtcccgcgccaccaaacgcgccaccagttgggcctgtccgcgcaggtccatgggcacacgtggcagcgacaggcggaagcgccccgcggcgtccgtgcgcgcacgatttggcaggcctcccgcctgccactccgtgggcgcgggccagtcaccgtggatgtcccacgtcaggcccacctcgatgtcggccaccggcgcgcccgaggcatacgtcacctgcccatccaccaccggcacctcgtccacgcgccagaagggccgggcgctgcgcgcctccacgcggaagcgcggcagggtgaagggcttcacctcgaaggacgccgaggcctgcgccccgccgctcacccagctcaccgtccagcttccttgcggcgcgccccggtccagcgggaagcgcccggccaccacaccccagggcccggccggcgcgcgctcctccagcaccacttcgccggtggaatcccgcaccacccacgtccccggccgcccatccaacggcgccaggtccttggccctcagcaccaccgcgcggaagaggacctcgtggcccggctcgtacaggggccggtccgtcagcacatgcgccagggcattggcatacagcggcagcggcgcatccacggtgtccgtacccagcggcgaggtgacgcgggcccggagctggtagtcaccgtccggtacctccggcagcacaacgcgggccgacagcccccggtcgtccgtggtgcgcgtccactccgtccctttcgacagcggaagcggcgtctccttcccctccccgtccaccaggaacacggcggccgtgccctttgtcaccagggccttcatcatctggccggattccgggtgcggcgccagcgcatgcgtcacgaccaccacctgccccgtgtcgccacgcgccaggccggagccatggacctccaccacctggcggaactgtccgtccggacagctcggcaccttcactcctcgcaggacccaggcggaaaggcagacgtcccaggaggcaaaggctaccgcgccccccacgagcaacgcagccagtcctccccccagcagccggcggcgccggaagcggattgtcatcggttctccccttccctccactctatgccgggaagccgaggccctgacgaggccccccgttcttcgcgtggctcaagacggtgcgctagggtcgccgctccttgccagcgcccaagcccaaatcccgcctgccccaggacgcgcttcccgtgcgcctggaatcgctcctggaagcactgaccgaccggcatctggcggaccggctggagcgcgtgcaccgcgcggcggcggtggccatcgaccggctggggcacctgagcatcgcgaagtacgagcccacgtcggtggaagcggacggcggcgcggacctgtcgctgtgggagacgatggcgccggccattggcgacacactggtgggcgtcaaccagctcatcagcgccgtccaccaggagttcccgccccccacgcgcccggtcgggctcggcgacggtggctgggccccgccgccggccagctcggatgagcgccttgcgcaggaggtggaggcggtgctgcacgccatcgcggaccggctggcccggcgtgtggcggagctgggacagcagatgcgccgcccggaggtggtgagcgaccgctggacgctgatggccgagctgcagtccttccgcgccgacttccgcgtgcgcatcggcgacctcgtgtacctcaccgcctcggccttcgccgacgtgcgccgcgaagaggtggtgcccggctacgcccaccagctgggcgcacgggcggcgctgcgcgcggcggcggcggacctgcgccgctccctgcaaggccggctggagcgcgcggcgaaggcggaggcccgcgcgcgcccctcgctggcacggcaggtggcggagagcctgtccgccttcgtatcccttcccgcgtcagtggcgctgcgcacgccgcagaagcaccaggtgctggagctgcgcgcacggctgctggacacggccacccagtcggagctggcgccggacgcgctgccagagctggtggagccctacctcacgacgttggatgagcagatggaggaggtgacgcgcacctggctcgtcgtccatgaccgcgcgatgtgggccacctgcggcatgaagctggaacaggcggacatgcacctcacgctgggctcacgaggcgcggagcgcgtgctggcggaggcggtggaggcggcgggcgcgctccagggccgctcggcgcccttcgacgccttcctgcgcaaggcgaggcaggaggcgggcgacggactggacgaggcaggagcgcgggagctgctcggccggtttcgggagcggctcgcggccctgcccttcagttgaagcgggattacggcttggtgccttcggccttcgcgccctcgggcagcgcgggcgactcgggcttcggcgggaggatgcgcagctcgccgtagcgcgcggccagcgactccgacgtcatctcctcctgccactgcttggggttggtgttccagccgtagtcggccggcaccttgccgccgccctggctggcgtagccaatcatgtccgggaactgcttggaccaacggcccgcggggtccggctccttggtgatgagctggcggttgggacggtgaaggaagggcttgggtgcgtcactcatggcccgtagcctctccgaaagcagcccgcgagggtagagggaagacgcggagcctcaggccgcccggcgggtccgcttgcggcgcccggtgctcaccggcggcagcacgcgggggcccatttcgaacaccgcggcgaagaagcgggcctgggcctcgctgccataccggtatcgacgcacggccccggcccacgtctccacctccacaccccagcctcgccggtcatggaggagctccacccgcagcaccccacccatgccgccaccgtcaccctgtgcatccatgccccgggctcttgaaatccccgtgccagggcgcacacgcgacatcaccgggttgcggtgtcggccacccaccaaagcgcggcgggcccgtaaggaatgcaggagggctcggccgcccgcctgcccgccaggccatgcccgaccgggggacaccgcaggtcgccttgtgccccgcgattcctgcgttaactcagaggcatgactcaattcgagagcaacaccggcgagcggttcgccgaattcgtcctccccgacggctgcgtgctctgcggtggagaggtgactgtgcgtgcctctcaggcgggtgcgcacagctattgcccgcggtgccactggctgtccaagcccagcatgcgcgtgcgcgacaacggcgtggagctgtccttcgccaccaccgtgctcgcctgagcacgcgccgcctcacggcggcaacatcgtctccgacagcaatagcgccagcagggtcgccctctcgccctgcccgaggcgcagcacttcctcgggcagggacagggagacggggcccggctggagcgtcgtcccaggctggcaggtgcgccagcccgaatacccttctcccgtcacggacagcgtgtagttgcatccgcccatggcgccagcgatggcgaagggcgcgatgacgaggctcgacggctggctggcgaagtttccctccagacgcaggcccggctctggcgtcctttcgaggacgcggaggtcgacggtgccctcccccacgcgtccgagcaggtttccgctggcccagccgacatccacgtcactgccacgcacctgtcccaccagcgcggcgccgcgctgacgcagctcgacgccgggcccccgcacgacgccgccctcctccagggacagcgccaccgactgagagcccgcttcgagccgcagcggtcctccctgtccggtgacggagacctgtgcccgcgaggagggcgcgagcgtcagacacaacacgcccaggattccgatgacacctcgtggccctgtttcgctccgtgacacatgacacctgctttcggcgggtcctctgcccgaaggtgaggctccgccgaagccgtggcagggcccgtggacctggcgcgctcacgccgggactcgaaaggtcccgggaagcgagcgcagggtccgtggctcagtggccgccgtatgtaccgctcgcggcgggcaccgcttcgggctcgcactcgcgcctgcgctcggattcatcccaggcgcggccgtcctcgtagccccactcgtcgacgtccacctggtagctgacctgcgacaacagccggccccggcacagctgcgagtcccagttgccctccgccagcgagctgttggcgcgggagagcagctcgcgcatcacccactccgggacgatgtcgcggtccgcggggtacgcgaagcggaagaacatcaggtgcgcgagcagcacctcccagtaccggtcgaagcgcgccagcagccgcggccagtcgaacgtgcgccccgtcttcaggagcaagtgcgtgagctcgtgcccgtcgaagcgctctcgctccaggacgaaggccttgctccaatagatttcctccgccggaggcacattgcacgcgcagttcagcagccgggcacggaccgcgtgctcgaaccagccgtcgtcaacgacggtgatgccgttgccggacgcgaagatgaggtcgacgaggaagtcgtcccagaaggccttgtgcagccagccgtggacattgctctgtgtgctccagccattgcgcgcgagcacttccaatgcgcggtccgcgtcgtccttgcggatgaacaggtccaggtccttcgtgtcgcgatagatgcccgtgtagtgggcgaacgcgtaggcgccgccgaccaggaacgggattcgcgcgtcagacaacaattggatggcataggcccgtgcgcccagctcggcgaccggccgccgaacctccatccgccgtgggtctcccccgggcgcgcccgaggccttcggtggttgctcagccatgcgccaaaaataggagcgcgatgccgggacgacagcggtccggccgcgtggcaggccgcaggacaggcgggcgtgcgtcagcgcgccagcatcaacatcagcggcgccgtcgcgaaggacagcggaacgcccactcccaccatcaacaccgccaggtccgggtccaggtcatgctcggccgcgaggatggccgcgctcaccatgggccccatggccgactgcagcagcgtggcctgcaccaccgtgggcgccagccctggcagggccagcagccccgcggccgtcagcgccggcaccagcaacagcttgtacgacagccccagggccaccgcgggcagccggggcttgatgcccgacaggcgcagttgcaggccaatggcgaacagcgccagcggcgtcagcagcgagcccagccgctccagcactccgtccagccagacgggataggcccatggccgcgtcgccaacgccaccaccagcgccaggaacgcgggaaaggtggccactttgcgtgcgagttggcgcagggacagcggcgtgtccgcgcccgcccgggccgccgccaccgtggccagcgaggacagcaccaggaaggagccgagctgatccaccaccaccgccaccggcaggcccttggcacccagcagcgcctctgccatgggcagccccacgaaagcggtgttgcccagccccgccgtcagcaccaacgccatgatggacggcttcgacagccccagccggggccccagcagccggaagaacggccccgcgcccaggtagtagagccacggcaccgaggcggcgaccaggagctccggcacgaacaccaactggtgcatggcccgcagcaccagcgcgggcagcgccacgtacagcacgaaggtgttgaacgccccggcggagccctccgggaacttcccactgtgccgggccaggacgcccagcaccatacacgcccccaacagcccgatgacgttccccatggcgggcgcagcgtctcagcccgccgcgtcggactccagcgacatgcggaaaaagaaacgggcggccttcccgtgaaggaagaccgcccgtcgttcacttcacgtcgaagcctggactacggcttggtgtagttgatggccaggttgaacgtaccggacgagtagccacgcaccatgatgtacgcggtggtctggcccgcgggcacggcgatgtcgcacgtctcggaagcgccggcgaggtacggacggcagttgtacgcgctcgtggtgggggccgcgccaaagcggacgtagaggtccgggtcacccgagcccgtcatcacgaccttgaagttggtgccggccttcacgctgaaggggccgtagttctggctgccacccgaggtcacggaaccagagcgcgtctcgctcgtgggcgtgccgctaccaccgcccaggggcgcgaggtagttgatggtcaggctgaagctggcggccgagtagccacgcaccatgatgtacgcgctggtctcgccttccgggacctcgagctcgcaggtctcgttggcgccggcgaggtacggacggcaggtgtacgcggtcgtggtgggagccgcgccaaagcggacgtagaggtccgggtcacccgagcccgtccccgtcatcacgaccttgaaggtcgagcggggaacgacggtgaagggaccgtagttgacgttcgcgttcgcgccgacagagcccgtgcgggtctccgtggtgggcacaccttccgggggcggcgggggcggcgggggcggctcaccgttcggcgtgccatagagcgcctggatgccctggacgtccttcgtggtcagcacgaggtcacccgtctgcgtgccgttgcagtgcgggtagtgcatgacggacgcgctgtcgtaggtcgtcagcacgccccagttgctgtcctcgaagcactggccgccggcctcgggacgggtgtgctcgtgacggaagccaagcacgtggcccagctcgtggcgcgtcacgcccgccagcgtccagacgcccatggggccgaaggcgctgttgtcgaagaggacgttgcggctggagcgcgcgtcacccgggaagaacgcgcgggcgatgtactggccattcacgttgatggggcgcacgtcgaacagcacgttgttgttggaggcggtgcagttggagtcctgcgcgctcacgtggacgaacttcacgtggccggcggcctcccacgcgcccgtcgcgctggccatggcgttgaccaccgcctggtagttgctaccgaaggtggtgctcacacagtaggtgaggttcagcttctgcgtgtcgttccacttcgcgtccgccccgcccacgcggtggacgatgagctgcccgttcttgacgttgttgtcatagaactcgcgcaggtgcttctcggtcgcgaacgtcgtgtcaccgtcagcgatgaagatgcccgtgtcgggctcctggtacacgagagagaggaactcctcccacgacatcccctgaccgagcgtctcctcggaggcgggggtggtgccatcgctaccgccgcaaccggcgagcagcgccaggcccgtgagggcgccgacgaacttggactgtgacatggacatccttgttgggatgagtggttcgcagccgattaagcagccgccatgccagcatccaagccatcgccgtcattcaggatttctgatggctccccgctcaacgcggtgtaccgggactccaagacccctcggccattcgtaaacaggccttacacttcatcctgaaacgacagtgcttctaagggtttgcccatagaagaacagccgactgaaattcagacaggccgtcctgaaacaagacacccttcgccggccacccatattcttttgtcctaaaaaaagacgatgtcagcggaaatcctacagccccaccaggctctccggacgattcaggccgcgggcacggcccagcggctggaggatgtcctgcggcggcgcgtccgcggtgagcaggagcgcgcgcacggcggtctccaccacgtcctcggcaccggggcggaccatgccgcggcgggcatcctccacgcgcttgccgcggtaggcgtcgaagcgctccttcacgcggcgggcaacgtcggacaccgccttgtcgcccacctccacgcgcagctccaattcgttgcgcagttgcaccgggtccgcgagcacgccgtaccggtcatagcccttgtgcgccgtgtcctcgtgcatcaccgcgtagtcctgcgtgttgggcgcgggcacctgctgctccttgatgaggtcccgcatcaccgcggtgacggaggccgtcacggtgagccggtggagctgcacgtcgaacacgaagtccgaatacatgggctcctccacggtgatgggctcgcggaaggtggcgtcgcggtggcgctgcacctgcgtgcgctgcccctcggacttgtccagcgcctcctccagcgccttctccttctgcagggacgcggcggccttggccaccagcagcacctcctcggcgacgcacgccttgttgtcgcagcgtgaggggttgcactcgctggggaactgccccggcccgctgacctcgcgggcggcctcgccgcaatcctgcagggcctcgcggcactggcggcgctcccgctcgcggcagcgctccgcggccacgcgcaccatggacagctccgcctgcatgcgcaggtactcccgcagcgcggcggcctgcttgcgctccacatcctccagggtgcgctcggccttcaggagctgggtctcgaagccgctgcggcgcgggttgggcacggagcgatttccggcgaggtagcgctgcgtgcgctgagactcctccaccacttggagcggcagcacccgctccagtgacaaatccagcgtcacgccttcgcggcccgccggggcctccgtcaccacgcgcaggggcagttgcgtgggcagcctcgccgccagccggccggccgccagccgctgcgccacgtccggcgctccggcccggtcctccaccggcgaggccaccaccaggaaggccacctcgtcacgcagcttctggcgcacggcctcggcccgctcccgcgccgcggtggcgcccacgcgctcctggtccgcgcggacgtaggccaccagcgcgttgcccagcttgccggccttctccaggccctcacccgtgccgaaccaacgccgcgcccaggccacctgcacgccgtccacgccccgcttggcggccgcgtggtccggcgccaccgacagcaccgcgtcgaactccgtgcgcgcgtcctgcaatcgttccgccttcaacgccacgttgcccgccgccacgcgcgcatccagggtggcgccaagcagctcccgcgccgaaacgttgtccgcgttgagttccagcgcgcgcaccaggcgcttcatcgcgccatccaggtccccggaggcatgcacggcgcgcgcaccctccagcaccacctcgctccaggcctggcgcaccttgcccagcttcaccttgacctcggaggcctccgggtccgccgccagcgcgcgcagataggccgcctccgcctccgcccacttctgctcctggctggcggcgtctccctccttcaccgcacgggagaaggcggaacagccggacagtgcaagcaccagggccagggccagggcccccaaccaggggtgggacgaagaaggaggggggcgggggcttcgggcagacgcgttcacacctgcatcttcgaggaaagcccccatcgggtgaagactccggacgtcctcttggtcgtcccccatcccggcaggcacccctcccccgaaggtctgccattgccagccaaccccacgctcccgccaagagccctcaccccccgttacagcgacaatgtatgtcttcttttcaacggccttgaattcttgcgctgcgggctactctgccccagaatgagtcccaaacaccccacccctggcaaacttcgccagaatttacagtccggttgcgatgatttgccctgactgtatatattgactcattcatcgccctcccgccgcattcccaaccggagcactctggaccctcccccatggaatctgtcgcccgctcccagacttcatcgcctcgccaagtcgtacggaccgtgcttcatgaggccctggagagcaaactcggtggggaggtcgtggtccggtccacctccgtgtccggacggatcttcgtggtggcgcggaaggtggcctgggcggtcctcaacgggccgggggcgctcaacttctcttcggtgctcatccgggagcgggtggtcagccgcgaggacgtcgagcaggtggtggcggagtgccggcagagcgggggcaacttctgcgagacgctggtgacgtggggcctggttccccgggacaccatgcgagacctgctgcgccgccacatgtcggagcagttggaggccttgctgtcgctgacggacgcccaggccatgttcgttccgcagccgcgcacctactccagccaactgacgtatggcctggatgagctgatttccactgtcgcgaagccacccacccacccgctggtagaaagcgaagtcatggcgaacgtgaagcagtccctggaagagacgctgaaaatcgagggggccttcgcggcctgtctggcggactcgaagagcggcatgtgcctgggcagcgttggcggcagccccgccttcaacatcgagacggcggcggcggccaacaccgaggtcgtgcgcgccaagacgaaggccatgagcatgctgggcatcaaggaccgcatcgaggacatcctcatcacgctcggcgagcagtaccacctcatccgcccgctgacgggcaaggagggcctgttcctgtacgtggccctgcaccgcgccagcgccaacctggcgatggcccgctacaagctgtccgaggtcgagaagtcgcttcaggtgtgagccgtcccccaggtggatgagcgcccgcccgccagccgggcggcgcgccccaccccgcctcggacgcgcccaggtggatgcgcgtcagggccccgcctcgttagagagtgcagccccttcctgttggcacccatgaagtccgtgcgaccgcacggcgcgggtggccccggacgcgccgggaatgacgcggcgcaatggcaggtagaggaatgacacgtcccacgaggggggcaagagaggcaccatgtcctgtccacagccacgacccaccgagttccgccttccgctgcgggccgagtccttctccatcgacgagcaccgcaacgtgcactgccgcttctacggcggctgcatcgacgtcgcggtgaagaaggactgggatagcttcacctgcgccaagtgccctctgttccacgaggaccaggccccgggcgccagcgcgtacgccttcaaccagcccgcggatccgggccggccctagcggtcatccgcggacaggccccggcggtgcgcgcttccatgggacgagggagcgccccaccgccggagccactgttgaccagcccacgcgaagccgggactcctggagggagtaggcatgcggggctcctgacgccagcttgggcccaacctgcacgggcgactcctccgcctgaagggagaggcccccatgctgcgccagctcctgctctccgacttccgttccgagggccccgccgccggacatggctggccgctggtgcagcacacgtttcccaccgtgcagctcgcgcccctggccgccgggcgcgggggccgcgtgctccacctggacgcttccgaatggaacgcgccagccttcgaccccatcgcctgggacgctcgcgtcttcgaagcggcggagagcaccgaatggctgtccttgcatctggacggcgcgagctgtgaggcgctcgtcgtggccgcgctggaaatcctcacccgctaccaatgtctggtgcggcgccgcaacgcggcctcggccacaccgctcttcagccggctgctggcgcggtaccgctcgctgcatgatttagagcagccccgggtgcgcgcggagttccaccgcgcggtggatgcctggcaatggacgctccggctgcggccagatgtggaccttccgccgcaggccgcggccttcttccatgaaggggaacaacccacgacgccgcttcacgccgtccgcccggtgcgggtgttggaggaggcccgtccggatgaggtcacctgccggcgcgtccgggagttgcttacgcgcgacgcgcgcacaaccaagcgcggggggtgtcc

SEQ ID NO: 1093 - DNA, 16187 bp, Myxococcus xanthus
  unsure (1)..(16187): unsure at all n locations
gctctaaaggcccctgcgccgcgggcttcatcgacagcgcgggcaagctgggcctcaccgacgcggagcgatggactcgctgtcgctcaacaagttgaaggagggctcgctcgtcatccacgacgcgtccttcgtccgcaagctggcgcggtgctgggccagggacctgcggcactcgaaggaaatcacgctggagaatgggggccgcaccaatccctggcggcggctggcccgccgggcgacgcagctcgtggggcaggaccggtagcgaggggaacagcagccggttgagctcccctcgctggccctgagtccgcgtgccctacttgcccttggcgagaatcgcaccgaggctggggtcgaaccaggcgacgcggttgggccccacggcaaggctcgtgatgttgccgtacctgacggcaaacgctagcgcccactggctccctcctaccgggagccggaggatgtcgtatggactcaggttctccgcgatgaagaggtccgttccgtcgctggcgatacccgtggtggcgttcgacgaattccagagggatgaagcagggccgccgggcctggctgccttcacgatggtgccgcccggctgcatccagtagagatgatgaccatccactgcgagggggccagccagggccgtcgtatagagaatggcaggcgtgccgccctggaccggcatgtggaggatggagcctccctgggtccagaagagttccgcgccatccgtgacgagctggccaatccccgatagccccgaggccagggaggtgatgctcccgccattgacgggcatcttgaagatggccttgtcgtcctcgacccagtagacaaacgtggcatccgtggtcacggcgctcgggttttcgcggccggaggcgagcacctgcgctctacccgtggagagcgacgccttcatcacctggccgttggttcgtttctcgacccagtacacgctcgtggtgtccgcggccatgcccgcgacgtccgttcgcccgtcgatgactacgtgctccgtgccaggcgccatcacggtatccgggccagcctggtagctggcggtgaggtcattcgacgacagcgcagcgccgtgaacgcggaactcggagatcgagcccttgaagaatggatccgcggaataggcggaacgacccaaccacgcattcgcgagcgtgcccaggctcgccggagtgagcgcggtaggggtggtggtctgagccacctgcatgccgtcgatgtacaggcggttgaccctcgcgacgctgtccatggtcacggcgacgtgcgtgagtgcgcccgttgggaacccggttgcactggtggcctgctcctctccactgatggccgggctgaagatgctgaagcgtggcgcatcgaccgccggccccgagtcgaagccgccattgcgcggggtgaggaccagggacttgttccaaacgccatcgttgaagtcgaagatgcgcgcccacgtctgccccgaggcggaatcccacttcacccacgcctcgaaggtcgcatcctggaggctggcgagggtcccggtgatgggcaggttcacataggcccccgctccgctcagaatcacctcgccattgacggtcgtggcacccccctcgagcgtggcatgcgccgcgctcaccgagtcggtcccgccggcggtgaagctgtagcggtggaggaggctcgaaccgcccatcgtcaggcccgcacgcgaactgctcaacgcgtcttgctcaagctggagttgctgctcgggcgtgcaccccaccagaccgaggactcccgccaacatggcggaaaccttcgtagcctggcggagtgcgtcccaccctccgcgcggcttggagtttcgcgagctgaattcggacattgttctcatggctttcacctgaagaggggcaagggagcggcaatgcgtggtggaatcaccaggcgccagtctgtgtttgcacctctcgtgcccactcgagcttcgcttccgaatcggaccgctcacgcttccatcaaggggcgtggcgcgtctccgccagcgcacgcgttggtagggtgattgcgccccagggggatgtctcgacagtccggcgacatgccggcgacatgccgcgagcactccttggaccgaagcggaccccgtgtctcttctgagaagagacctcgtgatataggaacgaccggggagcgcggggcccttcaactgagacggccgctggctttgcgcgccgctctctttgaggtgcccatcgatgaatcgtgacgatgagacggagctctggctcgcgattgacgaggggatcctgtcccgcgaggaggcagcggccctgcttcaggatgcgcgacgcctgggacgaagcccactggagttgcttcaggagcggggccggatttcggaagagacacttgcctctctgatgcgggagaaccttgtcctggaggagcgcccgtcaggtgagcagccctctcccgagcagaccgttacggtcgacccggtccgggctgaacaggcattggccccaggggacgccgacgtccctgctttcccgctcctcgggagggagcgataccaacccgtgcggttcctgggacagggcggaatgggtcgtgtgttcctggcctgggacccacggctgcgccgacaggtcgccctcaagttcgtccgcgacgaggaatcgcacactcgccgcttcgtttccgaggcccgtgcccaggccaaggtgaaacacgagcgcgtatgtcaagtgtatgaggtgggccacgtcggggggaaggtcttcatcgccatgcagtacatcgacggccagtcgctcggcgctcaggtgcgctcgctcaccatcgagcagaaggcactggtgatgcgcgaggctgctctgggtgttcatgcggcccaccgcgtcgggctcatccaccgggacatcaagccttccaacatcatggtggagtcctccgacgacgggactcccaggccctatgtgatggacttcggtcttgcgcgtgaatggaacgagtccgtcacggccagtggcgccgtcttggggacgccgcactacatggccccggaacaggctcgcggagaggtgagcgggctcgaccgccgcgcggatgtctacagcctgggggccaccctctacttcctcctcaccggcgaggtccccatccctggggccaatggcctggaagtgctcaacagcatcgccaccgaggagccgcgcgcgccgcgcctgcttgctccaggactcccggcggacctggaggccattgccctcaagtgtctggagaaggatcgcgacgcccgttacgactcggcgcgtgcattggcggatgacctggagcgtttcctgggcggcgagccggtgctggcacgcacgagcttcgcgtactccctgcgcaagcgcctgcgcaaacaccggctcctgaccacggtgggcgccgccgcgctggtcacggcgggaggggccctcggttggggcatccgggcccgccaggaggccgccgagcgtgagcgaatcgtccagcgattcaccgagctggtggagggcatcgagtccaggggccgctactccgcgctctcgcggctgcatgacatccggcaggaccgccgggcactccaggcccagatggccgaactggaggcggagatacagcgctccggtccacaggcgctgggccctgggcaccatgcgctggggcgtggccacctcgcgctcggagacgaggcgaaggccctggagttcctggagtcctcctggcgcaatggctttcgctcgccccgggccgcgtatgcgctcgcgctggtgagcgggcggcgctatcagcagcaactcctggaggcgcagcgaatccgtgtgccggcgctgcgggaggccgcgacgcgtgaagcggagcgcctctaccgggatccggcgctcgcgtggttcaagcagagtgaaggcgctcaggtgccctcgagggaatacgtggcggcgctggtcgccttctacgagggccgcttcgatgacgccctgctcctggcggatcgcgccgccagcgagctgccctggtttcatgagctgcccatgctgcgcggggacgtccatgcggcacaggctttcaaacgctggaacgggggagaccccgagggagcccgagcgagcttcgaagccggtcgcaaggcctacgccgccgccatcgccaccgctgaaagcgaccccgccgtctaccggtccctggccttgctcgaaaacgatgcgatggtcatggagctgtatggcaggggggatgtcatgcctgcgtaccaccgctccctggacgcgctctcccgttgtctcaccattgctccggacgacgcccagtgtgttatccgcatggcgcgcgcgcaccaccgcctggccgagcaccggctcacccatgggggcgatggggaggagcctctcgcgaaggcgctggaggcagcgcggcgtgccctcttggtggagcccgggcttccggcggccacattcaacctggctcggagcacctggctccaagcgcgctatcaaatcgagaggggcgaggacccacgcgcgctgctcggagaagccgccgcgttgttcgcgagcatcggcgtggcgcaccgggaccgcgcctaccacggcgattcaggtctcgtcttcacgacatgggcggactacgaggagcagattgggagggattccggcgggaacagggacaaagccatcctcgcctacgaggcggccatcgccttggacaatcgtgtccccgaggactggatcaacctgggtcgtgcgtttttttcacgggcttcccgtccactcaatgcggaggcggagcaggacctgcggcgggcggcggcggcactcgaggaggctcgggccctcaacccccagcatatggcgctgtacttctatgcggggcaggtcgacgagcagttggctcggcggcggggtcgtcgcggcgaggatccgcgacccgtcctggcgcatggattggagcagtatcagcggggcattgaaatcaaccgccggatccccaacttccataacggaatgggcgtggtgcacttgctgcgggccgaggattcctggaaccggggtgaggatcccctgcccgcgctggagcaggctcggacgtgcttcgaacaggccatcgctgtcgcgcccggacagggctttgcctatgcgaacctgggctctctcttcgtccggcgcgcgcactacctgctcgcgcttggcgagtcgcctctttcgagcacgcatgaggcaagggaggcactgagacaagcctccgagaggatgccgggggccgcgtggctgctggtcctcctcggcacggtgcatgtcatccaggcccgcgtcgagtcggaccaagggcgagaccccggggctgccatcgctcgcgccctgaaggaactccacgccgcgttggaggtgaactccttggaggcggagccctggctccagcttggcaaggcgcaggccctccaggcgcactggaaggcacagcgcgggtcgctccagaccgagtccatggaggcagcggcgaagtccttcgacagggccctcacgctctctccagacgacccggaatatcgcctggaggctggccgcttctaccgacggtgggcggaacaccagaatcgcacgggtcgtgaaaacggcccgctccttctgcggggcctcgaacacgccgagcaagcgctgaagctccggcccgactgggccgcggcccgcgccctgcgggccggtttgaagttggagtgggttgaagccgagccccccggggacccgtgcacctggaggcgccaggccctcgatgagctgacccaggcgctcacgcacaattcaaacctctctaatgagtggggtggcccactcgcgggcgcacagcggcttgccgcatgcccctgagcctgtgcttgcgtcgccctccgccacgtccgcggctgcctggcgtgagaatgaaacgtcgtgccgcgagcgtggggcgtaccttgggagcggtggctagaccagagagggaagttctgtgccaggaccgcctgatacttcgattttcccggaggatgtggggggttccccttttgaagagcggttctccaccctgtctctcagagggtactcggggggcacggtttccacgagtttgacgacatagttgcgtatgaatctatcttgggaggtgggggccttggttttgtctatctgaggaacgaagtcgtgttcgtatgtgtttttttcttcggtgaagacgaagtcgtgggtgggatcattgattgtcaggatgcaggcgtcggggtcggtatcgcagaaggtgattgttggagtcagcttcaagtcgggagggagtatgatcctgaaggttatcctggtgccgtttcggaccgagattggcttcggtgtaggtttttcctcgttgaagttgatggtgatgacgtggggttgcatggtcgtctcctggtctgccattgaggtggtgtgaggccgtccgctcaggactccttcgaatacagccccaattccttgacacgccggttcagggcccgtttggacacctccaggcgccgcgccatctcatccaggttgccctggcacgcgtggaaggcgtgggtgagctcctccacgctcaggtctccagccagacggatgctggggctgcgctcgatgagatcatagatggaggagcgggcgatctccaggtggtgggcggccttcttgacgtcccagtcgtgcgcacgcaaggccacgaggagttcctgttcgcccacgtccgtggacttgcgacgggccgcaacctcacgcttcggggggacggcggaggcggagggccgggccggcggcgccaggtcgagcctcaactcctgggcgaggcgtgcatcaagctccaggcaggactgccccctgctgccgatgacgagctgtcgggcgacgttccggagctgacggatgttgcccggccagggatgcagcaggagctgcgccgccaagtctgatggcatccaaggtagtgcatgagggtctctcgcggtgaggtggtgggcctctccgagcgcgtccaactcctggcgggcgaagtggaggaacagtggagcgatgtcctcccggcgctcgcggagaggggcaagccggagctcatagccggccagccggtgaaggaggggagaccggaagcgcccctcggcgatctgcgcttccaggtccgcatccgtggccgcgatgaggcggatgttcgtcgccacgggcttgctggcccccaccgggtacagctcccccgtctccaacactcggaggagcatgacctgtacgtcggatgaggcctctcccacctcgtcgaggaagagcgtgccgccctccgcggcttggaagaggcccttacggtcgcgttgggcaccggtgaaggctccctggacgctgccgaagagttccgccgcggccagttccttcgggagggcgcccaggttgacactgacgaagggacttcggcgctggctccggctcggtggaagggcctggggcgaccagttccttgccagttccggtttcgccccggatgaggacggggcacgtccagatcggcgacgcgttcgatgtgtcggcgcagggcatggatggcggcgctttcgcccaccattcccagggcggatggtgcgtttgattcgggggcaggggccaggtgcagcagcacccccgtccgcctggagaactccagcgggactccttgttcaagcgctgtcggaccgaattcgcgggccccgtggagtggctcacccgctgacgtgcatcgtcccacttcgcccaggacgacgcggatgcctgctcccgcggggacgaacaggatcgacttgcgactcatgaaggggtcgcccaggggcaggcccagcggctcgcccgggcggcagaagtccggggcattgcgggagagcgggacctcccggccggcgaggagtccatgcagcagcagcctctccccgaggcgggtgacggtggtgtgcgagctgagcgtcaacgctggaatcgggcgcgcggacgggcgctgcccgtacggaaccgactcggaggccgtggacacgtccgaggtcctcgcggccacatggggaggggggacgctgggacgtgacatccgtgcgaatttatctcaatgctcaatgaattgcacccgcaggggctcaagtactgaggtcgtccaataccctttcaccccttggtttacttaaagggtgcgctgggacctgccccctcccatcgcggcgggcactgcaaccaggaccaagccctcctcctggcgggtgagcgatggagggctggacgggtaggtgtgcctatcccaaattcgatcgctgcgtcatgagcgcgtcgaggcgagtaagcgagccgtgcacgaggccagaagtctccaagccatccggggtaaatctttgtctattacggccacaaccaccgtcgaggtggcgcactccagcgccttggctgcggcgcgacacgtggaacctgtcaacgcgagtgagacagtgagttcgagattggcggtgtcttcggcatgggggcaccgcgggggaatcgctcagggtgagcggcgtaggcagcggcgagcaccgcagcgcgggccgctcagcggctggcccgccgggcgacgcagctcgtggggcaggaccggtagcgtcagcgcgcgtcccttacgccgacctgccggcagaagctcagcaccgggcacgtggagcacttcggccgcgtgcccgtgcagacgtgcttgccgaagggcaccagcagccggttgagctccacccaccaggcgcgcgggagcacggcctccagcgcctccatggtggcctccggcgtgcgcgcctgcacatagccccagcggttcgtcacccgatggacgtggatgtccacgctgatggcttcgtgcccgcaggcgatgcccagcgccaggtgcgcgcacttgggtcccacgcccttgaaggactggagcacctgggcatcacacggcagcgcgcctccgaattcatcccgcgtccgcgtggcgatggcgtgaagctgccacgccttcgcttcatggaaggtgacgggctggatgagggcgtcgatgtcttccggcgacatgcgcgccagggcctccggcgtggaggcgcgctggagcagggcgagcgagacgggcagactcacctcgtcgcgtgtgcggatggagaggatgcaggcgacgagctgctcgaagagcgtgtcatgtcctcgggccgcgagcgcgaacatcgccgcgtccgcgaagtggcgcaccgcctctcggatgcggccgagcacctcgtcgatgtcgaatggcttcttgtccggccggggcggtggttccacgacgcggccgggcttcgtgggcgcctgccggctaggcatggcgcgttcctcccgcgggatggatgctcgtcatgtgctgcctcccgccccaaacctggggacgcgggcgcgacgaggccctgggccgtacgaagggccggcggcagggcagggggccgtccgtcttcgtcagtcgagcggctttgacaagtcccgggcgtaccagtggtcgcagccgaagtggcccgtgctgcccatgggcgcgcacagtggctcgaagcccatgcggcggtagagcttctgggcctgctgcattccggccagcgtctccaggtagcagcgctggaagcccgcttcacgtgcgaactccaggcagcgtcggagcaggcgctcgccctggccgaggcctcgggcttcggggaggaagtacatcttccgcagctcgcagacgcccgcgtctcctccttcaagtggggcgattccaccgccaccgatgacacgccccgcccgctccacgacgaagtagacgtgccggggccgggcgtaggcggcgctcatcgctgacacctcggggtcgtggatggcgaagccagggccgtccgcgccgaactccggcatcaccgtccggatgatgccggccaccgcggcgtcatccctcgattcgatgcgtcgcagcgtcagctcttccgtgctcatgcgcgcaacgtttcacagccggggccgaggtgccagcggcggaaaggggggcgcccgctgcgttgacgctcacgcacgggttgtgcaaccgggtgcacaggtgtcacgggtgtgatgcagcgtgtacgcgttccccttcgtcagggggtgtctgtacgcgacggcctcttgagtggcatgttcgttgtatcgagggggatgcatgtactgcgctgactgccgcgaagagcggcgtggcaaggactcgtggtgtgcgctgtgtggcgctcggatgacggcgcgctcgcgtgaggtcatcgaagcagagctcacgcacgttcaattcctgctcgatgagctgacgcggtgggagtcgtccgaggttcctcccaacgtccggcgcttcatctcggagcggtatgagcgtcaggcacgcatcctcctcgcggttttgacggagctgcctccagcgggctcagcggaggcggccaccgtcgtggctccggcgcatgcggatgccgcgacgtccgttcccgccgcgttgatgcaggagcctcccgcgccgcaggaggcggcttcggtacaaccggaggtcgaggtgactccggccgtggaggctccgggactcaccgaggagccgcgccgggccgaggcatcggctccatcggagccggaagacgtcgcggcgccgtcgcacccgtccgagccggaggccgatgccggagtggacgctgcgcccgaggctgtgcagtcggatgattcgcgccccgaggccccgcctgtctggctgccgctgcccgcgaatcccgcggagccctatgcggagccgccgccggcgcgaagcctcaccgcgcgcctcgtcgaggagacctccacctggaaccgcgtgtggaggccgttcctctacgaaagcctcatgtggttcgtcggggccttcctcatcctctccagtgccctctacctcgtgttcgagagttgggtggggatgtcgtccggcttccgctcgctcacggtgttcgggctgacggcgagctgctccgcgggcttcaccggttggggcgcatacctcgccaggcgcgaggcgttacgcaagcctgggtacatcctggggctcatcggtacagccgtggctccgctcgctggtatcgcactggggcccatgggcttgggggacgtcttccaactgggaggcgtcggcacggtgtggctcatccccgcgctgctggcatgggcggcagttgcggccttcctggcgcgcaagccgctggaggccttcgattccacgtcccgtcccttcatccaactggcgctcgtggccagtaccttgatgatggggttggcgccgctcgccgcggggcagggcggcctggcgctgtggctcaacgtcctgccgtgcgcgctcttcttcctcttgtcctcgcgtccgccaccagcgccgcgtgagggcaccgcgctcgctttcgtcctcgccgcgccgctgtacctgctgctgctctatttcgcgcgcctgcacgtcgcgctggcaggcgcggacgtggcggtctccgttggcacctatgccccgttcggcgcctttctcctggccaccgcgttgcgcttccgcacgctggatgccgagcggggcgcggattcgctgtccattggcgcggtgtcactccaggccacctgcctcatcgccgcggcactggctccggcgccggcgctcttcgtcacagcggcggtcatctcgtggacgttgctgtcgctgtcgcgcggcggcgtcgctcgcatccggtgggtctacgcggcctatgcgagcacgtacttggcctatgcctgcttctgccagctcatccccgggccggtgcggcgcatcatcaatgcggtgaaggcctggttcggttacaccaccgagccgctgccccttcagttcggagcgctgtccgcgttgcccttcatcctcgcgggcgcgttgttcgccgtgtcgcggctgtggcgaggtcagcgtacgggcaatgcacgggacctcgcgctggcggaggtgctgctgcgcgccaccgcggtggcgagcccgctcttcgtcttctttggcctgtcgggaccggacgctcggccctccttctggagcgcgctggcgctggcggtgctgtgtctcgtcctgggcctgctggtggagcgtttcttcctgacggtggtgggggcggggctgtcgctgttccttcccttccaggcctacgccgtcctgggggcgtccggcggcgcggtcgcgtcgggggcgctggccctcgtgctcgccgcggtgagcatgctgtgcaccgcgcgcacacgcgggttgctgggcgctgtcgtgggcgtggtggccacggtggggttcctcatgggcctgactgccggtgacggcttcacggccgtgacgggcatggccctgtgtggcgccgccgcggtgcttgtcgcctgggtgcttcagcgtgcctccctcatggcgttggcgtccgtgctggcggcggccgcgcttccgcgcctggcgggagagctctcgcccacggcggtggcgcccacgctcgcggcggtggcgctcgggctctcgttgctggggatgcggggtgggctggcgcggtggctgggcctgccgggcgtcttctacgcgatgctcgcgattccctggggcgtgctggcccaggcgccggggctggccggcatcatcctggtgtccgcgggcgcggtggccgtggcgtcacggaccttcccggtggtgcgtcccctcgcggtgctcatgtcggccctggcgctggtgcacgacatcccggggctctattcgccatgggggggatggatgtcaccgggcctgtccgtggcgctgttctgctgctgggccctgggggcttccgtcgcggcggcgcggtggggtcgaggcatcagcgcgacggtcgccgggctcatcgcgctcgtcttcccgctgacggccctgctgggcgcgcgttcgtcggagcaggcgcccctgttgctgggggcggcgctcgcggcgctgctcaccgcgcgcgtactgcccgcggggctgagtgtcgccgtggccgcgctctatgcgctcaccgcgacgttcagtttcggcgccgtgccgttgttgtgcctcgccggggtgttgagtctcctggccgtgctggaggaggtccccgcggtcttgcgcgtgggggcgggcggtcaccgcttcgccctggcggcgacgttgtcctccgtcgtggtgctgggcgtcgcggtggtgaagtgggacgacgcggggctgccgttgctgctcgtgggcacctgtgtgctgcccctgctctgggcgcgagccaatcgccagccgttcttcgcgtcgctcgctgtcccgtattccttcgtgggcatcgtggtggtggggggcgatgtgccctcgtgggttcgggcgcttccgctgctgagcctggcgctggtgcgtgtcgtggcgcacgtccccgccgcggcatcgctgctgctgcgctcgcgtgaggaggcgcctcgccaggcgctgtcatcgtggatgcagggatggctcgccgtggtggccctgcccgtgctcctcgtcgcgctcaggccgtaccatgtccccacatcgctctatgtgctgttggcgtccctggcgctgatgcccggaccgcgtcccgtcttgcgcgtgtgcggctccgcgctggccctcctcttcttcctggaggcacgtcccatcgtcattggcctgctgctcgcgctggccatcgcggagagtcatcggcccgctcgcgtgtgggcgttcttccggagcgcgccggacacagcactgcggcccggcgccgtcatcacggcgctcatcctcgcgacgctgcccaccctctattcgcccacgccgtctcatctggccacgctggcgggcgtgttggcgctggccgcgttcctgctgtctcagcggtggctgctgactcccgccatctgggcgttggcgttggcgcccatgggcgcggtcagagtgaacgagctgttcgagcgggggctcgacgcgggcctgtccgtcatcgccgtggtgttgggcgcggccgtggcgtccgccgtgttccagtccggacgcctccaacgcgcgctcacccaggccttcgcgaaggtgttgcctccgctggaagacacctggagcgagccgctgtgggtgggcagcgccggtgcgttgggcgcgctgctgctggagcgcctgctcctgtcaggccctggctcgctgcctctgccggtggcggtgggcgccgcggtgacggcgtgtgtgttgatggtggcgagggagcggtggatggccaacgtggccaccgcgttgctgggggcctcgctcgtcgccgccgtggacccgctgtgggtgcccgctgtcgtcagtggaacagggctggcgctatgcctcatcgggtcgctcgtggacgctcgcggtgtgcgcgtgggcgcctcgttgcaccatggcggctgggtgctggcgctgctgtcgctcgcgggcttgcgcgaactggagcacgtgggcaccccgctgacgttcctcttcggcgtgggcgcggcgtggcctgtggtgtgncggcgtcgcgagcgcgaggtggtggggtggctggcctcgctcgccgccgtgcacggatggctgctgtacctgggcgcggtgtactccagcggccggggcgcggcgttcatcctgccgtacctcggagcggccagcgcgctgttggcggccctctcgctcttcgtggccagcaagtcgcggcgccggagcgtggggcacggcttcgccggggtggcgctcttcgaggtgatggcggggttggcgctcgtcgacacgtcgctgggcgcgctccgcgagggactggtggcgagcgtggcgctgggcgtgctgctcttcgccctggtccgccgcgcggccacggagaaggaagaggcgtccgcctacatggcgcaggtggtgctcgcgctgggctatctctccgtccgcatgctgggaatgggggcgcacccgggccccggcgacagcctggcggccctggtgggcggtgcgctgttcaccggcctctacttcttcgtgcagcgcgagggttcctccctggcgtgtttccgacgccccgccttgttgggcgcatatctcttcccgctggcggggttgctctccgctccatggagcgacccccttcacgtggcggcgttgatggtggggtatgccgctcacttcgccgcgctggccacgcacccgcggcatcggggcatggcgtcgctgacgtcggtggtggcgttcaacgcggcgctgctgcttgtgtggcaggggacgggcgcgggagaggcgcagttctatgtcatccccgcggggctctccctgctcgcgttgctgcgcgtgttccgcgaggccatcgaggtggagacctatgcccggttgcgtgcgctggccgtcaccgccatctacgttgcgggtgcctggaagccgctcatgttcaatgatggcggttcgatgctcctgtgcgtcacgctctgtgtggtgggcgtggcgtgtggcatcgcgctgcgcatccgctcctatatgtatctgggcacggcgttcctggtgacgtgcatcgtcgccaacctggtgcgcttcggcatgcgggaccaccggattgccgcggcctcactgttcgttctgggactgatggtcattggttccatggtgatgctcagtgcgcaccgcgcggcgctgctccagaggtatgcacgggtgcgagccatgctcgcgacctgggagggctgacaccgggagttcttggcggacggcctgggaggtggttttgaatgcggcccctcatgtcgctccgccttccactccttgccgtcttccccctcagcgtgctcgtggggtgtgccactgtgaagccgcgcccctcggagcccgtcgccacgacggaggcggtgacggtggccgcgccaggaggcctcgcggagccggtgccagtgccagtcactgcggtggaactggggaccaccgaagtcgcgcccacggtggtggcgacgcagtgggtgagcgcgggcgtgctggaggccacgctgcgggcggccgagcaggtgacggggcccgccagcaccaccggccgattttgggacgtggtgctcgcgcctacgcagatgtcgcgctccatcgtccagcgctccctccagctcgtgggcatgcgcagcctgcgccgagtcagccgcggcgttccggcatgactgcctttagagcac

SEQ ID NO: 1094 - DNA, 15782 bp, Myxococcus xanthus
gacctcgttgaactgttcgccctccagccccgcgtctcgctggaggactacgcctctccggcggccttcgccgcgcgacaccgtgcgctggccgcgaaggtggatgccctgcgcgcccgggatgcgtcaggccagccgcgctatccagcgctcgccgtgtggccggagtcggtgggggcgccgttgctgttcctgggccacatgcaccgcgtgcggcaaagcacctcactccagggtgcactgaaacgcgtgcgcctctccgaggcctggggggtgtggaatgcctggagcgacttccggccaccgtcgctgacggagtgcatctacgccgcgcgagcgcccctcgtgcaccggacgctgtggaacaccttctctggcatcgcgcgggatttcggcctgtgggtggtggcgggcagtgcgctgctgcccgccggccgccggggggagggctcgccggacttcgagcccttcagcgcgcgcacctacaacaccagctacaccttctcgcccgaaggcaactgcgtcgcggctgcgcgcaaggccaacctggtgccctcctgggaagacgggctgcacctgagccctggccgcccggaggacctggccgtgctccagacgcccttcggaaagctggcgaccctcatcggttatgacggcttcgcccagccgcatacccgcgacgagccctggttcgccccctgcgcgcaatacctcgacgccatgcgagtggatgtcctcgcccatcccgccatccacgccgggccatgggcacgctctgcccaaggcgagcgctggcgacacgaaggcctgcccgcgcagctccgcacgctccggaacgtgcgctacgtggtgagcgcgcagcaggtgggcagtctgctcggcggcaccttcgaagccgcctcacacatcctggagcgcacggcctccggcgacgtgcgcgtgctcgcccaggcccagacgacgcaggaggaggacgtggtgcacgccatcgtccccaccgcggcacacggcacgccttagtcgccgagcttcttcttcagcagctcgttgaccagggcggggttgcccttgcccttcatggcccgcatcacctggcccacgaagaaaccgaacacctgcttcttgccggcgcggtacttctcaatctcccccgcgttcttcgcgaggatgtcgtccaccaccgcctcgatggcgccggtgtcgctcacctgggccaggcccttctccgcgatgatgtccgcgggcgccttgcccgtgcggaacatctccccgagcacatccttgcccgcgttggcggacaccatgccctggtcgacagcgcccagcagctcccccagctgtgctggcgtgaagcgcagcgcggacagcggcgtaccctcttccttcagcaggcgcatcagctctccgaggaaccagttggagagtttcttgtagtccttgtagtgcccggcgcaggcctcgaagtagtcggccagcggacgctcggcggtgaggatgcgggcgtcatacgcgggcagtccgtactggctggtgaagcgctggagcttcgcgcgcggcagctctggcagcgccttcgccgcggcggcgatggcctccgcgctcacgtgcagcggcggcaggtccggctccgggaagtaccggtagtcgtgcgcctcctccttgctgcgcatggagcgggtgacgcccttgttcacgtcccacaggcgcgtctcctgcaccaccttgccacccgactcgatgacgtccacctgccgggcaatctcgtactcgatggcctgcttgaggaagcggaacgagttgaggttcttcagctcgcagcgctggccaaacgtggtggagcccttcggcatcaccgacacgttggcatcgcagcggaagctcccctcctccaggttgccgtcgttgacgcccaggtagacgagcacgtcccgcatcgccttgaggtactccaccgcctcgtccgcgtcgcgcaggtccggctggctgacgatttcgagcagcggcacccccgcgcggttgaggtccaccaggctctggcccccaccggcgtcatgcacgctcttgcccgcgtcctcttccatgtggatgcggaggatgcggatggccttctcgccctgcggcgtgtcgatgacgagccgcccgtgctcgcagatgggctggtcgaactgcgtaatctgatagcccttgggcaggtccggatagaagtagttcttccgactccacacgctcgtcgggcggatggtgcactccagcgccagccccgtgcgcacggcgaactccgccacgcgctggttgagcaccggcagcacaccgggcatgcccaggcacaccggacaggtgttgcggttgggctcggcgccgaacgcggtggagcagccacagaaaatcttggactgcgtgaggagctgcgcgtggacctcgaggccgatgacgggctggaaatcgctcacgggcatggcggtgtcaccagggcggacgctcgagggccctacaggggcgcggagcggcggaagaagtcgtgctcgcgctcgtaggcgcgggcaatgcgcagcaggccagcctcgtcgaagggccgccccagaatctgcaggcccacgggcaagcccgccttcgtgaagccgcagggcaccgacaggccgggcaggcccgccaggttgcaaggcagcgtgtagatgtccatgaggtacatggacagcgggtcctcgaccttctcacccagcttgaaggccggcaccggcgaggtgggcgacagcagcgcgtccacctgctggaaggcccgcgtgaagtcctcgcggatgagcgtgcgaaccttctgcgcacgcaggtagtgggcgtcgtagtagccggaggacagcgcgaaggtccccagcatgatgcggcgcttcacctccgcgccgaagccctgctcccgcgtcagcgcgtacacgtcccgcaggctgcgcgcgtccttcgcccgcaggccgaagcgcacgccatcgtagcgagccaggttgctggacgcctccgcgggcgcgatgaggtagtacgtcgccagcgcgtacttcgtgtggggcagcgacacgtccaccagcgtcgcgcccagacgctcgtactcgcgcagggcctcgcgcaccgcggcctccacctccgggtccatgccctcggtgaagtactcgcgcggaacgcccagcttcaggccccgcacgccggcctccaggtccgccgaataatccggcacgggcgcgtccgcggacgtggcgtcctgcgcgtccggccgcgcaatcacctggagcagcgccgccgcgtccgccaccgtgcgcgtcatggggcccggctggtccagcgacgaggcgaaggcgatgacgccaaagcgcgacacccggccgtaggtgggcttcagccccacggtgttggtgagcgccgcgggctggcggatggagccgcccgtgtccgttcccagcgcgccgaacacctcgcgcgcggccaccgccgccgccgagccaccagacgagccgcccggcgtgcgcgacacatcccacgggttgtggctggggaagaaggcgctggattcgttggatgagcccatcgcgaactcatccatgttcagcttgcccaccagcggcaggcccgcctccttcagcaggcgcaccaccgtggcgtcatagggcggaacgaagccctccaggatgcgcgagccggcggtggtctccacgccctcggtgaggaagatgtccttgagccccaacggcacgccgtccagggcgctggcgggactgcccgacttgcggcgcgcgtcactggcgcgagcggcggccagggcaccggcttcatccacgcgcaagaaggcgcgcaccttcgggtccacctgctggatgcgcgccaggctcgcgcgggtggcctcctcggaggaggcctctcccgcggccagcttcgcggccagctccagcatcgtgaggtccgtgagctgcatggcgtggaacctccggggctactcgatgattttcggcacggcgaaggacgtgtccgacttcgccggcgcgttggccagggacttctctggcggcagggacggccgcgtcacgtcctcacgcaaccgtgaggacgtgagcgtggcgtgggaagtgggctccacggcctccacgtcgagcgactggagctgctccaccgcgtccagcaccgcggacagctgggtggtgaagcgctgctcctcttccggagtcagcgacagccgcgccagtgtggccacatggcgcacctgctcgagcgtgagcgccacggcggcctacttcttcttgaagaggttgaggatggcccccatcaccttgccactgccctcgtggccgtgctgggcgaccagctggtccagctccccggcgtccaggaagatgccgtggcagttgaagcaggtctcgatttcgacattcccctgcttcagcgtctggaggtccatgccgcacttggggcacttcatccagtggagcttcttgagctcctcgcgctgctgcgccgcgctcgccgcggcctgctccagagccagcttgcgcttcttctcaatctcctcccgggcgaagtactcctcctcggtggatgacggcttgtcggtacgggcgtcggccatgtgatgttcctccacgaagtcccgccgccgcgcggcatgcgcgcccgggcggcgatgttgggcggcaccataccccctctggggaggggtgcagccgaaatgtaggttccccgtcctgagctggaaaattgaccggtcccccgccctccctacactcgctgcgggcattgctacagcccgctacgcggctgagacgcgcagagggaagacggacatgacggcgaagaagggtcgggcggagaaggcggtcttgtcccggcaggaaatcgcgacgcgccgcagggcgctggcggacaagcggatgaaggccggcaagggcggtgacgtcaccacccgagccatcaccggcgtgttcctgctggcggcgtcgttgattgccctgctggcggtggccactttcgacgcgaaggaccgggtgggcccgggcttcaacaacgcggtgggccccatggggcacctcatcgcggagtccctgcgcggcttgctgggcgtgtgcgcctacctcatcccggcgggtggcatctacacggccatggtgctcttcgtgggcagccgcgaccggaagcgaggaccgcaaatcatcagcctggcgctgctgacggtcagcgtgtccgtgctggcgcagttgatgttcgccggtgacaagggctgggcgcacccaccgggtggcgcgctgggcgccagcctgggcggcatcatgtccggcctgttctccacggtgggcaccgtcatcctggtgacagccatcagcgcggccgccctcatcgtgggcacccagtacaccttcctcaagctgtgctcgctggcgtgggccgggctctgcgtggtgggccgccgcgtccaggagtccgccagcgtgttctgggaggctcagaaggtggcctaccaggagcgccaggaacgcgccgccgaggagaagctcgaggaggccgccttcctcgcgcagctcgaggccgacgaggaagagctcgccgaagccgagcgcctggccgaagaggcagaggccgccgaggccgaagcgatggcggaggaggccttccggctgtcgaagcagcaggagaaggagcaggccatcgccgcgaagctggcgctcaaggagtcccgcgagcgcgagaaggcggagaagctggagaagaagctgctcccgccgacccgcgaggccgattcgctgccccctgcccccgcgcccgtgctggcccttccggagaaagcgccggcgaaggcggagaaacgcccggccctcggtgccgacccggcctgggccgcgtccttcctgccgccctcgcccaacctcatcattcccgccgacggcgccgacgccaccgaaacgccgcgcgcccgccgcaggccgaacatcgtcaccggcccggcgccggtccccatggctgacatggaggccgagcctgtcgcgcccgtcgccgccgcccccatcgcgccggtgccgcccgcccccgccgccccggccgacatcgtccccgcgccgccggccgcgctggcgcgcatgccgctcatcgtggagcccaaggccccgcccaagcccaccgtcaagaagagccaggaccagttcgagttcgtcggcgaccgcaagagcttctcgctgccgccgctcgacgtgctcgagtacgacaagacggagcgctccgcgctggacaaggacgtgtacctgtccacggcggagaagctgcgcgcgaagctggcggacttcggcatcgtcggcgaggtggtggagattcgccccggccccgtcgtcaccatgtacgagttcctcccgggccccggcatcaaggtgagcaagattgccgcgctcgcggacgacctcgccatggccatggaggccatgcgcgtgcgcatcgtcgcccccatccccggcaagggcgtggtgggcatcgaggtgccgaacagggaccgtgaaaccgtctacctcaaggagattgccgagcaggacgccttcaacaagggcgccagcaagctgaccatgtgcgtgggcaaggacatcgagggcatgccgtacgtcctcgacctggccaaggcgccccacctgctcatcgccggcaccaccgggtccggtaagtcggtggcggtgaactccatgatcatgagcatcctcctcaaggccacgcccgaggaggtccgcttcatcatggtggacccgaagatgctggagctctccgtctacgagggcatcccccacctgctgctgccggtggtgacggacccgaagaaggcggcgctcgcgctgcgctgggccgtggaggagatggagcgccgctaccagatgctgtccgaggcgggcgtgcgcaacatcgccggcttcaacaagctggtggagagcaccgcggtggaggtgaagacgaccaccgagtccgcgccgaagaagaaggcgaagccgaagaacgtgctcgtgctcgatggcgagagccccaagtcctccatgcccgcgggcggtgagagcctgggcgtcgccgcaccccgggacgacgaggacgacatgctcgacgcgcaggcgcccgaggaagccgaggctccggagctggaggacgagtccgaggacaccgaggcgatggaggccagcgagtccaccgagccggagaagaagcagctcaagaagctgccctacatcgtggtcatcatcgacgagctcgccgacctgatgatggtggccagccgcgaggtggagacctacgtcgctcgcctggcgcagatggcccgcgcggccggcatccacctgatggtcgccacgcagcgcccgtccacggacgtcgtcaccggcgtcatcaaggccaacttccccacgcgcgtcagcttcatgctgcgctcgaagccggactcgatgacgattctgggcacggtcggtgcggaggccctgctgggcatgggcgacatgctcatcatgccgcccaccagcgcgcacctgcagcgcgtgcacggcgccttcgtgtcggagaacgaaatcaagaaggcggtggaccacctcaaggcccagggcaagcccgtctacgacgactccatcctcaagccgcgcgacgaggacgtggaaggtggcggcgaggaggacgagctgtccgacgagctgtacgaccaggcgctcgcgacggtcagcgagatgcgggccgtctccatctccatgctccagcgcaagatgcgcatcggctacaaccgcgcggcccgcatgattgagcggatggagcgcgacggggtggtgggcgcggcggacggcgccaagccccgcgaggtgctcatccggggcctgggcgacatgcccggcgccggggccatgtaaggcccacgtggccgccgtctcccggatgggatgggaggcggtggccctggcggttccacttcacgggggcgtcctggctcggcccggacgccctcgctgttttccaccggggcgtgcccatgattgtcgccatcgcccgcttccggccagcccccgaggaagcggaccgcctggtcgcccgcttccaggcgcgcacgcgggcggtggacggatacccgggcttcctggggctggaggagctgcgctccttcgaacggccgccggagctgatgctggtgacgcgctggcgggacaaggcctccatgcgggcctactttcagtccgaggacttccagcgggcgcgggaggcgagcgcccagcaggaggacgccaccttcgccctctacgaggcggtgggcacatgaaacgcgatgccggttcccaagcggcccggtgtcgtctatgggcggaatcccatggctgaacgcattgcccttttcgccaccgccgctcgcggcaccgaggacctcctggccgacgagctgaaggagctcggcgcccgccgcatccgccaggaccgcggcggtgtccgcttcatggccacgctcgacgaggcgctcatggtggcgctctggtcccgcatcgccatgcgcgtgctctacccgctgggcgccttcgaggcccggggcgcggaaggcctgtacgaagccgccgccagcatcccctgggaggagcacctcacccccgaacacaccttcgcggtggatgccacgctgaaggacagcgagcacagccactccggcttcgtggccctcaaggtgaaagacgccatcgtcgaccggatgcgcgacacgaagggcgcccggccggacgtgaatacgagggacccggacatccgcgtggtggcgcacctcgcccgtgaaacgctgtccctgtccctggatttgtgcggcgagccgctgcaccgccggggctaccgcgtgcgccccacgcccgccccgctgaaggagacgctggccgcggcggtgcttcgcgcggcgaactacacggggacggagggcctggtggacccgatgtgcggctccggcacgttgctcatcgaggcaggcctcatcgcccgccggcgcgcgcccgggctcaaccgggacttcgcggtggagcgctggccggagctgggcacccgggcccgcgagctgctcgcggacatgcgcgcggatgcccgccgcaacgagcggaaggtggaagtaccgctgctcggcttcgacaaggacccggaggcgctggaggccgccagccgcaacgtgcgcgccgcgcgactgacggaggaaatccagctggccgagggtgacgcgacccggctgccgccgctgccggagacaggcggattgatcgtcaccaacccgccctacggcgaccggctcggcacgggcggccagaagggcatgaagagcttctacttcaagctgggcgagtcgctgcgcgtgccgggctggcgcgtgtgggtcatctgcggcaaccccgccttcgagagcgccttccacgcgcgcccctccgcgaagcgggacctctggaacggccccatcgcctgctcgctgctgggctaccgtcctccagacggcggcagcgctcggggtgacaccgggaacggctcagaagcgccgctcggtgcgccgcgccagccggaggatgttgccccggtgcgtccacagcatgagggcgaagaggagggctgagagtcccgcgtactccacggcccgcgcggtgagcgccgacgtgcccaccgccgtggcccccgccgccagcgagcccagcgagctcacgcgcgacacggcgaagacggcgacgtacaccagcgcggccgccagcgcggcctggggcaccagcaccagcagcacgcccagcgccgtggccacgcccttgccgccctggagcttgagccacaccgggtagatgtggcccagcaccgcggccagccccaccgccacatgcacggtgggcgcatccggcaacaggcgcaccgccaggaccacgggcagcgcgcccttgatggcatccagcagcaacaccaccgcgcccagcttcttgcccgccacgcgcgtgacgttggtggcgccgatgttcccgctaccgccggtgcgcacgtccaccccgcgcagccaccgcgtcagcaacacaccgaagggaatggagccggcgaggtagcccagcaggacgagcgcggaagtcacgacgcagaggctacagcagcaggtgggggaagcgcgtcttcaccaccacgtaggcgtaattgaccaggatgatgatgggcgtcacgacgcccaggacgctccactcgcggggggagagttccacctgggggatgggcatcgcgaacaccaggtgcagcaccatgaccaccgccgccagcgcgaacacgatggccgccaccgttcccagggggttggcctcccaggcgccggcgaagttgaggtgggacacccggtcggccacgcgcgtcagaccgcagccgaggcagggccacccggtctgctccctgagcacacagccccagaaggggatgatgcgggccaccgggatgtagcgcgccacgagcagccccaccacgccggcgagccccatggcgtccacggtgctgaaacggcggttgcggggagggatgacgaccttcaagcgcacctcctcagcgtgtgcgaatggatggactttagtacgggggtcgccttgccggagcaaagacttttggctaagcggacggggtatgaacacgctccgcacgtccctgatgctgctggtcgccgttcccctggttgccgctgcgggtgacaagtcgtccgccaaggcgggcaaggccgccgaggccgactgccaccacccgcccgctccgcaggcgcagaccgcgcccaaggccgaaggcgcgcccgatggctggaagctcacccgcggcgagcccctcaagggcgccaaggcggtgaagctcgcggacgtgctggccaagccgcaggctcatgacggcaagacggtgctgctcgaggggcaggtgcgcaaggcgtgtgagcgcaagggctgctggatggagctggcggcgaacggccaggacaagggcccgggcgtgcgcgtgacgttcaaggactacggcttcttcgtccccctggactccgcgggcgcgcaggcgcgtgtggaaggcgtgctgaaggtggccgagctgaccgacagccgcgcccagcactacgagtcggagggcgccatcgtcccccgcggcgccgatggcaagccgcgtgaggtgcagttggtggccacgggcgtcgaactgcgccgctgagacgacatggcacgaagcttcagcatgcgcggcgtgcagagcgcggcggaccgcgccgtgcagcacgcccgcgcatggatgttggagacggagccgggctcgcgcgtgcatgacgtgcagttggacccgcgcttccagcaccggggtgtggacctgctctgggagctcccctcgggagaggtgcgcggcatcgaggtgaagggcgaccgcaacgccacccgccgccgctacttcttcgagttggtgtccaacctggagaaggacaccccgggctgcttcctctacagcggtgcggacctgctggtgtacgtcttcctctcgcagggagagctgcacgtcgtgcccatgaaggcggcgcgcgagtggttccttccccgggcgaaggagtacccgctcaagcacgccttcacgcagacgggcgccatccgctacaccaccgtgggcgccgtggtttccgtgcgagacgtggcggaaggtgtccccggcgtgcttcgcgttccgctgaagcgccggggtggcgcgaaggacgtggaggaagaggtgccgcccacctccgaatctcctcagggacaggagtcgaacggctaggacgaaggggtggaagcgcggctccctggcaccctctttcctgggcgcggagccgcggacgggcccctcttcccacgggctgtgacaggaggccacgcaggccccctgtcacgcgcgtgcctcagtgacggagacggcggtgtccggggtgaatcttgtcgtgggccgcctccaggcgctcggagatgcccatcagctccagcagcgactcgcggtcgttctgcgccttgtagacgtgctccaggcgggggacgaggtccagcgcgaggtgcaggtcaccgccattctccgccgccgcgagcagcgtgcgggccgcggccgccgcctgaccgtgcgccttgatgtggatgaggccgtccaccgccagcaggcgtgcgatgggggagcgctcggtgtcctcggtgagcttcaccatgtcctcggtggcgggctgcagctcgcccttcgccgcgcggacgatggcccgcgagattccacggcggtccggcaggaggaactcctccaggtccgcgaaagactccgcgtggcccacgtggcccgacgacgccagcgcctccgcgaggctgtcgaagatttcggcctgcttctccgtgaagggcgccagcgcctcgcgcatgaagcgctcctgcggcgcacccttctcgtcgagcggcatcttcgcgcgcaccgcgttcatcttctcgaaggcggcgtccaccgccgcgtcctgccgcccacccaacaggaacgacagttgctgcatcaggttcgccagcgtgtcggccatctccatgggcgccacgcggtccggcagccagcggctccacagctccactgccgccgccacagcgaagtccttgaaggggccggtgcccttccactgcggccgccactgctgggcaatgcccagcgggaaggccgtctccgccagcttgcggaagtcgtcctcgcccacggcaatgccgtaatggccgagcgtcccgagcagggcctccgtcgagtactccttcaggcccttctgctgccacgacttgtccactcgctgcgtgctcacctggatctccgctgccctggacgccggccatcggcgcgccaagcggccttctagcggaagccggggcggacgtgcaccaccacgtgcaatcccacgtcaggcggcggacgccgggggcgcggtcctcggcacggtgggccacaggacggggttgcgccgaccgtcctccacccgccgggccaggtacggctcacactcccgggcgtcgaaggcccgcttccaggccgcgaagttccctccggccttccaggcatccatggccgccagccccgcctccggaccgcactgggccagcatgtactccacccaggcccaacgcgcggacgtcgggcgcacctcggcgcgcccccggagccccttgcgcagtcgctccagccgcccctccacctcgcgaatgcccatgaagggagcgccatccaacggcgtgttgcgcttggccacgaaaggcgccacgcccagcgccaccggtaggatgcgggacagctcgctggtgaagcggatgagctcgtcgatgtccgcgtcctcttcggtcggcagacccacgacgttgtacaccttgagctgcttcatccccgccgtacgagcgaaggtcgcggcccggacaatctgttcctccgagtgcttccggtccaccatgtcccgcaggcgctgtgacggaccgtccgccgccaccgtgaggttggtggcccctccgcgccggagctgatccaccagctcctgggtcagccggtccgcgcgcagggaggacacccccacctcacggccggactccacaatcgtccggagcaactcgacgatgcgcggatggtccgtcaccgccgcgcccaccagccccacccggcgggcatgctccggaatcagggacaggatccgctccggcggcaccgtgcgcatgcccccgttcgtggtgcgccgcatgacgcagtaatggcagccccgggagcagccccgctccggctcgatgaggaacatcgagcgcagctcggtgttcggtgtcacgatttgcgaccgagcaggcagccgtgaatccgtggccttggccacgtggtaccgcgctccgccccgcccgggcacgcggaagcccgggatgcgcgccaggtgcgccaggagggcctcgcgctccatggtcgccgcggcctccaccagcaggtggatcaaatcctccgcctcgccctggacgagcacgtccacgaagggctccagcggatccgggttggagaacgtcaacggcccgccgcccaccacgagcggatagcggccatcctggcgctcctccgccaggagcgggatgcccgtcagctccaacatggagaagagccccgtcagctccagctcataggccacggagaaggccagcatgtcgaagtcggcgacagggacctgggactcccaggtgaagagcggcgtccgggtgcgcttgaaggcgtccacgtcatccggaaggaagacgcgctcggccgtcgcgccaggatgctcgtggatttcacggtagatggcctggtagccgagcgagctcatgcccacgtggtaggggctggggtagcagagggccacccggtagggcgccgccttgtgcagcgtgccctgttcgtccgctagcaagctgcgaacgcgctcgatgagtgagtaacggccctccatgtgtctccagtacaggtccagccttttaaacaccgcggccccggtcagccactcccatgtggggagagaccgccggggccgaggtgcgccacccaggtggggtggcgcggttcagcagacgacttgttcgactacttgaacgacgggatgtcacccgccggcacgcagtagcccgtggttccagtcgcgctggtcggctggcacaccacggcgaattccgggttcaggccggaccccacaccgcagttctctgcgggctccgtcgaggcggtatcgcacggtgcgggcggccacacagcgcgcatcacgtaggacgaagtgcaaccattgctggtgtacttgagctcgcccgtgaactgggttcccggcgccacagccgccgagtacacgcgaacattagtgaactcgtagcggatggtgttcgccgccgcagtatccgaggccgccacgttgacgaacgcaggagcgaagtcgttcgcgtggcagaagccatggtccttgggttcggtgtccagagaaccgagcgaagtctgatccgccgacgtggtcgtcgtgtcagcaatcgcgcggctcgccagagtcgcgggacgaagtgcgagctgcgcggcccccgtctccgggttcacgtacttgtagacacccatcaactccacgagcggcgcagtcgtggtgcactcgtcgccattcgcgtccttgggggaatccacgacgtcgtacttcaccgcccagctgggcgactcctgcacgaagcagttggtctcaggttgttcgaagttgcagcccgtcagcaggcttcccgcgcccacgagaaccaacgcagtattgacgatgttcttggtcatgtgactgatgttccgattccgtgactgggcctgggattagaacgtgtaccggatgccgaagcggacctgacggggcgcctggtacgagagcgggttcttgaagttcttgttcacgtcgccgtcgacactgccgaagggctcgtcacgcggcgcctggtcctggaactccacgcggcccgggaggttctccaggtccgcaggcgtgccacccgggatgggcttgatgtcgcgcagggtgtacgtctggtcgaccgtgttcacgccctggaagttgaagaggttgaacacgtccagggtgaacgactccacgctgtccttgctgacgcggtagttcacgccaatgttggagtcgatggtgttgatccacggcgtacggccgccagcgccacgggggaggacgaaggactcgtcctggaggtaggcccagtggctaccccagtagttgatcggcgtaccagagctaccgcggtaggagacacccacgctcgccgtcagggcgttcg

SEQ ID NO: 1095 - DNA, 15923 bp, Myxococcus xanthus
gcccacctgcggcaacggcacggtggacaacggcgagcagtgcgacgacggcaacaccacggcgggcgacggctgcagcggcagctgccgcgtggagaacggctatacgtgcagcggcgcgcccagcacctgcgccaccacctgtggtgacggcacccgcgcgggcgccgaggtgtgtgacgacggcaacctcaacaacggcgacggctgctcctcgcgctgcctcctggaggacggccagccctgcaatgcgtccggcgtctgcgagagcggcatctgcaaccccaacaccaacacctgcatcagccccaacgtctgcggcaacggcatcctcgacgagggtgagctctgcgacgacggcgacaccacggcgggcgacggctgctcggccacctgcgccatcgaggacgggttcggctgcaccggcatcccgtcggtgtgcgccgtgacgtgtggtgacggcatcaaggcggacagcgaggcctgcgatgacggcaacaccaccaacggggacggctgctcggccacgtgcaccgtggagagcggcgccgcgtgccagacggcggacgtgagcgtgttcatcacccaccagggcaacgcgaactgcacgcaggtgtcggacatcgacgcccccgtgctgcccgacgcggccatccaggccgggctggacgtgccgggccgctaccgcatccggtacgtgtccggcgcggtgagctactcgggtggcgtcaactggtaccccggcgtcatcggcgtcagcgccaacgcgggcacgcaggtgcagggcttctcgctgggctacacgccccgcagcggtccgggctcggccacgcgcgccgaggccatgcccctgggcttccccctgtcccgcgacttcacggcggccacgggtgacgtgcgcatcgcgctggtcgacaccgactgcaacctggccaacaactccgacacggcggtgacctaccgcgtggacgcgctgtccatctgccagacggcccctgtcgtcacgtctccgacgccgggcggcaccgccggcgaggaactcgagggcaccgccacgccgggcgccaccgtggacgtgtacctggacggcaaccccgcgccggtgtgcacggtcgtcgccgacgcggaggggaactggagctgcacgctgccgacggacctggaggaagggccgcacaccgccgtcatcacctccaccttcccgggcgcgccgcagacctccacgacggtggacttcatcgtcgactactcgccgccggcgcctccggtcatcaccggccccacgccgggcgccgtgctggacacgcagacgcccgtgctgagcggcacggcgaccccgggtgacgaggtgacggtgtacgagggcggaaccgccctctgcaccaccacggccgatgcggcgggcaactagagctgcacgcccaccacgcccatggccgaaggcccgcacacggtgacggccaccgccacgcctccgggcggcaaccccggccccacctccacgcccgtcaccttcaccatcaccctgaccgcgacggagccgccggtcatcaccgggcccgccgacggcgcggtgctcaacacgtcgacgccgcccctgagcggcacgtcggctccgggcacggtggtgacggtgtacgagggcgacacggtgctctgcaccaccaccaccaacgacgtgggcgcgtggacctgcacgccggcccagccgctggaggatggcccgcacacggtgacgggcaccgccaccgacagcgagggccgcaccagcgagccctccgcgcccagcgagttcatcatcgacacccaggagcccgacacgcgcatctcgcgcacgccgccctcgcgcggcggcaaccggacggcgaccttcgagtacggcgcctccgaggaggacgtcacctacgagtgcagcttgaacgggggccccttcgagccctgccgggacagctatgacgtgggcgagggtcagcacaccctgcgcgtgcgggccacggaccgcgcgggcaacgtggacagcacccccgcggcgtactcgtggacggtggagctcacccgggccttcgccggtggcggctgcagcacggcgcccgccgcgtcctggctggcgctcctgggcctgctcggcctccgccggaggaagcgcggctaagggctgaccgctacacctttccgccgggaggtccacacctccctctgaggccaactccgccggcctcgtgggcctcccggcggattttccccccgccacgcgccagcccgtatgctggggccgtgcacgtggcggggcgattgaatgagacgtacgaggaggagctcctcctcgcgatggacgaaggactgctctccggcgaggaggtggcgctcctgcgtgaggacgcgctccgcctgcggcgtggccccctggagctgctgcgggagcgaggccggctgtccgaggactccctggtggcgcttcgtggcgagctcgcctccgagagcacggacccgagcgttggccggccgctcgaggccgccaccctgacgcccgtcaccccgggcgtgtccccgccccccgccgtggagccggacggccccaccttcccggtgccggactgggaccgctaccagcccgtgcgcttcctgggccagggtggaatgggccgggtgttcctggcgtatgaccccatgctccgccgcaacgtggcgctgaagttcgtgcgcggggacgacccggagctggcccggcgcttcctctccgaggcccgcgcgcaggcccgcgtccgacacgagcgggtgtgcgaggtgtacgaggtcggcgaggtgcgcggccggggctacatcgccatgcgcttcgtggacggccagtcgctgggacagttggcgcgctcgctcacgctggagcagaaggtgctggtgctgcgccaggccgccgagggcgtgcacgccgcccatggcgcgggcctcatccaccgcgacatcaaacccggcaacatcctggtggagcgcaccgaggacggcgggctggcccccttcgtcatggacttcggtctggcgcgtgactggcgcgaggaaggcgccgcgcccaacgccgtgcagggcaccccgcattacatggccccggagcaggcgcgcggtgaggtgtcacgtctggaccggcgcgcggacatctacgcgctgggcgccacgctctattcgctcctcaccggccggccgcccttcaccggcgccaccgaggcggaggtcatcacccggctccagcacgaagagccggcgccgccgcgcgcgctcgatgccgacattccatcggacctggaagccatcgtcctcaagtgcctggagaagcaacggcccgcccgctacgactcggcgcgggcgctggcggaggacctggagcggttcctcgaaggagagcccgtcctcgcgcgacagggactgggctaccgcctgcgccgcaaggcccgcaagcaccgggtggcgctgacgctgggctccgcggccctgacgatggtgttgctggcgctcatccaggcgggcatcgcccgcggcgaggtggccgagcgcgaacgcctcacgcgccgcttcaccgaacgggtggagcgcatcgaggcctccgcgcgctactccgccctgtcccgcctgcacgacacccgtgaagaccggcgcgagctgcgcgccagcatggacgcgctggaggccgaggtgcgcgaggcgggccctcacgcactgggccccggccagtacgccctgggccgcgcgttgctcgtgttggatgagcgggactccgcgcgcaagcgcctggaggccgcgtgggcccagggctaccgcgagccccgggtggcctgggcgttggcgcaggtgctgggagacctctaccaggagcggctgctgctggacgtggagcgccgcagcccggagcagcgcgaggtccgccgcaaggagctggagcagaactaccgggacccggccctggcctacctgcgccaggccgaaggccccgacgtccctgtcccaccgctgtatgtgaaggcgctgttcgccttctacgagggccgccacgaagaggccctgacccacctggaagccatgggccgcgcgcagccctggttctacgaagcgcctctgctgcaaggcgacgtgctgctggcgcgggccacgcagcgctggcaccagggcgacaaggccggctcgcaggaggacctggacgcgggccgccgcgcctatgcctccgccgtcgccaccgcggagagccaacccatgggccactacgtcctggcgcgcctggagctggccgcgctggtgatggaactgtacggcgaaggcaacgtgctgcctcactatgagcgcggcgtggaagcggcgacccgcgcgctcaccaccgcgccggatcaccaccgctcgctggtcgtcctctcccgcctgcaccgccgtctcgccgagcagcgcaccagccagggacgcgaggacgccgagccgctgctggagaagtccatccacgccgcgcgcgaggccctggccctggcgccgcccagcgaccgtgtcgcgctggagctcgccatcacccaccggctgtgggcccgctaccgccaggagcgtgggcaggacccgagcgagcagctccgcctgtccatcgaggccttcgagcgcctgcgccccgaggagcgcgactatgccttccacgccaacctgggtctgacctatcaggtgtgggcggacgcggaagccgagcgcggcgtggacccgctggagcaccagggcaaggcgattgacgcgtacctggaggccatccgcgtgcgggagaaccaggccgacgcgtggatcaacctgggcaacgccctgcgccgccgcgcttcgaatccacgcgccaccgacgccgcgggagatttgacgcgggctcgtgacgcactggcgaaggcactggcgctcaatcccggcaacgtcgtggccagcttccgcggcgcggaaatttccgagcagttggcgcgctggcgctggagccacggcgagcccttcgaggcggacctggagcaggcgctggccctgttccggcaggggctgggaatcaacgcaaagctccccccgctccacaacgggctgggcgcggcgctgctgtggcaggccgagcaacgctgggaggaaggcggcgaccccgagcccctgctccagcaggcgcaggcggccttcgaggaagcccggacgctggcgcccagacaggtgtacgcccacaacaacctgggcgaggtgtggaccctgagcgccaccttccagtccgcgcgcagggagaatccagggccgagtggccgcgccgccgtggaagcctaccgtcaggcactctcactccagccccaggacgccgacctctgggccaacctcggccgcgtgcagacactgctggcgacgtggagcttggagaccggcggcgacccacgggcggagctggcgaaggccgaggagtccctcgcgcgggccaccacgctgaatccccgccagggccacacgtggcgcaatatgggcgaggcccgcgcgctcaaggcccgctggctggcgcaccggggcgccgctcaggaatcggacttcgagctcgcgtcgcaggccttccagcaagccctgtcgctggagccccgccggcatgactaccggctggccaccgcgcgattccagctcgcctgggccgcgtggcgtcagcagcggaacgaggacgccgcgccgctgctgaaccaggggctcgcgctcgtggcggaagtcctggcggaccggcccaggtgggcgcgggcccaggcgcttcgtggcggcgggctgctcgccctggcggagacgcgcgcctcctcggagcaacggcaggcctggcgcatcgagggccaggaggtgttgcggcaagcactggcccgcaaccctcacctggaatccgaatggagaggccggctcggcgcggctcgcgagccgctggccggccctcctacgccctgacgtggctcagtactccttgggcgggtccgtcgtcacgtccaggttgccgttcttcgtctccaactcgagcccgtggctgcgcgcctcgggggagccgccagtcaccaccgtgaacgggtacgagccgaccgcggccccgtcggaaacggggtcctcgcgctgggctgcggccagagaggtgttgttcaagttgaacgacgccgtcgaatccaggcacgcggggggattcaccgtcacgtccgatgcggcgccaatcatttcaatggagaagcggaccgtgtctccgtgccggaccttgttgttggggatgtagctcaggttcccggacttgttgatgagaacagtgatgatggccatgggccgtggctcctgtgccccactggggcgtgtgatgaactgctgccggttgtgacctgcatgcaccataccagatgggtctggttcacggcgtcctcaatgactcacaaccgcagcacgccctcagcggaatctggacgcgtcaccccacccataaggtctggcctgacacgtcagggcggctcagagctccggcggatccgtcgtcacgtccaggttgccgttcttcgtctccgcctcgcctccgaggtgcggcttctccggcacgggagggacctccacggtgaacccatacgtcatgaacgcggccgattcggagaccgggtcctcgtagatggggggcgccgcggaggtccggtccaaggtgacgggattcgttgcgaccaggcacgcgggcggattcaccttcgcccacaaagggccgttgatttggtcgagcacgaagcggacgggttgcccacgccggaccttgttgttgggctcgtagaccagattccccgacttcatgatggtgacggtgacaacggtcatgggcgcggctcccgtgcccccaatggggcaatgagaaggattgctgcgggctgtgagttgcagacaccgtaccagtcaggaatggcgcgaggcccccctcgacaatcgacacccgcgccgcccctgaaaggcaaatggacgcgtcaaccgaacccaccaggtccgggttgacgcgtcagccaacactacccaccactgaggcccagctcccggacccgccgctggagcgcgcgcttggagacctccagccgctgcaccatccggtcgaggtcgccctcgcactcgtggaagcagcgcgtgatttcctcggggctcaaatcgcgcgcggtgcgcaggagcgagctcttgtcgatgaggacgtagacggacggccggggaatgcccagccagtccgcggtggccttgaggtcccaggagctggcgcgaagggcctccagcaactcctgctcgcccacgtccgcgggctttcgccgcggtgccttcgcgccatcgcccgcctcctcacccgtgcgcacggtcaacggacgcccggggactggctgcgcgtccgcgtccagcacctgctccagccgtgcatcggcgcgcagccccggcgtgccccggctgccgatgacgagctgacgggtgacgttgcgcaactggcggatgttgccggaccacgcgtggcgcaccaactggacggccagggccgcgggcagccagggctcggcgcgcgggtccgaagtcgtcagttgaccgccctcccccatggcctccagctcctggcgagagaagtggaggaagagcaggcccacgtcctcgcggcgctcacgcagcggaggcaccaggatttcaaagccggccagccggtgcagcagcggggccttgaaggtgcgctcctggatgcgggcctccagatgcgcgtccgtggcggagaccagccggacgtcgacaggcaccggcgtatggccgcccaccggatagatttcgcctgtctccagcacgcgaagcagcgcggcctgcacctcgggcggcgcctcgccaacctcatcgaggaagagcgtcccgccctcggccgcgcggaagaagccttcccggtcgcggctggcgcccgtataggccccgcgctgcgcgccaaagagctccgcggcaaccagctccttggcgagcgctcccaggttgacgctgacgaagggaccggcgcggcggggaccactggtgtggatggcgcgcgccaccagctccttgcccgtgcccgtctcgccgaggatgagcaccggcacggcgaggtcggccacccggatgatgtcctcgcgcacgcggtggatgccctcaccgtggccaacgatgcccaggtccaacacgcccggctggcggaaggacgaggccaggtggagcaacagcaccacgcggtcggccagcaccagcggcactccatcggacagctcctcgcgagagaactcccggccgcccacgacgggctcgttcgccacgcgcacctgggtgccgtcctccggcaccaacatccggaggccgcctcgtgggccgggctcgaactccaccggcttgcggctgaggaatgggtctcccagcgggagggccatgagccccccgggccgggagaagtccggcgcgttgcgagacagggccgctgtgcgcccctgggacgcgagcacctccagcaatagccgctcgccaatgcgctgcggctggggatgggacacaatcgtcaaggcaggcacggagagcgccaccgggctctgcccggcctgtgcgcggcccgcggtggtcgacatgtctgcggcgagtttctgctgcatgggtattcgtgtgagtcctgggatacccgctgagcctacacttccagaagcccgagcgctggcttcatccaccgaggaaacgacgtgagaatcccgtgagttgggcgaagtggtcggtgccggggccgcgacctatccgcatccgctgcctccaacctccggacctcctgggatacgtccacatcctccgagacttcgcgtccccgcctgaggggcgcacacgcactgtccgcatctacacacccggtacgtatgacgcctcacctgacaggtcctttcctgtcctctccatacagtccgagtccgcgctcttcgatacttggtgcgccaaccaccgtgggacgagccccgaagcaacgtggcggcccgggccgagcactccgtgcgcttcgtcattgaaacactgaagccatacatcgaacgcacgtagcgcgcccgcaaggggccctggactgggctacgcggaccacgcgcgggacttgcaacggcggctgccggaggccatgcgctggctgctgggatgacggccgacggccccggccagcgcgtcgcgggagaatggtagggtttccgccagatggacgccctgctccccgtcactccgaccgaggttttcgtcaccctcctcttcggcgccatctttctctatgccacctgggtcatcgggagcttcacccgtgacgcgatggtggagcgagatgtgctcaagcatggcgaggacgccgaggccacggtgctcgagctgagggacacgggcttgcgcgtcaaccgccgtcccgtcttcgaactgctcctggaggtccgtcagaggggacgcgcgtcgtatcaggcgcgagtgaggaagcggctgggtccacaccagagcgtcgggtcgctgggcgtggggatgcgcctgaacgtcaaggtcgaccgggccgaaccgagcaaggtcgccatcgtcggcgcggccatgacggcgcctgtcggggccttcgtgctccagggcatgccttccgcgggggacccggtgaaggcgatgcaggaccttcagtcgctgatggacaaggggctcatcaccccggaagagttcgaggtgaagaaggcgcagattctcgcgcgtatctgagaacgcgcatcgaggtgatgggtgctgaccgcggtcctggcgatgttgcccttcctgctcttctcgctcgtcggcctcggcgctgcggggtacttcttctattcgcacgcgcagacgcagcgcctccgcgagcacgggaccgctggcgaggccaccatcctccggatggaccgcacgtcgatgcagatcaacaggagttacgtctacgacttcctgctggagttcaaggtgccgggcctccccacgtacaggcggcagcaccgcagccgggcgcatgattggaaggccttcatcctggagcccggcgtgcgcctcaaggtgaagatcgacccgaacgaccctcagcggttcgtcgtcctggggcccgtcgatcagcagcgtccccagagcatccaggccctcgtcgcggcggccactggcttcaccgaggtcaggaccctggcggctccggacccggtgaaggccttgaaggacctccagtcgatgctcgacaacgagctcatcacgcaggacgaatacgcgcagaagaaggcggagattctcgcgcggctgtgaagcggcctcgccctacacgatggacgcggcggcccgctgcacctggggcacgccgggcagcgtgggcgcgggattgagcgcctggaccaacagtgagcgcagcgcgtccgccaggtcatccgtcgcgcccagggctcccgcgggagccccctgcaacgccgcggggacctccgcgcccaccaccaccaccggcatccggacctcccaggccaggtagtgcgcgagccgcacggagggctcggccacatccatcagcagcgcgcccatggcgcccgccgtgaagggacgccacagcggccgcgccgcctccgcgggaggcagcacgcagaagtccaggcgcagcacctcgctgagcaccaggcgccccagcgtgccgaaaccactcttcaccgcggtgggctcggccgacagcgcttccatgccgggcatgcgggagaggacccgccgggccgcgctcgcgccactgccgcacacgaagattttcgcggtggccaccttcgcgggcgctcgcgtgcggagaatccggccgcgcagcgcgtgcacctccgccgcgcccagcagctcgccggacgcagcctccacgccgtccccgtccgcggctctcgccacgccccgctgcatgagcgtggtgaggacgttgagcacctccaggtcggtggccggcgccaggtccagcacctcgcccagggcgcgtggctggcgaagcaggtccaccacctgctgcgtcaccggatgctggtctccttgcaggtccgcgtccggcgccagcatcagccgcgtgtggcgcggcggcaggccgggcatcagccggttcacctcgtccgactgacgcatgccctccagcagcgcgtcatccatgccgcggttgatgcgcggccgtgccgtgttgcctccgggcgagaaggtgaacgtcccgtccacccacgccagcaggcggaacagggccttctccccttccacgcgccccagcttcgcattcaccgggcggccttcgacgacggaaatctcgccccggtcgttgccgcgctccagcgtcagccggccgctgcgccggttcatgcccaacaactgcatcaggtccgggatgctgagctggctgagcgagccttcgatttcctgctgctcgctcttgaggtccttggccgcctcgctgcgccggaagatgtgctcgatgcggctgagcacctcgtccaggttgaagggcttgcgcagatagccgtcccgcaggccgcgcagccggtccgactcgaagctcgcggtggtgagcaccaccgggatgtcctcggtgcgcgggttggtgcgcagaatctggatgaaggtgcgcgcgtccagcagccggcaggcctcgtcgaacagcgtgaggtccgggtggcgcagcacggccacctccagggcccgcgagccatccggcgcgtagtgcacctgatagcccttggtgcgcagcgcccgcgacagcgagcgcaccgactcgaggtcagggtcggcgatgaggattttccggaccggggccacggtggcgctccgcttcgtgtcagtagggctgcaggtcgtattcggcctgcagcttggagatgagcccgtccaccaccgcggtgtccgaggtgtggaacccccacgtcgctccgtggccccgccgctggatgagcgcgtaggccgcgttctcggagagccagaggatgaactcgtgccgcgcgatgcggtcgtcgccttccaggaacacaggcgtcagcgcggggtgtgactccaggtcgacgcggcggcccagcaggtagatgcgcgacgccaaatctggaggcgcggactccagcccggcggcgatgttcaggtccgtgcgaatctccggcccgcccacgtacagcaggccgcgcgagcctgggtcccgcatcatctcccgggcaatctccgcctggagttcgtcgaagaggacgtcggacaccttgccccggcggctcggctcggagcgctcgtccaccggcagccgggggctgttcggcgtgcccaggagcaggtccacctcgtcccagaagggcagcccgtccagcatcagccggcgctgcaacgacgcgcgccgctcgtccatgcggcggcggcagcggtgcaccagctcgtcgaagtcctcgccgtccttggggaaggtgctggccccgcccaccatcgccagcgggaggcgctggtccacctccatggcctcgggctcctcgcgcacggcggccacggcgcggcgcacgaacatcaacgccccgaagaagtccgtctcaggcagcaggaggtagaactcctggtcgctcgccttcgcgatgacatccgagtcgcggatgatcttgctgagcgccttgatgatgccgcgcaccgccttcttcgcgtccgccgcgccctggcgcacgcgcaccagcggcaggttgtcgatggagaaggtcagcagggagaacgtccgcccgtagcgccgggccttgtagatttccttggacgcgtagtcggtgaagtagctgaggttgtacgccgccgtctcgcggtctctcaggcccaggcgctggagcgcgagcatcttccggccgttcttcaggcccaccgccgcgaagtcacccagcaggcgggcatcgcgcgaatgctcgggccggaagtctcctgacagcgggtcggagagttgcgccaacccgacgacttcccccgacgccaccaggggcacgtacatcaccgacgagcgctcgtcgcgggccagccacggctgggcctctctcaggcgtccggacagcggcccttccgggctcatcttctccgcgagaaactgccggtccagcagcccgcggtaggcccgcagcaccaggtctccccggtcgtccaccacccacagcgcggcgctctgcgcgtcgcagatggccgccagctccgaggtgagccgctcctggagccactccaggtcgggatgggacaggagctccaggcagcgctggtgcaggttgtggaagcgggcgaactccaggttctcgtcacgaagctgcgtccgctcgcggcgcagggacgcgcgctccagcgcccggtccacggcgagcagcatgtcgttggcgttcaccggcttggagaggcagtccgccgcgcccgagcgcagcgccacctccgagccccggatgtcggtgcgctggctgacgaggatgacctcctggtcggggtcccgctcgcgcaggcgcgcggtgagagcgaagccgtccacgcctggcatcaccacatcggtgatgaccaggtcgaacgacgtgcgtgccgcctcttcgagcgcgagcgttgcgttctccacggccaccacgcgatgcccgttatgcgtgagcaagtcgctggcgagctgacggaagaacatgtcgtcgtcgacgacgaggatgggtccggccacggcgcgttctgacctgggagcgagaggaacgcgggaggttaccggcccgagggagtcgcgacaacgccctcgaagacgaaggccaccggtccacggaggcggatgtcggacaggtcggcggggacgcggatgctcaggtctccccctggcagggtgacgcgcagccaggcatcggccgggagccgtttggccagcacggcggccacggcggacgcgcaggcgcccgtcccacaggcctgggtgaggccgcagcctcgctcccagaccaccacggtgaggccgtccgagtccacacggacgaactccacgttggtgcggtccggaaaggacgggtggtgctccagcaggggccccaggcgcgaggcatcctccagcggctggtccaggaggaccatgtggggattgcccatgctcaccgcgtaggcgcgcaggggcggatggcccggcaccaaggcatccagaaagggctgccccgtggcgcccgaaggcaggttgggggccaccagccgggcgggccccatggagatgtccacggccaccacgccgccctcgccatacgaggggtagcaggtgagcacgcccgccccggtctccacgttgatgtggcctggcgtctggcccgaatcatccaccaggaacttcaccgcgcagcgcagtccgttgccacacatctccgcgatgctgccgtcggcgttgtgcacgaccatgcgggcaatgccacgctcggagggcagcagcgccagcaccccgtccccgccaatgcccaggcgccggtcgcacatccaccgcgacgtggcggcgtcgatgtcctcgccggagccgcgccggtccagcacgacgaagtcattgcccaggccctgatacttgaagatgcgctcgcgagcttccacgagcgcaatcctagtcgcgagcggctattcgcgctcgtccggcttcgtgggcgatgtctggggcggcaggtccagcgcgggcaccgcgcctcgggggcgccgcgccggggccttggcgccctgctccgtcccggctggggggaccagctcattcctggccggctcgggcgcgtccaacagggcgaagctgtccgcgcgggacgccggccgctttgccgcggccagttcggcctcgcggtccgcgagcttctgctggaggtcctccaccagggactggaggagctccatctccgcggccatctccaggacgtcttcgggctgggaggacaccttgagggactccacggtggacaggagttcggtccgctccgcctccaacgcgtccacgcgggccttctgggactggagctgggtttcgagcccccggagctgttcatcgagctgggagcgctcggtctggagcaatgcgagctgcccggccgcgctgccgtcgtgctgctggagctgctgcctggccacttcgagcgcctgggacaggcgggtgcgctcggcgcgctcggcgtcgaggatccggacggcgtcggtggacgcggcttccagggcggtgacgcggccttcgaggcggacccgtgcggcgcgggcgacggacaggtcggactggaggcgctcgcggtcggagtccgcacgggcgaggcgctcctgggcggactgaagcgtggccgcccgctccgtggcggcggtcaggtcggcgcggagcacatcgagctgggacgtgagctcggcgacgtgggattccagtgtggccctgtcggcttgggcacggtcagcggtgtcggagagccgggccgcgcggtcgctggcctccgccagttgcgcattgagattcgcggaggcctcggcgagccgcgattccagctcggcttgctgtgcctcgaaccgggcgttgaggtccgcaagccgggtctccgactcggcgcgctgtgcctctgcgtgggccacggcctccgcgagccgggcctccagttcgccacgctgcgcctcggagccggccacggcgtccgccaactgagcctccagcgcgccgcgctgtgcatctgcgttgaccgcgacttccgccagccgggcctccagcgccgtgcgttcggcctcggtgcgagcagcagcctccgcgaactgctgcgccgcctccacacgtagcgcatcggaacgagagacagcttccgcgagctgcgcctcgagttcggagcgctgggcgttggaacgcgcgacggcttccgcgagctgcgcttcaagttcggcgcgctgagcatcagaacgcgagacggcgtccgacagctttccttcgatttcggcgcgct

SEQ ID NO: 1096 - DNA, 14555 bp, Myxococcus xanthus
  unsure (1)..(14555): unsure at all n locations
tggctccagccgctcgccgtccttggcgatggacaccggcagcggcgtcacctgggacagccagcgcaccatgccctgggtgaagcccacggtgatgtgctgggcgatgagcagcggcaccggcagcgagcgaggcagcttggacagcacgtccgccagcgcgggcggcccgcccgtggaggccaccacgccgaagatgtccacccgcgcgccagtgggcggcggcggcgcggtagccgcacgcggccggcgggagatgacgggcacctccgccatgaggcacaccgagtgcgccagctccttgccccagcggcgcagctcctccgcgttcgtcacgttgggcttgccgatgagctccagcgcgccggcgctcatcgcctggaagcccaggtccacgccgcgctgctccgcgaccgcgctcaccacgaggatgcgcgcgggggactgggacatgatggcggcgatggcccccggtccatccaggccgggcagcagcaggtccatggtgatgacatcggggcgcagcaggcgcgccaactgcacggcgcggttgccgtctcccgcacggcccacgacttcgatgcgcggctcctccgtgaggagggccgtcagcatgttcgccatggtgggcgaatcgtccaccacgaggacccgaatgggtcgctggacactcacgcgcgactcccccggcggctcatgacgtccagcacctctgccagcagacggcccgcggcgcactcgcgcttgctgaggtagccgtccgcgcccgccttcaggccccgctcgcgcgccaccgaactgtcatgcgcggagaccaggatgacgggcagcgacgccgtctccgggcgctcccgcagcttcgcgatgagctggatgccgtccatctcctccatgtccaggtcgcagatgacgacgtcgtaggtgtccgactggagccggtccagggcccgggctccgctggccgccaggtgcaccgtgaagccgcccgcctccagcatggcccggtgcagcgcccgcgcggtgagcgagtcgtccaccaccagcgcccgccgctgcgccgacacctgcacctgcaccgtctccgtcaccagccagtccggacggcagatgagcagcagctcgccacggctgagcgtggccgcgccctgccaggccggcacgtcgcggacttccgacggcaacgggcggatgaccaggtcccggtcccccaccaccgcgtccaccaccagcgccacgcgcttgccaccgctctggacaatcaacagcggctgcccttcggccggcggcgccagggcgcgcaggcccagccgcgcccccaggtccaccaccgacaacagctgtccctggtactccaaatgcgcccggcgcttgcccaggcgcagcgactccgcgcgcgccagctgcgtggcctccaccgccagcatgggcaggcccaccagctgctccagcacgcgcaccaccagcaccggcgagctgcccaggtccgtaggcagcgtcagcatgaagcgcgtgccctgccccggcgtgctcgcgacctcgatgcggccctgcagtgcctccaccgaggcgcgcaccgcgtccaggcccacgccgcggccggacgtgtccgtcacgtccgtgcgggtgctgaagccggaccggaagatgaggtcccgcagctggttttcattgaggcgcaccgtctcctccgcggtgacgacgccgcgctgctcggccaggcgtcgcaccacctccacgtcgatgccggcgccgtcgtcggacgcctccaggtagagcaggttgccctgctgctccacgcgcagggtgagcgcgccctcgtggtgcttgcccgcgcgctcgcggtccgccggcagctccagcccgtggtccacggcgttgcgcagcaggtgcaccagcgagccctgcagcttctccagcaggcgccggtccagcgacacctccgcgcccaccaccgacagccgcgcttccttgcccagctgacgggacaaatcacgcaccatgcgctggagcgggtccaggatggtgcgcaccgggcgcgtggtgatggccttgaggccatcctccagcgcgtcgacgatgtcactcgtctcctcaccgtcggtgcgcagcgagcgcgcggtgccggacagcgccgtacgcgcctccgccgtctccgccagcagcccctgcttcgccagcagcacggccacccgctccagttcgcggccccgctcctccacgcgcaggcgcacctcgcgcaggcgctccacctcgcgcatcagcgccgtcacctgccacgacgacacgcgccagcccgcgtacgcggactccggcagcgcgtccggcacgagcacgggctccgcggacggcaccggcgcggcgacggcggccaggcccccggtggcggcgaccatgggcgcggcctcttcggggcggcggggcgtccgccaccagctgcgccagggcggacgccgggtccggaagcgcctccccacgcccgtccgcgtgggcctgcgcgcgcagcaggaagaggtccaggccgtgaagcaggatgtccaccaccggccgcggcatcttctgagggttcgccttcagcggggcgagcgcgtcctccagcttgtgggcgatgtcgctcaggtcctgcatgcccagcgaggcggcgctgcccttcagggtgtgcaggtggcggcccagccggacgtagagcttggtgagggcgtccgtctccaggccctcgcgctccagctccagcaggtccatggtgaccttctggaccacttcctgggcctcgacggcgaagcccgcgacgagcccctgcagcatcggatcaacgggcatgacgggctcccgtgccgcgcgtggcggagaacagccgcttcaggtcgatgaggtggatgagctgccggtcctgcgtgaagacctccatcaccgccccctccgcgcgcacccgcgcggcttccaccgcgctcatgggcagcgtggtggggcggggaatggcctcgcagtccagcgcgcacagctcgccgtcaccgcggtccaccaccagcagcaccgccgggtcctgccgccacccgtggccgcccagcagcgacgccaggctgagcgcggccagcacctggccctggaagcgcagcaccccgacgacgtgcggcgccgacagcggcaccggcgacaccatcttcaggggcagcgcggcgcgcagcgactccagggagagcgcgtagcgctcctcaccgagcgggaactcggcaatccagtggaccgcctcctcgacggtgttctccccctgctcacgcaggcgggacgcgcgccgctccaacagctcgagcgcctcggcctcctgggccgcttccaacgtccgcggggtgaccttcattcgagcgccccctggttgaggtaggcgtcagcggacgcctggtagaaacgcgcgggcagggcctccggcccctccacgagctggtcaggaggaagccgctccgcgcgcgagcgcaaggcgcgcatcagcggcaccgcgccttcccgcgccccggagcgctcccgcagcagggccagctccagcagccccggcaagtagtccggcgcctggcggaccagggcctccagcacggaggacgcgcccacctcgtcgccttcctcgatgcgctccagcgcattcaggtgcaacagcgtggncggcggcgaaggcaccacgggcacctcgcgcgccggagcgggcatcagcggcgccaccggacggcgggacggcgccgccaccggacgggcgagggcggcggcgcgggacgcggcggcggcgcgggcgttcagctcttcctgcgtgaggaggcggaaggcctgcagctccggcggcccctcgcggaccatgcccgcggggacgcggtccacctccacggcgcccaggaacaaccagccgccggggttgagcgtgcgcgacaggagggtgatggccgcgtcacgcgcggcgggagtgaaataggtgagcacgttgcggcagaggatgaagtcgaagcggccgaagcgctcgggcagcggcgccagcaggttcgcctgggcgaaagtggtgatgcggcggacggggggaaggatggtgacctcgcgctcgcccgtctccgagtagagcgggaagaggcgcggcgcggactcgcggcgggaccacgtcccgtaggtggcgcggcgtgccgcctccaggctggcctcgtggatgtccgtccccagcacctccacgggaaagccgtgcggcagcgacgcctggaggcacgcggccagcgaatacgcctcctcgccagacgcgcagcccgcgctccagccccgcagggccagggcaccccgctggagcgccgcgggcacggcctcgtgggagatgaagcggaagtgctccgggtggcggaagaagtacgtctcccccaccaggatggccttcaccagcgcggtggccaggtgggagacgggatggagcagttcgcccagcaagtcgggcgcggtgcgcccgcgggccagctccgcgcgaacgacgcggtccaccgcctcggaggcaatggcgtcattgcgaaagccagtgatgccggccaccacttcccgcgcgcgggccagcagccgcgggtcgagcgctccgctcatgcgttccgcccggcctccgcggcctcgagcatcgcgggcagctcccgcaggagcccccgcgcgatgaatacccgcgggtccaggatgggcagcgaacgccctcccgaccgcagcatgccgatgagcccctcgcgcagcgggccatggtcggcgccgcccacgcgctcgcgccggtcgatgtccgccgccgcgtactcctcggggtccttcaccgtgtccacggcgagcgccagcgacacgccctccgcctcgatgacgacgagcatgcgctccacgcgcgtcagcttgtgctccacgcccagccggcgcgccacgtccagcacgcacagcgccgcgccccgcacctccacgtattcgcgcaggtacgccggcccggtgggcagcggccgggtcgccggatgcagcaggacctcccgcaccgcgtccagcggaatggcgaactccagctcgcccaccgtcacgcgaagcaccaacaacgagcccgtgcgcgcccgctgccacgcgctcgtcatggcctcgcccaccgtctgcagcagctcgtccgcgcggaacggcttggccaggaaggtctccgcgcccaggcccaggcacgcctccgcgcgcgacttctccgaggagatgatgatgacggggatgtcggccgtggccgggtccgccttcatccgctggaggacctcgtcgccgtccatctccggcatggacaaatcgagcaacaccgccgccggacgcaggcgccccaccttctccagggcctcgcggccgttgctggcggtgtggatggtgtagtggccggagaggatggcccgctccagcgcgagaatcgcgtcgctgtcgtcgacgagcagcagggacggcaggctcacggcggtcaggccttggtgaggaactgacggaccgtttccgtcagctcgtggtgggacaccggcttctggatgaaggcgttggcgccggcctcggtgccgcgctgacgcaggtccacgttcttctccgccgtcagcagcaggatgggcaccgagcggacctgcggcatcgcgctggcgcgcacctccttgacgaaggtgatgccatccatccccggcatgttgatgtccgcgatgaccagactcaccggaaccagccggagaatctgcagcccccgggtcgcatcgtccgcctcgacggtcgagaccttgaggttcatcaggtagatcttgacgatgttccgaaccgtcgggctgtcgtccaccagcaagacgttggtgctgtgggtgctcactgtgcggcggctcctgcgcaggccccgcgacgcgcggagagtcctgcgaaacgttcaagactctaccgtgagggctctcacgtgagaacagggggcggtccggcccggtttccatccgggcaggcaggtatcggatgacctcagaagggacgcccccgggtccagatggtcccggggaatgggccttactcgccggcgggcttgggcgggagctcgtccgcatccggcgtcaccggaggcgcgccaatggcgtggtagccaccgtccacgtggatcatttcgccggtggtggagggcagccaatccgacagcagggcacacgcggtgcgggccaccatgtcgtggctgtccttcgcgctccagcccaggggggcctgctgcccccagccacgctccagggccttgaagcctggaatgcccttcgcggcgatggtggacaggggaccggcggccagggcgttgacgcggatgcccttggggcccaggtcgcgcgccaggtagcgcaccgtggactccagggccgccttgcacacccccatccagtcgtagatgggccaggcgacgcggttgtcgaagtccagcgtgacgatggagcccccctgcgtcatcagcggcaggcacgccaccgacagctccttcagcgagaacgtggagatgcggaacgccgtctgaacgctctcccacggggtgttgagaaagttgccacccaaagcatcttcgggcgcaaaggcaatggaatgcaacacgccgtccacccggtcccaccgttggcgcagggcgtccgtgagtgcggggaagtgggcggagttggtgacgtccaattccagcacctccattcccggcttgaggcgcttggcgctccgctcggtgagggacttggcccgaccgaagccggtgaggaggacctcggccccctgagccagcgcgtgctcggcgatgccgtaggccagggactgaggcgtgagcaccccggtgatgagcagcttcttgccttggagcagcatggagacagcctcgttgcgggaggggaaagacaggaaacgcgttctctaccattccttctgggcggaatggttgaagttgcactcacttggggcatgaatccacctgctccgcggcaatgggtgcggcttatcagccagcgggcgggcgctacaaaaggcgccgctaaaaccccccaacggggcgcccatccagtaaaagacgacacgccatggcgaatttccaggacacgtttctttccggcgccaacatcgatttcatcgagggcctctacgcccgttatctggaggaccccgccagcgtggatgcaagctggcgggaggtcttcgaccgcagcaacggcgccggacgacccatcttcagcacccggctgctggagccagtagcggctccagcggcggccaagggaggcggcaagggcgccgcgcccaaggcccaggtcgcgccggcgccgcagcccgccccggtggccgctcccggccagtccgtccaggacatctcgctgcaggcgcgcgtggaccacgtcatcttcgcgttccgcctgcgcggccacctgcgcgcgaagctggatccgctcggccgtccgcgcccggcgctggcgcacgtggcggatgtggccctggtggatgacagccacttcaccgacgccgaggcccagcagctcgtggagaccaatggcgtgttcggcgagcagcgcgtgcgcctgacggagctgctggcgcgcctgcgccgcacgtacacggacaccatcggcgtcgagtacatgcacatgctcgacagcgagcgccgccgctggctgatgcaccggatggagtccaacgagaaccgcaccgacttctccccggacgagtgccggcacatcctcaccaagctgtcgtacgcggagggcttcgagcacttcctccacaccaagtacgtgggcgccaagcgcttcagcctggacggcggcgaggcgctcatccccatgctggacgcgctgggcgaagtggccaccggcatgggcctgagggagatcgtcatcggcatggcccaccgcggccgcctcaacgtgctgacgaacatcctgggcaagcagccggatcagatcttcagcgagttcgacggtccccggaacccgcaggactacctgggccgcggcgacgtgaagtaccacatgggcttctcgtcggaccacaccacgcgccagggccgcaagctgcacctgtcgctggccttcaaccccagccacctggaagcggtggacccggtggtggagggccgcgtgcgcgccaagcaggaccgcggcggcgacaccgagcgcaccagcgtgatgccgctgctcatccacggcgacgcggccttcatcggccagggcgtggtggcggagacgctcaacctgtccggcctcaagggctacaccacgggcggcacggtccacgtcgtcatcaacaaccaggtcggcttcaccaccgacccgcacgactcgcgctcgtcgctctactccaccgccatcgcgcagatgctggacatccccgtcttccatgtgaacggggatgatccggaggcctgcgtccacatcgcgaagctggtggccgagtaccgccagacgttcaagtcggacgtcgtcatcgacctggtctgctaccgccgctacggccacaacgaaggtgacgagccctcgttcacgcagccggcgatgtacgacatcatccgcaagcacccgacggtgcgcacgctctacgcggcgaagctggcggagcagaacaagattccggctgaggagtcggaggccatcaagcagcgctgccagcaggagttcgacgcggcgctcacccgcgcgcgccaggagagccagttcaaggaacccagcgcgctggaaggcctgtggaagccctaccagggcggcgcgctgaagagcgcgccggacgtatccaccgcggtggacaagcaggtgctgtgtgatgcgctgcgcaagctgtccacgctgccggagggattcaacgtccaccgcgacgtggagcgcaccgtcatcaagaagcgcctgggcatgctggacagcggcgagctgcagtggagcgagggcgagtcgctggcctacgccacgctgctctccgagggctacaacatccgcatcaccggccaggactgcgagcgcggcaccttcagccaccgccacgcggtggtgcacgacgtgaagacgggcgagaagttcgtcccgctgcgccagttcatcagcggcacgggcaggaacggcttccacatctacaacagcccgctgtcggagatgggcgtgctcggcttcgagtacggctacagcctggacgtgccggacggtctgacggcctgcgcaagcgcagttcggcgacttccgcaacggcgcgcagatcatcatcgaccagttcatcgccgccggtgagagcaagtggcgccgtctcagcggcctcaccctgctgttgccgcacggctacgaaggccagggcccggagcactccagcgcgcgtctggagcgcttcctggacctgtgcgccgaggacaacatccaggtctgctaccccacgacgcccgcgcagatcttccacctgctgcgccgccaggtgctgcgcccggtgcgcaagccgctggtcatcatgtcgcccaagagcctgctgcgccggccggaggccaccagcaaggtggaggagctggccacgggcaccttccaggaagtcatcctggaccgggtggacccggcgggcgtgacgcggctgctgctgtgcagcggcaaggtgtactacgacctggtgaaggcgcgggacgagcgcaaggacgagagcatcgccatcgtccggctggagcagctctacccgttcgcctccgacgtgctggcggggctcatcgcgaagatgccgaagctcgccgagctcctgtgggtgcaggaagagccgcgcaacgctggcgcgtggcacttcatgttcccccgcctgcacgacctggcctccacgcagtcgaagcagcaggtgaagatcggctacatcggtcgcgccgaagccgccagccccgccacgggcttccccaagacgcacgaatacgagcagcagctcatcatcgaggaagccatcctccgagggaccagaaatggccgttgaaatcaaagtgccccccctgggcgaatccatcaccgaagccgtcgtcggcaagtggaacaagaagccgggtgacgccgtcaccgccgacgagccgctcgtcgtcctggagaccgacaaggtcaccatcgacgtgccggccccgtccgctggctcgctgtccagcatcgccttcaaggagggcgacaaggtccgcgtgggcgaggtgctcggcctcctcgaggcaggcgccggcgctcccgccgccaggcccgccgccgctccggctccggccgccgcgcccgctcccgccgccgaggtgcccgcggcgtccgacgcgcgctccacgcccaccgcgcgcaaggtggccgaggagaaccggctggacatctcccaggtgaagggcagcggcgccggtggccgcgtgcacaaggacgacgtgctgggtcagctcaaccgcccggccacgcccgccgccccggcgcagcccgccggcccccgcccgaacgccgcccgcgaggagcgcgtgcggatgacgccgctgcgcaagcgcgtggccgagcgcctcatccaggcccagtccaccgccgccatgctcaccaccttcaacgaggtggacatgggcgaggtgatggccctgcgcaagaagtacaacgacaagttccagcagaagcacggcgtgaagctcggcttcatgagcttcttcatccgtgcctccgtcgaggccctcaaggccttcccgcaaatcaacgcggagattgacggtgaggacgtcatcttcaagcactactacgacatcggcgtggccgtcagcggcagccgcggtctggtggtgccggtggtgcgcaacgcggacaagcagggcctggcggagctggagaagtccgtgggcgagctgggcaccaaggcgcgcaatgacaagctggccctggccgacctccagggtggcaccttcaccatcaccaacggcggcatcttcggctccatgctgtccacgcccatcctcaacccgccgcagacgggcatcctgggcatgcacaacatcgtcgaacgccccgtggcccgcgacggccaggtcgtgattcggcccatcatgtacatcgcgctcacctacgaccaccggctggtcgacggccgcgaggccgttcagttcctggtgcgcgtgaaggagtgcatcgaggacccggagcggctgctcctggacgtctgacttcaggcccggcatccgggcaagacttgcattccgggcggccggctggacttccagccggccgtttcactacaactgggcgtgtctcccggttgtcggggggcgggaagaacgggcggctctcctcgcgccgccccgcaagactgaaggacgtgcaatggcaaccggtaccgtgaagtggttcaacgacgcgaagggctttggcttcatcacccaggacggcggcggtgaagacgtgttctgccaccacaccgccatcaacatggacggcttccgcaccctggccgaaggccagaaggtggagttcgaagtcacccgtggccccaagggcctccaggcgcagaacgtccgcgccgccggctaacgcgtccgtcagccactccctccggactggccgatgacaagaggcccggccccaccacctggggaccgggcctctggtttttcaagccctggggccgcgcggcctacaggttgcgcttgaagtggtccatgacgcgctcccactggcgctcggtgacgagcgggtcgggcaccatgtgcgtcaggccgctcagcggcagcaggtcatgcggcttcccggcgcggaagagcgcgtcgctcaacttcagcgtgtggaagaagtagacgttgtcgtccgcggtgccgtggatgagcagcagcttgcccatgggcttgtcctgcttcgcgtacgtgagcagcgagctcttctcgtaggcctccgggctctgctgcggcacgcccaggtagcgctcggtgtagtgggtgtcgtagtccagccagtccaccaccggggcgccggccacgccggccttgaagacgtccgggcgcttgagcacggccagcgcggacatgtacccgccgaagctccagccggagatgcccacgcgggacaaatccagctccgggacttccttggccagcgcctggagcgcggcgacctggtcctccagcgtgacgccggagaagtcgcccttcacctcgcgctcccacttcgcgccgcgcagcggggtgccgcggccgtcaatcttcaccacgaggaagccctggtccgccacccactgcgacatcaggtgcgcggccatgctcttgtggaccacggtggtggtggggccgccgtacacctcgacgatgacgggcagcttcttgccgggcttgaagtcgcgcgggcgcaccagggacgtccagaagcgctcggggcccacctgccgctgctccacgttgggcgtgtagggcggctccttcgccaccgagggcagctcgcccacggtggttccgtcgccgcgcaccacctgcaccttgggcatggacttgaggccctggccattcatcaccatcagcccgccgctcttggacaccgagcccgactcgatgtcgagccccgtcgtcaccttctccggcgcgccaccggccttcacgcgccacaggtggctctgcgtggggttggggccgccgttgaagtagagcgtgtcatccttctggatgtagcgcgccagcgagcggaagcccgcgtccggcttcaccagggtgcgcaccagcgcgccgtccgccttgcgcagctccacctccgggccgccgttgcgctccgtgtaccagaggaagccgctgccatcctccagccacagcgggaagacctgctccaggttgagccaggcggcgtcctgctccgtcagcagctcccgcgacttgcccgtgcgcgggtccaccgcgagcagcttctgctcggtctgctcccggttctgcaccagcgcggtgagcggaccgcccttgggccacgtcacggtggccaggtacgggtacttcgccgcatcccactgcgcccacacggttttcccaccggtgacgggggtgatgcccaggcgcaccttggcgttggccttgccggggcgcgggtacgcgaagtcctcgccgccgcgctcggggtgcatcacgtcgacgatggtgagcttctccacctccgtcgtgtccgcctccgtgtacgcgatggacttcgcgtccgggctccaccagtagccggtgaagcgccccatctcctcctgggcgacgaactcggccacgccgtgcgacttcgcctcggtgccgcccttggtgacgcgctgctcgcggttggcggccacgtcgatgcggtacacgtcgtgttcccgcacgtaggacacctgcttgccgtccggggagaagcgcggatccaacgtgcccgggcccgtcttcagctccgtcaccttgccgctggcgcggtccaccacgtagaggcggccggacaggggcaccagcagccgattgccgtcctcggacacctgatagctggtgaagccccgggcgctgacgcgcatgcgctcacgacggtccttctcctcgggggtgagcgtctcctcggcgcccttgaggatggcctcgggggtgagtagctcctgcgtctgcccgctctccacgtcgaacgcgtagagcgtctgcacgttggacgtgggctgggtgcgcaggaagaggatgctcttctcgtcgggggagatgcgcacaccgccgggccggccgctcatgaagcggcgcgtctccgagaactggcgcaggaaggggtcttgcgaccgctgcgtcttggacatggtcaggggcttctgctcctgggcggaggacgaagcgctcgcaagcaggagcgcggcggtgaggacgtggcgcatgcgtcgtcgaatccccgcgggaagggcggggctcctttcgtggaaaggtgcgggacagcctacactcggcggcctcgcggccggagcaaacgcttggcgtgctggaggattcccgacgcaatggaaacggaagacgacgccccgcggcacctgcgcctggccggcatcatccgactgggcctgggcgggggacgtggcccccgagacgcctacgtgttcgacccgcaccggctcgccctccccgcctgggcctgcgccctgggtgacacggagggccccgccctgctggtgacgctggaccggcacctggacaccgtgatgccccgggcccccgcggccgtgccggaccggactgccggtctgcgcgcgctggatgaacatgcccgctgggcgctggacgtgcgcaactacgaccacatcctcgcggccatggaggcggggctggtgggggacgcgctgctgattgcccgcgcccgcccccgtggcgccttcacgggggacacctacgtggacagccggggccggccgcaccggctggtggcggtgcccaccgtggaccgggcggcggaggcctacagccgccctgcccccggcgacgccgtgcgcgacgtgctggacgcggccggccgggtgctgctggacgtggacctggactgcttcacgtccctgagcgacgcggacccgacgacggtgctcccctggccccggcaggtgattcgcgagttcctgctcccagaggactc

SEQ ID NO: 1097 - DNA, 13637 bp, Myxococcus xanthus
ggaccggcccggtgacccgctccggcgtgctgaaggggaagtattcgtacatgtccccggagcaggcggcgggcatgcgggtggactgccgcgcggacatcttcgcgctgggcatcgtcctgtacgaactgctcaccagcacgcgtctgttcaagcgccccaacgacatccagacgctgacggcggtgtcggagtgccgggtgttgccgccctcgcacgtgacgtcgcgcgtgccggcggatttggacgccatcgtcctcaaggcgctcgcgaaggagctgccggaccggtaccaggaagcggcgcacctccagcacgcgctggaggagtggctgcgtgtgcaccaggcgcccgcctcgtccgcgcacctgtccgccttcatgaaggaggtcttcgcggagcggctggccgaggaggcccgggcgggcgacgtgctgggcgaggactcggattcgggggcgtcgaggcaggaggctccgccgcgccgcacgggcctgcggcccgcgttgccgccgcgtccgccgccgatgtctccggaggacgacgcgacggcggcgctgcgtccgcgaccgacgtctcgcacgggccgcttcgaactggagccggagaagcccgcgccgcggctgacgggacagcgccgggcggtggagcccgagcgaccctcgcgctctggcatgaacgtggcgtctccgctgccgccgcctccgcgcgtggaggaggacgcgcccacggtggatgcgcgtgcaccctcgtcggtgacccggacggacgtgaagctgggcggggccgctgctgccgcgccgacggagcctcgcggcgctccgcggcctttcggcggcacgggccgcttcgacgtgggggcgccggtcctccccgtggatgacgaggacgcccccacggtggatgcccgcgctggcgcgcgctcgcaggtgcgaggggggtacgtcgtggaggaggacgcgcccaccatcgccatgatggatacgggccggcccgcgcgggtggtgattccgctgcgggacggggagccgctcgaggaggacgcccccacgctgtcgctgggcatgtcgcgcgcggcgaagcgccccgtggctgccgcgggcagcaagacgtggctgtacgtggggctggtgttgctggtcgtcgcggcggtgggcgtggtgctctggtcgatgcggtcgccggagcccatgccggtgtcgttggacccggaggccgcggtgcccgcgcccgtgcccatgcaggccgaggcgccggtccaggctccgacggagctgcggcccccgcccgtggtgcccccgcctcccgtggaggccgcgcccgcgccggtgcggctgcgcatcgaaacgaagcccgcggacgcggtggtgctggtggatggccaacgccacgacgagcggccggtgatgttcgaaacggcggtgggccagcaggtcgccgtgcgggtggaggccgaccggcaccaggcgcagacgcgcacggtgatggtgggtgaggacgcggagcaggtggcgcgcttcacgctggagcccgagccccgcgcggtggctgctgctcccgtggcggcggtggttcgcgagcgtcccgcccggcccgagcccaggcaggaggtgcgactggcccgggtgcgcttcgtcgtacacccttgggcggaggtgacgtgcggtggcaagcggctgggcgaaacgcccttcgaggccgtggagctgcgcgtgggcagctatgactgccgcttcgtcaaccccgacctcaagaagacgctcagtcgacgtatcgaggtgaagcccatcgacctcaacgtcgtgagcgtgaagttcgaatagcacatgccttggatgctcccgtgacgctcgaagccggcactcacatcggcaagtacgtcgtccgccgcaagctcgccgagggcggtatggcggaaatctacctgtgcacggcgcgcggcgcggagggcttcgagaaggaagtcgtcatcaagcgggtgcgcgccttcctcgccagcgacccggagttcgtggggatgttcatcgccgaggcccggctggcctcgcggctgaaccacgcgaacgtggtgcagatattcgacttcgacaagcatgaggacacgtactacctggccatggagtacgtgcgcggctgctcgttgtgggagctgcgcaagcgcggcaaggagctgatggagccggtgccgcccatgctggtggcgcacatcggcgcggaggtcgcccggggcctgcattacgcgcaccgcgtccgcgtgaatggccagccgctggacctggtgcaccgggacgtcacgccgcacaacgtgctgttgtccttcgatggcgcggtgaagctgacggactttggcatcgccaaggcgggcaacaagctgacgcagccgggcgtgctgaagggcaagttcgcgtacatgtcgcccgagcaggcccggggcgaggccgtggatgcacgcacggacatcttcgcgctgggcgtggtgctgtgggagatgctcacgggcggccgtctgttcgacggggactccgaggtggcggtgctgcgcgcggtgcagcagagcaccattccgcctccggcccggctgaatccggacgtgcccgcggacctggatgccgccgtggtgcgagctctggacagagaccccgcgctccgcttccagacggccgcggagttcgagcgcgccctggcccagtgcgtgctgacgcatgcgaggtccttggacgacacggacctgagcgcgttcatgcgccgcttgttccccaccagcctcacccaggcgattcccaccgtgcaggagcgcacacacgtcgtggaaggggagccggcacctggggcagaggcgtcgcccgtgccgcgcgagcccaccgcggtgatgatgtctgctggccgcagcggcctggcgttgccgacgtctccggacgaagacgtcaatgcgccgaccttcgtgttgccgcgcaggggcgaggcggccgcgctggatgcggcgccactgccgcccatggccacgccgatgatgccgctgccggcggtggcgtcgtcgccggtgcctcgcggtgcttctttcgaaggcgcgccttccactccgggccggcagagccgtccggagggcatggtcgcggtgtcggggccgcgctccggtggggccgaggatgctcgcggtgcagcctccagcgaggatgcacgggccgagaagacgccgagcaggggatcaggtgtcccggcggtgtccgggagcgcgcggacgccgagtcgtccggaagggggcgccgccgtcgcgtcaccgtcagggtcctccgggagtctgaagttggcgagcgcctgggacgatgaggacgacgacgaggaagggaccccgtcgaatacggagcctgaggcgcatcccgggatgagggcagccgagcctggagcttccgaggtgcctgcggcgggtgcccatgcgtccggagccgagggccctgcggcgagtgcccgtgcgtccggagccgaggggcctgcaggtgcccatgcgttcggatccggggttcttgggacgagtgctcggggctccggagccgaggtgcctgcgggggcccatgcgtccggcgccgagtctctcgaggcgggggcccgtgcgtccggccccgtagcctcggtggccgtgccggcggcgcgccgacagtgggcgatgggactggccgtggcgttggggctcgccgtcgtcggaggcggcgtcgctgtgatgcgggggaccgaagaagcagctcctccggcggtgccggcagagcccatggtggccgcacccgctgttgatgaacccgtgccgaccgcgcagcccgcgccttcagcagtatctgagaacgccgagggcggggagacggggcccgccgaaaccgccgataccgaatccgaggtggatgggctgatgcgcgaggaggtgctcgccgctgccgccacccacccggcctccgaccccgcgccgagtgcggccggcacccagcaggagccggagcgcgtacgcgctgcgccggccagcggaacgctccaggtccaggccgcgccctatgccaccgtgttcatcaacggcaagcgcatgggcgaagtaacggggcgggcgtcgtaccggttgcccgtcggcaaccacaagctcgtcttccagcacccgtccggcgagcgccgctacgacgtcgccgtcaccgcgggcggcaccgtcagccgcgagttccgcgcccccagggggcgctgaaccaggccgcctcccggcgcggcggcctcaccggcagccgtgccgcgacctgagcccaggtccgaagtcacccgccgtacccgtgctcgcttccgcttgagcacccccaacgtccactcctgaacgctgctgcctcgcctccagcggggccgccttcgggctgtcacgcctacctcgtcccacctgccgctccgcctgttcaaaggcgcgcgattcgtccgccgccgcttgcctgcctggtggtctgccttgacacccaaccgctcgttctggcactcagtggcccccactcagtggattatattcaatggaatccatggacctgctggctcctgaggagattgctcggatcgagcgcgagaacgcgggcggcctgcccgcgagcgccatcctgaaaatcttccggccacggggcgtgcgcctgtcggaggcgacgttccggaagtacgtgcaggcgggcttgctacccaggagccgccgggtgggcaggaaggggaagcaccaggggagcgtcgggctctacccggtggaggcggtgcgccgcatcaatgtcatcaagaagatgatgtcggaggggcacaccctggaggacatcaagcggtcctatgtcttccacagcaactatatcgaccagttggaacgggaccttgcaggcctcctgaacgggttccaggaggaactgggggaccgcgcctttgggggggagcatcggcgtacgcttgaggcacagctagcaaccttgcggcaaagagcgcaggatctggtccgggatgtcgcccggctcggtagcgccgtgaccgcacgcgcagacgaaaccatccgttcgcaatagaatacccgggaaccgggtagactggcctcacgtggaggggacatgtcggaagtgaagcagctacaggaggaggggggggaccaggaatcggaccaggcgcaggagcgccgccgttccaagaccatgtcgcgcaaggagatggcgcgcgacctgcggaggcgtcgcctcacgggtcaagtggaccccgaagaggccgacctgctgaagcagatggacgacacgcggccgcgtacgcgcgcggactgcatcaacggtccccggccgtgcaacttcgtctcctgcaagcacaacctctacctggacgtgaatccggagacggggtccatcaagctcaacttcccggacaaggaaatttgggagctggagcacacctgcgccctggacgtggcggagaagggcggcatcacgctcgaggaagtgggagagatcatgaacctcacccgcgagcgcatccgccaggtggagacgcgcgggctgatgaagctgcgcgaagccaccgaagccgagccgccggtttcggctcgcaagccctgatgttcgcgggtggtttccacccgcaaacggagggccgacgtgttgcgttgacaccccagggggtggttgctactaccgccgcttcccgcacaccgaggcccacacgtgctggctctcctgagcgtttctgataagcgaggtctggttcccttcgcccaggggctcgtccgcctgggcttccggttgttgtccaccgggggcacgctggaggcgctcaagggcgcgggggtgcccgtcaacaaggtgtccgagcacacgcagagccccgagattctgggtggccgcgtgaagacgctccacccccgcatccacggcggcatcctgggacggctggagctggaggccgaccgggaggagatgaaggcgcacggcatcgagcccatctccctggtcgcggtgaacctgtatccattccggcagacggtggcctcgggcgccgcggagccggaggtcatcgagcagattgatatcggcgggcccgcgatggtgcgcgcctccgcgaagaacttccggcacgtctcggtggtggtggacccggacgactatccggcggtgctggcggagctggagcagcagaaggcggtgagcgaggacacgcggcgccggctgatgcgcaaggccttcgcgcacacggcggcctacgacgcctccatctccgcgtggctgtccgcgcaggcgggcgagccgttcccgggggagctgtcgttggcgttccagaagtcgcaggacctgcgctacggggagaacccgcatcagcgcggcgccttctaccgcgagcacgccgcgccccaggagccgacggtcgccttcgccaaggtgctgcagggcaaggagctgtcgtacaacaacatcctggacctggacgcggcgctgggcctgctgctggagttcccggaggcccccgcggccgtcatcatcaagcacaacacgccctgcggcgtggcggtggacgccgccttggtgaaggcctaccgcacggcccgcgcggtggacgaggtctccgccttcgggggcatcgtcgcgctcaaccgcgaggtggacgcggccacggcccaggccatggcggagacgttcctggaggcggtcatcgcgccgtcgtactccccggaggcgttgcaggtgctggcgacgaagaagaacctgcggctcctggaggcgggccccgcgttggccagtccccaggcccggccgcgtgcccaactggacgctcgcagcgtgtccgggggcatgctgctgatggaccgggactcggtggagccgccgctgtcgtggaaggtggtctccaagcgggctcccacgccggaggaggagcaggccatgcgcttcgcctggaaggtgtgcaaacacgtcaagagcaacgccatcgtcttcgcctccggtgaccagctcctggcgcagggcggggggcagacgaaccgggtggattcggtccgcatcgcgatgcagcgcggcggagcggccctcaggggcagcgcggtggcctcggacgccttcttcccgttccgggatgggctggacgaggccgcccgggcgggggccacctgtgtcgtacaacccggcggttcggtccgtgacgcggagttgattgccgccgcggatgaacatgggatggccatggtgctgacgggagtgcgacacttccggcactgagccatgcgcatcgtctgtcagaaatgcgcggccgcctacgcgattgatgacaagctcatcaccgccaagggcgttcgcgcgcagtgtcctcgctgccggaacctgcagttggtccggcgcgatccctcggccgtgcccgctgctggcgcgccggctccggcatcccagcccgcggcgcccgtcacgctgacgcccgtctccggcgccgcgcccgcggacgacctcttcggcgacttcggtgcgccgccgcccgccgcgcccgcacctggcgctgctccggctcccaagcccgcccggggagagggccgctcgggctcggacctgttcggcgacttcggggcaatgccctcgcctgctcccgcgtccgcgccgcccgtggaccccttcgcgagcgtggggatgccggcttcgggaggcggtggggcggccggtgcggaggacccgctgctcgacttcctgggaccgccgccctccgcgccgcagggcctggagtcccagccttcgcatccggcgaagcccgccgccgcgaagcccgcgacctccggctgccgcgtctgccagaagccgctgacggattccttcgaccaggcgctcggcatctgtgatgactgccgccagcctggttccgctcgggcgccggccggcacgagccgtccggccgctccgggggggaactcggacttgctgccgcccatggcggacctgggtgggggctccgcatcggtggcgcaagcctcggagccagcgcccggtgccgagccccgtagtggcgcacgcgtgcccatcagcaccgacatcattccggacatggggccggagcctcgcagtggcctccgcgcctcctcgccgcagttgggagcggagcctcgcagcggctcgcgctccgcgccggtgctcgtcacggatgggcgctcccgtgggggcaagggcggactggtggcgggcctcgtggggctcgtcgtcgtgggcggaggtgtgggcggttacttcctgtaccaacagcagcaggaggcgtcgcgccgccaggccggtcctccgcccgtggccgccatcccggacgcggtgaaggccgtgctgcctcgctggaagttgaagtacctggagattctgggcaccagcgcggaacggctcgcgcaggggcagcagcagctcgcccgtgacgagcgcttcgcgtacgcggaggcggaggagtccttccagcaggcgctggtgctggacccgaccagcgatgccgccatcgcgggctacgtccaggcgctggccctgggacgcggcgcgcgcatggacgacgcgacgttccaggaggcccgcgcgctgctgtcggcggcggagtcgcggtctggccgcacggcgccgttgctgctggcgcacgcgaacctcctgctggcccgctccggtcagcccgagcaggcgcgcccgctcgcggaggagttgctggcccgcgcggagctcgccgacgcgcagaaggccgaagcgcacctggtgctgggccgcacgtggctgtcgtcgtcccgcgagctggctcgcagtcacttcgactccgcgcagaagctgtcgccggacatcaagcggctgcactactaccgcgcgctcgcgcatgcgtcgggcggtgagtattccgccgcgctggacacgctgcgcaagcggctggagacgagcccgaaggactgggagagcctggcgctcaccgcccgcatctaccaggaggtgggggagcccgcggaggcgcgcaagttgtacgaggcccgggtgaaggcggagcccggcgagctgcgcgccctgttgccgctggcgatgctgcgctaccaggcggaaggcaacgccgcaggcgcggtgcgggacttgcgcgcgctgatgaagaaccgggcgcgctacgacgagcccgaggtggccgaggtgctggtgcacctggcggccgcggagcgcaccgcgggcagtcaggacgcggcggtgaagtcggcggaagaggccctgcaactcgtgaagggattgccggaggcgcacctccagctcttcctggtggccctgggccgccgcgacgcggagaaggcacggacccatctgccgggcttccgcgggcagttggaggacggcgcgctggagaaggtgctcgaaggccggctgctgctcctggagaagaagccgctggaggcgctggagggatttcaggaagcggtgaagctggacgcgcggcggctggacgcgcagctgctggcgggcgtcgccgcggcgagcgcgaagcgacgggacgatgccttccgcgcgctgcaccaggcgctgcagtcggacccgctccggctggagccgcggcccgcgacgtctgcctactggctgcgcccgcgcgagacggtggagggcgtggagggtgccatcctcgcgctgtccgagggaccggaggacccgtccccgctgttgtacgaaggcctgctgcgcttccaccagcaccagttcgacgcggccgagcgtcacctgcgcagtgtgttggaggtggacgcgaacaacgcgggggccctggcctaccgctcgctcatcgcgctgcagcgaggtgctctcgcggacgcccggcgcctgggcgaacgctccgcggcggcggggcggcagatgccggtgtcgcatctggcgcacggcctggcgttggcggatgcccggcaggtggaaccggccaagcgcgcgctgcgggacgcgctggccctggcgcccacgctgctatcggcgcaggcgcgactggcgcagttggagtcggcccagggcaaggacgtggcacgagacaccctggtgaaggtggtggggttggatccggcatacctccccgcgaagcggatgctctacctgttggaacggtgaggtggatgtgaaggtcctgctgctcggttccggtggccgtgagcacgcgctcgcgtggaagctgtcgcagagccccatgttgacccagctcttgtgcggtccgggcaacccgggcacggcgaagctgggcacgaacgtggccctgcgcgcggacgcaccggaggaagtcgccgcgttcgcgaagcgcgaggccgtggacctggtggtggtggggccagaggcgccgctggtcgcgggggtcgctgacgcgctggccgacgcgggcatcccctgcttcgggcccgtggcggcgggcgcgcgcatcgaagggtccaaggccttcgcgaaggagatcatggccgaggccggcgtgcccaccgccgccttccagaccttcaccgacatggcggcggcggaagcctacgcggtggcgcagggccgcatcgtcgtcaaggcggatggcctggcggcgggcaagggcgtcatcgtcgcccacgacgtcgaggccgcgcgcgcggcggtgcgcgccgtgggggccatgggcgtggcgggccagacgatggtcctggaggagctgctggagggcgaagaggtgtccgcgatggcgctgtgtgatggcgagcgctacgccatgcttcccttatcccaggaccacaagcgcgtgggcgaaggcgataccgggccgaacaccggcggcatgggcgcgtacagccccgcgcctttcctgtccgccgcgcagctcgccgaggtgggcgagcgcgtggtcgccccgacgctggccgtgttgcgccggcgcggaattcccttccggggtgtgctgtatgcggggctgatgctcacgcgcggcggcccgaaggtgctggagttcaacgcgcgcttcggtgacccggagacgcaggtgttgatgatgcaactgggggaggacctgctgccgttgctggacgcgtgtgcccggggcgcgctcgtgccgcggacgctggtgtccgcgcttggtgcctcggtgggcgtggtgctggcggcgcggggctatccggacgcgccggagaagggccagcggattgaagggctggacgcggtgccacccgacgccacggtgttcctggcgggcgcggaggcgcgcgacggcggcgtcgtgacggccggaggccgggtgctgacggtgtgcgcgcggggcgaggacctggctcaggcacgtgagcgggcctacgcggcggtggcgaccgtgcgcttcgagggcatgcacttccgccgggacatcggcgcgcgagggatgaaggccgccccgtgaaccgcctttcgcgctacctgctcggggagctgctggtcccgctcggcgtgtgggtggcgttcatgttcctgctgctcttcgtcatgcagttcctgcggggcaccgacgtgctgctgggctcgtcggtgacgctggtggacatggcgcggttgctggcctacctggcgccgcacttcctgatgatggcgctgcccatcgccttcctgctggccatcctcctggggctggggcggctgggcgaggaccgggagctggtcgcgctccaggcgctgggcatcgggccggtgcgcctgctggccgcgccgatgggcatcgcggtggcgctcagcgtgctgatgctggtcatcacctccacggcgcagccctggggcctgacgggcttgaaggtgctggtgagcgaggtcatccggaagaacgccgtgggcgacgtgaagtctggcgtcttctacgaggacctcagcaacttgacgctgtacgcggagcaggtgtccgcggacgggaagtggaccaacgtgctcctgcatgacgaccgggaggcgaattcgccgctgctggtgctggcgcagcgggggcaggtgggcacgtccaccagcggcgaggtgctgcgcttcgcgctggaggcgggggaggtgcaccgctccgcgggccgcgagacggaggagtacagcatcatccggttcgaccaggccgaaatcagcgtgggcgtgggcgcttccatgggcaagcgcagccgcttctcctactcccgcgaggagctgacgcccggcgaactgatggaggcggcgcgcgaggcggaagcgcagggcgaggatgcgcgcatgtaccggatggcgctgcacagccggttggggaacgcgctggcgcccatcgccttcgcgctgttgggcacaccgctggccatgggccggcgccagtcgggccgggcgtggggctacctgctgacgctggggggctacgtcctctactacctgctgagccgcgtcttcgagcagatggggcagaagggccaactgcccgcgggcctggcggggcagatggccaatctggtgttcgtcgcggtggggctggtggccctgtaccgggtgagccgctcggggacggtcaagtgagggggacgctcttcatctacgtgctgcgcacgtacctgcgcttcgccctgggcatcctcgcgggcctggtgctggtgttcgtggtggtggacttcgtggaccgcgcgaagctgtacacgggcccgggctgggtctgggacgcggcggagctctacttctacaaggcgatgatgtcggtgcagcaactgggaccggcggcgctgctgctggcggcgggcaccacggtgtccgcgctgcgcaagcagggcgaggtgacggccatccgggcgctgaccttcggcccgtccgcgctgtacctgcccatcctcgtggcgtcgttcgtggcctgcgtgggcctggtggccttcgacgagcgggtggcgacgtactccggccggcgcgtggacgaaatcaccacccagcgcttcaacaagtggggcgactggcgcttctactacacgccgaagcagtggttccggcgtggggacaacatcttcttcctccggggcggcagcgcgcaggagggcttccaggacgtgtccgtcttcacggtgacggagtccttcgacctccagcggcgcctggacgcatccggcatgttcccggtggaaggcatgcgctggcgcctgacggacgtggtggagcgcaccttcgacggcgaggggaagacgtccgtacggcagctcccggaagcggagtacgacctgggcgtggccgtcaccgcgttccgcatccggccggggcggccggagcagatgcgggcgtccgagctgcgcgagcagattgtcgcgcgccgcgacgtgggcctggcgacgaagcagttcgagctggccctgcacaaccgcttcgcctacccgatggcggcgttccccgcggcgctgctgggggtggggctggccctgcgcgccaaccggcgagggcatctcacggccgccatcatcgagggcctgctgacggcggtggcgatgtggggcttgatgatggtgtgccggaccctggtgctcacggagcggttgtctcctggcgtcgccgcgtggacgcccaccgtgctgctgggcctcatcgcgggcgccgtgtggttgcagcgcgagggccggttgcacctgccgcggcgctcgctgctggtgagatagcgtgtccgcgctcatgggaaccgtgtccgagcttccgctggacctgcgctggcgccgcgccatcaaacgc

SEQ ID NO: 1098 - DNA, 16450 bp, Myxococcus xanthus
gtgctctaagggacaggtcgatgcgcagtggcagggtcccgacgaagaagccaatcagggactcgagctccgcgcggtcgcggttggccacgggcgtaccgatgacgatgtcatcctgcccggtgatgcgcgccaggtaggccgcgaatccgcccatgaggaccatgaagctggttccacccgtgcgcaggctcagggcttcgatggcctcgctcagcgccttgcccagggcgatgcgctcggtggcaccgcgcatgctcgtccggggaggacgaggccggtccatgggcaggtccagggccgacggcgcgccatgaagcgtcttccgccagtggtcgagccgctgctccagcacctcgccctggaggtgccgccgctgctggtacgcgaagtcccggtagtcgacggggagctcgggcagcgtcaccggctggccggagacacgtccggcatagagctgggagagctcgcgtacgagcacgctgatggaccacccgtcaccgacggtgtgatgcatcgtcgcgacgacgacgtgtgccgcctcgtcgaggcagaacagcttcgcgcggaacagcgggccgtttgtcaggtcgaacggtcgcgcggcctcctccgcgatgagcaggcgaagcgcctcgggggacgtctctcccagggtgacctgctcgaacggaacgtcctggttcgcccgcggctcttgccacacgcggccatctcgctcgacgaagcgcatcccgagcacggggtgccgccggacgatgtcggacaggctttcctggaaggcgctgacgtccaatgtgcccgtcagccgcagcgccatgggcaggttgtaggccgtggtgccggggtagagctgatccaggaaccagagccgctcctgggagaatgacagcggaatggcggcgccctcgggcgccggttcaatccgggcaagcgtcagcgtctggcttccccggcgcgcatcgagcacccggctcaaggaggcgatggtcggattctcgaagaggtcggagacgcggaacgcagcgtccacgtcgccgcgaatccgcgagacgacctgcatcgcgagcagcgagtgcccgcccagttggaagaagtcctgctcccgcccgacaacgccgcgtcccaggacctgttcaaaggcccgtgccacggtcgcctccgtaggcgtgcgaggcggctcggatgggctctcggcctgcacgggcgcgacgggggcggggagcgcacggcgcgcgaccttgccactgggcgtccggggcagctcgggcatcggcacgaacagcgcgggaaccatgtactcgggcaggtccctagcgaggaagtcgggcagctcggccaaccgcaccgtctccgggacgacgtaggccaccagccgcttctcgcgcgtggcatcaccgtcgacgatgaccgccgcatcgcggacatcggggtgcgcacacagggcgcgctcaatctcgccgggctccacacggaagccgcgaatcttgacctggtcgtccgcgcggccgaggaactcgatgctcccgtccaccgtcaaccggccaaggtccccggtccggtacgcccgcacggggggagacaggggcagctcgacgaagcgctcggcggtgaggtccggccgtgacaggtagccgtcggcgaggcacgtgcccgccagatagagctctccgggcactcccaccggaacggggcgctggttcgcgtcgagcaggtggaccgccgcgttggcgatgggccgcccgatggacggcagcccaggccaatgccgcgggtcgccctccaactcgagcgccgtcaccacatgcgattcggtggggccgtagtggttgtgaaggcgcttgccaccttcctggaaccagcggcggatggggtcggtgatgcggagttggtctcccgcggtgatgacttccgtgagccctggaacgcgatgctcggtgcgcagcgcggcctgtgccagatggtggagcgccacggccggcaggaagaggcgttggacgcgcgccacatcgaggaagtcggccaacgcgtctgggtcgcgtcgggtgccttcatcgatgaggaccaacgtgccacccgagcaccaggtggagaaggtctcctggaacgacacatcgaagttgagcggcgcgaactggagcgtgcgcagggggctggcgtgttcggtctgccactcgatgaggttgaccagtgcccggtgcggcatggccacgcccttgggcttgcccgtcgagcccgacgtgtagagaacgtaggccagatgatgcggctccacccggggccgcggtgtcttcgtggcaggtgcctccgtgtcatccagcaggacctgcgtcaggccctgagacgggagcagctcgctgtacttcttctccgtgagcaggacgcgcggcctggcgtcctccagcatgtagcgaaggcgctcaggcgggtacgtcggatcgagcggcacatatgcgcccccggccttgaggaccgcgaggagggcgacctgcgcatggatggagcggtccagacagatggaaacccggacccctgggcccacgcccaatgcgcccagccggtcggccagggcttccgcggcctcatggagctggcggtaggtccgcgtctcgccctggtgctccagcgcgaccacgtcaggcgtcctctgggcctgacgctcgaacagctcggggagggtgcggccggtgtacctgcgctcggtgcggttgaggtcggcgtacagacgccgctcctcgttggacaagagcgggagctctgaggtgtggagctcgggctcctcggcgatggcctggagcagccggccgaggtgcgcggccatccggtcaatccggtccgcgtcgaagaggtccgtgtcgtactcgatgctgcaggcgagcgcgccctcacgcggctctacgaagaaggtgaggtcgaacttcgacgtcgagctcgccggcgcttgaatctcggcgcgaacatcggggagctggagctcgccaccgctctgcccctggaggacgaacatcacctggaacagcgggttgtgcgcaagtccacgcggtagctcgagtgcggccaccagcttctcgaagggcacgtcctgatgcgcgtaggcatcgagcgccgtcttgcggacgcgcagcaacagctcggagaacgtcgggtctccagacaggtcgacgcggagcgcgagcgtgttgaggaagtacccgaccactccctccgtttcgtgccggtcgcgattggcgacaggcgagccaatcaccacgtcctcctggccactgatgcgcccgaggtacgcggcgaaggcgccaagcagggtcatgaacagcgaggcgcccgagctccgggagagcgcttcgagccgctggcccagcggcgcgtccagcacgaagccatgagtcttcccatggaaccgctgccgttccggtcgcggatggtcggtggggagcggaaggacaggcggggcgtccttcaaggcttcacgccagaaggcaacgctctcgtccaggcgtcctgattccagccgctgccgctgccatgcggcccagtccgcgtagcgaatgggcaacgcgggcagggccggctccgtgccgctcaccagcgaggcgtacacgatgcagaactcgcgcagcaggaccccgacggaccaggcgtccgcgatgatgtggtgctggttgaggaccaggacgtggttgtcgggtgcgagccggaagtgccgcgcgcggaagagcgggccgtccgtcagcgagaacggcgcggcgacctcctcggcgatgcgtgcgtcgaggagggcaggggagacgtcctcgctcacgagcacggaggcggcaggtgcctggactcgcaggacgggcgtgcctccacggtcgtggaaggtgctccggagcgcctcatggcgttcaaccaggagctggagcgtccttgcgagcgcgctgccatcgagcgtcccctggagcctgagcaccaacgggacgttgtacgccgcgctgtctcctccgagcgcgtcgatgaaccacaggctctcctggcccggagcgacgggcgtgtctcccgtcagctccacgtgcgggatgggctcgaccgccgtgccctgtccggagagcgtctccgcgagctgcgcgatggtccggcgctcgaagatggctcggacgggaatgtcgacgccgaaggcctcgcgggtgcgcgcgatgacctgcgtcgccttcagtgaatgcccaccgaggtcgaagaagtcatcgtggatgcccacgcgctcctggccgagcaccgcgctccagatgccggcgagaatctcctcatggggcgtccggggcgcggccgaagccacctggggctgggcctccagggcacgtgcttcgagcgccgcggtgtcgaccttcccgttgggcgtcagcggaagccggtcgatgacgatgacccggctgggaaggatggccgtggggagcttcgtcgccagaaactgcgtgagcacggccgcgtcgggctgaggcaccacgtcgctgacagcaaacgcaatcagccgaacgtcgccgttctgccgctgcgcctcgctcaccacggcagcagcggtgacgtcggggtgggccgccagcgcggcctcgatttcgccaagctccacccgcacgccgcgaatctggacctgacggtccgcgcggccgtggaacgcgatggttccatctgggaggaaccgggcgaagtcaccgctcgcgtacatgcgcgcttcaggcacgcccgcgaacgggtcgggaacgaagcgctccacgttcaggtccggccggttcaggtagccccgggtgacgcccacgccgccgatgtacagctctccgatgacacccggaaggacgggacgccgctggcggtcgaggatgtagatgcgggcattggcgaccggccggccgatggagggcagcccttgtttgccatccggcgcaacggttccggatgtcgccaccaccgtcgtctcggtggggccatagttgttgacgagctggaacggaagtcccgcgggcggtgtggcgtggagccggtcgccgcccgtgagcacgaagcgcagcgcgcacggcgaaggccactgcaaggccagcacggcctctgcgaccaccgtcggcaggaagctgatggagatctgctgcgccaccagccaattcgccaggtcggagggcgcactggacagctcgggtgggaccaggtgcagcgtggcgcccgcagcgagcgtcggccagatttcccagacggaggcgtcgaacgcggtgctggcgagctgggtcgtccggtccttcgccgtgaggccgaaagcctccgtgtgccaggacaccaggttcatcaggttccggtgtgtgaccaggacgcccttgggcgcgccggtcgaacccgaggtgtagatgacgtaggccaggtcatccagctgcaccggctccttcgcggggacgtcgggcgtggccgtctcgttcaggactcgggagacgtcgagccggggaacgcgcgtgtccgcgatggggtccgcacccgtgttgaggatggcgaccggcgccgcatcgcccacgatgtaggccagccgctcagcgggatagttggggtccaggggcaggtaggccgctcccgccttgagcacgcccaggagcgccaccaccatctccacggacctgccaatgcacacgccgacgatgcgctcccgaccggcgcccaactgtcggaggtgccgcgccacgcgctcggcgcggcggtcgagttcgcggtagctgatggattggccgtcggggcccaccacggcggtcgcgtcgggtgcggccccgtccagcagggctgtcacagggcgggtgacatcgtaggcacggggatgctggccccactccgccagcacgcgccgggcggcctcgtccatcaggtcgatatcgccgaccgtcttcgcgcccggcagcgactcgagcgcggcttccagcaaccgcgcgatgcgctccgccatcgggcgggagaacgcgtccgccgcatacatgacgcgcaactccagcgactcgcccgggatagcgaccagcgccagtgggtagctgatgcggtcgtgcgtgttgaccgagctgatggtgaggccactgcgaggcaggagcgtcgaggcgtcgagcggatagttctcgaacaccaggatgctctcgaagagcggccggtccttcggcgcgtccgaccagtgctggatgtccgccagcgaggcgtagctgtacggctcgaccgcgccttgctcagtctgaagccccgacaggaacgtggcgaccggcgccgtgccgtccagccgcgctctcaggggcagggtgttgatgaagagcccgacaatggactcggaaccggcaaggtcggcgggacggccggagaccgtcacaccgaagatgacgtcgtccgtgcctgtcgctctcgccaggaccagcgcccacgcaccctggaccagcgtgttgagcgtcagccggtgcgccttcgcgaagcccgtgagccgcgcggtcagctctggcgacagccgctttgtgacttccggctgcgtatcgccggccggttcgctggtgtcctgtcgctcggtgaagggcagtggcgtgggttgcttgaagccctggagccgctcgcgccagaaggactccgcgcgggaggggtcctgctcctggagccaggcgatgtagtcgcggtaggggcgtgcggctggcggcagcgctgcgacgccctcctcgaaggcaccgagcacctcgcggaggacgatggagaagcaccacccgtccagcagcaggtggtggtaggtccacacgaacaggtggcgcgcatcatcgagccggatcagcgcgcaacgaatcaggggcggcgtgcccaggtcgaagccctggagccggtcctcgcgcaggaagtcgtcaatccaccgctgctgcgcgtcctccggcacatgtcggatgtcctcgatgcgccaggggacttcggcctccaccgcgacgacctggagcggcttctccaggccttcccagaggaagccggagcgcaggatggggtgccgggcgaggacgtgctgccaggcctccttccaacggttgatgggcaggtccccccggacctcgcagctcagttgctccacgtacatgcccgcgccgggctccatcagcgcgtggaagagcatgccgtgctgcatgggggcgagctcgtagatgtcctcgatcgactcttctgacgtcatggcgctgtcctgcccctcaccttccacctggctcatcgcggcttcttggtcagcgtgagcacgcgcttcaaatccttggcactcagacgcgccgccgggaagtcagacgccacccggaccgccgcggcgggctccgcgcgctcgcgaatcatcgctcgcacgttggcgtggaactccgcgttcagccgctcgatggtctccttgtggaagaccttggcgccgaaggtccagtcgaggcggagacgctgacccgcttcgaccacggcgttgagctcgatgcggtggggccgggtggcgccaggcgcgtgcagcaggcccagtccctccttggcgcggcctcgcaccacaccctgcgtcggcacggcgcccatctgtcccaggtagttgaagacgatgcccgcgttcggaatcgcgccgagcctcgaacgaatcgacgcatccggcgacagcgcacggagcacgccgtagccgatgccgccccgaggcgtccggcgcagcgcgtccttcgcgcgggccagcgtctcacgcacgccttcccgggcacccacgtgcaggcggagcgggaagagcgcggtgaaccaacccaccgtgcggctcaggtccacgtcctcgaacaggaactcgcgtccatggccttccaggtcgattcggacagtgctgttgccggaccaacccgtgagcgtccgggcgagcgcggcaatcagggcctcgttgaccttgacgtcgtacgccgtcgggacctcgttcagcaggagctgggtttcctccgcctccagccacgtgacgagcgtgcccgcgtcgctcaccgtgtccggggcgtgggggtcgttcagcggcaggtcctgcgagtcatcccgctgcgcggtggcgagccaggcgtcgagctcggcccgggcgttgggcgtcgccgcatacgcttcgagccgcttcgcccagtgctggaaggacgtcgtcttcggcgggaggccgacctcctggccattcgacagttggctgtacgccgtcagcaggtcctcgatgatgattccccacgacacggcgtccaccaccaggtggtgggccaccagcgcgagccgcgcggagtccccacccagccgcagcagggcggcgcgcatgagcgggccctgctccaggtccagggactcgtggaggtcggcgagcgcctcttccacgtgctcgctcccgtccacgtccagcgtgtccaggggaatgccagtcagcgccgcctcttccgcgtggaactgggtccagccgtcaccgtccttgcggtagcggaagcggagcgcgtcgtggtggcgctccaccgcttcgagcgcgccgcgaagcgcggccaggtcgattcctggctccacgtcgagcatcaccgccatgttgaagtgctgcggcccggcgcggttctggtcgaagaaccaatgctggatgggcgtgaggggcgcgctgcccgtcacgagcccctgctcggcgttgatgacctgggtgctggaggccacgcgcgccaggtcggcgatggtctggtgctcgaacagttggcgcggacgcagccgcaggccctgctgggtggcgcgggagatgatctgcagcccgaggatggagtcgccgccgagcgcgaagaagttgtcgtggatgcccacggactccttcttcaagacggtggcccagatgctggacaggatctgctcctcccgcgtccgcgcatcggcgaaggcggcgggcgcctgggcctgcacggggtccggaagcttcttgcggtccaccttgccgctgggcgtcagcgggaaggtttccagcacgacgaagtgcgccggcaccatgtagttcggaagcaggcccatggcatggtcgcgcagggactgaatcgtcagcgacgtgcccggacggcccacggcataggccgcgagctgcccctggtggaccgtgatgaccgaccgctggacctcggggtggctgtcgacgacggtttccacctcacccagttcgatgcggtagccgcgcagcttcacctggtcgtcgatgcggcccaggaagtcgatgctgccgtcggcactccagcgcgtgagatcgccggttcggtagagccgggcgttcggagcgtcggagtacgggtccgggatgaagcgcgtccgggtgagctcgtcgagtccgtggtacccgcgcgcgagcgccacaccgcccacgtacagctcgccgggaaccccgatggggacctgccgctggtcggcgtcgaggatgcgcgccacgagccctggcaggggccggccgatagacggaacgcccgtgtcgcccttcttgagctcggcgaccgtcgcgatgaccgtcgtctccgtcggaccatacgcgttgacgaagcgacgggtgtccgtcacccacttcttcacgagctccgcggggagcgcttctccggccgtgatgagcacgcggagatcgggataggcaccctccggcagcgtcgcgagcgcggagggtgacagcaccacctgggtgatgtgcttctccgtgagcaccgtggccagggcctcgcccacgcgcgcggtctcatcggtgggcagcaccagccgggcgccgctggcgaacgccatcacgatgtcccagacggatacgtcgaaggacagcgacgccgcctggaggagccgactgtccggtccgagaccgaagagcggggccgaggccacggggaggttcgccacgccccggtgttccagcaccggccccttcggcttcccggtggaacccgaggtgtagatgacgtaggcggcggagtccgcgtcggggaacgggagggtggacggctcggcgtgctccggcaggggctcatccatccacagcgtctggccctggaagcccggccgctcgcccagggcgcgctccgtgagcagcacctccgcgcccgagtcgtccagcatgtggcccaggcgcgcctgggggtactccgggtcgagcgggacatacgcgccgccggccttccacacgcccaggatgcaggtgatgaagtccaccgacttcggcaggcagatggcggcccgcttctcccgtccgaagcccaacgaaaccaggtgccgggcaaggcgcgtcgcccgcaggtcgagctcgccgtagctcaggcggacgtcgccatgctccagggcaatggcctccggtgcgcgcgcgacctgcgcctggaacagctccatcaccgagccgggcgcgagcggggcactggggccttgctcccacttcgccaccaggctggcttcgttcgcacccagtagcgcgaacgcgggcacccggcgctctggagcctgcaccgcttcgcggagcatgacgacgaggtgctcggccatccgctcgatgcgctcgcggtcgaacaggtccgcgctgaactcgagcaggccggagaggccatccgcggattcctgcatggacagcgtcaggtcgaacttggcggtgacgctgtccaggtcgagcagttgcacgtcgagcccgtccagcgcgggcggtgagaacggtgcgttctggagcgcgaacatcacctggaccaggggctggcggctgaggctccgctcgggcgcgaccacctccaccagcttctcgaacggcacgtcctggtccgcgtaggcgtccagcgccgtgcgccggacgcgcgacagcaattccaggaagctagggtcgccggacaggtccatccggagcgcgagcgtattgacgaagaagccaatcagcggctccgccgccgcgcgattccggttcgccaccggcgagccgatgatgaggtccttctggccactcagccgtgacaggtaggcggtgaaggccgccagcagcgtcatatacagcgtggcgccttcccggcggctcagctccttcaggcgcgccgtgagggaacggtccacgtcgaagcggaccacgccaccccggtacgtcggcgtctccggccggggccggtcgctggggaggttgagggacgtgggcgcccccgtcaggcgttgcttgtgcgcttcgatggactccgcgagcgcaccgtcccgcaagagctgccgctgccacagcgcgaagtccgcgtactggacctggagcggcggcaaggccagctcacgctgcgagcgcagcgcgttgtaaccggccgcgagctcacgcgcgaggatgcccacggaccagccgtcggagacgacgtggtgcatggtgaggaccagcacatggtccgactccgagatgcggaagaggcgcatccgcagcagcgggccccgctcgaggtcgaacggccgggagacctccaagcccgcctggacctggatgagctcgagcagctccgcctccgaagcgccggccgggtggaccagctcctcagtgggcggaagctcggccgtgacgttcgtggagatgacctggaagggctgcgcgccatccgccgggaagcacgtgcggagcacttcgtgccgctggacgatggcgtccaggctcagtcgcagggcctcgtgatggagggggcctcggagccggagcaccagcgggatgacgtagatgggggcccgcgtctcctcgatgcggtccacgatccacagccgctcctgggaggaagacagcggaatgcgctccgggcgctccatgggcccggtgaagtcgaccgcggccactccggggcgctggcgctgctgttggacggccgtcacgagccccgcgacggtggggctcgcgaagaacgtgcgcagcggaatctccacgcccagtacggcgcgaatcctggacacgacctgcgtggccagcaacgagtggccgcccaggtcgaagaagctgtcgtgcacacccacgcgctccgcgccgagcagttcggcgaagatgctggccaggatctcctcctcgccgttgcgcggctcgacgtaggccgtctccaggccctgtgagacggatggaacgggcagggcgcgccggtcgaccttgccgttctcggtcaggggaatccggtcgacgaccatgatgctcgcgggcaccatgtactcgggaaggctcgcctgcgtccgcttgcgcagctcgctctccaggcggcgatccacccggctccggagcgggtcattggcgcggcgtgcccccacgacgatttccggtgcactgccgaagagggccacgggcccgtgcgccgacttcgcagccggggtgaagaccgcgtcgaaggaaccatccacgccgccgcgcgaccagtcgagggcgacgttgagggacagggcctccgcgagctggtggagagactcggggtcgatgccaggctccggatcgctcgcgggcgtcgtggcatcgcggtccagcacacgccgacggagcttctcgaaggaaccgggccgcgaggatgctccatccgtcacgctcgccagggcgtccaaggatgcctcgactcgcgcgttccggatgccacgcaggccgacacgccgggtgccgtcctgggtcagccgggcgcggagctcgggcaggctcacgttgcccgggccccaggccacgtcggaggcggggctgggaggggtgtccaggtggatgagcacgtcgtagcggaaacgcgtcagctcgttcaggcacgcgccccgcttcgggcgaatctccacgtgggtgaggcgagggatgcgctgcttgagggcccagaagaagtccggggcgagcaccagctcctcttccgccgccatgcgctgcgccacgcgggtcttgagcacctgtgggtcgagcgtgccggacgcctgcgccaggatgatggacgcgtggaaggcctccagcaggcggaagttccgtacgtcacccacgaagatgacgccgcccgtgtccagccgctgtgaagccttctccagggcctgcgcgaggtactccgcgctcgggaagtactggaccaccgagttcagcatcaccgcgtcgaagcgcatgtcgccgaagtcgatgccgtccaactggtccgccgcgcagtggaagagcttcgcatgctcgagtccggccgacttcgccgtgttgccccggagcatgttgacgacgacacccgagacgtccgtggcccagtaggcctccgtggacggcgcaatccgcgtgaggagcagaccggtgccacagccgatttcgagcacgcggcggggcttccgcacgagaatctggtggaccgtgtggtcgacccactccttcatcgcctccgcgctgagcggtgcgccggtgtagctgctgtcccagcccgcgatgttgaagctggggtccaactgcggctcgctggcggagcgtgcatagaggtcgtcgtagagcgccttccactcgcccacgtgcgtgtcgccgacgccgccgtccgcatccgaggacaggagcgtctccgcggcgttgtccctgggcacgacgtaggcggcgatgcggcggtcatccgcgctccgctcatgcgtggtgacgtaggcatccgcgaccgccgggtgcgtggcgagcaccgactggatttcacccagctcgatgcggaacccgcgaatcttcacctggtcgtcgatgcgccccaggtacgtgaagccgccctccggaaggcggatggcgaggtcgcccgagcggtagagccgcttgcccggcgaagacgggtcctcgatgaagcgctgcgcggtgagctctgggcgcttcaggtagccgcgtgcaacaccagcgccgccgacgtacatctcccccggaacgccggccggtacgggctggccgtgctcgtcgagcaggtgcagctcgaggtctgggagcgggcgcccgatggggctcgcggcggaggtgaggtcggcctcggtcacccggtagtacgtgacgtgcaccgtggtctcggtgatgccgtacatgttgatgagctgcgtcccggcgtccccataccgctcgaaccaggggcgcacggtcgccgcgtccagcgcctcaccaccgaagatgatccacttgaggccgcggccgcccttgccatccgcgatggacggcgcgcgcgtcagcgctcggaatgcggacggcgtctggttgaggaccgtcacgccctcacgtgcaatcagctcaccgaaggcctcgggcgcgcgcgtcatccagtggggcacgacgaccaggcgcccgccgtacagcagcggcccccagagctcccagacggagaagtcgaacgccgcggagtggaacagcgtccagacgtcatccggcccgaagccgtagagcggctccgacgtcgtgaacagccgggtggcgttggcgtgggtgacgacgacgcccttggggcgccccgtcgaaccagaagtgtagatgacgtaggcggcgttgtccggcgtgatggccggctcgggattcggcgcgcgccggccgcccttccagtcgagcgcgtccacgaagacggtgggcacacgctgggtgggaagctcgccggtgcggctggactcagtcaccagcgcggcgacctccgcgtcctccagaatcaacgcgagccggtccttcgggctggcggggtccagcggcacataggcgccgccggccttgagcacgccgaggatggagacgaccagctccgcgctgcggtcgacgcagatgcccaccagtgactcggggcccacgccgtggtcgcgcagcgcatgcgccaggacattcgcccgggcgttgagctcggcgtagctgaggtgcgtctcgccaaacgtcagcgcggtggcattcgggctgcgctcggcctgggcctcgaaccagccggtgagggtctgggcggtggtgacggccggggcgctttcaacgcgcgcctcgtgcacgggggacggggccttgaccgccagggacagccgggccaccggctcatccggcgcgcggaccatctcctcgacgagcttctcgaagtagccgcgccacagggcgacggtgtcgtcgttgaagagggcgcgattgaagcggagcacgccggagaaggcgccccgcgtctcccacatctccaacgtgaggtcgaactgcgactcctggtcgctgatggggaagggctcgagctgcaggttgccccaatggacgcgggcgtcctcgtcgggcgaggcccacagcgccatggcgccgccgccctcgcgcgaggcgtggagcgagatggacgcctggaagaggggagacacgccaggacggcgctcgatgttcagtcgctccacgagcgatgcgaacgggaagtcctggtgcgcgagcgcctcgtggacgacggtgcgcatccggcccagcaaggtccgggtggacggcgcaccggagaggtccgcgcgcagcgccaccgcgttggcgaagtagcccaccacgtcatggaaggcggagccgggccggcccgccgtgggcgagccaatcaggatgtcctcctgccgcgccagacgccccagcagggcggcataggcggacacgagcacgacgaagggcgtggactcggcgctctgtgcgagcgccttgatgcgggccgtcagctccgcggagaggcggaacgggctcgcgccactccggttcgcggagaccgccgaccggctgcggtcggcgggcagcgccaggataggaagctcaccatcgagcttcttctgccagtagtcccagtgggcccgccccgcggcacccgacatcgtctccgcctgctgcgcgacgaaggcggcgtatctgcccgtgacgggcggcagggacggctgctcgcctcgcgcgatggcctgatagagctgattgaactcctgctggaggatgcccgcggaccacccgtcgtagacgatgtggtggacggtcatcaggaggacgtggtcctcggaccccagggagaagaggttcccccggagcagcgggccccgctccagggagaacggctgacggtaggcgcgggccacctcggactggagctgctcggcgctccagccctgcgcgtccacgtgggtgaagctcggctcgagggtcgggtggcacgtctggacgagctgcccttccgcggtggacgagaacgtggtgcgcagggacgcgtggcgctcggccagcattccgaacgcgcgcttgagcgacgccacatccatttgcgagcggatgcgcagtgcgaagggcgtgttgtaggccgcgctctccggggcctgctggtgcaggagccacagcgccttctggccggacgcgagcggggagaggcggggggccgcctttccggacttcgccatgagctccgcgagcagcttgcgcttcgcctcgagtgagaggcccttcatgttgtcagccggggtgctcatgccgtctccctctcctgcgccgtctgcgcggcgagcatggccctggaggatcgtgtccagctcacccttccgacatgctggttcaccctgc

SEQ ID NO: 1099 - DNA, 13751 bp, Myxococcus xanthus
atcgagaacccggggcccctcccggggtccgcgcgaggcaagcgcgggcctgcccaccgtggagcgccgcctcgccttggcctacgacggcgccgcccgcctcgtgctcgacggcggcgaggcgcgcacccgtgtcaccgtcaccctgccccgcgcgggcccccaacctggagtcctcacctgagcgccccacttcgcgtcctcatcgccgatgacgaactgctcgcccgaaagcgcctgacgcggctgctcgcggcgctcccggacacggaggtctgcggcgaggcctcggacgcggatggcgtcctttccgccgtgcgcgcgggcggcgtggacgtggtgctgctggacatccacatgcccggcctcagcggcctggatgccctggccctgctgccggaaggcggcccgcgcgtcatcctctgcaccgcccacgccgagcacgccgtgcaggccttcgaacatggcgcggtggactacgtgctcaagcccgtggagcccgcgcgccttcagaaggccctggagcgggcacgcgcacgcggtccggccacatcacccacgagcacggtcagcaccccaccgaagccacctggctcgcccgtccgcggcctgggccgcctgcccattcccacgcggcagggcatcgtcctggtggatcccgaagccatctcccacgcgtcgctggaggacgagctggtgaccgtgttcaccacgcagggagacttccttaccgacttcaccctcaacgagctggtggagaagctgccgtccgagcacttccaccgcgtccaccgccgcgcgctgctcaacctcacgcacgtggcgcgactggagccgctggacacaggtggctacctggcgcgcacgctgcgaggccacgcggtggaggtgagccgtcagtccgcgcgcgagctgcggcgcatgttgggcctgcgtcgcggcgtcgaggaagagggctgaagaaagacaaaggcccgcgctccggtgcatccgcgcgggcccgactgcgggtgacgacctacttcacgcgcacttcgacgctgacgacccgctcaccctcgttccgcgagtagacgacggtgccgcgctccgtccagaccggcccgaagcccgtgcccaggctgtaggccgtggcgacgtcgtagttcctgtcgaaggtgatgacgcgcacctcgccgtcctcgcccggccgcaggctggtcgtcgtgtagacgatgatgcgccggtccgcatcccactccacggtgccgcccagcgcggggttggggatgtaggccgagctgaactgcgaggtgcccgcgttcgtcatttttttcaggtccttgccgttctccttcacgagccacagcgagggcacgcccgagcgccgcgtggactggaacagcacgttgcgcccatccggcgtccacacgggctcgctgtcatcgaagccctgcgtcacccggaccgacctacccgagttcgcgttgagcacgtacagctccgagctccgcaccacgtcgccctcgcggtatccatccggcagcttcacatacgccacgcggctgccatccagggacacctcgggcgcaccggtgcgctccgccaccaggtgcgaatcgccctggttgtccatgcgaatgagctgaagcgaggtcgtctggtacacgatgatgcgccggtcggcggactcggacgacggctccaccaacgactgggacgccacgccaggggactcggcgtccgcgagcgcctccgcctccgccccaccacacgcggcgagcagcagcgaagaagccatccacatcgcaaggttcctacggggactacggcagcggacgtcagtcggatgcatacggtcctctgggtggaatccacctaccagcgcggggttgacaggttttacagtccgcgctcacgggtattccaggtcagaacaccataacaacccggaccgtcataaatgatacccgccgactggacgcgacaccgccccacaccgcgtcacggtaacgcgaaaagtgcgggaacctgggtcgcgtccgcgccaaggatgtctgagaggacccgggacgcctgaatggggacggcgataccagcgcgcgcgcaccgcgcggcttcgtccaaggtgagcgaaggcgtggaacagtaggactcacgccagtgctcggcgagccgccgggagaaggccacgcgcagggcctccaccttcgcctcgagccaggcctcggccagggtgaagttcggccgctggggcctcacgttgccttccttgaaggtgacgtcgtgctcgtggccggactcggagagctggtcctgcaacgtcacggtgaagggcccgcgccgggcgtccaacaccacggacgaagccaccgtgacgtggtgcgcctgcgacagccgcagcgcgtggtactcgaatttcctggggacgtcgcggtaccgcgtgacgggcacggagtaggtgtgcgtgtgcttggtgtacttcgtcaccttgcgcgtcttcgtcttgcccttcgagtcggtgtactcctcctccgcctcgtagggctcctcgatggtctccgtgcggtcctcgtggtccgtgtacggcacgctctccgtccacggcgcggtcagctccacggggtgactgtcgcgctgggtgacgaagcgtccctccaggctgaacaccggccgcgccgagcctcctggcgcgaaccagggcgaggactcgaaggcctgggtgagccgggcctccaactgcgcctgttgtgcctcgtccaggccctccacggtgcccgtccaggaaggcgggccgaacagctcgggcgccgtcgcggggcgaggcgcgtactcccgccagtggccgcagtagcggaacaccagctcgcgccagtgcggactgtcatccgtgctggtgtcccgcaggcgctggcaggacgtcttgccgctctggagcaccagccactccatgtcgcgggagatgagggccagctcgcggtgcgccagcagcggctgcttgcgccgcaatgcctgctccgccgtgagcgcgtgtccctggcgcgcggggttgccgacgagccgctggagatgacggcgtgtgccatccacctcctcgtgcagggagctctccaagccgccattcagcttcgcgttccatgccgtccggtggttcaggaagcgcaggagccacgcctccgcttcttcgtcatccccttccaggcgcgcctcccgcgcgttgctcagcaactgcgccagcgcgcgcgagcgcaggccctcgcgcgccaggaggagctcctggtcataggggctctgccggatgaggtcgtcgtagatggccgcggcctccacgaacatgcccttttgcgccaacgagtccgcgcggccgcgcagggtggtacaggcacacagaaccaacaaggagacgaggaggagccgggccatggtcacgaaagcgcgagtcgcgtgcgtccggtgacggacgtggcgacgaaatattcacggcgcgtcgcgatttaccgcacaccccaggcgacaggctactcgaccggccatgtatggacaggcgctccggattcggagcgctggaggtagcgctccaacatcgccgccagggcgtcccgccggggcatttgtgactccagccgcgccagcatctgccgctgccatgtcgcgcccgtccgtcgcagcacgacgcgctgttcgaggatgcccagcagcgtgtccgcctcctccgcgtccacgcccgcgcgaaccaggccctcccgggcgtcggggagcagccgcttcaccagctccgtcgccgccatcggccgcggactgggcgccgtggaggagggccacagcagctccgcgtccaggccctgccgtgcggcgcggatgaagttgccgtacgcgtggacgaagggtagcgcgggtagcagcgcatccacgcgctcggccagcgccagcgtgagacccagcaggaaggcgccgttggccatcatgtccaccagcgtgggcccggcgggcaaggcgcggaactcgatgcgcaggtggcctccagccttcgggtcgtagatggcgcggttccagctccacaccgtgctctggtgcaggcgcagctcctccaggtccggcacctcgcccgccgccacgcgctcgcggaggggctcatcgcccgacaccggcaacagcggtggatgcagcgccaccgcttcggcgaacaactggtaggcgccctcgcgcacccagccatggccgaacgacacgcgcgcgtggggctgaaagccgccttctccgggctcgccccggtcatccaccgcttgccggaacagggccacgcgcgtctcgtcccacagcttccgtcccaggaagagcggcgagttgcccgccgccgccaacaccggcgccgtggcgagctgcgccgcgttgtacatgcgcgcgaagtccccaggcgccacgcgcaggtggtactggagcgacgtgttcgcgccctccagcgtcacgtccttccaggtgagcgacagcgcctcctcttcgccccgaatcgatacatggaacggcgcggaccggcgctgacggatggcggtggacatggcgcgatagcgcggctcgctcgtgagcgcgccgctgcccaaatccgcctcgcgcaaggtggggaggatgccgatgacggccacgcgcgcgcccagcatggacgcggcccggcgcaccgcggacaccgcgctctccacctcctggcgcagcgcactgaaggacctgccggccagcgggcacggacgcaggttcacctccaggttgaaggcatccagctccagcgtcacgcgggggtcttccgcgcgcgccagcaccgctcggttcaccggcagtgggaaacccaggcgatccacgaggtacagctccagctccgcgcccacggtcggcgcacccacgccgaaccccgggcgcgccaaaagtgcccgcagcgcctccaggctctccgccagccgccgggagaaacgctcgtggtcctccggacggaattcctcctgatggatggccatccccatgacggctcaaggtaggtacggccgcctgcttccgccccagcgcccgggaacccgcctgcccggccacccggcgcctgccagaccgccccgcagggcagggtcaatgtccacgaatggcaccgggcacgggtaggtacgcccgcgcccggtgtgttatctcggggcctggtcatgccgtccgacacgtccgccaacctgtacgatttgacgcggcccgcgctgggggcgctgctctccggttggggcttcggcccctaccaccgcgaccagctctggaccgcgctgtaccgccggcacgcgaccactttcgacgaactggacggcctcaagccggagctgctgcgcatgctgcgcgagcacacgcgcctgggccagttggccacccaccacgagtccttcagcagcgacggcttcacgcacaagctgctgctgcgactggacgacgggcagaccattgaaaccgtgctgatgcggttcaagggccgcgccacggtgtgcatcagcacgcaggccggctgcgccatgggctgcgtcttctgcgccaccgggcagatggggctctcacgccacctgacgcccggcgaaatcgtggggcagatactccacgtcaaccgcatcctgcgcgcctccggcgagacgctgcgcaacgtcgtcctcatgggcatgggcgagccgctccacaactacgagcacacgatgtccgcggtggacgtgctggtggatgcgctggggctcgccatgggcccacgcttcatcacgctcagcacggtgggcgtcgtgcccggcatccggcggctcgcggatgaagagcgccccatccacctggccgtcagcctccatggcgccaccgacgccgaacgcgcggcgctggtccccgctggacgccgctggcccctcgacgagttgatggacgcgtgccgctactacagcgagaagcgcaagcgccgcatcttcttcgagtggacgctcatctccggccgcaacgacaccgccgagcacgcgcacacgctgggtcaactgctgcgcggcatggacgcgcacgtcaacgtcatccccctcaaccccacggtgggttacgacggcggccccagccgtccggagtccgtgcgcgccttccaggacgtgctcgccacctatgacgtgcccagcacggtgcgtcagcgccggggcatcgacatcgacgcggggtgtggccagctcaaggccaccgtggaacggcgttcacgccgttcacttcccaccagcgcctgacgcattcctgaaggccccaagcctgctgtccgcccaggccccgggtacgagcgcactgtctcgaacgtcgaagcgcccgagcgccgcgtgaggagagctcacgctcgcatgcccgccacaccgcgtgcgcttcgcgcgaagcgcacgcgccatgacgcaaaggtccatccgtcagggtcccgagttacaccccgagcggtgcgtcgtgtcggtggcggacgcccatgtcgattgcgggtggtgccccttgcacgcgacacggccatgggcacattctttccatcggcttccccggggaggtgggcgatgctttccatccaggagcacgcaacggtggatgaggcgagcagtgagctgctcgacttcgttctcgagccgtacaactggctgtcactgccacgaacaggcatggacccggcagcatggcccgggcagaacacgctctatcagcgccgcgtggggtcgctgcgcatctgcgcgtccgtggacgtggcggccacgctggacgttttcctgcacatcgccttccgtgcaccgggcctcacgccggtgaaggcggcggaccatctggagagcttcctcaagcagcggctgccactgacgcccaactccgaatggcaggtggaggtggacgagcgccggtggattcacttctcgcggcgctacgcgggccctcacctcaaggcgtgagcggctccagccggtagtggcgcagcggctgcgccacgttcttcacgggcgtctccgtcaggggcccgaagcgcaggccctggaagaagggctcatccgagcccaccagcgcgtcatgcacgcgctccatcaccagtgtctcccggaaacccgccagtgactggaggcgggccgcctggttcatgccgctggagaaggccgtgtactgacggttgggcccgaagaggccgcagttggcgtgcgccaggttgacgcccaccgccacacccaggcccggcagcttcacgcgctcacacagcgccgccacttcctcgcgcgcgcccagcgacgcggtgaaggcctggatgtcacacgcagcccgcaccgccgcctgcgcgcgctcgcgtggcgtgcccttgaagaagggcggcccgaagaggccgatgacacagtcaccgaccatcttgtcgaacacgccgccgtgctcccagatgcagcccacggcgcgctggctccactcatccacgaagcggccgatgttgcgcgggctgtcgaagccctgctcgcagatgcgggtgaagccgttgatgtccgcgaagaggatgcccacctcctggtcctgcgcccgcaggtactgggcgtaggcggggtcgtgcaacaacgcgtcgatgatggcgttggggaagaactgcgacaggtggatgcgctcgcggttgtagtcctggagccgctgactcagcgtggacgccagcacccggatgaggtccatggcgtaggaggagaagccgctgtcgttccacacgacaatcttccccagcgggccctgcgcggcggcgccggagatgagcacggcctcggtggtgcggccggagaagagccgccgcagcgtggactcctcgctcaggagcagccgggggccgtgctgacggatggcagcctccaaccccgcatggggctgctcgccgctttcgaactccaggtgcccgttgcgataggtgcggtagtgcagcacatgcggctgcaccgcgtcccggtacagcagcaggaagcctggcaggcgcacgcgctgcgccagcgtcagcacggccaggtccatgcccgcttcgaagacggggttggccagatggctgttgcactggaggatgagctggtgcttctccgacgcggtgtgcaccaggcacaacaccgtgtcgagctgctccgccacggtgtccagcacgcgcagcaggcgcgcggaggagtccggcgcggtggcgtcgttcgcgaagagcaggccgaacacgcccacgcgcgttcccgccacgtccaggggctggctgaccagggtgtccgcccccaaccggcgcacgcccacggcaccttccagcagcgcgccggggtgacggtcgctccagtccccctcgttccacgtctgctccaccagctcctcgtcgcgcgtggtgatggccacggccttggcgccggtgagcgagagcaccaacgggaagcagcgcttgaaggtctgcgtcagcgtctcacgcccgcgcaggctgtcctccaaggcgtcatccaccgcgcgctggagggtgcgcagcgccttgtactcctccagggtgatgtcggtcatgggctgcccttctatcgccgcccgggcggtgctgtcacagcgcgggcgtctgttgctggccgccggacacctgtccgtccgccacgtcgatgagccagtacccctcgtgtccggattcggtggaggagcccgcgccgaagacatggggccggtcggcggtggcgggatggtggtagcgccggtggatgtggccgtgcaacaccgcgtagcgcgggcccggcagcagcttcagcaaggcgtccgcgtcccggaggccatggtgccagcggtccggtcgcccatggggattgagcggcgcgtggtgcaccaccaccaggatggcgcgcccctccaaccgggcgtccttcagcagcgcggccaggcctccaagctgggcctcgccgatgacgccgtaggacaggcccggcgtgcgcggcacacgggcggacagcagtcccaccaccgcggcctcggtgcccagcagccggacgaagggaaaggcgccctcacggcggtactccggcaggtcgctctccagcaggtggccgaagtatttcgcgaagcgtccggtgcggtggctcccgggcgtgaagacgtcgtgattgccggggatgacggtgcagcgacgggggtcctccgccagcgcgcccagggactggcgggcgccgctgaactcggcgtccagcgcgtacgccgtcaggtcgccggagaggatgaagtggtccacctgcgcggcctgcgcgtcccgggcaatggcggccagcgcctggggcgcgcgcgcataccgccgggcgcggcctcccacggtgagctccgccagggccatccaacgtcgccagcccaaccggtgcagcggaagcgcgaagtagtcctcggtgatgtggacgtcggagcagtgggcgatgcgcatcgaggggatttccgccaatcacgacgaacgtagcacccacctccgggggcgtcgacgaagcaggccacgggcactgcggcgggccccccgcgtcggttatggtcccccgcgacgatgattcactccgcgtgcccgcacgccctccttccccacggacctcgggggcgcccatgagccaggtccgaggccgcttcgcccccagccccaccgggcgcatgcacctgggaaacatccgcagcgcgctgctcggctggctccaggcgagggcggcccacggccgcttcctgctgcgcatcgaggacctggaccgcgcgcgctgcaagccgcagtacgtggacgacctgctgcgcgacatggaatggctggggctggactgggacgagcagcccgtcttccagagccagcgggacggcctctaccgcgacgcccaggcccggttggaacaagcagggcgcgtgtatccctgcttctgcacacgcgcggagattgcacgggccgccagcgcgcctcacggactctccgacgaaggcccccgctacccgggcacctgcgcgcacctcacccgcgaacagatttccgagcgcgcccgcacgcgcccccccgcgtaccgcttccgcgcggtccccggcgaggtccgcttcgtggacggcttgcagggctcgtactcgcaagacgtggacgcggtggtgggcgacttcgtcgtgcggcgcaacgacggcgtggccagctaccagctcgcggtggtggtggacgatgcggccacggacatcacccacgtgctgcgcggggatgacctgctctcctccacgccccggcagctccagctctacgccgcgctcagcctgcgcgcgcccgacttcctccacgtcccgctggtgctgggcgaagacggcaagcgtctcgccaagcgcgagggtgccttcgcgctcgcggagttgcgtgagcgtggcgtggctcccgagcgggtgctgggcctgctcgcctcatggagtggatggggagacggtggccccctgacgctcgccgaactggtgcacagcttccgtcccgaaagactgccgcgcacgcccatcgtcgcgggagaggccgcgctccgagaagcactcggcctggggtgagcccgggctccgccctcctccacggcgagacatccgggcgcggcggaatcgtgcctccgctgccccatggccatgtttgccgcgaacacgagcgcctcctttccgctcgaggcgctcccggcggaactagaggcggaaccattgcaaccatcggcgagaaccaagcgcccggcgtggactccgccgtcgcgggcaacccctacaagctgagctggggctccatcttcggaggcgccttcgtcgccctggccctgtggcttctgctgaactcgctcggcctggcgctcgggctgtcgtcgataaaccccaataacccgggcagcgtccgggccgcgagcatcggcaccggcatctggagcgccatcgcgccgctcatcgccctcttctgcggcggcttcgtcgccgcgcgctccgcgggccggctggacaagggcggcggtgcgctgcacggcgcggtgatgtggggcttgacgacgctggtgggcaccgccttgctgggaatgctgctgtcgtccgtcgtcggcaccgcgctgcgcgcgggcggcgcggtggtgggggccaccggctcggcggtggcgggcgcggcctcgggaggtggacaggccgcgcaggccttcgggttggatgccaatgacgcgctcggccccatcaaccggcgcctccaagcggagggcaagccgaccatcaccgccaaccaactccaggccgccacgtccgaagtcctcagcaccgccctgcgcaccggcaacctcgaccaggaggtgctcgtcacgtccatcgcggacaacacgcgcctgtcgcgccaggacgcgcaggagatcgcgggccgggtgagcggccagttcaccgcgttccagggcaaggtcggtcaggtgggtgagcaggtccaacagggcgcgctgcaagcagcggagcccaccagccgcgtcttctggggcatcttcgcgtcactgctgctgggcctcatctccgcgatgcttggcgccaccgtgggcgtgagccgccgccagcgcatcgccgctgaaggcgccgtcatcaccacgccgcccacccgccccacggagccccccctgccccgccgcgaggtgtatccgtaggggaaggctggcgcggtcgtgagcgccgtccccgagggctcacggccgtcgccttccacacactccgctccgcgccacgcccgcacgcgcgcatgcgttaacattctccccgaccgaggcggcgagcccaggcacgcggcggcgtcgcgcgcctctcggggggacatccatgaaccagagcaccacgtacctgctgtgtctcaccgcgctggccaccgtctccagcggctgcttcctgcgcacgggctacatcctcgacgcgctgaacacacccggagacccgcaggcggcgccgctgcccgtgcccatccaggagcgcgcggcgcgcatcacccgcacgcacctggtggacgcctacgccgaccccaccgaagccgcgcgctggatgtccgcgatgggcaacgcgccccagcccatcctcgagcaactggactgcctgaagcagagcgcgggcggcagcaacagcgcgtgctacgagcgattcctcaagaccgccatggagccgccgcagtggggcctgccgtcgctgcccaccacggtggaccccgccgcgccctcaccgcgcgaagtggacgccgcgcgcttcctggccaacacgctgggcatcgccgcgtcgctggtggccctgcgtgatgcccagggggaccgcgtgcccatccaggtgctcacccgcggcatccgcgaaggcgccgagtccgccgcgcagtacgtcagcgtccgcaagtggaaccgcacgctgggacgcccatccaacgccattgtcctgagcggcggcggcgccaatggcgcgttcagcgcgggggccatctggcgcctgctcggcgtgctggagcagtgccgcggcaaaccggcgccggagggttgtggagacgcgcgtatcgacctggcggcgggcagcagcaccggcgcgctcatcagcacgctggtggacctgttccacacgccgggccacgaagaggccgcgcgccagctcctcgtcagcaactacacctgctcggtggagtcggacctgtactgcgtcaacaacacctggatttggaagattgcctccaacctgcgtggcctggtccagttcgacggcatctacggcaagctccgcgcggcggtggtccccgagcagctcaccaacggcacggagctggtggccgtctccgtggacttcgacaccggtgacgtcttcggcatcagcgaccaggacccggcgaacttcgacccgaacgccaccgaacagcagcgcgtggagggcatcatcaacggcgtcgtcgcctccatcgtggagcccgtgctcgccgacccggtgccgtggctgccgtcacacaccgggaggatgaagggctccttcttcgacggcggcgtgcgctccggactgccgctgctccaagccgttcagcgcggtgccgagcgcgtgctggtcatctccaccggcggcgtggagccgtcaccggagaacccgccggacaacgccgtcagcgtgctgatgcgcaccatcgaccttttcgtcgcccagccgcgcgtgggtgaggtgcagcagggggagatggccgccgtgggccggcgcttcgcggagcacaacgtctgcgtggagcgcctggcgaacgtggccgacgccgccagcgtcaacgccttctgccgccgcacgggcatgggcttcgtcccgcgcgagcccgcggccctcaaggcggccaccagcatgtggctgggctccgcccgcttcgaccaggtggcctccagttggcgttcatcgtggatgttccgtccggactcgcagctccagatggccagcggctacggcttctcgccggaagtcatgcggccgctgttcaaggaaggcgtgaagcacttccagcagcgttgccgtgaagtgctgcgcctcttcgagattcaaggcacgctggccgccgcggagtgcgacaagccggtggacgacgcggtgtcggaagccgaggcgcggttcgctccactggcccagtgcatgaagggcaagcccgagcagcgctcgtgcaagtgagccctggaggcatatcctccaggcgtccatgtccgaccggtcgtccctcatccgttggctcgtcattcccggcgtgagcctgggcgtgctcatcctgagcgccgcccatacctacgagcgggaga

SEQ ID NO: 1100 - DNA, 15447 bp, Myxococcus xanthus
ctacggaggagcgtgtcttcaagggccgcgtccccgcgcgcagcgtggtgattcccggcatgcgggagaagcagttcccggccggcaagtacatggtgccgtgcgcgctcatcatcggtcagcggacgaagtccaccgaccagaagaccagcctcaatgcggcgctgcgcgacttcgcggtggcggtgtaacggctgaaatccagcagcccgcgcgcgccgtagaaggcgtgtgacggcacggaacgtgacgatggcgcaccatctggacgacatcctgcccgaatgggcactggggatgctggaggccccagcccgggcgtccgtcgagcagcacctcgcggagtgcgcgaggtgccgcgaggtggcggaccggctggtgtccacgcacgcggcgctggcgtcgctggtggtgccgccgcccgcggtgctggcgcggttgatggaccagatggaaggtccggggaggcttgcccgcttcgcggaccgggtggcggccttcttcgacctgtcgcgcgagcgagcgctggcgttgctggacgctgtgagcgacccggcggcgtggatgcccggaccggtggagggctcggagctgatgccggtggagacgggccccgcgcgcgaaggcacgatggccgccatcctccggctccacccaggggtgcgctacccccggcacacgcaccacggccgggagtggaacctggtgctggagggcggcttccgcgaggatgatgggcacgaggtctggcccggcgaggagctggagaagacggacggcagcgcacatggcttcacggcgctgacggaagggccggcgtgtctgtgcgcctccgtcctggagggcgtgacgagcttcgaggaagcgttcgcggacggctgacgcccggcgctatggtggaaggcgtatggcttccatcgacctcgccacgcggctggctcgcaccacgctcgagctgtgccgcatccccagtcccatcacccaggaagggcccatcgccgaccatgtggagcgctgggcgctccagcacttcccgcgggaagaggtgttccgagtcggccacacgctgctgctcggcaagctggaggatgcgcgccccacggtggccctcatcggtcacctggacacggtgcccgcgcaccccagcgacgcgggccgcgaggcgcgcatcgagggcgagcgcgtcttcgggctgggcgcctcggacatgaagggcgggttggcggtgatgatggcgctcgcggaggatttgcgccgcgacacgctgcccgtgaatctggccttcctcttctacgagcgcgaagagggcgcttacgccgaaagcggcctcatccccctgtatgagaagcggccggacctggcgaaggtgcggttcggcatcgccatggagcccaccgacagcgtggtgcaggtgggctgcgtcggctccatgcaggtcaccgtgcgtttcaccgggcgcagcgcgcactccgctcggccgtggcagggggagaacgccatccacaaggcggggccgttcctcgccgagttgctcgggcgtcagcgcgtggaggtcaacgtcgcgggcttcccgttctacgaggtcatcaacgccacgctcgccaagggtggccgcgcgcgcaacgtcatccccgaggccttcgagctgaacctcaactaccgcttcgcgccgggcaagagcatcgaacaggcgaaggcggacgtgcacgcgctcgtcgccgggcgggccgaggtggagttcaccgatgcgtcgcccagcggcccggtggtggcgggcaacccgctgttccagaagttgatggccctcaccggcctgcccgcggcctccaagcaggcctggacggacgtggcgcgcttcggcgagtggggcgtggatgccatcaacttcgggcccggtgagacggcccaggcgcatcaggccaatgagagcgcgcccatcgcgccgctcgcggacgcgtacgagaagctcgcggccttcctcaagggcgcgagctgacgaggactcgtcgcgggacatgccctccggggcatgacgcccgcgcgcggtgcatgtcattcgtccgctgtcgttcatctgcgtgccttcaccgcacacgccctggcgtgcatgggcgtaccctgtccatgcatcgcctgcagtcttccccaaccggagccgactgaatgacgaacgagtccgtcaatccgcagctgaccgacgatgtctctccctccccggcggaggcgggcattgcgcccacgccgcggcgccgcaccgccacgaagcgcaagagcgcttcacggacgggtagcacgcggaagtccgcgcgcaaggccaccgccaagcgtgggactccccgcgcgaagaagacggcggcacgcgggaagacggccacccgcaagtccgctacgcgcaagtccgccacgcgtgccaccggccgcggcgcgcgcaaggccaccccgcggaagacggggacggcgggacggaccgcccgcaagacggggacgcgcggcaccgcgacgaagcggaccaccacgggtggcggcgcccggaagtcgccggcccggcgaacgacgcgccgctgaggcgttccgcggacaatcacttcagggccatgggggctggactcccatggcccttggtgttttcaggcgccgctcagcgcttcagtcgcagcaggaagacatcgccgcgcgcgaagctctggcgtccggtgccgaagtccgtctcgcggtccgtgtggccgaagaggaagacatccccgtcgggcagcacgcccatggagggaatggcttccaggccatacagctcgcctctcggccggggcgggtccgccaggaacatcgtcgtgagaagcgacgtgcccgctgcgtcgtagcgcagggccacgggctgcgccgagcccatgccgtccttgcctgccacgccgttctcgatgcggttgaaggtgaagcccgccaccatcagctctccggagggcgccagcgcgagcgcgtccacctggagcccgtcccccaggcccttggcccatgtctcctgtccttccgccttggcggagacgacgaagggggtttcccggaacgcatgccccggcacctgcatgtcaccccagcgcacggtgcccaggaatgggcccgcggccaccacggtgccctcgccgtcgatcgccacgtcgcgcatggtgccgcgtgcctggctcatggccttggtccacgtcagcgagccttgctggtagagcgcgacgaagggactgccgctttcggcggcgctcacctgctgactgccgaagcgcaccgcgccctcgtactggccgcccaccgccatgcgcccggcgccatccaccgccatcgtcgtgagcgccacgcgcccgcccccctggggctcgcccacggacacggcggattcggccagccctccgtgggcgtacgtcaccaccaccgcgccagcgccggtgacgccgttgccgaagtccgtgctgcccggcgcgttgaaggccaccagcgtccgtccctgggtgtccaccgccaggtccgccaccgcgaggccggtgcccacgggcgtgttcgtccacaggacgttgccgtccgcgtccatccggaccacgaaggtgccatcccccagcttgtggctgaggaggtccaggacgccctccgtggtgccggcgatgacgatgccgcccgccgggtccgcggcgatgcggccccggacgaacgcgcgccgctccggcggcgcctccggggccctcacgtcgaaggccttctgccagcgcggctcgcccgtgggcgcgcgccgcgtcagcaccagcttcgcccggtcatccgtgggctgaaggctgtccaggtcatcgatgtcatgcagcgacagcgtgaggaggtcgccgctggcatccaccgccgcgcccagcgccaggtcgtcctggggcgtgccctcgcgctgcatccacagcgtgctgcccggccccggcggtggcagtggcggacgcggtggtggcggtggcacgccgggtggtcgctcttccggaggggtctccggaccaggtgcttcttccggaggcgcgacgcagtcccccgtggggtcctccgtacagtgctcctcgccgggaagctcgctcgtgcttttcccaccacagcccagccacaaccccgccccacccagaaccgccgcactcacgacggtccggacccatcgccacgctggatgcatgcagtccccccgcttcgcccaggggagggtcggcatgcgtgtctgtgtcagcaacacccactggggcgtttgcctgcctggccgcccggatgcgtgaggcggccccgctgacagtgggaaatgtcgccccgaaggtggcactcccattgccccagcaggggcctgggatgccatggccgtggcgcttaagggggcctcagcgccagaagcccacggacaggcccacgttggtgtagcggcgcgccaggtcgaaggaggccgtcacggaccagtcctcccagtagcggaagacgaacacctcgaatccgccggtgacgtgggggcgcgcgggccgcttgtcgaagggggacggctccgcgtacgcgccggcccgcagccgaatcatgcccggcaccgtgtcatgctccacgccgatgcgcggcgcgaaggaggtgcccttgcccaccatggcctcgtccgccgtggacgcgaaggtgcgcgcgggcaccgcgttgtccacgctggagatgaggtccacctgggcgctgatgagccagcggccagcgggcgcgtccaggggctcggcttccggcaccggtagcgcgtctccctccacgaggagctgtcgccgtgccgcgggggacagccggttgtagcgctccgcgccttcgcccagccgccagctggcgcccaccgacagcacggcgggggacaccaccgcgccgaagagggtacgccccgcgagctccgggagctgtttcggctcgcgccgccagtctcccaccacctccggccgcaccgtcacgcccatgcgccaggggcgcccatgcggccggtacaggatgtccaccgccacgcccgtgtcgccgtagcgcaggtccgtgcctccggagtccagccggaaggaggcctgcgccgcgtagatgcccagcgcgaggatgaagtcgtcctggccaaaggacatggcccccgccagcaccgactgcgtgagcgacacgcggatgcgctcaccgggccccgcgcacgcggccgtggcgcagtaggacaccacgctgttgcgcatcgcgaagccgatgccgaagcgcttgtactggagcagcaggccgcccagcagttgccggctgtcgtgggactcgtcgggctgcccgtcgttgtccacgtcccgcttgcgcgagccggtgaagggcaggtccaaccaggacagggtgacgcccaaatcccagtccttctccaaggccggaccccggtgcgccagcgaggccaggttgctgggcagccccgcggcgccctcggcgatgcccacgtacgcgccgcccatcgccaccatgcgcgcggagcccagcagcgcgccggggttgaggtacagccgctccgggcgaggctccagcggcgggggcgtctcctgcgcccatgccgctgatgtggcgcccagcaccagcgcgcacccgaacgctttcacccccccgccaccgcgtcctgccggacgcgccaccgacctggaaggactcaccgagcgcgcgtggcctccgtgaagagacggtccgcctcggtggccagcgcggtgtcgcgggcggtgaggcccccggcgtcgtgggtgacgagcgccagcgtgaccttgcgccagcggatgtcgatgtccgggtggtggtccgccttctccgccgcctgcgccacctgctccacgaaggcgatgccggcgaggaaggtgggggcctcgaaggtgcggcgaatcatcccgccctcgtgcttccactcggtgtgctgcgagaggaaggactggagcgcctcgggtgcgagcagcgtgggtttggaagccatggccgcctttctacccgctcccaggcttgagggaagacacccgccgtccatcgtcacggggtggacggccgcgcgtacactttcacgccgtacagaatgttccagtgctccaggtggaagtagcgccgaccgacgaagggtggccggcgcccgtcaggagacggcagcagctccaggacgacggtgcccgtctccgcgctccagcggggcacggcgtagggcctcgaggaacccgtggccggcgacaccacggggacgccgaagcccgttgtccgcagacgctcggcgccctggaaatggaaggaggaggtcatctccatgacgccgtccaggcgcaggcggccgctcgccgccgagtaccggagcagcgccaggctctgcgggccggaggcggcgcgcacccacagcacaccctcctcatggcccacgggcagtccggggacgctatggcagggctcgccggggacgggctgcggcgcgcccgcggcgtcgagctggtaggggcaggcctcgatggccatggtggcgggcgctggcgcatcggcgatgcggaccaccagaagccgctcgcccgcgcgcatcagcagcgaggggatgtcatcgctgaacgtggccagccgcgagggaggaacggggggggagcccgtggcgcgcagtccctcctcctccgagaaggcgtagcggtgcagatgcgtttcatccagcagcagcaactccgtcgcggtggcgagccgcgcatggggcggcgcatcggcgggcgcgcccgtggcggggaagggcgcatcggcggaggtcgcgaggggcccgtttcccaggtcgacatagcggcgcacccgggcggcctccgtcacccacaccacgtcgccggccacgacggcgggggcgaagtagtcgcccaggggctggggctcctggtccggcgtgcgcagcgcctggctgccgcacagccacgttcccgacgacgtccggtccacgccacggcactccagcacggtggacaagtccgccaggggcgcctgggcgctgtggtcctccaccgcgtagagggaggactggcggatgctgcccaccggagagaaggcgacgacgaggtggtggcgccccgtctgctccggcgtgaaccgcacgatggcggacctcccatgcaccgccagctgcgcggtggcggggaccacgcggttctgcgggtccctcacctccacggagacggattgcgcccggtcttcctgcgaggagtcacacctgctgaagacgccgtggacggtgagcgcctgcggctggcccacgccgaccatcgcgtcgttgaagaggggggatggcccgtgctcctcgcaagggcccatggggcaccccacccccgtgcccaccgccagcagcaccgtcagcaaccgaaggacctggggggcctgtctcacgcgcgctccacggcccgcttccacttggccaggtgtcgctcgcgggcatccggcttcatcttcggcttgaacgtcttctccgccttccatgcgcggcggatggcctccgggctgtcccagatgcccgcgcccaggccgccgaggaacgccgcgcccaggctcgtcgtctccaggttgcgcgggcgcaccagcggcacgcccagcacatccgcctggaactgcatgaggaggttgttggccgccgcgccgccgtccgccttgaacacggggatgtcccgcccgctgtcgcggcgcatggcctccgccaggtcatgaatctgcagcgcgatgccctccagcaccgcgcgcgccatgtgggccacggtggtggagcggtcgatgccagcgaagaggccgcgcgcctcgggccgccagtgtggcgcgcccaggccggccagcgcgggcacgaagaccacgtccccggagtccttcacgctggcggccagcgcttcgatgtccggcgcgcgcttgatgaccttgagcccgtcgcgcatccactgcaccgccgcgccggcgatgaagctgctgccctccagcgcgtacgtggtggtgcccgtcccgcccagccgccacgctacggtagtgagcaggcccgccgacgagcgcaccggctccgagccggtgttcatcagcaggaaggcgccggtgccataggtgcacttggattcgccgggctcgaagcacgcctggccgaagagcgcggcctgctggtctcccgccatgcccgccacggggatgccgtccggcaggctgcgcatgccacgcgtggtgccgtacacctccgcggagccgcgaatctgcggcaggcacgcggccgggacggacagcatggcgcgcatctcgtcgctccactggagcgtcgtcaaatccatgagcaacgtgcggctggcgttggacacgtcggtgacgtgcgccgcgccgccggtgagcttgtagacgagccaggtgtcgatggtgccgaagcacacgtcgcccttctccgccttcgcgcgcgcgcccttcaggtggtcgaacatccacgtgagcttggtgccggagaagtacgggtccaccaccagccccgtcacctcgcgcacgcgcggctccacgccctgctccttgagccggcggcactgctcggcggtgcggcggtcctgccagacgatggcgtgggacaacggctgtccgctgccgcgcatccacaggcccgtcgtctcgcgctggttggtgatgccgatggcggcgatgtccttgccgcgaaggcccgcgctcttcagcgcccgggcgatacaccattcactgctggcccagatttcatccaggtcgtgctccacccaggacggcttggggaagtgctgggtgaactccttgtaggagcggccgaccacctgcagcttcgtgtcgaggatggagacgtgcgttccagtggtgccctggtccagggccaggacgtacttcgccttcggcatggggtgtgccctccctatggtggatgccagcggggagggaccctactccagacgaggggccgggcaggcgtgcttcctgcccggcgacgcggctagtagccgtaggggcgccggtttccgagcaccttccgaaggccgaacgcggccagcccgcccagggcgaggcggcccagcgggctgccgaacacgccgctcgaggccgcgcggccgcggccgtaaccgccgtggccccggcgtccatacctgctccggccacggttccatccaccgaagcccgagctgcgacgattccccaagatgttgtccagtagcgacatggtggctcctctgttcgtcgatgcgttgagagcccccgccggggcggagatgccccgcgggcgcggagtgccctcaagttgacgcttccctccgccgggggcagccctggccgaaggacgtgcctcccgggccccctggcgggcacgggaggcagccatgcggtctgcctacttcccgctgtagatgccgatggccccagggcggacgatggtgcccgccgcgtcccgctgggcactgaaggccaccagcaccttgcgcgcgtcaccgctgcccaccatctggatgtcccagacgggcagggcggacagccctccgagcgccgggttgtggctgacgaactccccctcgccgtgcatgcgcctcaggcccttgccccagcggtggccaatccagaggctgccgtcgcgcgggtccagctccagcgaggagatgttgcggtcgccgtcgccctccagcaggtagcccgtcaccagtccggcgtcgctcatcttcgccaggccccacgcgaagctggacacccagacggtgccgtccggcatcagcaccaggtcgctcaccaggtcgtccttgcgctgcgcatgggtggggaactggggttcggccacggcatccggccacaggtcgatgcggttggcgacgtgcttcttctcctcgctctgcttgcgcgccatctcgaagttccatggagcgccggtgcctacgtggcccacggcgttggtcatgatcttgaaccgcgtggtccggatgtgcgtggccagccagacgtcgccgtcgggccgcaccgccacgccccagacgtctccggcgagccggctgtcctcgctggtgccgtcccccatcgcgatggcgggatggatgtgctccatgacgccgaacttgcagcgctggcgattctcgccccccgtgtagacccacgcgttggcggcgatgacctcggcgttggtgcacgcctcgccgccctggtagtcgggctcaccccacgccaggccgtggttggacgcgaaccacaggctgttgcgtgccttgtcccagatgatgcggttcaccgagcagagcttctcgcggtggccgtaaccgggcacggagtgcgcgggcgagtggaggtcgtagtgcaccacgcggagcgttccgtccgcctggagctccacgcggtccgcgtcaccgctcttgaagatggcggggtcctcgaacacgccgggggccttgtagaactcgctctcgcagttgggccggccctcgtagccgacgaagacggtgcccgcggggccccccgtcaccgagaggaccttgaggtagcgcgcttcgggtgctgggtccttgcccttccacggcgcccagggcttcaggccgtccgccagggtgtagcaacgcagggcggtggcgcccggacgcaggaggcacaggccgtcctcgccgcccgcgacccagatgttgccgccctcgtcctgggtgacacccaggacctcgcgagggccgccctcggcggtacccaagaagcgccagttcgcgctgtcgggaggaatgggttcgccgccgtccccgggaccgttcgtgcccgcgtccggctccaccggtggtgggtccacgggcgtccccgagtccggatcctcttcacccacgggcggcggctcctcgccttcgcccggtggtggatctccgggcggctcggtgggtggtggttcgttcccttcgccaatcccatcgtccgtggacggcggcgactggagctgctcgctgccgtgacagctcagcagcaatgtcagcccgagcacgcccgcccaccacttgcactgtccaagtccgctcatacctgggtccgcctccggtgtctgtctttggacgcgttacttcgcgtcctgactccagaggcaagcagggtgccagggggcgaatgccgggccgtgggggtggcaggggaaggccgaggaagcggtagggctccgcgctgccctcaccgggaacctggacgcctcaccctcgggggcgtgccgtgtgtccgttggccgcggaggacaggacgcgaggcctgcgcacgggcgggagcgcgtcggggtccacgtggtgcgccacgcagccgggccggagccgctcgagcttccgggcctcctggagtcccaggcccgggttgccgtcgaaccagacctcccgcaggttcttgaaggcggccaggatttcgacgccctccgcgcccacgcgggtctgcaccagccggagtcttgggacggcgccgatgtccgtctgctcccgcagcgtgtgcagcatcgccgtgtcgaccgcgccgccgagcatctggaactcctccgtcggcgtcagcgcgctcaatatctccatgtccaggaagctcgcgtcccgcagcaccagctcccgcaggtggccgtcgtcccgcgtgttgaggccgtagacgagctcccccttcaatccccggcgctggatgcgtccgtcggggaaccaggacgtgtactcacctccgtccacgtgcatcttgggttgtcccgacacgtaccagcgccgctcggacacctcggtggcgaagccgcccgcgtattccacctcggaggtacagtagccgttgcgcgtgaaggcataggcgacgcctgtgaagggccggccctggaagagccgaggcccatagtcctcgggcatctccagcagcgcgctgttcacgcgcagcccgccttcgggcagcgggagccagtcgggggaggggccggtgatgacaccttccgacgccgccatcagcgaatccagcgtgccgtcgtgcctcaaggaatacgccaggcccgagaagagcgccttgccgtgtcgcagcctgccgtccacgccccgaatcagaaagcttgctcgcatccgttgcatggtccgctcccgttctcaccgggcacgcgccggtgaaggccctggcacctgcttcgtgccactggagcggaggcccgggcaatccaggcaggcggcaaagcgtttgccctggccgttcggcgattccggctgtctggagttggcgaacgggatgcccccgggttggaggcgaggatgcgctaccggatgttctgcgtggtttgcgcatccggcgcgcctcgcgcctgggactccctgcgtcgaggcccctgcgtgtccgcgtagcccgtcagctccacatacccgcgccccgtgaggggctggcccgcgcgcgtcccctccagccctaccgtgccttcccagtacagcacgctgacggggagctcctggtccgccaggcgcggtgtcacggtgaggtccaggcccagcgaatccacctgcatgcgccagcgtgacgggtactcaccgccactgtgtgggctcttccaggtgtccagcaccgtgagcttcatgtcgtcgcggccgacgtgcaccgcttcacccgtgccttcggggggcacccacaggccggtgctgaacgcgtccggcgagccgtcccggtgacggagctggtagtacatcagctcgctgccatcggagagctggagcgagaaccaatcccagcccacctgggtcgcgccgagcgcgctggtgctccactcgcggtccatccagctatggcccttcaccgcgtacgtgcgcccgtccacccgcaccgtgccgcgcgagggcatgcgcgtcatggagtagtagtaggacgcgttgccgcgctccgcgctcttctggctcaggccccggtcgccctggagcaccggtggtttgcccggctccaggagcagctccagtgtcaccgcgtccgtccgcgcgcgcagccgcatgggccaggtggacgggcccgcgctggccgcctcccagtcctccagccacaccttgaagggttgcgaggtggcgccggacagtcccagcgccacgcggctgaagcgctccgaggcgtggaatccgccgctggccacgtccgtcaccgcgaagtgccccatgtagacctggctggcgccccaggcggagtcacgcggcgcggcctcgggggccagcgcgttgcggaacagggtgaactggtagccgaaggcgcgcccgtcctccgtctccaggttgcctgtccagtaccaccactccgtgcggtactccggatgcgggccgtggtcctcggggaagtggaagtcccgaggttccttcgcgcgcgcgtagccctccgtgctgccgctcatggcgctggccacggtcagcgtgccgccctggcgcagcgcgggcagtggttgctcgcgggtgatggccaccaccgccgcagccagtcccaccaacaccaccaccgttcccacgacgagtccccggccgttgctcatgtgtcactcctcccgcagcgccagcgcgggatgggcgcgcgccatcttccaggcggggtagaggcccgccagcgccgccgccaccagcgccagcaccacggcctgcaccagcgtctggggtgtcagggccagttgaagcgtccagccgaaggaccgctggttgatgacgtgcaccagcacgtaggccagccccacgcccaatggcacggagaacagccccgccagcagtcccaacagtcctgtctgcagtgacaccagtccccagagctgctccggcgtcaggccggtggcgcgcagcacggcgaactcgcgcgcccgctccagttgcagcgccatcagtgcgctcagcacgcccacgaaggccacgccaatggcgagcagccgcagcacctgcgtaatcgtgaaggtgcggtcgaagacgtccagggacgcctgccgcagcgagcggttggcgcgcaccagtagcgcctgggtgtctccggcgcgctcgcgcaccgaggccaccagcgcgtccacgtcctggccgggcgccgcgtacagcgccacgccgctgatgccccggtcgtcgaaccagtgctcgtaggtggtgcgtggcatcagcagcgtgcccacgtcggagccgtagtcaaagtacacgcccccccacgcggaagtcgcgggggcccttgtccgtggccagtcgcacggagtcccccagctccacgccccggtggaagccgaagggctccgagacgagaatcgtgtcgggcgaggactccaactcacgccacgccgtcttcgcgtcaccctgcttgaaggtgtaggggcgcaccggcgtgcgcgagaagtcgacggccatcaggtccgtgggcacgccgtccacgcgcacgttcgccacgcgaagggtgctgctgcccgcgacgcccggcgtggcgcgcagcgtctccgccagaccggggagcagcgtcgcgcctccgcgccgcgccacgagcgagggcggcgagatgaacacgtccgcctggagcgaggtgtccagccacgacaccaccgtgccccggaagctggacaccatgaggcccacacccaccgtggtggccaccgccaccattagcgccgccagcgccacggacgtgcggctgaggctggtgtgcacacctcgcgcggccatgcgccccagcagaccaaaggccatgcccagcggtcgtgccgccagcgcggacaccgtctgtgtggcccagggcaccagcagcgccgcgcccagcagcaccgagaagaggccgccatacgcgggaagcagcgcctgggtgggccaccgcagcagcacggtgcccgcggccagcaccccgaggcccagcagcgccaaccggggcgcccgtccgcgcgatacgtcctccagcgtggacctgcgcatcgtcgtcactggcggcgaacgcgcggcctcccacgcaggcaccagcgcggccagcagcgtggcgcccagtcccagcgccagccccttgaacagggtgaagggctccagcgccagccgccgcacgctcaccacgaaatacaaatcattgagcgtctgggtgacgagctccaccagccctcgcgccagcaacacgcccaagagcaagcccgccacggtccccaccgcgcccagcacggccgcttcgcccagcaccagcgcgaagagctcgcgccgggtgatgcccaccgcgcgcaggcggcccagcagcccgcgccgctgcaccacggagaacgtcatggtgttgtagatgaggaacatccccaccacgagcgccagcagcgacagcgcggtgaggttggtgcggaaggcccgcgtcatctgctccaccgtgcccgcccgcgcggcggcgcgcaccaactccaggccttgcggcagcgtggccgccacggctcgttcctgcgcgtcgccgccggtcagccgcaggtccacgcgcgtcagccggccggtgtgccccagcagctcctgcgcggtggacacgtcggta

SEQ ID NO: 1101 - DNA, 13579 bp, Myxococcus xanthus
cggtgtcgaggaacgcccgtgcctccgcgcgcaacgtcacgacttacgaggacagcacgggcgtctctggcgcgaggtcccggtggtgcgggcctacaacgcctgacccagggcgcgcgtcacggcgcgagctgttcgaccgaaggcgcgtgcgaaatgcggatggctgggatgtccaagacatcatcctgcttcaggcgggtccccacgatgacctggtagggcggttcatcgagcacgggggcacgcccatagacgacgaagtacttgtcgttggcataggccacgttgccggacacgagctggcgagccgccgcgccccgggagatggcaaagccgtggcggtcacggacgtccccgttcagcttcacgcgggcgccacggacgcggccggtgtcggccgtcagcgcgctccaggtgacgagcacctggtggccctcggaggcgaccttgggcgtgatgtcgttcgtgctcgaggtggcgatggggatgccgctggggtccaggacgttcgccgtcccgtccttcactcgggcgccgtagatgtcgggggtgccattgcgtgcgtcgctccaggcgacgaagaagccctgcttcgtcgccgtcaccgccgagaagttctgattgcccggcgcagcggagatgacgaagccgtccgggtcgagcaccgcgcccgtgcgccggattctcgcggcgaagatgtcctggccgccgaagcgagagtccgtccatgtcgccaggtaccggtcatgggaccaggccaccgcgacgccataggagttgatggcggacagttggttggagatgaagacctcctggacgtcgaagcccggcttcgccgtgttcagggtgatgccgcggaccgcgccagtggcggttccgccgaagccaatccacgccaccaggcacttgcgctcgtggcaggcgatgcccggggagcccgcgggctggtggtcggtgggggtaaagagcgtgaccggcgggccgtccaatgtcccgttccggttgacacgcgtcaggaagatggaggtgtctccggtccagacgacgaggaactgccggccatcgaacgcggtcgcatggtagtaggcgtcgggtcgaagcccggggttgagggggatggcatccgggtccagcagccggccattcttcgagacgcgcgcggcgtagaagcggccggggcggccgtcggaccaggccacgaagaactggtttccgtcctcggccacctgggcatccgtcgcgaaggtcggtgtcgcccagttcgggtagggcccctggctccccggaccatgaagcccggcctcgacgtcctctctcgaaggggagttgccttcgagcacctccgcttcaccgccacacgccagagagagtagtcccccgaggagcaaagcgctccagccacgagtttgctttgacggtccacgcatgattcgccccttgcaacatcagtccggcggcagggtccacggcgggggccggtggtcgcaacgcggtattcctgccgaagcgagcgaatggacagacgccgggcgcatccaggcgtgcttcgtcgcgccttgaacgaacgcctgaacccgtggcctatgtcaggacggcagcttgtcccccacgagcccgcggataccctggagcttgtcggggttgcgagtgacgtagattgtggcgactcggccatcttcgatgtccagggccgtcgtctggagcgtgccgtccttctccagggtgacgaaggcgggcagtccgtcgatgaatccctcgtgcacaagctgcgaggcgttcacgcccgtgatgcgcagcaagccctcgaagaagcgcaccgtcttctcctgaccgtagatggggttgagggccgccttcaccttgccgccaccatcagagtacacgacgacgtcctgggccaggagcgcctggagcgcgcccatgtccccgctccgggacgcggcgtagaaggccgaggccagctcactgccttgtgcttccgacacgggaaatcgcggccgagcctcgcgcacgtgggcccgtgcgcggctggcgagctggcggcacgcggcaggggcccgacccatggccttcgccacctcctcgaagtccatgccgaacacgtcgtgcaggaggaaggcggctcgctccagaggggacagccgctccagggccatcatcaggggcagggtcaagtcatcaccctccaccgcatcgacgatgggctccggaagccaggtgcccacgtattcctcgcggcgtacgcgggcggacttcaggacgtccagacacaaccgtgtcaccgtgcggacaagcacggcttcggcgtcgcgcacggcggcgcggtcggtctggtgccagcgcaagtacgcctcctgcaccacgtcctctgcctccgcgacgatgcccagcatccggtaggcgatgcggagcaagcgggggcgcagcgggtcgaaggcgtcagcgggattcacgtcaggcggcctcggtgcggggagtggtgacggggtgaatggagcggaaccccacggagatgcggttccaggtgttgatcatcccgatgagcagtgtgagatgcacgatttcctgctccgagaagtgcggcgcgagggcagcgtagtcctcatcggacgcgtgcgtctgggagacgtgcgtcagggcctccgtccaggccagggccgcccgttcgcgctcggtgtacaggggcgactcgcgccaaccgtccagcaggtagatgcgctcctcggtctccccatgcgcgcgggcgtcccggctgtgcatgtggatgcagaacgcgcagccgttgagctgcgatgctcggatcttcaccagctcctggaggctcttctccaggcccagctccagcagcttctggccgtaatcgagcgtcaacttcatcgcatcgggggcgacggcgaacgcgttcatccggggcttcatgggcggctcctgagtgtcgtgcagggcgaaagtgcctgcgttcaacttcaggacgacgcagccggtgccgcatgtgacatggccttttccggccgatttattcgccccaccgctccacgggcgacgaatcagtcgagccccgtcttgctgcgccccagttatccggggctcgtgaagttgcgtgaagccgtccccgcggtgcgaaagctcacgccggctggaggaagcgtccgtccaccaggtggtcgatgacctctcgcgcggaatgcgggtcgagccgtgccttcgcgccgagcttcgacacggcgctggagaccgtcgtggggtgctcgaaggcggccagggcggccaggaggatggcgccgtcctcgccctgcgtgagcgtggggtcggagaaccgtttcgggctgactgaaggggcgcagctcatcgtgatgccatccacggagcggaggaccgtcaccgcctcacccgcgagcttcgcgggggcgcggtggctgcccagccactctcccagggtgaagcgctgggtccagggagcggtgttgcgcagccgcgtcctgccctggatggcgacgctcttgcgcgtgtggcggtgcttccaggccagcgcgtccacccggtcggaggtgtgctggaccgccgcctccaggcccgcgtcgcggaatcgaatcatcggcacggacacgtcaccgggctcgcggcgctcgaagtagtcgaggaactccgcgaacgtcttcgcctctgtcaccatgtcgaagcgcgcggggtgctgcgtcaccagcgccccgggctgcgcttcgagccgctggtagcccaccacgcagtccaggctgatgatgcgctccacgagccgcaattcctccgccagggtggccttgctcgcgaagggcaggcctccgatgccggagatttcgatgtccaggttggggtacttgcggcaggcgtcgatgacttccagcagctcgcggtccttcgcgcagggcttgagcaggccccggcccatctgctccagccgctgctgttcggagaagcaaccgatgtcgatgaccatgtagacgcgctggaacgtcgcggccagcgccgccaccagctccacccggggcacgccccacaggaagtacgtgcagcagtggcgggagaggtccacgcccgcccaggtgctgctcaggaaaccggcggtgctgcccgcgaagtcgtagcgcatctgccacgtccgcccggcgatctcctggtggtcgcggcgcacgttctcctcggcgcgcaggaagggcttcgcgcgcccgaagtccgctttctggttgcctcgtgccccgccgcaatacaggcagttctcaccgcaccccttgccgggcgcgacccagccggagaacgagtgctggtccatctggctgaggaagatgtcgttgaagtgcgagtagtagatgtcgtccgtgttcgtggcgcgctgcacgtactccagcggcagccggcgcggacggccgtccggactcctcgtcacgacgttgggcggcgcctcctcgccattgcacagggccagcagtggcacctcgccgtcgcccagcacgatgtggtcgatgctgtcgtagccgctcagctccttccaccagtacgacgcggagttgcctcccacgacgatgcggatggaggggtcgagccgccgcaccgtcctcgcgatgagcagcgcgcggtccacgtggtggaaccacttgaggctgatgcccacgagcttcgggcgtacgcggcgcagaaggctctcgaaggtgcgtgtcacctcggcttcggtctcatccccgtcgtacagccgcacgaaggcctcgatgccgccgcgccgcaggtaacccgccaggtacaggatgccgcacgtggcctcccccgttcccgcaccgacgaggaggactggagagaggacacgaccacccatgcgacggacaccggcctttcaggagacggcgggcagcgtaggcgaaacaggccaggctcgggcgaaatggtggggcccgtccgcctggctgcccgtccccagcccgaaaaggcggagccctccgcgccgagtcatggcggccttccgttcgccattcacttcggcgacgcaccgttgctcgcgcgaagcctcgcgagggttcgctcgagcacttttcgctggagatggtcctggggaatgcctggcgtccggtccatctcgctcaaggcctcggtcagcagtcgctccgcgtgtgcccgctcgccatgtgccatgaggatgcgcgcatggcccgcgagcacggtgcctcgggagactcccttggccagggccagggcccgcttgctcgccgtcagcgcttcatccttcctcccggccatcaggtacagcgtcgcgagccgggctggcgggttgtagtccccgggcagctcccgctcgctgcgctccaagaggggaatggcggcgtccggctggtccaacagcgcggtggccatcacccgatgcgaatcgagcgccgcgcgctcctcggccccattcgcgtgagtggcctggagctggaggaacgcccaccaggttcgcgcctggtcgcgcagccccgcttcgtccccggacgcctcacgggcctcgcaagccagctcgtagagcgacgagcgttgcagcggagtcagctcggtctcgggagcacccagggcccggtttgcctcgtcggcgaactggcctcgcaccgctcgcgcctcatcggtgttagtgtccagcgcgcagcccatgcccacgtacagcagccgcgtgcgatcgtccacgcgcgagagcttcggcagctcgctcgcggccacccgcatgcagtccgcggaggcgcccgtggcggccagcgacttgctccaggacacgagggcgcccgcgcggcgcgcgtcctcgggggccaactgctccagggcccgctgataggccaccgcggcttcgccgtgctgaccggagagggcgagcgcatccgcccggaccagcgcctccgtgcccaggcggccttgctggaaggtccgctcggattgctcgagcaagcccaggaattgggggagggacaccgcgcccaacgagcgcgcgaggacggcgccgtgttccggctccaggacgaagaaggtgggccacgtgtccaccgggtatcgctggaggaaggccatgctggtgtcggcgtccgtgtccaccgcgagccagacgaagcggtccgcccacgcatccagggcgggggacgtcagcaccgtggcgcgcatggaccggcacgattggcaccagggggcccaggcctccacgaggacgggccgccggccctcccgccccgcccggagcgctccctcccagtcattctccaggaagacgggccctgccttcgcgggaagggggcgctgcgggatggcgggaggcgtcgcgcacccccagagcagcagcagagcgccgacggcgagtctcatcgtcatggattctccggggttgagggctcgacgcgggcccctgacaccccgggagcgggtgcggttccggaatgcggacggattggacgaagaggggctgtgttgaaaggggagggctggagcggcatctccgcgcaccccgaggaccgagtcgctcggggtgcgtggagcatgccgtggccggcggtgacttcagcgcggcgtgaccttgagcagctttccgttggtggcgtcggtgagcaggtagagggctccgtcggggccctgcaccacctcgcggatgcgcacgcccaggtccttgaggagatgctcctcgcccaccacgcggtcattccgcatcatgagccgcaccagcgcctggctggacaggcctccgatgaagatgttgttccgccactcggggaacagggtccccgagtagatggtcatccccgagggagaaatgaccgggtcccagtagtacacgggctgctccatgcctgggccacgagggctctcgtggatgggcgcgccggagtactcctcgccatacccaatggtgggccagccgtaatccttgccggcctcggggcggttgagctcgtcacccccgcgcggtcccatttcgaccgtccacagccggttctggctgtcgagcgccgccgacaggacgttgcggtggcccaccgaccagatttccggcttcgccccctcggtgttcacgtaggggttgtcctggggcacggagccgtcgggattgatgcggaccaccttgccgaagtggctgttcagttcctgcgcctgcacccggcccgcgaggatggagcgctccccgagcgtgacgaacagcttgccgtcgggggtgaataccagccgtccccccgagtgcagcgtcgactcgagcgtgggcatcatgcggaagatgacctggacgtcctccacgcgaggctgcgcaccgtccacgagtttcgcacgcgccaccgcgagcccgttgccgccctggcgtggctcggaataggtccagtagatgagctggctctgcgcgtagtcggggccgacctccacgtcgagcaggcccccctgtccacggccatccacgttgggcagccccacgacggcgggagacttcgcgccctgcggcgtgacgatgtagagcgagccggtgggcttctctgtcaccagcatgcgctggtcgggcaggaaggcgatggcccagggattcctgaagcccgaggcaatctcggtgacctcgatgggcgtctgcgtctggatggctgggacgcgtgtctgtccggggaaggccggatcgaactcgggcacgttgggcgggccctgcgggaccggggggccggtgggaagcggatcttctggcggaacgcccgcgtcatctggagggacgcccgcgtcatctggcggaacgcccgagtcttccggcgggacgcccgagtccagctgcgggacgcccgagtcttggggcgttggcgtggggtctggggtctggctgcagccagataggagggcggcgacgatgaggggcattgatagggttcgcatgcgactctctcctgggggatagaacggaattgaacatcgcgtgcctcgagtcgagtggaaagtccgcgcttcaaccggcggccggaccgtgccggacatcggacagaggctcgcctctcgggtggcacgcagcacgccatcgccaatcgctgtgcagcgaggcaccaattgtatggagtggccgtagtagaatgcacggcgctcaacggctcaccccgagtttcggcccccctgttggggcttcttcgggctccctgagtttgttcccagctcgccagacggtgcgagaccaggggccgctctgctttcggccccctgcagcatgggtcctggcgagaagagcgggctacggttccacgccagggcggcctgaagactttggcgacgtggcccggcccggcaggacggcgcggagccgcgcatcgcgcagccagagccccagccagagcagcgtcgcgatgtagacggggaagagcatgtgggagaagagcggattgccgacccggacgtgggtggcgaccgcgcctccgagatagcccgtccacaggatggcccccagcaccgagagccggggagtgaggtacaccgccaggcacgccagttgaacgattcccaagccgaagagcacgctcacggggtagccgagctccaccgcgccctgctgggcctcgggaatctggagcaatttcccagtggcatcgaacagcaagaagaggacggcgatgccgctcaggacgcgtcctgtccacagggccttcttcgaggaggactgcgtgcccgactgcaggcgagtggctggggcggcgtgctggagttcggtgtgggtcgtcgtggtcatggggtcctccgtgaagcggttttgagggttggaccgccatggccaccgaaaatcatcggtcggtcggaaaaaagatcgcgggccctccgcgcctgactgaccgccgctcggtttggcgggcagggtgcgcgccatcatccatcgctgtgcagtgaggcacccagcgggtgcaggcgcgaacgtcatgcgcagccgtcaacccgacgaatccggcggtgtggtttccgccggacgtggcgtcgccaatggacgtctcgcgtgaggttgaagctcgtcacgacgcggcactcctacccatcaatagacaatctcaagccgggggtgatgctcccctcgtaccagccgtcattggggacgaaggtcgtgtagacgtttccgtcgccccaatgtccgacgccagtgtaggcggttgcggagatgatcaccgagcgcactcgtctattcgggggcaggaggctcaagtcgaagcgcaggtagcatgctctggaaatcatagcgcacgctgtcagtcgtcgtgagatgcgggcctcaccacgtggatggttttccaccccctgacccgcagtgtccagacgcgggggggaggtctcatacgacttggtcacttcaagaatgcatggctcgcaccgtggagatgagcctgctggaggcgctgggtgaaccgcagcccgagcccttgaagccgcgcgacttcatcctcccctgaccggcccgcgtcacgcttccatcacgccgtctccgtagggtggctttcgcagcccccaccccatccttggagaagattcgtgcgcgttctctcttccatggcagcgattcctcgcgtgctcgccatgatgttctgcctctttggcgcccaggccctggcgagctacgccacggtgctggacggcactgtgctcctcagcgctgacaacaccagccgctacctggtggcgggcggcgcgaggttcttcatcccctccacgcagtggagcctgtattccagcgccaacctggtggtgatgtcccagtcctccattgatgccatcacccagattccccgggacggcacgctggctcgcgagaaggggcagatcgccatctacgtcttcgtgggaggcatgccctggtggattcccaaccccacggagctggacttctgggatgactggaagaccatcaacgaaatcccgagctactgggaggcgcccttccaggactacagcatccagcaggtgctgttgcgcgagcgcacggggacccaaatctacatctggaccacggggctgaagattcccatcaccaacgcgtcggacctcgcctactacggtggtgagtccaacgtgaagacggttccgctgggcacactggccaaccacagcgacagcgagccgtactgcggagcgattctgcgcgagcgttcgagcagcacctcgtattacctcgggtattccgccggcctcatgaggaggtacgccaccacgtcagcccctcacgccgtggttccggatggcgcgctctcctccttcccggtgaccacaagcgggccgtactgcatccagtaacacgatgcttccgcaaggagggggctcttgcgccctccttgcctgcaggtgatgtgtctcgccgtctacttcacctggagcacggacagcacgttgcccgaagggcccttgaaccaggcgatgggcggccccatgtcgcggcgtggggcggtttcgacagccgcatgcggacgagggtcgtgtccaacctcatcatgggcgcgtgcaccgtggccctcggcgtggtgccccacttgggggtgtacctggcggccatggggatcttcggcgtggcactgccgctctacaacacgcccgccacggtgatgctccaggagcgcgtggagccggcttacctgggccgagtcttcagcgtgatgaccatgctctccaccgcgctgatgccgctatccatgctgctcttcggccccctggcagaagcggtctccatcgagccgctcctgcagatcaccggcgtgttggtgatcttcctcgggctgctcgcgccgctccaccgccggctgatgtccttcggcgagcccaagcgtcccccagtcgagtcccaggacctggccagttgagggcctgattcatggctcggagaaagagaccagtcgggccccgtttccgcgaccagacacgcgggccctcactgacgaggtgcccgcgtgcccggggtccggtgcggttcgctacggcgcgcagtagatggcgcgttcgaacttgcccgtcacttcgacgatggagtcagcgcgaaccacgtactcactggcacccacacgcgtgtcggcgttgcaccaatcatacgtgtagcccaacccggtccaggggtagtgcgtgctctgccagaacccatagctgtaggcgtagtaggcgttgatccaattcctgtgctcggaggtggcggaggcagggaactgaagaccgcacgaggcgtcgtcaatctccgcgtccgggcagggccggaacaggttctcgggccggacccatagctcgacgacgtagcgagcgttgtcgttctccgtgggcgggggcaatcccaggtactggttgaggcgacccacgagcttctcttcgggaaccgtcttgcagaacgtctggagctgaggcgcgggtgtgacccagacctcacgggagagcgtgttctcgcccagcgtgtagccagcgaacgtggtccagatggccatgcgcacggccgtccgggactcgttccagatgagccgcggattcgacgggctgatggcccacagctccgtggaaatgtccgccaccgtgggttcggccgcgttgcggacggcctccgcataggtctgtgaatcgcaggcgagttcctcgggaggacccggaagcgggtcctgcgtatcttcaccgcagccagtgagggccaggagcgcggtggttgcagtgaacgttcgcagggtgcgcgagaaggcgctgaacatcgtgacatctccgtgaaagaatggattcgcggcgagtgtagacgaatcatgaagggacgagagccttgtctatccgtgaatcgcacagcgcctgagcccggctcccaggtaggctcgctctcaaggagaaccgcatgtcgaagcagcacgagccccatcccatgaacgtgcctggcgacttctatgtcgtggaccagtgctgcgccgcatgcggcgtccccacacacattgcgccagagacgttcgcgttcgcgaccgaacgacttggcggcgactgctacgtccagagacagcccaccacccccgaagaggtcgaccgcgcgctcatggtcgttcgctgccaggagttcggatgcgttcggtaccgggggacccaccccgtcatcctgcgccgactcactgaagcgggggaaggcgaccagtgcgatgcgcctctgcccgcagggatccgccctgtcttgcggaaccacgtctccgtcgaagcacagcgtctcgatactcgcgcttgggagtcagcggctgtgcttgagcgcttccgtctttggctgacgggccaacaacccaactatcgaaccactcacatcgagaggcgcgcctccagcgcctccttttcgttctcctggaccgagaatgggttccacgaagtgacggccaaccccatcggcgacgtaccaggccggtggctcctccgacatgcaggaaatatcacggtgtccgagatcatcgcggagtggctgaagggcgcaggggaactgggcgcggtgcagtggtactcgcaggaggagtgggaacgtggccttccgggccaggcccgcccctggtaaggcgacgcacagcccgcgggcgccagctccccggcgcaccccggtcagcagcgcggtgcgacctccacaaaaggataggacggataggagccctgttgagggcggcaggctggtgaagaggggccaagaagggccgctggagggtgacacgcgggctgtgcgccgcccctcggggcacatgccggcccaagcggcccatccaaatggtgaacctgccccctgtggactgtattacattgtcacgactcgattggaaaacctgtccttaccatggatgccaatcgccgggtttcgggcgttgctgattatgatccgtttggacatgtcaatcgtaccaccctcgtcgcagacacgccgctcggggttgcaccgcagcagactgcattgatggcaaccctgcaggttccgacctctgcggcaaccggtcgtctccgcagtcaatcgctaccggacgggacggcgtaaatccctgttggaccgcagggcggccaatggcgaggcgaaggtggatgagcgcttcctcgccattctctcgcgcgtgctggcgggtactcccgaagaggtgggctggtgccacccgacgtggacgcgggagttgctcgcgctggagatggagcgccggggcctggcgcgggtgtcggttgccaccatgggccgtgcgcttgccacctccagaagctcatgaggcgcgtccatgcctacctgcacgctcgcaacgcccagcggcgcgccagtcctatcctccgcaaggtccatctgcggcgcgccgcctgagcgcgtgcgagattcatgagcgggcgtttaggatgctgcgccatgggaatcttcgtcatcgggtctttctttctggcgctccttggcgggggcgtgctcggggccgtgtcactcctcatccacctgttcgcggtgcgaaaggggcgcggctcgtggaagcggttcctgctgatttccggagccgccacggtgttggtgggcgtatcagcctattggtggatgttcagctcccccgaagcgtcgggcgcaccgacaggggacgactacgcgcgggccatctgggggctttagagaacg

SEQ ID NO: 1102 - DNA, 13818 bp, Myxococcus xanthus
cgttgcctgtttccgccgcagcgctctcagagatcgacagtgttcgaccaaggccatcatatgtcgtactcatcgtccgctgcagcacacctccagcctcccgacgtacctccgtgacattacctctcccgtcatagcttcgacgttccacccggccgagcgggtcagtcaggacaacggctcgtccaagcaaatcatacgcagtggtgctcgcgtgcccgctcccatccacctcgcgcaccttccgcccgaccaaatcgtacctagactcctgaatgtaacgcagcggctgggcagtatcggacgctcccggcacctcagggctatgctcttccacgactcggtaaaacgagtccaatcgatatgtccgatcaaacccagacaaatccgcatgccagaccttattaccagcatcgtcatacctggtcgtcgagaggacgtagctcctccctacttcatcgggacttcccccctgtgaaatgaagcgggggccgtccgccacagacaccttcacctccacgggccgatccgcgaaatcgtaggctgtggtggtaagtacgccgcggcggtcaatgaccgtcgtgcgattacccgcctcgtcatagccgtaacgggtctccaatggagcagcgagcccgcctcctgactctacgatgcgcgccaatcgtccagctgcgtccagataatagtctcggacgaaatccactccctgctcttcacgcttgagttgcccgcccgcgtaatactgcactgtccgcgacaccccgggctccccaaagttccactggtcctcctgcgtcagccgatctagcgcatcccattgcagagtccgatgccggccaagaccatcttgctcaacttccagtcgcccccgtgcatcaaaggtggactgtaccgtgattacagacgtgtcacttacctgcagtgtcttcgagcgcaactgcccatacatgtcatattccgtcacctgctcctcgtgaccgtccgcgccgacagtcgcggccaaatctcccggcagagcattcggcgggcaatcggcgccctcaataccgcagtaacgccaactcaacacaacgtcttgcggcgacgtcgccaaggatgccaccacctcgtcgcaaggcgcagtcgaagtcagcgccggacgagacacccggttcgcgtagcggcgcgtctcaagcactcgccctgtccccacaggaaccacctgttcaggagaatcccctatcgaatcgattcttgagacagttgcaaaaccttccgcgtccacatgacatacttgaacgttaaagcccgggtcgtacccccatttctccactatttcttcgacgggcagaccttgggcgtccaaaacctggagcgtaggggcgacaagcccagaacccggcagcgccgtgcccccaatacgacgttcagtcaaatttccaaattcatcatagacaaaattcgtcacccgcccgcgctcatctgcttccgtttcacgagcacggtgagttgcgttccatagcgcactagacgtcgcaaagacaccagtggtcaacggccgcaccgtctccactacagcccctgtcgcattcatccggtagcttgacgcaggcacccctggccgaggtccatggactgtcgtggtgtagactgtcagagcttccccgagaatcgtgcgcggctctggtgcgatactatacgcgaacgtggtgatcccctctcgaacaggcaacgtttcgagaacctcgatcacctctttcactctctcgtctttattcatcagcagcaggtattgatcctcgcccgccaacacatccgtgctgctgtaatacgtatatcgggttacctcgccgttgggccccgtgtaccgcgacatccgtgtccgcccagcttcggaggcgccctcttcataggcaaaggactcagtccgaacgagatttccctcgtcgtagcgagatacggacaccaagcgaccttgctcatcatagtcgtagctgaccacagcctccaggaaggtctcttctgcagcatctggggtccttgaatgatgcaactccacggcgacaagttgctgtcgccctccgtggagcccatatccgaaccagagagaccgtccgctcgccagatcgaacacccgcgacagcgtattctcttcagcgatattattatagctcagcatcagcgaatgcccagtcggagcaaccaccgacgtaagtcgatatttcaaagggaagctgaatgtgtccaacagaccgtagcgatactccaccccgctcttcgccctgaaaacatacgctcgttcagttccggtgccctccgcacggaacgttccgtgatatcccggctgcggaacgcagcccgtgccgtcaccggtgcatttgaacacctgtccgcccccctcaccactggtgacgagaaaacggaagtctccaagaggccgaacgaccccattatacgcatgcgtccatcccaatcccaacacaccgttttctgattcaccactggcgtacgtacgcgaccatgtcagccccaaacctcgacttggagactctagatccacggcctgcttcaccaaatgaccatccaccaagctgacccccttgatgaacgtatggcccacagacagcctcccttccgacatgacggaggtcttgagcggcacttcccgagtcactgtctgagcattggcattcgcaggagtaaatgagataccaatagtttcaacccccgcagcccccggtgacaggtccaccaccgcgtagccattccactccaccacgataggcaatccgctaatcggggtgacctgtgtgacggcactagtagcattaacctgcacagcggctctggagatctcatctccgccgcgcaacacgcgcagtattccatcagaattaacaagcacgacaagctgggcagaataagccacaggcacctgggcatcctcaggcggcggctgtcctggaacaggatttcgcgcagaaacaaaatcccacgctggcaacacccagcgtgcgaccagcgggaggcccctcaacacgagctctggttcttgagcagtgacttcgaactctcttacagcctgaagaaccttcgtgacggaagtcgggccatgatctttcgcgtacagctcgaaccgcacacccccgccccgagtagaggaatttaggctcaacaggtgactaacgccggcggttgattgaatttccgcatcaccgtcggagtcaagaggcagttgctcgaagcctgttacaatggcgtcgccaggttcgttcggctgaactatcattcgaacgtagagtttatccgaactgctattggctaccgtgaatcccaccgcttgatcggacgcatccgcatccccctcagaggatacgactctgccgtccggaagcctccttataaggcgtaaggaaggaacgacagaacgactggggttatacattccccggtgacaggaaacaggattaacacgtccctccacataaacgcggcaactcaaaaggtaattctgatacggctggggattccccgccgaaggcgccaccaaggcctttacgcgatgaacaacagacatcgcatcatcaaggggctcaactcctatcagaacaggctcttccacataagaatccagaagatttgaactactcccacctggtccgtaaccggcatacgtatcaatcttgacctcagcggccagcaacccctgctcattgccattcagcggagtccagccagtggcgccttgcggccagcgtagaatctgaatcttcgaaacccgtgaagagtgcagcccatagacagtggcatacggctcataagacggagcacgcagaacataggtattcctagacgcggttgcactcacgtcaaagtcttgaatcagactccccaaggcagctgtaacacgataggtgcctgatgtcggcccgggaatatagtccacagcctgatacccagaggttcgagaccagccagttattgtcatcaactggagcggatttgagtagtcgagaacctggggagtgtcgaccatgctagacgcaaagaaccgtcctgtcggatccaactgcgtccaaaccacaggctcatttgccaggttatttccatactgatctacaacccgaacattcagactccccatcatctgcaagccaggttcggtcggcgtattatcaaaatttggaagaaggttcgcaggaacatccggcaatccaaccagtgcaaatggctgaatcagcccaaacacctgagttccgtttgatgtctccgctgccactagattgtagcccaggtactgggcagcgtaagtgcccatcctttgaatacgtgacctctcgatattcgcatcgggaaccacccgcaccgacgcgtgcccgtgctcatctgtaattgcctgcaactcactctgtccccccccaggtccaggatgtggcagaaacatcaaatgagcatcccccgctcgcttgaacgttacagtcgccccgacaacgggttcaccagagaaagttgacactcgcactgtcaccggcaaagcgagcggctgaccgaccacgccttcctgcaggtcagttgccacgactttttcgatacgagcaacttgcgtcacatcgtctaccgcgaatcccgcatcccagctcgaaaccttcgactgcagccgagcgatgccctcatgcggtgactccccccaagccagttgccatgcccgtgtgtagctaccgccagaaagcgactcgatcgccttcaattgaagcgcgagggcttccaagatttcgtctttgtatgcttgggatgcgccccccatgaaagcgcctgcgttcacctgctccacgacattccgaagagcagaatgagcgcgctccagtgctagcgcctctggcacctcagcccatggcatatggagaaaatgctgccaccaagcaggacgggctccaagagtagcataagcttgcgccaggctctcaaccaattgaacctgatccgcatcccgttttgactcccactcggcgcgcgctgcctcaaaggccgctgtccagtcctcagccagagtttcttctgacgaaggaggttggcggcacatcgagtcaaccgacagccccccttcgagctgctgctcgggcagccatttccaaacacccccatccgcacgtgccaccagcgacgctaacagcgctagcagcaacatccccgtctgacctgaccgcatcgcactccccaaggctcgcattgacatctccccttgcagagttcactacctgcccactccgacaagtgtcaattccagcgccatcatggtttcgtcacggtgcccgagcccgacctgggtcagtgccgcatcaacccaaggcgttctttccgcacagtcagaactccaaccgttgtagagcctgaccagtgcagcgcgcagacgcgaggcaacacagacagtacgccaggagccaataccagtgtgagtcctgcgcccccacctgggtccctaagaaacccacttgaagccttgcaggccacccgaatgagagcggcccatgccgaacacccgcgcgctataccgctcagtcggcctcaaggaggcggagctcttcctcgtcagtggatgctcggcgttcctcgccccgactgcccgaccagcccatcttctacccggtgatgaacgccgagtacgcacggcaaattgccgggactggaacacgccggacgcgggctctgggcacgcgggcttcgtcacggccttcgacgtgggggcggactacgcctcacgcttccccgtgcggaccgtgggcaacagtcgccaccaagagctgtgggttcccgccgaggagctggccaccttcaatcagcacatccaaggccccgtgcgcttcacggaggcctggtacggccccggctacctcggtccggacaccacgctcggtcctcttgaacgccagctcctggccctgttcgagcagcgcagcgacgccctgccattgattcaggccaacaccgccgcctgtctcttcaactctgcctggtggtccaccgccccggcggcagcccaggggctgaacccatccgaccatcttcggctgctcgaccgcctccaccaaacctgggtaaccctgcaccccacatggcccctcccggccccgggtgggaatcgtcaaaccgacccacaatgaaaatgcgcgccattcgttataggcgcgacccattttgcgaccccgttccgtatcccattttgaagggatgacggacggccgggcattgggctcgagccggctcgcgacgagggacggagttaccgtgctgcctggaaacgaccggtccgtcttggaggctttccgccgaggggagacgtccgtcctcacgcaggtgtaccgagcctattcgccggaggtgctccgctacctctcgcgaaagttcgcggtgggcacggatggggggacgcggagcgccgcgttgtccgcgctggatttggacgccgcccatcaagagacgttcgtccgggccttccggcccaacatgcggcaggcctatgacggggttcgcccctacctgggcttcctcctcacggtggcgcgctcgacagccatcgacctgatgcgcgcgtcggggcgcgtgtcccgcgaggccgtccccatggacgacgcgcccgagctgccccacttgcccaccgagggccggacgccggaagaagaggccctcagcaccgaagtgcgcgacctggtccgcgccttcctcgacacactcacggacgaaggccgcgccctggcgcaactgcgtttcgtggaaggactttcgcaggaatccgccgcccagcagctccagctcacccgaggcgaagtccgggtgcgcgagcggcggatgcggacgcagttcaccgagcatttgaaggactcgggctggctggacgcatcggccgagcccgggcggatggagctgggagtcctcctggcctcgctcgccctgtgcgcaatagggagcatgccctcatgaggtggtacgagagacatatcgacgccagcctgacccggtggtcgctgggagacctgtcctcccaccagtccgctcgcctgctgcgccacgcccacgcctgcgggcactgctgcgcccgatgcgagcgctgggcccaggcccaccgcgccctggagggcaatgacatccacgccccctcctccgtggagctccaagcattgtcagacggaggcctagaggccgccctcgccgcggccgcaccggaacaggctccgtcccggtggccctccctggccctgctcggcggcgcgctggccgctgtcttcctcgcggtggtgctcatccccaccgccacgacgacgcccggcgagttcgtcgcccgcggcgaaggcaccgcgccgcccggcgtcgccctgcgaatcttctgcgccaccccgggccaggccctgcgtgagctgcacgccggagatgcctgccgcgccggtgccatgctggccttcgccgccggtggccatgcgcctttcacccacgtcgcggtccaggtccgcggcgccaagaaagcggaggtgacggccggtcccttcgccctgtccggaggcttgggcaaggaagcccccctcgagctgactgtgcccatgcctgaaacggcaggcaccgtcgaagtcgtcgccgtcttcgcaggcagcccagccgagtccctggcgaccctgcgcggtgaacagacaaagggcacggtggtgctcaagcagtcagtgagggtagaggaagctccatgaaaaaactgggagtgctcctcggcgccgcggcactgctgctggcccgaggtgcctcggccgaagccgtggttcgccgcgccctggtcattgcccataacgggagcgacgacccgtcgctcccgtcgttgcgtttcgcggacgatgacggcgtgctgtgggcggagacgcttcaacgcctgggcgtggagacaacgctgctggtggacccggacgaggcgacacgcgccacggcccggccggtgctcgcgggcgcacggcccccaaccccagacgaggtgaagcgagaggtcgcccgcctccgcgctgccaacctggtggaccacgaattgggacgccagacagacgtgctgctcgtctacgtgggccacggaaacacagacgaggccggacgcgcgtacttcaccctcgcgggtggacgtctggataaagcaagcctttacgcggacgtcgtggatccgctcggcgccagctatgtccacctcatcgtggacgcgtgccgcgcgtctggcgtcgtgggcagccgcggcggtcagacggacgcggcggtgctcgcggagctgcgcggcatgctggcccgtgagcagctcgccacccggcccaccgtgggcgccgtgttcgcggagagcgacgacggcgagacgcacgagtggtctcgcatccgcgcgggtgtcttcagccacgtggcccgctccggcctcatgggcgccgcggacatcaacggcgacggcaaggtggagtacagcgagctgggcgccttcgtcaccgcgtcgctccagggcgtgaagggcctccccgcgcgcctgtcgctccacgccttcgcccccacccgcgagccacggcgtccgctggtaggccccgcaccgaagggtcccagccttccgctgcccgcagggctcgagcactcgcgcatctccgtcgaggattcagacggacggcggttggccgacgtgcgccgttcgaaagaacagtacgtgctgctgcgcctgcccgaacgcgacgtgtattggattcgcacgcccacgcaggaagcccgcatcaccctggccaagctgtccaccaacggcatcatcgacatgggcgaccgggagctccaggagcgaggccccgccgaggaggccctgcgcaagggcttgttcgcggtgccgctcgacaaggatttctacgagcgctacgtggcggtcaccgggctcgcgcccgtgggcgtatcccaggcgtttcctccgagcgcgggcggcaccttcccgcggttcatggcgcagcggcccgacacaatggggggttgggacctgggttggacggggcagcaggcaccgctcggattgagcacgctggccaccggccccacggtgacgtggcggcgcgaggcgcccctgccgtcgctctactacggcgcgcgcgcctcctatggcctgacgcccctggccaccgacgacatccgcacccaccggggtgcgctcctgggcctcctgggcgcacaggcaccggcacacctgcgcgtgccgctgttcctggaggcgggagcgggctggggctttctgggaatcactcgcggacaggtgcgcatgggcgaccccaccgtgctctccacatacaccgccgcgggggtgacgggagcgctggcgggtgtgcggctgcgtctggcggccacgctcacttatgaccgcgtcaccctggaccagcgcaattactgggaccgcgcgttcggcttcgagctggcgctgcgacgctgagagaattgctcatgaaacgcatgtggatggtgatgctcgtgctcgtcacggggtgtgacggcatcgacttggaccggctcgtccggcagcacccgccgctcacccggctggagcccgagcccgcgggtgccaactgcgcccagggtggtcatttcgtccgcacgggcctggacctgaacgacaacggcgtgctcgacgacggcgaagtgaccgtcacccagtacgcgtgtgtcaccgccatccccggcgtgctgatgcgcgtgcaggacgagccccccggtgagaactgcaccgagggcggcagggtgtaccgcgcgggccaggactcgaatcgcaatgacgagttggaggacagcgaggtcactcgcgaggtctacggctgcgccagctcggaggccgtggtcacccgcgtgcgggcccgggagccgttcgtcttcccctgcggtaagcatggcgccgtggtcgaggccgggcaggaccaggacggcaacggcgtgctcgacgactcggaggtccgggcgacgtccaacctctgcgtactcccctccgaggtccgggtgcgccagtcaccggctccggctggcgccgcgtgccccacgcccagcacccaggtggacgtgggcaccgacgcggacgcggacggcctgttcgaggacgaagaggtgatgtcatccatgttcgtgtgccagcccctgcacacgctggatggcacttaccgcgtgcgcaacgcggtggacctcgtggcgctggagggcatctcccgcgtccgcggcagcctctacttcgactccgggtccgtcacggaggcccgcctccccgacttgatgatggtcgaaggcgcgctggagatcatcgacacgtcgctcgaacgcgtggagatgccctcgctgcgcctcgtggccggcccgctcaccgtagccagaaaccccgtgttgaccacgctgaccctgggcagcggcagccgcgctccactccgggtctggggagacttcagcctggtgtccaatcccttgctccccacgctcgcgggggtgagcgcggtccttcctggcagcaacatcgtcctgagagacaacgatgccctcgaaggaggctacttcacattcgtctccgcgctcctcggcagcatcaccctggaaggcaacgcgaagctctccacccttcccttccggcacctcgaatggctgggcggctccctgaacatcatcgggaactccgccctgagcaccctgagtggaactgtgctgcatacggtcgtgggagacctggtgatcgaaaacaacgaggtcctctccgggttgtggggcatgccagcgctgacgtccattggcggtggcctccgcgtgcgggacaacgccaatctgcgctcggtggaaggcatgaatgaactcacccaggtggggacgctcgaattcgatcgcaaccccgcgctggaagccgcgggggagttccccaagctggcgcgcgtcacctccggcatgcggttcaatgccaacgccgtgttgaaggacctgtgggggctccagaaggtgcagaacagcggcttcctgttcatcggcaacaacccacagctctcccggctgatgggcttcgaccggctgctctcactgaaggtgctgaccttggagaacaacgcgagcctcatcgacctgtcggacctcgccctcctccattcgctggaagagctgcatgtgatctcccatgagaacctgctgcgcctggacctgaacgccctggagaacgtcaccctcatcttcaccgtcacggagaacccccggctccccacctgcctggccgtgtcgctcgccgcacgggtcaacacgggcggcgcgccggagattcgcggcaacgacagctcatccccctgcgattgaaagcctcccagcggcgacttccgtcacgaggaagagagaagcactcatgcgatggacctggatggcggtggtactgctggcggcgggctgtgacggcatcgacgtgcggaagctcgtcacgcaacacgaggcacgcacgcgagtggaccccgaaccggccggagaccgctgcccgctcggcggcagggcctttctcgcgggcctggacctgaacgacaacggcgtgctcgacgccgccgaagtcacgagcaccgagtacgtctgcaccacgcccacgcccggggtgctggtgcacatgcaagacgtgccgcccggtgagcagtgccctcacggcggccacgtgtcgcgggcgggcctggacgtgaatggcaacgatgtcctggaagacggagaagtcacccgggaggtgtacggctgcaccgagccagtctccccgcgtgtgattcaccgaagccagcatcagcctccgtcggcgacggtcccgccgtggctctgtagctggggccgcacctgggtggaggccggccctgacgcgaacggcaatggcctcctcgatgaagacgaggtccgcgccatggagagtgtctgcgtggagccgacccggctcatggtcgtctacgtgcccgagttcgccggagcgacctgcccccagggtggcacgggcatccggctaggcgtggattcgaatgacgatggcgtgctcttggggcccgaggtctacaagaccgccttcgtctgcgaggccctgcacacgctccacggcgactacaccgtgcagacccccgcggacctcgccgcgctccagcgcatctcccgcatccaggggtcgctcctgatcaacgacgcgtccatcaccgagctgagcctgccggggctcgcggtggtggaccgcaccctgcgcctctggaacaaccaactcctgacctgggtggacctgcccgtcctgcgcttcgtgggcgacgacctcgatgtgacagccaaccccgcgctggacaggctgcaagcgggtggcgcggaccatcaacggctcttcgtgggccagggcgtcgtcgtgagcaacaacgaccggctgcgcagcctgagcgggctcgtgagcgtgtcgcctcgggagagcctgctggtggtgggcaatgatgccctggcgttccaccccaaagaggattccgtgctcgtcaacgtcgacaacctcatgggctcgctcaccatcgccgacaacaacgcgttgcaagcgcttcccttctcgaacctcttccatgtcggcggcaacgtccgcatctcggggaacccggcgctgcgctccctagaaggactctccccgcggagcatcggcggcgcactcgtcatcagcgaaaacgaggccctgcagacgctctccagcctcgagccggtccgtcacttgtccgagctgcgcgtgatgggaaactccgccttgacgaccctggagggcctgagcggcctgagtacactcgcttcgcttcgcgtgtcggacaacacgagcctcatccggctcggcctgagtagcctgtaccaggtcggccaggccttcgacgtcacgaataatctcgaactccccacatgcctcgcgacgtcgctcgcgaccgccgtgtacacgggcgacgccgggcaactccacatcagcggcaatgacgacaccgccacctgcggcgagtgacgctccgaaaggcccctggcgatgcgatggacatggatgttggcgctggtcctggccaccgggtgtgacggcatcgacctgcgccggctcgtcggtcagcacgaggcgcgcacccgcgtggccgacgagccctccggcccgaactgcgagcacggcgggaaggccgtgtgctcggggctggaccgggatgatgacggcgtgctcgatgacgacgaggtgacgggcaccgagtacatctgcaccacgctctcgccaggcgtgctggtgcgcacgcggcagctccctcccggcgagccctgtgcgctgggcgggcagctcaccctggcgggggcggacctggatggcaacggcctcctttcggatgatgaggtgacgcgcgaggtccacggctgcatggagccggcgcctgtcctcgcccgcgtgcgcccgctgctggcccagcccttcgtctgccggtacgacaacgcgctcctggaggccggcgtggacctcaatgggaacggcgtgctcgatgacaacgagctccgggcggccgcccgcttctgcgcggaccccgcggtgacgctgctgcgccagcggccagagcccgcgggcccgaactgcaccacgggaggtacccaggtggaggcaggcgtggacaccaacctggacaaggtgctcgacgagaccgagattctctcgtccgcattcgtgtgccagttgtcggcgacccatgacgggacgtatgcggtggagaacgcggccgacctggaggcgttgaagtccctctccatcattcgcggtggactcgccatcgagcacacggatgtcaccgacggtggtgctgcccg

SEQ ID NO: 1103 - DNA, 17315 bp, Myxococcus xanthus
aggggacgaacgcgccgccggccttcagcacgcccaggagccccaccaccagttccacggagcgctccgggcacagccccacgcggacctcgggacctacgcccagcgtgcgcaggtggtgcgcgagctgattggcctgttcctccagcgctgcgtacgtgagttgctggccctcggccaccaccgccaccgcgtccggcgtccgagcggcctgcgcctcaaacaagccatgcagcgtcgcgtcccctgcgaagggctcgcgggtgtcgttccactccaccagcatccgctggcgctccgcgtcggacagcagcggcaactccgacacccgctgcgacggattcgcggcgatgccctggagcagccggacgaagcgctcccacagcaactccaccgtggacaggtcgaacagatccgccgggtactccaatgcgcccgtgaggccctgcggcgtctcacgcaactccagtgacaggtccaccttggtggcaccgatgtccagctccaccatcttcacgcccagccctggcgttcggacctcgaccggcggcgtgttgtggaacgtgagcatcgcctgcaccagcggcatgcggctcggatctctcggcacgcgcagctcgtccaccagccgctcgaacggaatctcctggtgggcatacgcgccaatcgacgccaccttcacccggcgcagcagctccacgaaggtgggggctcccgacaggtcacctctgatggcgagcgtgttcaggaagcagccgatgagcccttccagctccggacggttgcggcccgcggcggatgtgccgacgatgacgtcgtcctgcccggagtaccggtgcagcagcgtctgaaacgccgccgtcagcaccatgaagggcgtggctccctcgcgacggcccacggcccacaccgcgtccatcacgggcttgtccacggagacctggagacggccaccccggcccgtccagcgcgcgggacgcggacggtccgttggcagctccaacacctgcgcgcccgcgagctgcttcttccagtacgcgagctgagcttccatgcccggcccctccagccagccgcgctgccacacagcgtagtccgcgtactgaatcgggagttccggcagcggcgacggccggcccgccgcgagcgcttcgtagcccgccaccagctcgcggaagagcacgcccccagaccatccgtccgaggcgatgtggtgcagcgtgaggtgcagcacggacacagcctcgctgatgcgaatcagcacggctcgcatcaccggcccgagcatcaagtcaaagggcttgcgcgcctccgtcagggcctgcttcagcgcgtccgcctcccgcgcctccagcgtgtcgcctcgggcctccagccgctccagcaccaggggcatggcgtcggcaatcacctggtacgcaccgccgtcttcgagcgcgaaggtggtgcgcaggacttcatgccggaggaccatcgcgttcagcgcggcctccaagagggcttaggccaccggaccatcgacacgcagggtgacggtgttgttgtacgcgatgcccgccgggtccaactggtggaggtaccagatgcgctgctgtgggaaggacagcggcagcggcttgtcccgccccacccgcaccacgggcgtggcagtcgccgaggaaacctccgcgctcaccgtctgccgcgtggggggcctggtgcccacggtgccacgggctggctgcgaggtaggacgccgcgcctttgtcgcacgcgcgggggcaacgcactccacttcgccggcaacgcggaaacgggctcgctggcccgtcaccaagaagcgctcatccgaaccggggacggagatgaagcgcgcccgcgtggcctccgggtcattccagaagcccagcggaaccgccgcgccggccagggccagctctcccaccacgccaaccggcaccggctcgccggacgcatcccgcacgtacacgggcgccgaagtgggagacggccacgccgcgcccaccaaggaggacgctatcgccacgtgctgcgccgaactggtgaggtcctgcgattcgcccccgagcacccagagacgaacgctccccagcgccgcctcggcgccaggaagctccgccagggcacgcgcctgcgacggcgcgcagcgcagcgtggtgacgccctcgtcttgcaccagcgacagcagtgcgccgaatccagcatcgccttcggccagcaccgcatccgcgggcagggcctgcacctggctgcgctgccgcaccacgtccagcagacggaggctggacatcatcggctccagcgccacgccgaagtcgacgaggcaggcaatctcgtccacgtcgagggcgcgcacgcgctccaccacgcgcacgcagtcctccaccgagccgaagaggccaccttccttgatgtagtgctccaccccctgggcgagcatcacctccacgtcctctggcgtgaggccgcgcacgtccacctgaaggccctggctggccaccaggttggcgaacacgtccaccgagctgcggaagtatcgcagcagcggctcgcgcacggcctcgcgcacctcgtccaggtcctggccgaggaaggtgtggagcatcaacgtgacgtgcccctggcctgggccatgtcccgccttgcggtacgtctcgcggtacagcgccaccttcgtcgccagctcgtccaggttggagcccagaccgagcacgttggtgaggatgcccgcccccacctcaccggccttccggaacgtctccgggttgcccgtggacgtcagccagaccggcagctccgcctgcttcggcttggggcgcagcgccagctccacttcattgcccgcgccgttgcgccgcagcaccgtgccgccgcgccacagccgccgcacttcctccaggcgttcaatgagcacctcgcgccgccggtcgaaggtccccggtgagagcgagaagtcgttcgcgtgccaccccgtggcgaatgacagccccacgcgcccacgggacaggttgtccaccacggaccactgctcggcgacttcgatggggtcatggagcggcaacaccacgctgcccgcgcgaatctgcacgtgccgcgtgagcatcgccagcgcgccgccgaccaccgaaggctgtggatacaaaccaccgaaggagtggaagcgccgctccggcgtccagaccgcggagaaaccatgtgcgtccgcgaacttcgcgccttcgaggagcagctcgtacttctcctcgcccagcgaatcctcatcgttggcgaagtacgaaagactgaagtcgagaggccgccgggtgtccggcttgcggcccaggacagcgaagcacgcggcgagctgctcgggcggaaggacgacacgcatcccacgcgcgagtgcccacagcaggtccagtcccgacgggtcagccgaaggcccccccaccgccaaccacacgtctcccccacccgcgcccgtccgggcatccagtgaggccaacacgtgcgccacgttccggtggctcagcatgacccggccgtaccctcccagcgcgtcgggcgcaggaacgatgaaggccagccgctccccgggcacgggctccatcgaatccgcgctcgaatcgacagagtccaccgcgacggcgcggattccctttggcaacgccggcacgtcctccgtgcgaggcaccagcaacaaccgaggtccttgcgcgggcagcagggacgccagctccgcgacctcaccggccgacacggggaggcacgcgcctcccgcctccagcacgccccacagtgcgatgaccgactccacggatggagtgatgcgcaccgccaccggcacgtcccggcccacgccctcctgcttcaaccgggccgcgagacctcgggccctttccgaaagctcccgccatgacaggcggcgctcacccatgctgatggccactgcgtccggtgtccgcttcacccacgacgcgaatcgagccagcacagccgcatccgcgaggtcccgatgcccgatgctcgatgacccaccggcgggcggcatgctggaaatcgcgaggccctcggcctggaggctctgcaccgaggacgcaggcccccgcgcggcagcgctccgttcctccggtgccgccagcggcatccgtgacacgcgaaggtcggggttcgcgagggccgcccccagcaacgtctggaggtgggccgacaggcgcgcgatgcgcggctcgtcgtagaggtcggtggcgtactcgatgaaaccgtggaagccgccgctctcgctctcgttcagcagcaacgtcagctcaccgagcgtggcgccgaactgcgcgggcgttcccggcacctccaccaactgcatgtccaggcccgccacggagggcggcgccgtggtgacgtgcgcgtgcagcaccagcgccgcgtcacacagccgcgagcgtgccgggtccctgccggaggccaccaacggcagcaggtgctcgaaggggacgtcctggtgactggacgcgccaaccgtcgtctcacgagcgcgcgccaccagctctcggaacgacgggtcacccgacaggtcggtgcgcagcgccatcgcatgggccacgaagccgatgaggggctccagctcgccgcgggcacggttgcccaccggcgtccccaccacgatgtcctcgcgccccgagtaccgggcgagcaccgacgccagggccgccagcagcgtcatgaagggcgtcaccccctcgcgctggctgaaacccatcaacgccgcgctgagctcgcgcgagaaggccaccgggaagcgggcaccacgcagccgcagctcggcccctcgcggccggtccgccgccagctccaacgacggaggcaggtccgccagcacctcgcgccagtacgcctcctgggccgccagtgttccacccgcgagcgagcggcgctcccaggccgccgcgtctacgtactgcacagccagctccggcagcggagcgggctgccccgcgaggaacgcctgatagttcgccgcggcctcacgaaagaaagccaccatggacagcgtgtccgaggcgatgtggtgcaccgtgagcagcatcaggtgctcggtctcggccagtcgcagcagactggcgcggacgatgggcccgtgctccagggagaacggccgcaccgcctcgtccaatgccagccgcagcgcctccgccttccggtcaccgccatgggaacgcaggtccaccacgggcacctggatgcggacctcggcggagaaccgctggcgcacacgcccgtcctccacgcggtacgtcgcgcggagcatctcatgccggcggatgacctcgttgacgctccgctccaggaccgggacatccagcgcgcctgagatgcggaccgccaggggcatgttgagggacgggttccccgggtcgagctgctccatccgccagacgcgttcctgcaccacggacagcggcagctcacccgcgcggtcgatgcggaacatcacctcggatgccgccctgccctccaggggacccgccgcctggagcatcgcctcgatgcgcgcggagatgcccgccacggtgggggcctcgaacagcgcgctcagcgggagctgtacggagaacgtctcacgcagacgggtcagcatctgcgccgccatcagtgagttgccgcccagctccaggaagtcgtcatccgggccgacctccactgcgcccagacgctcgcgccagatatccatgacgcgctgctggatctcccccacggtgacgggatccgatgcgccaggggtggcgaggggaagcacggagctggtgccagccagcgcggcccctgccaccggcccggaggccgcgggcaatacgagcggcgcgcctgacgactccagacggcaggacttctcctcgaatggatacgtgggcaacgacacgcggcggcgaggctccgcgccatggaacttctgccaggcgacgtccaccccggccgcccagaggtctcccagggattgcaacagcccacgggcatcgctctccgtgggacggcggcgcagcgaaggcgccacgaccaactgccgctccttgcgcgcccgtccccgcgccagcgacgtcaggtccgtccctggtcccacctccagcaggacactgcacccctccccgaaaagcgtctccaggcccgcggcgaagcgcaccggctgtcgcatctgccgagcccagtacgtagggtcggtggcctcttccgggcgaatccacgtgcccgtgaggctggacacatacggtagcgtcggcgcctggaggcgcagcgaggacaccgcccgcgccaggtccaccatcagcggctccacggcgctggaatggaaggcatgggccgacggcaaccgcaccatgcccacgccgcggctcgacagcgtggcctgcaacgcttcaatggcttgcaccgggcccgagacgacacaccggccctcgccgttgacggccgccagtgagagaccctcgccgagcaacggaaggacctccgcctcctccaaccccaccgcgagcatcgcgccgacgggcatccgcgccatgagcgcgccacgcaccaccgcgagccgcaggccgtcctccggcgacagcacccccgccacgcaggctgcggcgtactcaccaaagctgtggcccagcaccgcatgcggccggacgccccaggacatccagagtcgggccagtgcgtgctcgacgacgaagagcgcgggcagcgcgacgcgagggtccgccagcttctgggccgcgacggcctcctgcccctgcgcgggtaacaggagcgcgcgcacctcggcggcaagcgagagctccagccgtgccagcgccgcgtccacgtccttccggaaacccggctccaccgcgtgcagctcgcggcccatgcccaccgcctgcgcaccctggcccggaaacaggaaggccacgcggcgattccgccccgcctccaccgccgcgggcttgcgcagccgctccgccagttcagccccatccgccgccaccaccgcacggcgatgctcgaacgaacgacggcccacgttccgggtaaaggccacgtcctccagcgccagtcccggcgcggactccacgtgcgtcgccagctcgcgcgccatcacctccagggcggaaggcgtccgagcggacaacgtcaccacgtgcaatggccggtggccgcgcgccttctccgcctccgggggcgactcttccagcacgacgtgggcgttggttccaccgatgccgaaggagctcacacccgcacggcgcggcccattctcccgcggccacgccttgagcgcggtgttgacgaagaacgggctgcgctcgaagtcaatctccgggttggcgcgctcgaagtggaggctcgccggcagctcgccgtgctgaagcgacaggaccaccttgatgaaccccgccacgccggccgccgcatccaggtgccccaggttcgtcttgagcgagccgatggcgcagtagccagagcgctccgtcgtcttccggaacgcccgcgtcagcgcggcgatttcaatggggtcgcccagcgacgtgcccgtgccgtgggcctccacgtagctgatgtcgtcaccgcccaggcccgaataggccagcgcgtccgcgacgacctccgtctggccctcgatgctcggcgctgtgtaaccgaccttctgttgaccgtcgttgttgacggccgagcccttgatgaccgcgtggacgtggtcaccgtcccgcagcgcatccgacagcagcttgagcaccaccacgcccgcgccgttgcccgccacggtgccacccgcgcggtggtcgaaggcgcggcagtggccgtccggcgagaagatgagcccatcctggtgcaggtagcccgtgcgctgcggactggcgatgcgcaccgcgcccgcgagcgcgatgtccgactgccgcgtcaggaggctctggcaggccatgtggatggcgaccaggccggtggagcacgcggtgtagacggcgacgctctcgccccggagctggagcttgaaggacgccttcatcgccaggctctccgggcccgcggtggccaactccaggcccgcgcccgcgtccttccgtgcctcgctcagcaggttcagcaggtggccggacgaaccggcgcccgcgtagagcgagatgcgccccttgtaacgagacgggtcatacgccgcgtcctcgagcgctgtccaggcgcactggaggaacacgcgctgctgcgggtccatccactgcgcctcgcgcagcgggatgtcgaagaagccgtggtcgaagccgtccgcaccttcgaggatgccccccgcgcgaatgaagtgcgggtgccgccacaggtcctcggggatgagcggtgagcgctccagttcgtcctcggagaagaacgagatggactccacgcagcctcggacgttgttccagaagtcacccaggttgcgagcgcccgggaagcgccccgccatgccgatgaccgcgatgtcgctgctcgagtcctcgccctgcatgtcatcaagctcagccattgccgtgattccctcgccgaccctgccggcggatcgcctgacgccgctgctgggcgcgatccacgtgggcctcattgtcctgggtgtctgccgccgtctcgccgtcccgctccagggacatgacaaacgcgcggaccgtgggatgttcaaagaagcgcgtcgccggaacgtctcgcttcagctcgtcgcgcagcaatgcgcacgccttgaccacggacatggagctgccgcccaggtccgcgaagaagtggtcttccacaccgacccgctccacgccgagcaccttcgcccagagcgccgccacctgacgctccagcgcggtggtgggctccacgaaggcactccctgctggacgcgagacctccggctccggcagcgcgcgccggtccagcttgcccacgggcgtgagcggcagcgccatcagcgggaccagcgtggaaggcaccatgaactcgggcagcgactccgccaggaagccgcgaaggccgcgggggtccaacgtctcccctgcccgaggcaccgcgtaggccaccagccgcttgcctcccgcggggtcgggccgcgccaccaccaccgcctcggccaccgacgggtgcaggcgcaacgcctcctccacctcgcctggctccacccggtagccacgcaccttcacctgaccgtccagccgctcgaggaactccagcgtgccgtcctcgcggtagcgcacgctgtcgcccgtccggtacagccgcccgcccgcctccgagccgaaggggttcggaacgaagcgctccgccgtcagctccggccgaccctgataaccccaggccaggccgtctccaccaatgagcagctcacccggtacgcccaccggcacggggcgcaacgccgcgtccaccacatacacccgcgtattggcgatgggccggccaatgggaatggcccccggcgcgacggcgccctccatcacatggcagcaggtgaaggtggtgccctcggtgggcccatacccgttgaccaggatgccgccgcgtccaagccgctcccgcaccgctgccggtgggagcacgtcgccgcccgccaggagctgccgcacgccatccagggcgtccggcctcgcggcggagagcgcctcgaagagcgcggccgtgagccacaacgtggtgacaccgtgacgtgccagcacgtccttgagtgtgtccaccgtgggaggctgcgctgggaagaggaccagcttcgcgccgtgcagcagcgcgccccacacctcgaaggtggcggcgtcgaagcagatgggcgccagttggaggaagacctcgtccgcgccccaacgcgcgaatcgggagcccagcaccagccgagccaccgcgcgctgcggcacgcagacgcccttgggccgccccgtggagcccgacgtgtacatgacatacgccagcgactccgccggcaccgtcacgcgaggcgaaaccgtgggctcacgcgcgatttcatcccaggccgaatccaggagcaccacgtccgcactgcccgaaggcagcaaagccaccaccgattgctgcgccagcaccacgggcaggcgcgtgtcctccaccatgaaggccaggcgctcgcgggggtacgtggggtccaacggcacgtaggcgccaccggccttgaggatgccgagcatccccaccaccaggtcgagcgaacgttgcacgcacagccccaccggtgtccccggtcccacgccacgattgcgcaggtaccacgcaagctggttcgcccgccggtccagctccgcgtaggtgagccgagcctcctcgcacaccactgcgactgcctccggcgagcgcgccgcctgcgcctcgaagagctccgcgaggcatgcctctcgggggtactccaccgcggtgtcgttccacgccacgagcaggcgttgacgatccgccgagtccatcatcggcagctcgcccaggcgttggcccgcatccgccaccgcgctctccagcaacacccggagccccttcatcagccgcgcggccgtctcccgcgtgaagaggtccgcgtcgaactccaaggttccggtgaacccttctgccgcgtccgtcagggacaacgtgaggtcgaacttcgctgtccccgaggccagttccactgggcggagagccagcccttgcggcgcgacgtcctggcgcgaggcttcgtgaagcgcgagcaccacctgcaccaggggcgcgtggctcaagctccgaggtggttgcagcgcctcgaccagcttctcgaacggaacgtcctggtgggcgtacgcgtccaacgtcgtctcccgcacctgccgcaggagctcacggaaggagctcgagcgcggcagacgcgcgcggagcaccagcgtgttgacgaagaagccaatcaggttctccagcccaggctgctgccggcccgcgatgggcgatcccacacacacgtcctcctggccagacacccgcgacagcaggagctggaaggccgccagcaggcccatgaagggcgtgacgccttcacgaatgcagagcgcacggaacgcctccgacagctcggcggggaaacgcaccgccagcgtgtcaccccggaagcgctgcaagctcggccgggggaagtccttgggaagctccaggacgggcggcgctccggcgagctgccttctccagtatccgacctgcgccgcgagtgcctctccctgcatccactggcgctgccacaccgcatggtccgctggctggatggtgggcactggcagcgaggaaggccggccctgcagctccgcggcgtagagcgccgacagctcccgcacggcgacgcccagtgaccacccgtccgagacaatgtggtgcagcgtgaggaccagcaggtgcgaatcatcagccgttcgaatcagcaatgcccggcacagcggtccattcaccaggtcgaacgggcggcgagcctcttccgacgcggcgatcacggcctgtgcttcacgcgcctcctccggaagcccctcgaggtcgaccacgagaagcgccacgttggcgctcggatggatgatttggacgggctctcccgcgttgctggagaaggtggtcctcagggcttcgtgccgcaggaacagccccgccagtgcccgctccaaggcaggcacgtccagcggaccggcgagccatgcagcccaggggacgttgtagagggccgtgcctggctggagctgctccagcaaccacaagcgctcctgcatcgcggacagtggcaaggggttgtccctggacacggggacgatgggcggcgggcgcgccgtgccagaggactgccgggcctcgcggatgcgcccggccagcctcgccacggtcgggtcgtcgaagagctcccgcagcgacaaggcgacgccaaaggtggcgtgaatccgcgtgacgacccgagtggccagcagggagtgtccacccaaatcgaagaagctgtcggacgctccaacccgggagacaccaagcagttcgccaaagagttgcgcgagcaattcctcctcggggcctctcggtgcgatgacctccgattcgacggtgggcgcgggcagcgcacgccggtccaccttgccgttgggcgtcaggggcaggcgccccagtaccatgaaggcggcaggcaccatgtacgccggcaagtgcgcggcgaggaaggtccgcaggagcgaaggctcgggagtcgcggcggcctccgcggtcggtacgacgtaggccaccagacgccgcgagccccctgcttcatcctctcgcgccaacaccacggcttgccggacgtccgggtgacgcagcagcgcggcctcgacctcgcccggctccacgcggaagcctcgcaccttcacctgtgcgtccacgcggccctcaaaggtcaccgccccatccgccaacagacggacccggtcacctgtccggaagagccgcgtcccgggacgctcgctgaacgggttcggaacgaagcgctccgccgtcagcgcgggttgtcccagatagccccaggcgagtccgtcgccaccaagccacagctcccccacgcctcctggcggcaccggcgccatgtcctcgtcgagcacgtactgaaccgtgttcgccagcggcctcccgatgggaatcgatacggcgccctcgggcacatccgtgacgaggtgccacgtggagaaggtggtgttctccgtggggccatagacgtgcagcagccgctcgggagcaccttcacgaaggacccggcggaccggcctcgggtccacggcctctcctccgaagtggagctgtcgcaacccgctgaaggcgtccggcacttccgcggccacctggttgaaccaggccgtcgtgaggaagaggacgcgaatgccctcctcccgcagccaggacgcgaaggcactcggagagagcgctgtctcccgctccacgccaaccactcgggcaccgttgaggagcgcaccccagatttcgaacgtggccgcgtcgaacgaggcgttggatgcctgcgccacgcgatcctcaggcaccacgcggatgaagtccgtctccaccaccagccggaccacggcctgatgggaaacgcagacgcccttgggagtccccgtggagccggaggtgtagatgacgtaggcggcatccgctgcgccgactccggctccaagcgccgccgtttcagcgacgtccccttgcgccgagacctcctccaccgtgaggacactcacgccctccgaaggcaccgccccccgcagccgctcctgcgtcagcagtacgggtgcccccgcatccgcgatcatccatgcgagccgctcgcgcgggtacgccggatccaggggcacgtaggccgcccccgccttgaggatgcccagcatcccaacgaccagctcggcggagcgctccacgcagaggcccacgtgagtccctcgtcggactcccaaggcccccagccggcgcgccacctggttcgcccacgcgttcagctcggcgtacgtcagcgacgttccgccataccgcaccgccacggtctctggcgcccgcgcggcctgggactcgaacagcgaatgcaccgtggcttcgcgggggtacgtggtcgcggtggcgttccactccaccagcacgcggcgccgctcggcctccgacagcagggacacgtcgcccagtcgctgctcaggacgactccacatcgcctgaagcagaccgcgccagtgcgtcagcaactgctcggcagcgacctttgagattcgctcctgccggtacagcagcttcagccgcatggagcgtcccggaaccaccaccgcggtcagcggatagtgcgtgcgctcgaaggccgcgaagtcccgcagctccaacccggacgcaccgcgtacgagcgcggcatccaccgggtagttctcgaaaacgaggagactctcgaagagcggcgtgcctcggggaatgtcgctccacccctgaagccgggtgagcgggacgtgctcccgttgccccaactccaccagcagggactgaagctcgctcagccagggcagcaacccggcgccatgctggatacgggcgcgaaccgggagcgagtggatgaacaacccgacggcttcctcgatgcccggtagctccggcggacggcccgcgagcgtcgtcgcgaacatgacgtcctgcccgcccccatagcgggacaacagcaacgcccacgcaccgtggaccagggtgctcggcgtgagcccatggctgcgtgcgaactcctggagcgcagcggtatcggcctcgcccaaatccagcgcgtgctcacccgtgtcatgcgccgcggtggagcctcctgccgcaggcaatggcgtcggcgcttcgatgccctcgagctgctcccgccagaaggcttcgtcctgctcaggtcggcggcgccccagccattccacgtaggtgcggaaatccattgaggcggcgggcgggagccaatctgcccctgcggcaatcgccgcgtaagcatcaagcacctcgccaaggacgcgcgccagactccacccatcgagaagcaggtgatggaagctccagacgaaccgccaggcatggtcctccagtcgaatcagcgccagccgcatcagcggcgcctgcgacaggacaaagccctgtgcccggtcctcacgcaggaacgcggccagtgactgggattgttcctccgaggagcgcccgcgccagtcgagctcagcccacacaggggtcgcgcgtgcatggaccacctggacaggggcctccaacccgtcccagaggaacgaggtgcgcagtgaggaatgccgttcggacaccgcctcccatgcccgccggagtgctccggcgttcagcggaccggcgagcgtccagcttcgctgctcgaagtacgcgccggtgccgggctccagcagcacctggaacaacaacccatgctggaggggagagagcgcatgacactcctccgtcgcgcccgcgagttccaccaacgtttcgacacagtgacgcgccagggcttcgatgcgcgcgcgcgaatgcagcgcctcgctgtaatgccaggccaactccaggcgtccgcccacgacgcgagccaccacctccaacacatggctccggagcccacgcgtcccctgcgaggcccccgtggattcgggcgccagcgagaacagcgccgagtcccgagtacccgagtcgagctgcccgaggtagttgaagaggacctcagacgaagcgccggcatcatggcgaaggtagcgcagcaggccatatccaacacctctgcccttccgatgctcgcgtgccgcgcgaaccgacgcgagcacggaagcggacgccaacccctccggcaactccagacgcacggggaacaacgcggtgaaccaccctaccgtgcgtgagaggtccacgtcgtcgaacagctcgtcgcgcccgtggccctccaggtcgatgcgcagtcggcgctcgccactccatcgggccagcgcgctcgcaacacccgtgaggagcacgtcttcaaggcccggctgtgacatcgtcgccgatgcacgaagcagcgagtgcgtcacgtcggcatccagtgccactgtgacgacgcgctccgagccctgcgagttcaccccacccggcacatcccgaggaagcgcggccacatccgcgctcagcacgtcccgccagtaggccccctcctccgcgagcacccccgaggcggcatgcacctccaaccgtcgtgcccaggcctggaacgacgtcgtcttcgcgggaagcgccaccggctctccgcgggcaagctgccgaagcgccgtctccaggtcctccaacaacacgcgccaggagacgccgtccgccgcgaggtggtggatgaccagcagcagccgtcccctccgatttggtcccgggtcgaacaacacggcgcgcaggaggcaccccgcattcaggtccaaacccgcctgctcctccgtggcggtgcgctccatcgccacggcccgcgcggcggcatccaacccggataggtccacgagacgcagtggcacgtcgcgccctggctctgcgcacgactgcgcccaccccgtatcactccgcgacagccgcagccgcagcgcatcgtgatggtccacgagggcccgcagtgcgcaggccagcacgtccgactccaggcgctcacggggctccagcatcaacgcctggttgaagtgatgcgcttcgggaagctcgcgctcgacgaaccagcgctggatgggcgtcagcggcacgggccctacaaccgggccctggtctcccaagcgacgacggctcgtcgccacctgtgccagccctgccaccgtcggatgctggaagagctggcgcgcggtgaggtggatgcccacctgccgcgcccgcgcaatcacctgaagcgcgaggatggagtcaccgcccagctcgaagaagcggtcctcggcgcctacccgctcgacgcccagaacgcccgcccagatctgcgcgatctcaagttccagcgcgttacgcggctcgacgtgggccgcaccacgcccctgcactgcccgcaccggtgcggggaggccacgacggtcgagcttcccactgggcgacagcgggagcgcgtccagcgtgacgaaggccgacggcaccatgtgctcgggcagtcgctcaccgaggaaggcccgaagctccgatgccacgtcccccgaaggcgcgaccacgtacgccacgaggcgccggtctcccgggacgtcctctcgaatcgccaccgccgccgcacgcacgccggggtgcagggacagcacggcttcaatctctcccaattcgatgcggaagccccgcagcttcacctggtcatccaggcggcccaggtactcgatggcgccattcgccaggaagcgggcctgatcgcccgtccggtacatccgcgcccccggctgcgccgcgaaggcgtccggaaggaatcgctcagcggtcaggtccggccgctgccagtagccgcgcgccagcggtgcacccccgatgtacagctcacccggcacacccgctggcacgggacgcagccgcgcatccagcacgtacatccgcgcgttggcgatggggcgcccgatgggcacgacatgcccacggtcctcacgtgcgcaggcccacgccgtcacgtccaccgcggcctccgtcgggccgtagaggttgtgaagctcggcgagcaggcacgagaagtagcgatccctcagctcgggaggcagcgcctcgccactgcagaacacccttctcaggctggcgcaggacactgccagctccgtctcctccaggaagggccggagcatggacggcacgaagtgcaacgtggtgatgcgctcgcgagcgatggtgtccgtcagatacgcgggctcccggtgcccgcctttagagca

SEQ ID NO: 1104 - DNA, 15209 bp, Myxococcus xanthus
  unsure (1)..(15209): unsure at all n locations
ctctcaagcttcgcgttggcaatccagttgcgcttccggcgcgcgagccgcgccgcggcatcctcgtcgtcgaagcggcccgagctgcggagaatccgcgccgggccgctaccctcgaacgcgtggacattgacgaccgcgtagagctggccgtcgatgaggctggtcaccacgggaacgacgccgcaccggccacaggtgtggaactccgcggtccgcgtgccgaaaacatatggagggcgcggctcaggccggcagcttcttcaggaaggccagcagcgcggcattcacctcggcggcgtgctcctgctgaacccaatgacccgcgccgggaatgacgtggatgtcggccaggttcggcaccagggccttcatcgggtcaacgggagagaaggcacgcaccgggtccttctctccgacgatgtagagggccggctgcgagatgaccgccgtcgccagctccggcagttcgtgccagtcccggtccatgttgcggtagcgattgagcccgccccggaatccactgccggcgagctccttcgcgaagtacgcgacgtccgcctcggtgagccagccgggcaacgtctcaggtacgtcgagcctcgcgaggaagccttcccccttcttcttcgccagcacggcgggattcgtcacatcgaagccgggggtgcccgtgagaatcgcccggaccgtcctcgggacgtccgcctcgaactcggcctcggccacgccgggctcctggaagtagaggatgtagaaccacttctcaccgaacatgcgctgaaacaactgcatgggcggcatgggcgcgcgccccagatggggaacgctcattcccaccaccgcgcggaagcggtcgggatgcagggcggcacagttccaggcaatcgccgagccccagtcgtggccgatgacgatggccgtcctctcccccagcgcatccagcaggccaaccgcatcacccaccaactgcttcatgctgtacgcctcgatggcctccggcttgtcgctctggccgtagccacggacgtctggggccaccgcgtggtaccccgccgccgccaacgccggaagctgatggcgccacgagtaccaggactccggccaaccatgcaggagcaacacgagcggccctgaacccgcctccgcgaggtgcaggttgatgccattcgtctttacggttcgatgcgtgatgtcagccatgggtgtgctccagaggtgacggtacggtgggggcgcacaatcgcgccaggcgcgtcaggcacgaggcttgacgcgccgcttcgcggcacgagcgtgacggcggcgaacgccgcgtcccaggtccgccacggacgtgcttcgaaggtgttgcatgagcagcgccgcggcctggtccagcgcctttcccagcgcatcattgacggcctgctccacgagacagcccggactttcatcatggggaccgatactgaagagccccggtgttccgagcgcttcgtacacgtcccccaacgtcacggtgtcgagcgtgcgcgccagcgaccatcctcccccgtgccccttcaccgaggtgaggatgcctgcctcccgaagtccggccattgtccgccggaccaccacgggattggccttcagcagccgccccatcgcctctgacgtcaccacggggcccatgtcctccatgtgaaggaggacatgcaaggcgacggagagccgactgtcgcgtctcatgccacttcatatgtggcgtgagacgcggccagtcaagcgattctgcaggtggggtggctgggtggggtgtcgtgactcagtagttgacgacgccgttcgggagcagcaggcggtggctccccatgtccatgatggagcgagccacatcgagctgcaccaccgcgcggccacgcagcgccagttcgtgcacgggcgcctcgaaggtcaccggggcgacgctggcgtcgacgaagccggagccctccgcccgggcatagccgccgagcccctccagttggagcgtcacgcggacgcgatccgcgccttccggcacgtagaagtaggccaccaggtgcgcatggtcggcacgggccacatccgcgctgtcttgcaccaactccaccttgagcggagccccattcgcggtgacgcgaacagcaccgatggggagctccagcttgtcgtagccttccgccgccgagccgcggagccgcagctcgaagcgctgcccatcctccgtctggaccggaccggacggagcgggtggctcgccctggacggagtcgagccgatcactgcccccaccgcaggctgtcagggcgagggccgcgcaaacacacgtggacaacatggtcttcttcatggcgtgtctttccttgagatttgaagggtgtcttggagtgagttgggaacggctcagggcgagcagctctggccggagttggaggtcgggtcgacggcgatcgcctcagcggcctggggcgtcgacggaccggggatgaagccgggcgggagcgggagcgagtcgcaaccgttgttgaaggcgtccacggggtcgatgaggcccgagatgacatcgcactgggtggtgttcagggccgcaaccgcatccgtcaggagcgacgtcgggtcgggcgtcgcgccgaacaggcgctggttgcagatgcccaccagcgtctggcgcgcgagcaggaagcggagccggtccagctggctgcgcatccctcccgccgggtacatggccgggctgccccacaggatgccttccgcggcgggcagcgtggtgatggtcccgatggcgcccaggtcgatgggcccctgcgccaggcactgcgtgaccgtcaggatacggttcttgtagaagccgagcgtccgcgtcgggccggtgcactcgacgggaggcggctcttcccgctcacacgtcaggcgcgccgagcacatggcggagcccaagtcgaacgtcaccgtgaacgtgttgtcgatgtggttgtccgccacgccatcctgcgcggcaatggtcacgcactcgtcatagctgccgatatgcagcgcgaagtccgacgtcagcgaaccattgacaggaatgctcaccggcggcggcggcgagaacgtgaagccctcgctcgacagcacgtcatcggtcgccgtcaacaagatggacggcaacgtcgggtggacgttggtgaccttgaaggtgtagttcgcggtgtagggataatcatccgccaccaccaccgactcgccattgaccttcttttcgcaaatcaggtcgtgggcattcgcgactccgctcccgccgaccaccaccgcacataccgcggaaacccactgcttcttctgcttcatccgcattgttccgacctcgttcatgagcaccaggctcggacgcggcggatttcaccgtttgtgccacgtctgggaagacgcggggcgacaagcccctgacacaaggattccccatgggaggtaggtgttacgcccttcctcccgtcgaatggaaaatcacatcccacagtggggaccgcgccggcggacatgaagcaacatcggggctctgggaggagggtaattgccccacccgcgaccgtccgcacgccctgctgacctgggcgaacgcttcccatgtcccgcgagatgcctcggcagtgaagttccctgcacccgacaggcattggccccgcggggcgttgcgacgctttttcctcaggcgcccgggcgggagaacgtcacccgctggccgttggcgcccagttccagatgcgtcacgccggcgctgggaggccccagcacgggcacgatgaaccagttggcgcgccgcagcgtggcgggctgccgcagcgcggcgccgggctccagcatgcgctccacgcttccgcccggtccgtggaagacgacgcgcagcgcgcgaggcacgccctgggcgcggacgtagaaggcataccggtcacggcccccacccgcgtggcccgccgcgacgcccagcacctccatgtccttctcacggaaggccagcggcatgaccccatcaggcagtggcgcgggttcggaccggggtgcctccaggtcataggctcgcagcgcggcatccggaggcacaccgggaacgggggcgtagtgctccgcgagcggcgagacgaggtaggggtgatagccgtgcttgcgagcactcacgacgtcgggcggccgccggtacgccatgcggttgctccagaacatgaggctcaggtactccatggagccgggcacgtccgagtcctgcgcgaggaagaggacactgcgcgccggcgtctgctggtagagcgcgcgccccacctcgcgggagtaggtgacgtacaggtcatccagatgcctggcctggtagtctgccttcgccaccggaaaggtgacggccagcagccacgcgagcacgcccgaggccaggagccccagccccaggggcgcccaggacagcttccgcggcaggcgccagcacacgagcgcgacgagcagcgccgccgcggcggccacgaccagcccctcggcgagcccgggccgggcgcgcgtctgcaccagcaccgtggggagcacggcgcggacagcaccgagcaccggcaggtgcttgacgaaccacggcgtggcgaccgccgccaggagcgccgccgcgagcgcagggtggcgccgggcatccgcgcccgcgatggccaatgcggccaggacggcgggcaccgcgccccaggcaatggcggggaccttcaccacgctcagtgacaacacgagccaggtggcccccacccacaacgcgagccccaccacctccagctcccgccggcgcaccgcgcgcaccagcagccacacgaaggcgagcagcggcaacaccgcgggcagcggcgccaggctctgggtgttgacctcattcaagagggcatccaccggccggtgccagggccccacgtccaccgtcgggtcggcgaagaggtgggcgcgcgtcacccgcgcctccaagtcatgcagctccggccagcgccatgcggagtagaagctccacggcgcggccaggagcacggccatgcccaccatggccaccaccgtgctgaacctcggccccggacagaagcgcagccggccgagcgcccacagcgtcgccgcgatgcccaggggcgtcagcgcgagccccgtcttgcaaaggaagcccagccccacggccgcccctgccgccagcccccaccgccaggagccctggcgcgtggcgtggaacaggagcgccaccgcgacggcgttgcagcccgtcagggtgcaatccgtcacatcgccgaagatgcgcccctggacgagctgccagccaaagggcatggcgaggaagcccgccgcccccagcacggcccagaagcgcccggcgggcctgcgcgcgatgaggtagatggacaccgccgcggccaggtgccccaggagcgaggccagccgcaacgccagcggcgtcacgcccaccacgtgcatcatcaacgcgccgaaccagaagggccccgtgggcttgtgcatccacacgtgcgcggcccaccagtggcgcgggtccgcggggaagaccgggtccttgtagatgtgcggcgtgaagaaggtttcgtgcgtgccgcgcgcggcggcctggtgcatcgcctcgtcccagatgtagatggccgggtgcgccaggtgaggcgccagttgggccaatccccagacgacgagcgccacgatgagcagtccatcgagacgcctttgaaagacatcggggggcgcggcggcagtcggggcgtcggtgctcatcggggcgatgcgtggggatagcaccccaagcacgccagagccacttggagccgtgcgtcagtcgcgcccgatgccgatgtaggtgacgccctcgctccaggcgagccgcgggtcgagcacgtcagcacacggcggacggcgcgccctctagcctacgaggacttcacgcgcccctccctgcccggacgccactggccgctcgagcatcagggtccgcagccagtcgtggagccggtccacgccctcggcgattcccacctggggcgcccaccccgtggctgcctggaacttgcgggggtcggagacgtagtagcgcgggtcccccgtccgcccatcctcgaactggagcgcgggccgcagaccggtgcgctgagagatgagccccagcaagtccaacaggctcactgtccgcgacgggccgccgccaatgttgaaggcctgccccttgagccgtccgatgtgctgctgcgccaggccgagcgcgcgcaccaggtcccccacatcgaggatgtcgcgtacctgcttgccatctccgtagagcgtgaggggccggccttcgagcatgcacaggaggaagtgcgccacccagccctggtcctcggtgccgaactgccgggggccgtagatgcagctcatccggaacaccaccgtcctcagcccgtaagcccgcgcgtagtcgagcacgtactggtccgccgcgcccttggagcagccatcggggctctcgaagtccaccgggcagtcctcccccacgccgtgaccgcgcaggcccgcgtcccgaggcgcgtagcggctgggcttctggacgaactccacgcccggcgtgcaaccgtagaccttgttggtggaggtgaagacgagcgaggcaggccgctccatggcgcgcagcgcctccagcacgttcagggtgccgcccgcgttgacctcgaagtcggtgacgggcgtctccaggctggtggtgacagccccctgggccgcgaagtggaagacctcgctggcgccaacgacggattgcttcaccgcatgggcgtcccgtacgtccgccgtcaccacctccagccgggcgccatgccgggcctggagccaacgcaggttgtgcaccaccccggggcgcgtcaggttatcgacgacgcgcacggtccgccccgcggacaggtagtggtccgccaggttggagccgatgaagccggcgccgccgaagatgaccgtcctgcccccctccaccttccaaggttccgccgcgctcatacggtcagccctcgcgtctcgagttccgcgcgcgcctccgccacgcggtccgtcgccacctggtcctcgagccacgacgacagctccgcgagcccgtcgtggaaggaaacccggggtgcgtaccccagcaactcacacgccagggagatgtccgcgaagcagtgacggatgtcgcccatgcgatagcgacccgtcaccgcggggcggaggccaaggcggcccatcacctccgcgagcgtcagggccacttcattcacggtgatggactgtccactgcccacgttgaggacgtgcgagtccgccccccgcgcgtcgagcgccagcgcgcaggcgttcgctacgtcacgcacgttgacgagatgtcgtgaaaccagtcacccagcgaatgcaccaggtgttgaagctgctcggccgtcaactcggacggggtcatggcgcctccgtgatgcaggggggaatccatgacgagggtgcgcagcacgcaggaactttccaagtaaggccgggcgcaaggcccgtcgcctgtcgaagcccccggagacgcggcactacctttcaggcatgtccttgtggcgggtcctgttcggcaggcccattccgaacgagcgagcggaagaggagaggattggtccgctgacaggcatccccgtgctcgggctggacgcgttggcctccgcggcctacgggcccgaggccgcgctcaccgccatgctcgtgctgggcagcgccgggccgcggtacatcggcctgctcaccggcatcatcgtcgcgctgctgctcgtggtgcagttctcctaccggcagaccatcgccgcgtatcccgacggcggcggctcgttctccgtggcccgcgccaacctgggcgtgaggcccgcgctgctcgcggcctccgcgctggcgttggattacgtactcaacgtcgcggtggccatttccgccggcgtgggcgcgctcgtctccgccatccccagcctgtttccccacaccctgctcctgtgcctgctgctgctcggcttcatcatggtcgtgaacctgcgaggcatccgcaccgcgggctcggccttcctgctaccgacctacctgttcgtcggctgcctgggcatcaccctgctcatcggcatctggaaggtgctcacgtccaatggcagccccgtgcccgtcgtcgccccgccccggctcccggagagcacggccatggcgagcctctggctgttgatgcatgccttcgcgaacggctgcacggcgatgacgggcatcgaggccgtcagcaacggcgtgcccatcttccgcgaaccccgcgtgcgcaacgcgcgccggacgttgctgggcatcgtgagcatcctggtgatgctgctctgcggcgtggcgtggatgagccacgcctatgacattggcgcgaccgcgccgggccaggccggctaccagagcgtgctgtcccaggtcgtggccgccatcaccgggcgcggcgtcttctactacgtggcgctggcggccatcgtctgtgtgctctgcctgtccgccaacacgagcttcgcggacttcccccgcctgtgccgcgcgctggcgctcgacagcaacctgcctccggccttcgcccacgtgggccagcgcctcgtgtattccacgggcatcgtcaccctgtccctgctggccgccgtgcttctggtcctgttcaacggcgtgacggaccacctcatcccactgttcgcggtgggggcgctgtccgccttcaccttgtcccagctcggcatggtcatgcactggcggcgcatgagcggacgcggcgcgcggaggttccagtgggtgaatggcgtgggcgcggcctgcaccgccctggcgctggccgtggtggcgacggccaagttcgaggagggcgcctggctgaccgtcgtcttcattcccctgacctacgtgctgctccggacctcgcggcgccacgccgagcgcatccacgccgccaccgagacgccccaccccattcccgtgcagccgctcgccgcgcccgtggtggtggtgcccctccggcgcctggaccgggtggcgcagaagggcctgcggctggccctgtccatgtccccggatgtgtacgccgtgcaggtccgaggacaaccggacgcccaggagcaattggtgcagcgctgggagtggcaggtggccgcgccccttcggaaggccggacggccggtgccacgactggacgtgctcgtgccgacctaccgccaggtcgtggacccgttgctgggctacgtccggaagctcgccgcggagcatccgggccggttcatcgcggtgctggtgccagagctcgtcgagcgccgatggcaccacttcatcatccccagccacaccgccacgctgttgaagatgatgctcctggttcgcggagggccccacatcgtcgtcatcaacacgccctggtacctgcgcgagccgtcgggccggaagagacgcctccgacgaggttctgcatgcggacgaccaggttcttgtcgcggcgccccagcgtgctcgcatcatccgtgggaatgacgtagcccccgtcgaatctgacctcgcccggcgtgggccccgtgtgccgctcgacacgccctccactcggccctggaatcccacacgcggcacgcggttgaatgggcccgtcgctcacggaggtccgcccatgcgccgtctggccatcattccgctcttcgcgctgttcggctgcagctacgtgcagttgggcatcccaggaggccctgtcgacctgggctcgccccggaacacgagggtgggcgtcttgattcgccagcccgcgaatgaaccgctggaaggagcgccggagcgcgaggacaaggccccctgagcagagggactacagcagcttctgccccagcacgtcgaacgcttccaggtcgctcgcggcggcggggctggcccggtagtcctccgccaggagggtccagagcatgacgtcgcgccacgagccgtcagcggcctggaggcgctgtcgcaaggtgccttcgtgggtaaagcccagcttgcgggccaccgcggcgctcggcacgttgagcgggtcgcagtgaatctccacccggcgcaggccatccagttcgaacgcgacccggacgagcgccgccgccacttcggtcgcgagcccctgaccggcgtgctgggccgcaatccaataccctatctcccggcccccctcgcccacacgaggatgcagcccgcagccgcccaggacctccgtcccaccccggtcgaacacggcataggtgaagtcctgtcccaggtcgaagctcccgcgaaagcgccgcaggacggcggcctgctgctccacgctgatggggtagtgccgcgcccagtccaaccaggggcgcaggtggtcgaggctggcgtcgatggcgcggagcgcacgcgcggcgtcagcgggtgaccagcagcggagcagggttcgtgctgtctggagggtgtatgcgggcccgaagggagtcggagtcatgacgaaccagtggaagtagacctcgacgcaccccgtcccgtctaccgcaccacgtgcatctgggaggcactcaccccgtcgcctcgaacccgtacctccagggctcctgactgttccgcgcggaaatagaacaccgcttcctgctgcggtccctccaggtccatggcgccgctgccattcagaggcaccagggcctgcgtacacgccgcgtcccggaagaaggtcaccccgccaacattcccctgtgcctccaccaccagcagggacgaagccagggcggacagattgcccatggcgtcctgactctgcaccaccaacgcctcggagcacgcgcccgccgccacgtcttgctggggtgtcaggaaggccacctgcgccgccgcagccgccaccacgtccacgtcgaacgtggagcccggcagggtctccctggcatagcccgcgccactgatgcggttgcggctgatgacgttggccccgcccaggtccgagatggccgcctggtacggcacgccgttcgccaccacgccgtggctcaacgtgttctccaccacgagcaaccgtgaggattgcgccagcggcccgccgtccgcctccgcttgcgacaggtcgatgccaatgtcgttcgcctccagcgtgttgccctggatgaggacgtcctcgcacaccgggccgccgtagtaggccccacccgcgacgaggatgccggccgccacatagccggtccccgtatagacgttgccggtgacgcggttgcccagcacctgtcccgtggcgccgaagctcaactggatgccattcctggcgatgacggccgacggaccgccgccctccaccacgttgccctccacggccacgtccacccggcccgaggccacgatgccccccttctggtagcccacggcgtggttgcgcaggacctccacctgaaccacgcgggacgcgtcctgggcgtttcgtacctcgatggccacgccctcctggcaaccgctctcgcccgcgccctggtgcagcgcgcgcacttcgctatcggtgatggaaccgctcgccccgatgaatcggatgccactcaagccggcctcgcccgcatcacacgccaggtccgacaggccgcgcgccgccaccgtcacgtcgtggacgtgggccgtgtctccccggttgcgaagcacggcaccctggaagcggccgccttcggggtccaccgcagtcaccacgtgcccggcgccgtcgaaggtgactccgtccgggatgtacagcgtgccctccgtcgtgcagtccgccgtcaacgtcacgcggtcgttctcccaccgggcggagcagggaggaaacgccccacagcgccggtcatcccaccgaatccggaacacgtgcgtcgcgctcatccccgagacattcgtgacggtgagccgcacggagggctccacacccgccgggatacaggacagcgcggaccagggcacctcgctccgcgtcccgtcctgggtggcggttcccaggaggccggtgttcgcggaccactggaaggtgagagcctcgccgcgcgggtcctccgccaccgcctggagcaggacgggctccgcgctcacggcctccgtccgagattgggccgtggagacgatgatgggcggcagccgctgcaccacacatacgtccaccaagccgacgtgctcaccgcctcggccatcccgcatcgtgacgtggaactggcacgcgccacaggctcccgagggcggcgtggacggcgtgaagcgaggcgaccgcgcgctcgcgtcatcgaaggtgccttcgcaactggccgtccatgcgtaggtgagcgtgtctccgtcttcgtcccggccttccgcctggagttgcagggagtcgccatactggacctcgccagaagggagggagcccagctccaccatcaacggccagcgattgaaggcggccacgctgtccgctccgaagccatggtcccgggccactcgcacggggaagtccagcgtggccccctggcccaccgcgttcgtcaccaggagcgtcaaggtcacgaagccggacgcctctggcgccgtccagacgggcgccacggcgctggcgtcgctgaagcttccagccgaggcccgccaggcatacgtgagcgccccatccccggacgcggcctccgccaccgcgcgcagcgccacctgcccttcgggccggacctccgccaacgagcccactaccgcgtcaatgaacggcgctccgggaacgccggagacgggggctcgcgggaccaggacgaccagcgccgtccggtgcgcacctatcaccacgttcgggacgtcgatgtgcgccagcacctcaccgccatcacctcggacggtcgcgctcgcctcagccgctcgtccagaggcaatccgccgcaccagcccctgccacaggccgtcgccgccagagagcaccgcgcccgcttcttctcctcccacgggtctgagcgtggcacggacctccgtgacgggcccgggcgtcagcgtgcgtggcagcaccaccaccacccgcgccgacgcggagggctccagttggatgggctgcgggtcatccaggtgacaccccgccgtgacgagtagcaacaacacgcccgcgaggcgccaggggttctgcgtgtccaagaacgtcatgacggcatcctccggcgggaatggtattcgaaacgttaccgggagcctcccggcggcgcgaggcccctgcctcccatgcaacgcgtcagcggaccttccagggagcccccctgcggggcaccctcccgtcaactgcgcgacgtggacgctcgcggcaccgcgtcaagcgttgccagggcctgtcccccatgctcgagcggcccgactgaaggcccgcccccagcgccacgccctggcccggcgcgcggttcccggggcgccatcctacctttgccccacccgcgttccgtcgcgcgccaatcacatccaccacctcctggacatctcacctggacccgggcaggggcgactatccacatccagcgccatcgccatccgtggagtccatatgacgctgcacgacttcacactatcgagtccctctcactgagcacccgctcagagagaggagcgttcatgagtcgaaatcgatggcgatgtttcggaagtcttctggttggaaccctgtcactgccagtggtggggtgctcgggcgaggaacccagtcacgaagaagtccacaacagccccagtgaggacgtccacacggcagcgctgagcacggaatccccccaagagggcttccaggaccccacctgcgggtacattccctgccctgtcttccagaacggaaacgttctgacgctggcgggcaactgcgccacctactccaccctgcgcattccggatgggtacctcctggatggggctgggcacttcatcatcgcgctggacccccctggagaccatttcaagggccccatcgcgcgcaactgcggcagcagcgcgttctacatgaacctcaggctcatgttgaaagggctcacggacgtctgcgacacgggggatgacgcgctcgtgggcatccggttcgacaatgcgacgggctccgtcatcaacacccagattttcaacatccgccagggagacggaaccggaggctgccaggagggcaccggcatcctgattcgcaaccagggcccgttgagcccgacgcaacacgtcggtgtccagaacaatctcctgctgggataccagaaggccggcgtcgtggcggttggcgatgtcgtggtggacatcaccaacaaccgggtggtgggctcggggcccatcggcaacgtcgcccagtctggcatccaggtcgggctcggggccaccggaagcattgtcaacaacctcatctccgggcactcctacaccggcgagggcgtcgccagcggcatcctcgtctacggagggccgatgtacggaggcccgctgtccacggacgtcctcattcaaggcaaccaacttttcaacaacgacatcggcgtctacctgtcccagggcaacgcggatcaaagccctccggcggtgctgacgaacatccaggtcgtggacaacgtgctccacttcgacggggtgacgaatggctacgtctaccaggccggaatctcggacctgggaacgggcaatgtcattcactccaacatcatcaccggcgcggggtatgacccggccaccctccccggctccaccttcgccgtggatgtgctcgcgggtccggcagcaagcctcgccttcctcaatccgcctcggcaggtccccgtgggcctctgctccggcccgctcatcgtccagacccaggacgtgagcgggaacctggtcgttcccaccacgacgggcttcaacatcacctcagcgggtccggcctcccccggcatccagttctacgccgaccccgcctgcgcgggccccgcggtgacgacgctcgacctggggaacccccaggctcagggccgcttctacttccgagcccccacgccgggcagcgtcaccgtcttcgtctggaattcggactggacacaaggccagacgcagcaggtcttcatccccctggaatcggcgccaccgcccgccggcgccctacggctggagctgcaacactgacgggatggcccgggggccagaaggnncncccacgccctggccacccgggccgtgggcggccatatacgtacaaatacaacttaccatcagtacatgccggaacgaggggacctttcgtggcc

SEQ ID NO: 1105 - DNA, 16782 bp, Myxococcus xanthus
  unsure (1)..(16782): unsure at all n locations
cgagcgggaaggtcatcagctcgcattccagagtcggctcgggtcctgctggagacggcgcaagtgccgctgcggcgcccgggagagctggtctcggaccatgtgcgcgccatcctgcgtgtccgcgctgcggacctgctggggctgcaggacgtccagggactgctggagggactggaggcgcaggcgcccgtgctcgtgaaggaggcgctgcagaaggtgccgctgccgctgctcacggatgtgcttcgcaagctgctccaagagggcgtcagcatccgggacttgcgagccatcctggaggcgcttgtgtcgccgacgacggaaggggatgccgtcgcgctcgcggagcgctgtcggcaggcgctgcggcggtacctcagccacaagttcgcgcccaccgggccgctgtacgcgtacctcgtggacccggaggtggaagaggtgcttcgcggcatgggcccgcgagggctggcgcccgacccggagcgggtggcggaaatcctcgaaggcgtgcggcaggtggccaccgagggacgggcggtgctgctcaccgctccggatgtccggcggcccctgcgcagactgtgcgagggcgcgttcccggatgttgcggtgctcacctatggcgagctggatggggccctccagattcgccccatcggccggctgtcgccggtggcggtggggcgctgacggaggtgggcctagagccccgtgcccgtgttgcccggccccttgctttcgggaagcgggggcagctccgtctgggcctgctggggcgccggacggttcacgcggtcgcgcagctccttgcccgtgcggaagagcaggccgcgcttgggcttcaccgggatgacctgtcccgtcttcgggttgcggccttggtagccctggtagttcttcacgtgaaaggcaccgagcccgcgaatctcgatgttctcgccgcggcagagggcatccttcatcgactcgaaaatcgtctcgatggtggcctcagcctgcttctgcgtcacgcccctcttggccacgaggatgttgatcagatcggacttgagcatcggacgctcccgcaaacccggtgaccccttggaaacagggcgctctggcccgtggtcgaatcctgaaaacataacagaacgcatccttcgtgcaagcagggtgagcttccaaccacccagaaacgctacggatttccccctgcggccaccctgggtggtggggcgggagcaggctcggccagccctgggcggagcggcaccaccaggtccagccatcgggtgcgacgtagcaggtcgacaccggcgcagtcagctgcctggaagatgggctccatctgttcgaatccgggcgcccggggcccgttccatccctccgcgccgccggtgagcatcacgccgtgcacggcgagcgtggtatccgccagcgtgaggacagccgggtccttcgcgggacgcaggccccctttgcggaggcgctccagcagctcggcggtcaccatgcggtcgacgacctcgtggaccagcgactcggggacgcgcagccgcgtcgccagctcgcgcggcgagggaggcggcagtccgtccacccaggccagggtggcctcctgggcgacacgggcggcgaccagttcgtgcgcgcgcgggtggcttccaaaagcgaagagggagtgccggaaggcggtgtgttccacggcataggagagccgggcgccaaagagtaccaacagccagctcacgtagacccacgccaggaacaacgggagcgcgccaagcgagccgtagagggggttgtactggaagctgcgctccgcgaatgcggcgtacacctgcttggcgaacgtccaccccaagccggccaccagtcctccggcgagcgcggaccggacgcggacatgcgcgtagggcgtccagtagtagagcagggtgaggctggccacggtgacgagcgtggtgcccagcaggatgaaggcgccggcgtagggcgcgtggctctgcaggaagacgcggaccttgcccgtcccggagaaggacagcgcgaggaagaaggggcccacgagcaggaggcccgagtagatgagcagccggatgcgccacggccgttgccgccggatgccccacagctcgttgacggcgccgtcgagctgccgcagcagcgagccggcggacaggagcaccgccaggaagcccacgctgccaatggcgacggtgtgcgtggggttcaggaaccggtcgaggaactgggaggacttgccgcgcaccccggggttgagcacttcgctgaagaaaaagcgcagcttctccttgaactcgtcctggtggaaggcggtcagcagcacgagcgccaccgtcaggaggggcaccagggagaacatgctgacgtaggtcagcgcggcggcccgaagccggagattctccccgcgaaagccctgggccacagtcttcgcggccaggaaggtgtccgtcgcgaacagccccacgggtgtgtgctgtaggggcgcccagagccgggtggcccgctcgcggaagtaacggagccacgggaggggcgtcagcttcaccgattccctcaagaggcccggccgcgccagtcgcgggcctgacggaggcggagggaacgctgccccacacggggcgatacgtgctcggagcgtgaggacatcatccgtgtgacatggccggccgcgcgaggcgggaaccgccttggggcatggaggctcacgctagccaatccgcggccgccagtgccagcccacctcggtttgaggtggcttgccggcgtacacaggccgacacggtgcggggcttcgtgtgcactggccagcgacttccgcctcgccagcgccgccggctcccagccccggccttgaaaccaccggcagggcagggcgccgacgactgaccggcggaaagaactcaggtcgtgccgcccgaaggctccgacccaccacccgaggctggaggcggaggcggcgtcgagccacccgcgttctcgcctccaccagacgtgttctgcgaaccgccgcgctctccacgctcgccgcggtcgccacgccggtcgccacgctcgccgcgctcggagcgttcaccacgctcgctccgttcgccgccgcgctcggagcgttcgccccgttcgccgccgcgctctccacgctccccaccgcgctcggaacggtcgccccgctcgccaccccggtcaccccgagggcggtctccgccactccggccctcgcggcggccctcgcgacggtctccgccccgctcaccgcgctcggagcgttcgttgccccgctcaccaccccggtccctgcctccaccaccgccgccaccaccgccgcgccggccctgctcctggcggccgtagcctccgccattgctgtcgggcttgcgctgctgcatggccagctcgccatcacccgagccaggcgacgaggccaccttgtgctccggtcccgaggccgagcgtccgtaaatgtcgtactgctcgcggaggtagttctgctgcgccttgacctggatggacttgttgtaccggtccataaggtgccgcagctcgttgcgctcctcgacctggagcaggcgcgccacttccgccttgcagatgatgaccagcgtggagtccttgtagcccggcgcttcgcggcgaatctcccggaagatttcgtaggccacggtggtggccgtcttcacgaagccgttgccgtcgcagtacgggcagtcctcgtggagcatgcggccaatggactcgcgcacgcgcttgcgcgtcatctccacgaggcccagctcggagatgcgcagcacgttcgtcttggccttgtcgcggcccagcgcttcctgcagcgccttgaagaccttgtcgcggttctgcgccttctccatgtcgatgaagtcgcagatgatgatgccgccgatgttgcgcagccggagctggtagacaatctccttggccgcctcgacgttgatcttggtgatggtctcctcgaggctcttcttgccgacgtagcggcccgagttgacgtcgatggcggtgagcgcctcggcctggtcgatgatgaggtagccgccgctcttcagccacaccttgcgctgggtggcgcgctggagctcctgctcgatgccgtacgcgtcgaagacggtgtcgtcgccctcgtgcagggccaccctgtctcgcagcgccgggtcctgcgcggtgacgaagccgaggatgcgctcgtactcctcgcggtcatcgacgacgagcttctccacgtcgtgcgcgaagaggtcgcgcgtggcgcgcaggatgaggtccaggtcggggtgcagcagaccagggccgccgcgcttctcgttcttgcgcaccacctggttccacacctcgatgaggaaccggatgtcgctctcgagcttctcctgcggcacgttctccgcgacggtgcggacgatgaagcccgtcccgggcgggcgcaggcggtccacgatatcacgcagacgccggcgctccttctcgttggagatgcggcggctgatgcccacgtggtccaccgtgggcatgaacaccaggtgccggccggggatggagatgtgcgaggtgagccgcgcgcccttggtgccgatggggtccttggaaatctggacgacgacttcctggcccaccttcagcaggtcctcaatcttgtcggtgcggcgcggcttggccttctccttgtcttcgtgcttgtcgccccggcgcttctcctcctgtggccggcggcccttgtccttctcgccgcgctccttctccctgttccggggctcacgcgcctcacgggcctcgcgcggcgtgcggcgctcgccggagacctcggacggcttcgcagcctgcgcgccctcctcagcgggcgaggggatgatgtctcccagcgcggcggccgaggggggagggggctcgacgggaagaccggtggcctcgccctcggccgcttccatggccgattcagcgggcaccgccaccccggccgcgtcgggctcggacgccgcggcaacggccagcgccgcctcgggcgactcgacgttcgcgtcgggctccacggcggcctcggccatctgaggctcggaggagggcgcggcctcggcctctccacctgccggagcaggcgcggcctccacgggcgccgccgtggacggctcgaccgcgacaatctgctcgggcgtgacgggctgaacggccacctcggcggccaccaccagctccgacccggcggccggcgcttcctccgcgggcgccaccggcgtctccgcgcccggcggcgtcaccgtcggggcgttggcggccagctccagggcggtatcgcgcggcagggactcggtgggcgccgcgacaggctcgaaatgggcgtcctccggctccggctccaggtgacgggggggcgcgtgccgggcggcggcctccgcggcctcggcctcggactcgtccgggacgtccggcgcatcctcgtgctcaccttcggtcagctcgaactgcgcgcgcgcgaagtcagggtcgtagacgacgtcactgacatagaggaacgcggccttctccaggccaatgtccacgaaggcggcctgcatgcccgggagcacccggacgacgcggcccttgtagatgttcccgacgacgcccttgtccttcttacgctcgaggtagaactccgcgatgtgtccgccctcgacgagcgcgacgcgcgtctctcggcccgcggcgttgatgaccaggatgctgctcatggatgaatcctgctggcgcgcgcggtagggcggacctcaccggacgggcggcggcgagacgccgcgcctccgagcgcgctgcgaagggagaggcggcctccggcgggcctacagcgagcgacaccggcccgggcatgccgggtgcggctgggggctcgttgtcgaggaccgaggggaccaccgcctgctcctccgagttcattggcgccccgcattgcgaccggcaccgtgccgggcgaggccttgtcttcacaacgcgttcgagcttccccacgacgcgcgtgccgcccgctcttctatccacacccggtcgatgcccatcgtgggccaccttgggggggcgactggagcctcggtgcagctgacgcgcccggaggagccgggaacgcaacccgtcaaaatccctaccagacgtcgacccccgacaacgcggggcgtcacacaaccgtccagaaacacggggagtttttcacggccccccaggtgtgtaaagccgagaaacggcttccatccactgtcaggcagatgccgggcggctacccggcagggcatcaggcctgggcggtggctcgcttgcgctcccctggcttgtccggtcgccctcggggccgcctcaccagccggaggcctgtccaggtggcgtcgatgatgcagattttgttgtccaccagaccgatgtccagggccgcgtggcggacgaagtcctcggagaggtcccggcgggcaccctcgccccccggccagcacacccagatgccgccagtgagggccatggcgcgggccagggccggcagccgctgcaccaactcctgggggtcctcggtgaagaagaggatgacatccaggcccgtcaccgcggtgatgaggaactccaccccatccggcagcgggttgagcttctgcacgaagccccgcggcgggttgatgacggagaccttggacccggcccggatacccagcatggccgggagagaggccagcgcgtagggcgtcatgacgtgcgctccacgttgaattgactgaactcgccggtggccttgctgtccgtgcgctgaacgcccgaaacccgggcctgcgccggaccgcgatgacaccagtggatgaattcctcgagcacggcgggctccccttccacgacggcctccacggccccgtccggccggttgcgcacccagcctgtcaggcccaggcgtgtggcttcaacgcgggcgctctccctgaagaagacgccctgcaccttgccttcgatgcgcagcgaggctcgccgcgtgccactcatggactgccccatcctctaggcgttcgtctgcagcatctgcaggaacgcctgctcgtccaggattcttaccccgagttcctgggccttcttcagtttgctgcccgcatcctcaccggccacgacgaaatcggtcttgcgcgagacacttccggcgaccttgccgccccggcgctcgacctcttccttggcctgctcccgcgtcatacccgtcatcgcgccggtgagcaccaccgacttgcccacgaaggggcctcccgtggcgacctggggcgccgcgggctggacccccgccgccaggagcgcgcggatggcctcctgattctggggctcctggaagaaggtgtggatgacctgggccatgatggggcctacgtcctttacgcgggagatgtcctccaggctggcctcgaagagcatctctgaccgggggaaggcctccgccagcgccttggcggtggcgtcacccacgtggcggatgcccagggaatagaggaagcggcgctgtgtggtctgcttggagcgctccagtgacgcgatgaggttgtccgcgctcttgtcgcccatgcgctccagcgtcagcaggtcctccttggtgagcgcgtagaggtccgcgaacgccttcaccctgccggtggacaccaactgcgcggccagcttgtcgcccagcccttcgatgtccatggccaggcggctggcgaagtggcggatcttctccaccagttgtgcggggcaggaagcgcccgtgcagcggatgatggcgccgtcctcgtccttggtcgccaccgcatcgcagacaggacagtgcttggggaactcgaagggcgcggagtccgcggggcgcttggacagcaccacggagacgatttccggaatcacgtcaccggcgcggcgcacgaagacggtgtcgcccttgcgcacgtccttgcggcgcagctcgtcctcgttgtgcagcgtggcgcgcgccaccgtgacgccgcccaccttcaccggcttgaggtgtgccaccggcgtcagcgcgcccgtgcggcccacctggatgccgatgtccatcacctccgtggactcctcctccggagggaacttgtaagccaccgcccagcgggggctcttggagacctggcccaggcgcttgcgctggtcctcgtcatccaccttcaccaccatgccgtccacttcgaagggcagctcgtggcggcccttgagggaggcgtcataggcctggcgcacgccctccaggccctcggcgcggcggtactggttgatgggcaggcccagcgtcttgaggtactccagcttctcgatgtgcgtcttgaagacgggcacgccttcgcccgggacgcattcgtagaggaacacgcagaggggccgggcgaccgtcatccgcgggtccaactggcgcaggctgccggcggcggcgttgcgcgggttggcgaagagcggctcgccttcctcctcgcgcttctcgttgagcttctggaagtccttcttgcggatgaagacctcaccgcggacctccagcacgtccggcaccttcacgtcgtcctgggggaacagcgacatgggcaggcttcggatggtgcgcaggttcgaggtgacgtcctcgccagtggtgccgtcgccccgggtggcgccctggacgaacgcgcccttttcgtaacgcaacgcgatggcgagtccgtccagcttgggctcgcagacgtaggcgatgcccggcaggcccaccagcttgcggatgcgctcgtcgaactcagtgaggccctggtcctcgaagatgttggccagcgagatcatgggcgcccggtgcaccacctcgccaaactcctcggccgccgcgccgcccacgcgctgggtgggcgagtccggcgtctggaggctcgggtgcttcgcctccaggtcctgcagctcgcgcatcagcttgtcgtattgcgcgtcgctgacctcgggcgagtcgaggacgtagtaacggtagttgtggtgcgccagctcacggtggagctcacgggctcgggctgcggctttctggaagtcgtccacggttcgcggtccttactccaaaacacggcgcgtcggcgcgtgcctcgaaaggcggccactctacggttcccgactgacaaggtccggtcgtcgtctccgcgtgaaccgcgtcctgagggggaagcggacctggagggccaggtgttattgctggcagtggcgatgtccgcgcgccgacccgccgggtcctcaggtccggggcaggggactccggaaggcccgcacggccggctggaaatgagggccccgggggcgcgtgttgctcatctggaagcgacgcaaccgtggccctcaagatgccttgacaggccaggagggggtcaataacgtcccttgcggttcatggcgcaggtgtattccgacggcgccgacgcttctcccaaccacaaggctcacgcccgcgcagtcccttcctgggattccggcggggccgtcctcctggaaggtgcttccgagggccgcgcggacgtctccccccgccattccacccgtccgagtcctcgggcgcttcattcctcccaagcgttacagacatgcgtaaagcccgtacttcgagagagaaggctgccgacaccgatgtcgccgtcgaggccgacgcggagaagccacgccgcaagcgcgccgcgaagacggtggagcgggacgaggccgagaagcccgccccgcgcgcccgccgcagcgccgcccgccgcgacgaagagcccggcgccgaggtcgaggaggctcccgccgagccaccccgtcctgtgctcacccccatctcccgcccggtgcgggacgacgacctccaggaggcccgtatctccggcgagtccgaggagccggccgcctccctgccgcccccgccggagtcccctgagactcccgccatcacggaagtcacccgggatggcgagcccatgcaggtcatcaagctcaatgacctgaagcggatgaagatcaccgacctctcgaagatggcccacgacgtgggcatcgaggggtaccagggcctgaagaagcaggacctcatcttcgcgctgctgggcggcatcgccgacaagcgcttcgaggtccacgcggagggcgtgctggagctgctcagcgacggcttcggcttcctgcgcagtgcggacagcgactaccagcccagcccggacgacatctacgtgtccccgtcgcaggtgcgccgcttcaacctgcgtcccggcgacacggtgacgggccccatccgccagccccgcgagggcgagcgcttcttcgcgctccagaaggtggacaaggtcaacttcgcggacccgatgtcggacgcggcgcgcgagcgcatcctgttcgacaacctcacgccgctctatccgacgcgcaagctcaagctggagcatgagtcgtcggagatgaccacgcgcatcatcgacatgttctgccccatcggcctgggccagcgctgcctcatcgtggcgccgccgaaggccggtaagacggtgctgctgcagaacatcgcgcacgccatcagccgcaaccacccggacgtgtacctcatcgtgctgctcgtggacgagcgcccggaagaggtgacggacatggagcgcagcgtgcgcggcgaggtggtgtcctccaccttcgacgagcccgccacgcgccacgtgcaggtggcggagatggtcatcgacaaggccaagcgcctggtcgagcagaagtacgacgtctgcatcctgctggactccatcacccgtctggcgcgcgcctacaacaccgtggtgcccgcgtccggcaagattctgtccggcggcgtggacgccaacgcgctccacaagcccaagcgcttcttcggcgccgcgcgcaacatcgaagagggtggctcgctgaccatcatcggcaccgcgctcatcgacaccggcagccgcatggacgaagtcatcttcgaggagttcaagggcacgggtaactccgaaatcgtcctggaccggaagctgatggagaagcgcatcttcccgacgctggacatcaacaagtccggtacgcgcaaggaggagctgctgctcggcccgggcgacctggtgcgcatcaccgccctgcggcaggtgctccacccgttcacccccatcgacgcgatggagttcgtgctcaaacacatgcggcccaccccgtcgaatgcggacttcctcgggtcgatgaaccggtagagattgtctgagcaaggagtgtccattgctcagacacggacgtttccgcctgctcaccctcgtgctgggggtgacgctgggcggtggtggagtggggtgtgacggtttggaagacctgccgctgggggacgtgcccccggtgctgtccgacaagacctgttacacggacgacgactgcgtggccgacgcgtgctgtgggctggggaccgccgtcacgcacgcggacgaaggcccgacgtgtcgcgccccctgtaccagtggctgcccggagggctccatcgactgcgggcgttgcatccccacctgccgtgaagcgcgctgcgccgccgcctgccagtagggctcaggcggcgggcggctgacgttcagcaggcagcggtccgggcgtggccagggccaccgcgggcgcgggctgggccttgagccgcgcgtagtcgaagcacgccaccaggacggacgccacgggcaccgcgaagagggcgcccaccagcccgaagagccgctctccggcgatgagggagaaggcgacgatgacggggtgcaggtgcgccgcctgccccatgattttggggttgaggaagtacgcctctaccgcgtggatgccgatgatccacgcgagaatcgccagccccttctggaagccgtccgccagcgcgatgaggacgatgggcaccgagctgaggatggtgccgaaaatcgggatgaggctgaagaaggtggcgatggtcgccagcaggaacgcgaacttcacgccgaacagcagcagtcccatgaacgtcaggatgccgttgacgatgcagatggtgacctgcccgcgcaccacgccggacaacgagcggtcaatgcgctccagcagttgccgcgcgtcgatggcgtactccggcggaatcagcgtgccgaagtagcggcggatggcgtgcgcgtcgatggagaagaacgcggccaccatcagcacgaagaagagcatgaagacgcccgcggccacgctggtgacgatgctgcgggacacgttgacgatgtcgcccaggttctcctgcaccaggatggacacgcgcttcaccgcgtcccccaggaactgctccaaatccagcgcgaagccgaaggtgccgttgctacttccagcgtccgcgccctccagcgcgcggttggagagcgccaccggaatgcctcgtgtgctgagccacgtctccgcgcgctgcgcgagctcctggacgtgctccggggtgagcgtgttggcgaacgtcaccgcctcacggctgacgcgggacagttcgcggtagagctgcggcaccagcgcgacgatgaagaggtacacgcccacgaagaagccggcgtagatgagcagcagcgccgtccatcgcggcaccggccggccggccaccttcacccgggagatgcgccccaccagcggctgcaccaggtaggcgatgagcgcggcgcccgcgaagggcatgaccaccgaccggaaggccaacaggaccagcgccaggctcagccacaacactcccaagaggagcaggcgcttgcgtcggttggcggaggcggtggagtccgaaggctgctgcgacatgccgtctggcttacggcagtgccttcccggtgacaagggccgccacatgagcgccccgccggcgtcctgggagggggatggtgcctgttcaacatttcaccgagccacccggcggcggctcagacgccaggcaccgggaaggcgccgagctttgactggagccgctccaggcagtcgcgcatgtgcttgcgcttgacgcggccctcggtggcctcgcccaggcccagcatctgctcggtgagccagcggctgaggagcagcaggggcagccggtcgctcggcaccaggcctcgctccaggtagcgcttgttgcgcatgtagtcgtcgtaggcgtccgtttcgcgcgccagctcccactgcgccagccggaacgcctccgtgtagacggcccgggacggccgcggccggggctccgtgaagagagtcgcgaagtggccaccggtgtccaggtccagctcctcgacgggcggcggccactgcagcaggtccttgtgcagcagcttcgccacctcctccaggaggtgctccagcagggaagtcggtttgaggtcgaagaggtggtcccagcgagacgccatggcttcttctctacctcaaatgccggcgtcggccgtgcccgcgtcggggacgcccgcgtcaccgtcgcccgtgcccgcgtcggtgccgccgtcgcccgtgcccaggccctggcagcaggcgggcacctgcgcgaagtagagcgcagactgggcgcagggcacgcggatgtcgcggcggtaggcgctgcagccggtggcgaagcggtcgctcccgcaggtgggcggggccgcggtcgctgggtcgcaggcctccagggtgacggcgcacacggcgcgggagcggtagaagcgtgcgtcgttgcggtcgccggggacgacggtgcacgtcgtgcgctcggtgcacgcctggaggatggggccgctggagcacgggcccactttgcactccggctcgcagttgagcgcttccgagtcgtcacagcggggcgcctgggtgcacaggtcttccgagcacgcggtggtgagcagggcgaggagcagggtcggcagggcaagacgggacacggagggcctctgtcaggtcaggtgaatcgctcgaggaagttcagcaggattctgcggcccgcgggagagggtgtgaggcccgccaggagctgacggacgtattcgccgggcgcggcgcctcgcgccacggagtcccgctcgaggccctcccagcgggcctcgatgacggcgcggagggtgtccacgctggcctctggatagaactgcacgccgcgcacggtggggcggaaggccagcgcctgcgcggccgtgttcgcgttgcccgccagaacctgcgcgccgtcggggaggtgcgagacgatgtcctcgtgcgtcgcctgcgcgatgaagcgctccggcacgccgtcgaagagtgggtcctgcttgccggcctcggtgagcgtcacctcgacgctgcccgtctcccgcccctggggattgcgcgagacgcggccgccatacgcatgcgccaggagttgctggccgaagcacacgcccagcacgggcgtgccccgctcaccggcctccaccatgaagtccgcggcgcgcttcatccacggctcgagcgccgtcaccgacagcggcgagcccgtcatcatcaccgcgtcgtagccatccgcgcgcgtgggcaagggggcgtcccggtgtgccagcacgatgtcgaagcggtagccggacagtccgatggcttgcagaaaccaccggtcgtaatcgccgacggagacgcgcacggcctcggccgcctcaccggctttcagcaagaggacgttcttcaccgccgtaggttgccgcattgcgtccccattcctaccgtgtcgtgccccgcgtgtccgttcctggccagtcgcagtggaacgcgcccgtgtgcttcgaggtacccacatgaccggcgcctgttggctcaccttctcattcctcgtccccaggctgagcatggccgggcggcgggtggagccccaggtgtcgggcgtttccagcaagagaggggattgaatcgatgccaacccgacccaaggcgaaggtcctgacccaccctgccatggctcgccgggttcgcggcaaggcatcgcgtgcaccggcgcgaggcccggcggcgcgggacgcggcgagcgtggacacgctgcgccgctggctggatgagaagggcgtccagaaggtgaaggtgggcgcggtggacgtcgatggcgtctggcgcggcaagtacatctccctggagaagttcctcagcgccgccaaaggcggcctgggcttctgtgacgtcgtcttcggctgggacttgagcgacgacttgctcgacaacacccaggtgacgggctggcacaccggttacccggatgcccacgcgaaggtggacccgtccaccggccgcgtcattccctgggagccggacaccgcggcgttcctgctcgacttcgaaaaccccgacggcacgcctttcgaggcgagcccccggcagttgctccagaaggtggccgcccgcgcgcgctcgctggggtacctgccgcgcttcggcgcggagtacgagttcttcatcttcaaggagcagccgcagagcctgcgcgacaaggacttccaggggctgacgccgctgacgccaggcatgttcggctattcgtggctgcgcacgtcgctcaacgcgccgctggtgcatgcgctcatcgacgggtgcaacgccttcggcctgggcatcgagggcttccacacggagacggggccgggcgtcttcgaggcggccatccgctacgacgacatcgagaagtcggcggacaaggccgcgctcttcaagacggtggtgaaggagatttgcgcccgccacggcgtcaccgcgtgcttcatggcgaaggtggacgcgaagctgccggggtgctcggggcacgtccaccagtcgctgtgggatttggacggggagcagaacctcttccacgacgcgaaggcgccccacggcatgagcaagctgctgcgccactacatcggcgggcaggtggcgctgatgccggagctcaccgcgctctactggcccaccatcaacagctacaagcgcagcgtggagaatacctgggcgcccaccaccgtgacgtggggcctggagaaccgcaccaccgccatccgcgtcatcggtgagagcgccaaggcgatgcgcctggagtaccggcagttgggcgcggacatgaatgcgtacatcggcatggcggtcagcctggccgcgggcctgtggggcatcgagaacgaggtggagcctcccgcgccctgcgagtccaacgcctacgcgaagaacgacgcgccgcccttgccccgcaacctcaaggacgcggtggcgctgctgaagggcagcgagcgcgcgcgggagttgctgggctacggcttcgtggaccacttcgtgcgcacgcgcgagtgggaggtgcgtcagtacgagcgcgccgtcaccaactgggagttggagcgttacctggagctcatctgatgagcgcaaatgaggcagccgtcatgaagccgttcgacattccctccgagccgcgcgtcaccgagatggcgtggcccacgcgcatcgtcttcggcgccggcgcgctgctgcgcctgcccgcgcaggcccagcgtctgggcatccagcgcccgctgctggtgacggacgcgggcgtggtgaaggcggggctggccgcgcgcgtggcggacgtgctcaatacggcgggactggcctgtgaagtcttcgaccgcgtggagcccaaccccaccgagcgcgacgtcttcgcgggcctggaggcgtaccggagccactcctgcgacggcatcgtcgcgctggggggcggcagcgccctggacgcgggcaagctgattcagctcctcaccacacacgagccgncgctcagccgctatgacgacgcgaagggcggngaccagtacgtgcgcgacgacctgccgccgctcatcgcgattcccaccaccgcgggcaccg

SEQ ID NO: 1106 - DNA, 14638 bp, Myxococcus xanthus
ccaatttcgcaggccccttcagcaagcaggtggaaccatgggccggtaatcccgcgtgtgagcgtttcgtacccatgctgtccccgtacgtcgacggagagctgagctccggcgagcgcgtcaacgtggagcggcacctggcggcctgccgggactgtactggacgggcggcggaccttcgcgcggaatccgggctccttcgggtgggcctggacatggccgtggacgacgtggacttcaaggacttcacccagcgcgtcatggcgcgggtgacgccggacaagccgcccctcatggagcggctgaagctggcagtgtccgaaatgtttctctaccagcgcaccgcgatgatttcgtcgctggccaccgcggccgtgctgctactggtgggggtccccctgctgacgagcgaccgggcgccggtggggtacgcctccgagcgcatgacggtgaagtccatccagccctaccgcaacgcccaggtggcgccggtggtgatggagacggacaatgggggcaccatcatctggctggtggacgaggactcggacgtcctgtctcccggcgcggagaagggtgagcggcaggaccagacaggtgtcggtcagccagacgcaagcgggcgcaacgtccccgcgcgcccggcccccgacgcccccaggccgtcgggaggttccttgtgagaagacacgtgtcgtcgggccggatgctgtgggcgctgctggggctgggcctgttgctgcccatggccgccagcgcacaagacgcgaaagtccaggtccaggtcgaggtagtgctcgcctcgaagaagggcaccgaggtcgacccgcccgagctggagaagatgaaggagcagttccagaagcagaacttcagcttcacctcgttcaagcgcctctcgaatgaggtgctgacggtgagcgcgaagagcgcctccgaggtgaagctgcccaacggcgccaacgcgacgctgcaactgcagggcatcaaggacggcacggccacggtgcgcgtggccattccccgtcagcccacgctggacgtggagctgggccgccagggcgccgtctaccagaaggccggtaagtacgtgggcggggagctcatcctcgtgctctcccctcccgcgcggtagttcccccagcgccgcctcaggcggcgcgggcttccccgtcctcctccaggacgatgatttccaggtcctcttccatctccagggggaggacttcggcggtggcggtgtgcgcctggaggcccggtgcgggggcctcggcgtgctcccgctccaggttgacgcgcagcccgtcgaacatggtgtcgaacgccgcgtagatgcggtccaccatggccagggcgtccgcgcgcacctccggggacaactgcatggcctccagctccgccgccagctcctgttcgaacatggcgtgctgcgcttcggcctgcatgtggtggtcggagaagtacttcagccggtcgtccgcgccctgcgccgcgctgatgatggcggtgcggctgaagaagacatggctggtggactccagcgcccacagcaggacgatgcgcagccggtcatccaccgggcggtacacctcgctgatgatggcgtaggccgcgtcacgcgtcttcacgtgcgcgcggccgtacatggtgccgatgctcagcgagccgcccgtgagcgcggagatgtcgtcctcgaaccactggtcatgcccgccctcctcggcatggtgccgcgtggccagcgccttgaggtgcgcgtcctggatgaagtgtgcgttgaggcgcagcacgtcctggaacgtcatcacccagaaggtcaggcgtggcgcgaaggccatcacctgttcaatggggcggtccatccgcatgtcggagaagaaggggtgcgctgcgaagcgcgcctcgcgcacggcgatgtgttggagcacttccttcatgatggacctccctggggtgtctggtgatgcgccgcccccggcccgctggcgggactccgctaccaattgatgctgtacgtgcaggcactgtcgccgcgccgccggcaactcttggcctcatgttcaatacgcacccaaagtgaatccttgggacggaaccggtcgccaatggcttcgatgagccccaggtccaggtcacacggataggggttgtcacacaccatgcgagcgtttcgcttatccaccggctcgaagcggtagccgccgatggcacccttgccgcggtggttcatccggtatgccatgtccaccgcgcgcagccccttctccagcgtgtcgatgtccggcgggaagtgcgcgctgtctggaatcttccggccaatggttctcaccgtgctgggaccaatcttgtcgaacaccagccggaacgacttcagcagggcgggcatggggtaccaggcatccgccttcagcggcgcgatgccgttctcccccaggatgcgcaacgcgcgtgactgggcgagctccatgccgttgacgatggcgagaatcgactggccgatgacttcgatgccctggaacgacatgggctgaagggtcggtgcggtggcgctgatgggagtcttcaattccatacgggtaacgccctcgtgaggagtgacacgtattgaagcggctttttcctatattttcaaatagacttacatgtctgtaattttccggaagattcgatatgggattccccgtggctccataacgacccgcgcggtcggtatgaagccaggtgacctgggtttcgctgtgagtgggcgtgcgctcacgcggcgcgcgggagcgggcatccgtgggccccgtggggcgggatgccccagcggggcaacctgccccggcggagtgccccagcggccggatgccgtcatcaggcctcggggaagaacttccgtcggaagctcgccgggacagggctgaaaaaaagtcagaagtccggtccctggggcgggggggcaggcagccggccttcggaaaatcgcggggttggtgctcggcacgccggttgctgaaggaagcagcacaagcaaccctctcacccttggagacgaaatcatggcgaagactcagaagcgtggacaggtcatccgtcgtgaggcccagcagatggaggtgtcggcagcgagcgcggtgaagggggctggccggggcgcccgccaggtgcaggtgacgctgggcgacctcatcgcggcggccttcgacacggtgggcggcgaggtgaagaaggtggcgcaggtgatgtcctccaaggacatggcggtcgccacgggcaagcacatcgtcttcgtcggctgacacacgccaatccggggcgtgtgcggtgcaggaggacctggcggtggcgccaggtgagggcggccgaggcggggacgggaagggacgcacctgtgagacgcatcatctgtcccgggcggaattgctggacggtggaggaggcgagcgacgcgggcgtactggtggacgcgcgcgactactaccgggagctgtaccgggccgcgcagaaggcccgtcgttacatcgcgatgaccggctggcagttcgacagcgacgtggcgctgctgagaggcgaggaccttcgcgaggcgcgcggcgagtcacggctgctgccgatgctggacgagctgtgccgggccaacccggagctgcgcgtctacgtgctggcgtgggacttcagcctgctgctcgccatggagcgcgagtggatgcagcggctcatcttcaattggacggcgaacgggcaggtgtgcttccgcttcgacgcctccagtccgttgtatggcgcgcatcaccagaagctggtcgtcatcgacggcgcggtggctttctccggcggcatggatgtctgtgattgccggtgggatgaccgggaacaccgggtgcactcggagctgcgctgtgacagtgggagggatccgcacggcccctaccatgacgtgcagtccgtgctgacggggccggtggtggaccgcctggcggagttgttcgaggcgcgctgggcgcactcgggcggcggtgagctgcggctgcccagggtgtctcgggatgacgtggacttcacgccgagcctgccagcgccgctggggccggtggccatcagccgcaccttcggcaagacgctcctcccgccgcagcccccggtgcaggaggtggccatgctgtatctggacgccatcgcttcggccgagcgcttcatctacatcgaaaaccagtacttctcctcgcgggccatcttccaggcgctggtgaaacgcatgcggtcctcctggcggggacggctgcagattgtcctggtgctgccgcggcagccggaggcgctgcgcgaacagttggccatgggcatcgcccaggtgcggctgctgcgcacgctggagcgcgtggcgcacgagacgggacatgcctttggcgtgtactgctccgcggggcacgacgcgcgcaccggcgaggacatctacacgtacatccactcgaaggtgatggtggtggatgaccgcttcctcacgctgggctccgcgaacaccaccaaccgcagcctcgggttggattcggagctgaacctgagctgggaggcggaggcgccgaacgacgcgacgacgcgcgccatccgccgcatccgcgtgtcgctgatggctgagcacgcggggctggagggcctggcggccctgcgcctgctggcggccgcggacagcggactggtggagtggctggacgacgtggctgtcatggggctgcggcgcctgcgcgtccacccgatgtcgacggtgttcgaccagagtccgctgctcaagtcgctggagcccgagcagctcatcatcagacccggagcagtcggtggtgagcgagtccctcttggaggcgctccaccgagctgagaacgggtggctcgccacccgggtcagctggctgtcgcgttgcatggtgggcaggggcactgagcgaacgcacagcgcaatccttccaagcacgcagtgcaaaggctacccgagtaggcaggcaggtggctaccaagggccagcccgccagcccgccatgggacgggcccgggcgcacgggcacgtctggggggtagtccgtcacgcgcggcacgccgccttgtcgacagcacaacttctctcacgcaagggggagtcaccatgaagcttcctctcgcgcccgcagtgacggcgctggccttctggggttgttcgagcaactcggcgaacacgcgcgcggatgacagtgccatcggtggttcgggcacggagacgacggcgcccgagtccgtggacacgtcttctgaatgggatgaccgcagcgcgggtgaggccgcggacgtgacgaaaaacgagcgccgggacaggcaggacgcgcccaccgtctacgacggcgaggccaccggtggcagtggccccggcatgggcgcgggcacctcggtgacgacgccggatggcgagaagtacgacgtgcaggacggcccgctcctgggtggccagcagagtgaagaggcccgcaaggatggcgtgggcggctccggcaacatccagcgcgagccggtggacggcaagtccgacgtcaaggagctcgacgccagcgacgtggagacgcgggaagtggaagctgacgaggttgaagtcgacggcaaccgttgacgtggcgtgaaggtcgcgcgtcgcccgctggcgccaggcgggggcgcgtgtaccgacggtccgtagtggcacccacacgcggatgcagtcacctgcttcgtctcgcgccatggacaggtagagtcgggggacgatgactggcgcccccctcttcgctcttctcgccctggtgtccacgcagtacgacggcagctctaccgtggaggaggtctcttcagaggaggtctcctcgacatcgcggagggaaggtgcccccgtctccgccgcgcggctggatgagcccgtgcctccgggcagtgcccacacgggtggcgtgggcttcggcttcagcggccagttggaggtcggtggcctgagccttccctcagggcctcgcggcggggggcaggacttcttcgcgcgcatctacccctcgttggggctgacgcacggggagaccttcgtgctgcggctgggggcgaacctgcggctgcgggtcgtggacgaagcgcccacgaccacggaggactacagcggcggcctgcgccgtgaggactgggatgagctgagtgacctcgggcaggtggtgcgcatgctgcgcatcggccaggagggtcgccccttcttcctccgcgtcgagccattctccgaagagacgctgggccgcggctatctcgtgggccgctacagcaacgcgctggcgccggactatcaccccgcgggtggctcgctcaccttcgtgaagggtgcggtccgcgcggagattctggccagtgacgtgctcgccgcgcgcatcttcgcgggcgaggcgctgctggacatcggccgcatggccagtgacgacgccaatcgtttcgaccgctacctcatccggctgtccgcggcgcatgacgcgggccgcgcgggtggcacttcgcccgacctcaccctcgcgtcagtgggcggagacgttgccctgtacaagggggagcgcctgcgcgcgtgggccctgctgggcggcggcgcgcgcttcacgcgggcctacacgccgtccttcggcggattgctgggcgtggccttggagggacagatggccagtggcacgcaggtgagcgtgacggtccagggccgcaagcagggggggcgcttccgcttcggcatgttcggtcccgactacgagctgggccgcttctccggtgtcggtatgtcggagacgcccatcgcggacgaggtgcttccgtcgggcttcgctggctacgtggagctgagcgtcgcgaaggggaatcccaacgagctgctcctgctgggcagcgtggcggcgcagtacttcggctttggcaggacggacacggatgtgtccgctggcttcgaattgccgggcggcaggacgcgggcgttggggcgcgtggtgctgacgggcctgggggacaggccgcgttactcggcgggcgtggagctgcgccagcgcatcgtcaaccacgtctatgcctggggctccggcggaaccgttcattttccacagccggacggcacgctcgtgcgaggtgtcaccgcgggcgccggcgtcggcgtggacttccagcgctgaacggcagcgactcgagcggcgagtgggtcttcaggggcttgccgccgctgtcttcttgcccggcttgactgcggctgtcgtcagtcgtgccttcctcgtgactacgtgtgtcgtcacgggaaggtccatgaagaagccggtgggagagcaggacatgggcccgtgcgtactccttccgtgggcccgccaaccgccgtctggataaacgaccccgtgcggctctccgcctcccaggacgctgcgcagtcatctgtcgaggtcgacttggagtcgccaatcaccaaaggaaatgcggacggctggcttgttcgcagcggaatgctgattgtaccgagcaccggtgtgagtcttaccgcccggagtgtctcgggcactggggggcgcacaaatttgtagagttcctcggggagtaatagggtgcccccctcttctctgaaccgagactgacgctcaaatcttcgtcttgaatcacgtcccaatttctatcatcaaggctgggctgcacgtctccgaacgccatggaatccctcgcgcgacgctcctgggcaggccgtccgtcgaggagcgcgagctgaccggaccgcttcgtagaatcagttgggattccttctgcgaattcaatgaccggatcgaacacgcatggagctcgctggggggcgtcgagcagtttgccctggcggtgaacgagcaagtccccgagatattggcggtggcccgaagggtcctttcgcctcttcagctcctccggttggtgatctccgtcgggagctgggcgcatcctcggataacggtccggagcaagcttctcgggccggagcggctccaactcgaactgtcgctgccggaggattggcgtgattcgccggcgttcttccgcatcagcggcgcctcgctcgcgaacacgccacggctcattggcctgccccgggctcaggtggagatggagctcgtgccgcatcgagccgtgtatcggttccagctcccaccctctcgaacggccttctctctcgggagtgaagtggccagccatgcccacctgctgatgctggagcgaatctcccatctccaggcggaggtcagcgtactcctgagaacgccgcgaggcgggagctccacgggggctcgcaggcggttccttgcctggcgcggggcgctcacggcccgccagaccgaggtcctggaattggtcgctcagggaatctcgaaccgggaaatcgcgaaccgcctccggtgcgccgagcgcacggtggaggtgcacatcacggacatcctcaagaagtctggcaatcagagccgagcccagttgatcgccgcgttctggggagcgctgggctgagggatttacgcctcgtggaaaaccactagccgccttcatacgctccgcctggaagggcagatagggcttgagtccctacgcagcccgcaccgatacggatgcgcgcaatactcaccctttggaggcagtgccgtgcgcgcttctcgtatgcgttgtttgttattgtccctcttcgttgctggctgtggcgccgactctggcaagggagatggtcctccccctcccaggcccacgcctacggactccaccatcaccgtcgcggggagcaagaatactctcgctgtcaatgaggtgctcgtgttgaccgcctcggggcgggacagcagtggccagccggtggtgctcgacgacgtcatctggagttcgagcgaagcctccgtcgtacgtgtggagcgggacgggacggtgacgggaatgggggctgggactgcgacggtcaccgccgcgtcggggaacaagagcgggaacctgacgctaacggttcggggggccattcaccgaaacggaagcatcttgaccagcgagacgtggcgcgaggtggacaacccgcatatcgtccttgatgacattgtcgttgcggggcccggcaccccggtgctcaccatcgaagcggggagcatcattcgcctcgagcatggcgcatcaatcgagattggctacggcggcgagggcgggacgctccgggttcaggggacagcggagaagccggtgactttcaccacgaatgccgcctcgccggctccgggccagtggcagggcctgtacttgttggaagggaccacctccagcaacatctcccacgccgtcgttgagtactgtggttcgaattcgggctacggcgccgcgaacgatgcctgcatcatcgtgagtggaagcaccgtgcgtcccaactttcaggacgtgacgattcagcacagcgcgtcccagggcatcacgttcatgtacgaaggtgccttcggctcgaactcgagggggctgacggtcacggacgtggcgacttcccccatctccatgggagtcaaccaactcggaagcctcccgggggacagcgtcttcaagaccaacggacgcaacgtcatccggtcgcccggtgggcaggtggaccgctcgcagacctgggtcaacgttggcgtcccctacgtcatggaggactccgtctatgtcgatggcgcaaccactccgacgctgacgttgagcccgggagtcacgctgcgcttcggtcgcctgagctacttcgagatcggcacgggagagggtggcaacctgcgtgccgagggaacggccgaggcccccatcacgctgacggccgacgcggagttccccatgtctggccattggcagggccttgcgttcggcgagatggcgacggccgccagcaagctgacgcaggccgtggtcgagtacggtggcgcgcccgcgagcgatgggaacccaaacgcgaacgtcagggtcattgttgacaaggggcccatcattacccagaccacgcttcgtcactccatggggtgtggaatcactcgcgcgacgacccccaactatgacaccttcaccacggatttcaccgcgccgagcttggggaacgtgttctctgataactcaggttccgcgcagtgcggcccttgagccctgatgcgtgaggtgggacctggaccgtcccctcatttgaatcacacgaagccgaatgcttcgcggaagacggcctgctcgcggatgcgttcggcgaacttctacatgagggggcggcgccacttctctcgcatgttggcgagggcgctggagttgcccccgcagggtgggtcctcgatacctcccgccgggatggcaggccgcgccctcgcacttcgaggcgaaggcggatgccgctgcgagtgtgggcggtgctcggtcccgcgggcacggaccgcacgggcaagtggctccgtgaactgccgggactcgataccccgtggtagatgctgatgcatggcttcgacgcatgctcaggaagggggtcgcttccttcaaatgggacagacccaggacgcggtgaagagcttccagaaggggctctccattgctccgaatgacgtggattgcctcctggggctggttcgagtgcacctgagcaccggcgcggcggcggatgcggaggccgccgtgctccgcctgctggaggcgaagccggaccacacggaggggcaggcgcacctcgccatgcttcgcgcccaggcgggcaatccggaggcgctggagtccctcaaggcgttggccgccgcgcccaccgcgggctacttcgagcgcttcaacctgggctcgctgctgttcgagcgcggggacctggcgggagcgcgcgccgccttcgagtccgtgctccagatttcccccggcagcacccacgtccatttcgaactggggcgcatccgccttcagcagaacgagccggatggcgcggtgtcgcacttcctgcgggccgccgagggcgcgccacaggaggccatgccgctgctgatgctgtcgcgggcccatgccgcatgcggccaattggggctggccatccaggccgccacgcaggcgctggagaaggcgcggggtgggctccagcgcgcggtgctggaggacctcttcaaactgtacctgtccgccggcagctcggatggcgccaagcgcgtggctcaggagttgcgcaagctggacccttccagcatcacctatctctacctgctcggcctggcgacgatgagcgctggcgccttcgccgaggccaaggacgtcttcgcggaggtgctacggcaggcgcccggaagctggcaggcccagcacgcgctggcgcagatgcacctcgccctgggcgagcgcgccgaggcggtgaagctgctggaggcggctgtggccacggtgccgacggaccccggtcccaccaacgacctcgcggtggtgctgatgcaggacaacgaacactcgcgggtcgcggcgttgctggcgcccgtgttgggcgcgcacccgaatgacgcgggcacgcacctcaacatggccctggggaccttccccgcggacaaggagctctcagcgcgccacgcgaagcaggcgcaggcgctgggcgccgaggacgtgcgcgcgcgtgccgagcagttgttgaagcagctcggcgcctgacgcaccggcgggagggcgtcagccctcctcgtgcggctcggagtacaggcgcgggaggatgcgttcgcgcgcgacgttgacgggcaggccgatgcgcgtggaacagcgtgccgagctccgcttcgagcgccgacgaaacaatgtgtcggagcgcagcccctttctcaatccgctcacggctcccaattcatggacaggtgcggcacaccgccgcgtcaccggaaaggattggagatgagcacctcgaagaacatgcccgtggctctcatcacggggggaagccgtggactggggcggaacatggcgctcaagctggcggcccggggcaccggcatcatcctgacgtaccgcaccggcgcggacgaagcggcggcggtcgtgaagcagattgaagcagcaggcggcaaggcggtggcgctcccgctcgacgtgggggacacgcggggcttcggcgccttcgtggaagcggtgcggacggagctgggccgtcacttcgggcgcgagcggctggacttcctggtgaacaacgcgggcatgggcatccaagtcagcttcgcggagacgaccgaggcccagttcgacgcgctgatgaacgtccacctcaaggggacgttcttcctcacgcagcggctgttgccggtgctggcggatggggggcgcatcctgaacatctcctccgggctcgcgcgcttcaccttccctggccacgccgcctacgcgaccatgaaggcgggcgtggaggcgctcacccggtacctcgcgaaggagctgggggcccggaggatttccgtcaacgtgctcgcgccgggcgcgaccgcgacggacttcgggggcggcgtcgtccgtgacaacccggagctgaacaagacgctggccgcccaggttgcgctcggccgtgtgggtcagcccgacgacatcggggatgcggtcgccatgctgctgtcgccggagagcgcgtgggtgacgggccagcgcatcgaggcctcgggcgggatgatgctctgacggcgcgcgctccagcgtccttgggcaaggccggagcgctgaaggcccgtgctcagcgcttcaggcggaggatgacgtccttgtccgggccgcagtcaccgcgtccgtcgcagttgctggtggtgacgtagaggtggccatccggccccatgatgacctcgcgcagccggccgtaggtgttgcgcaggtacacctcgtgcctggtcacgcggctcgaatccggcgcgaactccacgcgctggaggtggcgtgagcccagcgtgccgatgagcagcgagcccttccattcggggatggccgttccggtgtagatggcggcgccgcctgggggcattgcgtccttgtaggtgatggacggtgtgatttgcccctcgcgcgtctcgcacgagtagatgccgggccagcccaggttgtcaccgcggcgggcgacgctgacctcgtcgtgtccccggcgcagcgtctcaccgctggggccgtggtccgcgatgtacagcgtggaggcatcgcgccagtcgaaggcctggaggttgcggatgccggtgaggaacgcgggcgagccagggatgggattgtcctggggcaccgctccctccggcgtgaggcgcagcagctttccggccgggtcgttcgcgttctgcgagcggtccgggtctctcgcgtcaccggtgcccgcgtacaacatgccatccgagccgaagcgcaggcgcccaccgtcgtgatacttggcggaggcgatgccgccgaagatgacgcgctcgtgcgtcgccgtggtgtggtcctccgacagcgtccaccgctcgatgcggttctcctcggtgccgcccgcgtccgtggtgacgtagatgtagaactggcggttgttcgcgaagttcgggtgggccgcgatgccgagcaggccgccctccgcggcgtccgcgacgggcaccgtcgccacgggccgcggctggaggacgccgtccttgagcaggcggatgcggcccgggcgctcggtgacgagcgcgtcgcctccggggagccacgcgatgccccacggcgtctccaggccccgcgccaccacctcgacgttgaagggcacggtgccgtcggcgccccagcctttctctacgaggatgcagtcctggggagacgcggtgccttgcgcctggctcttgcggcaggcggaggcggacagggcgagcaccacgagagcggggaggagcgtcaaagaggcgcgcatgagtggattaatgtccgcgagcgcgtggatgcgccagcctcccgggtgcggagcgtccagggacggacgcgcgtgccgggctgcttgcttgagacctggaggcaggcccggcgtcagtggtccgcgtagcgtttctcgccggcctccacgcgcgtggcgagccggttgccgcgcggaggcagcgggcaggtggcgaacttcgtgaatgcgcagggtggattgtaggcccggttgaagtcgagcacgacgcgcccgtcggtgggcatgtccgcggagaggaagcggcccgcgccgtaggtcgcgtcgcggttggtctcatccgcgaagatgatgaagagcttgcccgaaccgtcctccacgggcgtcagccggtgctccttgcccgccaccgtgaacacgagcgtgccgggggccttcatctcgtcgatggttcccagcacgttggggacctgcagcatccgaggcgtctgcgcgggctcgaagcgcgcctcgatgcgccagtcgttgctcgccgggtacgtggggatgccctggaactgcttgcgcgccgccgcgccggagtccctcacgcggacgcccagcttgtcgcctcggaggatgagctggaagctgacgttgccgagcttgagcacgtccggcgtgccctgctcgtccgactggagcgctccgcccgtgaagggctggccgttgcgggtgaaggtgacgccaggcgcgggctggaagcgcgcggtgttgccctgccgtgtgaaggtgcccagcttcgggggcggtgcccgcggggaagctttagag

SEQ ID NO: 1107 - DNA, 14899 bp, Myxococcus xanthus
tctaaagcgcccaacgcgctgaagtacagcccggcggagagcaccgtgagggtgggcgccgagggctccgagcgcgaggtggtgctgcgcgtccacaaccgtggcacgcccatccccgcggaggacctgccccacgtcttcggcgcctggcgccggggccggcgcgccgccagtgacgcgggcgcgcccagcggcctggggttgggcctcgacatcacccggcagattgtccgggcgcatgacggggacgcgcaggtggcctccagtgcgacggagggcacgaccttcctcattcgcctgccacgatgatgattatctgacgatgggggcacctcacgactccccgcttggggttgccgctaccaccttccgtgcatggcgtcagagaagctcatgttcgctcagtccgtggaagcgctcttcgtgcgggcgctcgggccgtatctcacccgggatggacgccagcgcttgaaggcggtggggctcgacctgtcggagccgctgcgcccccagtacacattggagcagtggcgcgccttccttcgcgtggcggcgcaggatgtcttcccggccctgccgccgcacgaggccagcttcgcgctgggcgcgcgcttcctccagggcttccggcagacgtcggtgggccgggccagcctgtcgctcgtcacccagttggggccgcggcgcacgctggagcgggtgccgtacaacgtccgggccggcaacaacttcaatgaggtccgcgtggaggagtccacgcaggacagcgccacgctgtggatgaaggacgtcacggcggacacgccggacttcgcggcgggcttcctggcggagacgctgcggtcggcgggcgcggggcatgtggaggtgaagcccatcgccttcgacggcacggcggccaccttccgcgtcacctggtcgaaggccgccagccgggcgcccgtggccggtgccggtccccgtcgcgtccactgaggcgggagcgccgccacgacgcgcccttccgctggactggctcggtctccaggtgtcccggttgccggaggcggcgctggagcacccgttcagggtgcgctggcgctggcccccttccgcgagctgtcgcacgatgccggccggacgcgctccctgtccggaaggaagtcaccgcatggcccggttgttcgtcgaggacctccacgtccggctcggcgcgaatgacatcctgaagggcatcaccgccgacttccgagatggcgaggtggtggcgctgctgggccgctccggcagcggcaagtccacgctgctgcgctccgtcgccgggctggagacgccggtgcgagggcgcatccacattggcgagcgcacggtgttcgacgcggcggcgaaggtgaacctgccgccagagcggcgtgacctggggctggtgttccagtcctacgcgctgtggccacacaagacggtgttcgacaacgtggcctacggcctgcggctgcgcaagcagccccgcgagcaggtggagcgggccgtgcgcgaggtgctccagggggtgggcctggaggggtacggcgaccggttccccagccagctctccggtgggcagcagcagcgcgtggcgctggcgcgggcgctcgtctacgggccgccgctggtgctcctggatgagcccttgtccaacctggacgcgaagctgcgggaggaggcgcgcgtgtggattcgcgcgctcatcaagcggctggggctcaccgcgctcttcgtcacccatgaccaggtggaggccatggccatcgccgaccgcatcatgctgctggacggtgggcggatggtgcaggacgggacgccggagcagctctacacggagccccggagcctgttcgccgccgacttcatgggggtgaacaacaccttgtccggccgtgtggtggagcggcgcggcggcgaagcgcggctccaggtgggaagccagtcattgtggggcctgcggcgtggggacggctccggtggcgacacggccaccggcgtcatccgcgtggaggaactccaactggcatccgggcccggggagaaccggctcccggccgcgctggtgaactccatctacgtgggcgggcgctgggagcaccagttccatgccgcagggcagacactgcgcgcctcgacgcgccaggtgttggccccgggggcctacacgctcgcgttccccaaggagcgcctctggattttctgagaggcgcgggggcggcgcggtgcctcatggcgcgagcccggtgggcgctggcgcggagcgctgccccgcggcgggcgtcagggcggggaaggcggtgtgccggttcttccagaagggcgcgtcgggccaccgttgctcctcgaggtaggtgcggcttcgcctgtgcaggtgttcgttgaagcgcagatgaagcgtttgctcgtaggcgcagagcgcatcctcttcaccgcgcaggtattgctccagggcttcggcggcgaggagcgcggagtccagcgcgctgaagattccctgggcggacagcgggtcatgggtgcaggccgcatcgcccactgcgagccagcgctcaccgtgcatctggtcgagttcgccgacgagcacgggcgccgcgacgagaggctctccggcgaagtcgcaggccgccagcctcgcctgggtgacgggggcttgttcgagcagggccgcccatggttccggcgtcgcccagcgcagtccgtgcaaggaatctccatcccccaccagggtgacggcgacacagtccgagggcagtcgcgcggagtgccaccagccttccggacatgattccaccagggcatccgtggggaacgattcgcctggccggagctggaacgcgccatgaacggtgaagcagcggtcgcggatgcggcgccgcgcgccctgggtcatggcgaaggtggctttccatccggtcgcatccacgacgaagcgcgcccgcagcgtgagcgcgcctgtcttgcgttgggagaggtgtagccgatagccctccttcgcgatggactcgacgtccagcagggtcgtcaggcgaaggacgcggacgccttgcctggctgcctccaggctgagccgttcgtcgaagcgtgcccggtccaggtgccaggcggagccccagggcgacatctgcgtgtcctggatgcggggctccgcgcggctccagcacgaggacgtcccgcgcgaagccaggtgtccatcgcgcaggaagctgctccagacaccgagccgggacagggggatgcggaggtcgggtgacaaggtctcgcccgggcggtgcgtgtcgtaatccgtgcgctcgagcatgacgacggacaggaagggcgccaggtctcgcagcgccacggccatggccgcgcccgctgggccgcctccgatgatggcgacgtcgtaggaggcttcgctcatggcgcgcccctccgcgcggcggcgggcgtcccgtcgcggcagggctcagggcgcctggtttcgacgggggcttggggaatctcgtgggtggggctcaagctttcgctcctcatgttccgaggtgcgatgtgcaaggcacattcctcctggcggcgaggcgcggtgcatcagcgcgtgtgctccgtgtcatggtcttccactgtgtgcggtggcttgtgccgggtggtggatgacgcgtcacgctgctcccgtgacgcgtcagcgtcatgcccgcacgcaagggctgcgtcccgccgagcccctgcctggcgcggggcgcacccgcggtgggagcctactcacgacgttctgtcgcgttgacgccgggctgtacctgtgttcaggctagccgtggaggtgcccatggccccgcaaatcagcctcgacttcgccacggagtacgcggcgcatccggcgctggcaccgttccatccggtggtgcgccgctggttcgcggagcggctgggcgagcccagccgtccccaggtcgagggctggccgctcatccaggcgggccaggacgtgctcatcgccgcgcccacgggcagtggcaagacactgacggcgttcctcgccgcgctggacgcgctcttccggctggcgctggaaggcacgctgccggactgcacgcaggtgctctacgtgtcgccgctcaaggcgctgggcaacgacgtgcagaagaacctgctccagccgctggaggagctgctcgcccgggcccgcgcggagggcttccgtccgcaggagctgcgcgtccaggtgcgcagcggagacaccccggcctccgagcgcgcccagatggtgcgccgtccgccgcacatcctcatcaccacgccggagtccttctacctctacctcacggcggagaaggcgcgcgccacgctgcgctcggtgcgcaccgtcatcgtggacgaaatccacgccctggcgcgcgacaagcggggcagccacttcgcgctgtcgctggagcggctcaaggcgctcacggacgcgaggccccagctcatcggcctgtcggcgacgcagaagccgctggacgccatcgccgggttcctcaccggcgcctcccaccgggagtgcaagcgggtggaggtgggccacctgcgcccgtgggatttgacgctggagattccagacgcggagctgtcgtcgctggccagccacgagatgtgggggcaggtctacgaccggctggtggagctgacgggggcgcaccgcacgacgctcgtcttcgtcaacacgcggaagatggcggagcgcgtggcgcacgacctgggtgaacgcctgggggaaggcaccgtggcggcgcaccacggcagcatgtcgcgcgaaatccgtctggccgcggaggagaagctgaagtccgggcagttgcgggccatggtggccaccgcgtcgctggagctgggcatcgacgtgggcaacgtggacctggtggtgcagttgggcagcacgcgcgccatctccgtgttgctccagcgcgtgggccgcgcgggccaccacaaggcgggcatctccaagggcatcctcttcgcgatgacgcgggacgagttgatggagtgcaccgcgctcctcaacgccgtgcgcgagggggacctggacgcggtgcggattccggagaagccgctggatgtgctggcgcagcagattgtcgccgcgtgcgcctgcgaggagtgggacgaacgcgcgctcttcagcctcttccaacgcgcgtactcgtaccggaacctcacctgggaggagtaccagggtgtgctggagttgctgtccgaaggcgtggcggcgcgccggggccgcgcgggcatccacctccacagagaccgggtgaatcagcgcctcaagggccggcgcggcgtgcgcatcaccgcgctcaccaatggcggcgccatcccggacaccttcaccttcaacgtcaccgccgagcccgagggcaaggtggtgggcacgctggacgaagacttcgcggtggagtcctcgcccggggacatcttcctgctgggcagcaccgcgtggcgcatccagcgcgtgtcgggcagcacggtgcaggtggaggacgcgcgcggcgcgccgcccaacgtgcccttctggcgcggcgaggcgccgggccgcacggacgagctgtcgctccaggtgggccgcctgcgcgaggaactcacgcagcgcgaggatgcgccggcgttcctccagaaggagctgcgcatgccgccgcccgcggtggacgcgctgatgggctatctgcgcacggggcagaagatgctcgacgccgtgcccagccacaccaccgtggtggccgagcgcttcttcgacgaggcgggcggcatgcagctcatcatccacgcgcccttcggcagccgcatcaaccgcgcgtggggcctggcgctgcgcaagcgcttctgccgctcgttcgacttcgagcttcaggcggcggcgacggaggacggcatcctcctgtcgctgggcgagcagcactccttcccgctggcggagattttcgacttcctccacccggaccacgtagaggaggtgctggtgcaggcggtgctccaggcgccgattttcggcacgcgcttccggtgggtggccactcggtcgctcgcgctgcaccggatgatggggggcaagcgcgtggcgcccaacctccagcgcgcccgcagcgaggacctgctggcgtcggtgttcccggagcaggtgggctgtcaggacaaccacggtggtggcgacctggagttgccggaccatccgctggtgacgcagaccatggatgactgtctgcgcgaggccatggacgtggacggcctgcgcgaggtgctgcgcggcatgcgtgatggccgcatccgcctgctggcgcgcgacgtgccggagcccagcctcttcgcgcacgcgatgattcacagccagccctacaccttcctggatgacgcgcccgccgaggagcgccgcgtgcgcaacgtggccctgcgccgcgccatgcccgccgaggacgtgacggccttcggagcgctggacgcgacggcgattgccacggtggtgacggacgccgccccgcccatgcgcgacgaggacgaactgcacgacgcgctgttgcagttgattctactgcccgcagcggaggtgccgcgcgggatggcgacgcccctgttcgagcagggccgggtggcgtggatggacctgcccgcgggccgcttcctggtgtcggcggagcggggcagcgcgctgcgggtgctcttcccggacgcgcccatgcagccgccgctgccggtgctgtcgcatgaccggcccgtggagcgggacgccgccgtgctccaggtggtgcgcggacgcatggagatgctggggcccaccacggtggcggagttggcccggctcatcgtgttggacgaggactccgtcaaccgccatgcaccagttggaggcccagggcaacgtctggcgccgtttccgccctggaggtcccctgcggatgggccagcccccgtggagtggtgcaaccggcgcctgctccagcgcatccaccggctgtcggtggggcgaatgcgcaaggaaatcgagccgatgagcgcgcaggacttcatgcgcttcctcttccgctggcaccacctggaggaactggacgcgctgcgcggctccacggggctgctcaaggcggtgcggctgctgcaggggtacgaggcgccggcctccgcgtgggagcgcttcctgctgcccgcgcgcatgcgcggctacacgccagacttgctggagcgggcctgctatgccggtgaggtggcctggggccgcctgacgacgaaggaggcgaagcccgcgccggggcctcgccggggcgcgccggtgacgccgccggagcccgcgcccacgcgctcgcgagcgtcgcccacgcgcaacgcgtcgttgaccttcacccttcgcgaggacctggagtggatgctcaccgcggcgcggcctcacgcggtgctggcggacggggacgtgtggacgccgccggacctgagcgcggccgccaaggacgtggtgacggtactggagcggcgcggcgcctgcttcttccaggacctggtgtcgcgcgcgcggcgcctgcccgccgaaatcgaggacgcgctgtgggagttggtggcgcgcgggctggtgaccgcggacgcggtgcagaacctgcgcgtgctccagagcccggcgcaccgcaagcggcagaagttgctccaacgcggtggtcctggccgctggagcctgctgacacccgcggagccgaagtcgcaagacgatgtgctggactcgctggcgcgcctcttcctccaacgctacggcattgtctggcgcgacctggtgatgcgtgaggcgctggcgcccacgtggcgcgagctgctcttcgtgtaccgccgcatggaagcgcgcggcgaggtgcgcggtggccgcttcgtgtcgggcttcgtgggcgaacagttcgccctgccggaggcggtggacatggctcgctcggtgcgccgtcagcctccgtccggtgtgcgggtgcagttgtccggtgtggatccgctcaacctcacgggcgtggtgacgcccgggccgcgggtgccggcgatgccgggcaacgtggtgacgtacgtggacggcgtgccgcgagatgtcggcgcactggacgatacggccgacggcaacgttggagaagacacggaagatggcggcgaggcgatggcgagctgagtggtgaggtcccgtcgggcagcggatgctagggtgccgcccctttcgcttcttccgaggggtcgcccgaatgcgtcgcctgctgttgatgggactgttgctgctctccgttacctcctgttcaggcgacgacgaagacccgggggagcagtcctccaggaccgggcgcatccaggggacgctgacgcctttccggagcagcgaacggtccgcaggcgacggtgcctcccagacggtgcgctcgccgtttcgcgcgggtgagctggagaagctgaaggagacgctgcgggggatgcacgcgggacgctcgcgcgagccgcgggtggcgccgaaggccatgccggggcttcccatcatcccgtcgcagccggccgccgcgccgctcgagcgggcctctcgcgaggaccccacgattcccggagacgtcatcctccgcttcgaggaagcgggcctgacaccggagcgcgtgctggcggcggtgcagcgcccgggcttccgcgcggtgcacaagggctacgcgagtgagtacgtgcacctggtgggctacgagccgctggacggcaaggcggtgacggccgcgaagacgcaggagtgggcggcgcagctcgcccaggtgccgggcgtgacgtatgcggtgcgcaacgagcggatgcgggcgacggcggcgccgaatgaccggggctacagccttcagtggcactaccccacgctcaacctgccggccgcgtgggacctggtgccggacgcgtccagcgtggtggtggccgtcctcgacagcggcatcgttccgcacccggacctgacgaatgtgttgccgggttacgacatgatttcggacccggagaacgcgggtgacggcgatggccgggacagcaatccgcgggacgaaggtggggacacgcccagcggcggctcgacgtggcacggctcgcatgtggcgggcaccatcgccgcggacacgaacaaccaggtgggcgtcgcgggcgtggcctggaacgcccggctgctcccagtgagggtgctggggaagaagggcgggagcagcttcgacatcgccgcggccatcacctgggccacgggcggccccgtgccgggcgtaccgcccaatcccaatcccgcgaaggtggtgaacatgagcctgggtggccgcgcgccgccgcaggcgctgtaccaggacgccatcgacgcggccttgggacgcggggccatcatcgtcgtcgccgcgggcaatgaggacgtggatgcgcgcaccagcacgccgtgcaaccagcagaacgtcgtctgtgtgggctccaccagtcttgcgggccagcgcagcagcttctccaactacggcgtggacgtggacgtggtggcgtctggtggggagatgcgcgaggacctgaacggcgacggctatccggacggcgtgctgtccacggtgctggatgagaacgggcagcctgcctatgccttctcgcagggcaccagcatggcggcgcctcacgtcacgggcgtggtggcgctgatggcggcgtcgcggccggacctgacggccgcgctggcggagcgcatcttgaaggaaaccgctacgccgctcaccaacgcgcagtgcccggagggctgcggcgcggggctcgtcaacgcgcgagcggcgctggcccgcatcgccaacgtggaccctggcacgttggaccctcagcttaacgtgacgacgtccacactgttcttccggggcagcgggacgcagccgctcattctcagcaacgtgggcgggaaccggggcggcgatttgacggtatcggccagcgtcagtgggcccaatgcctcggcggtgtcattcccgcagggcaacacggtgcgggtacccgccttcagctcggccccgttgagtgtggcggtggatgcatccgggctggccggaggggacaccgtggtgacgctgagcctggtgggctcggggacggcgggctcggcgacggtggcggtgaagattggcgtggcgggcgcagccaatgacctggacgccctgattgcgttcgtgtggcaggacgcgcgaggggagtggcaggcctcgaaggacgccatcgcggtcgcgcgcgcctcggcggactacgcgtacagcatctccctggcgccgcggacgtacttcgcgttggccaccatcgacgacgaccaggatggcaacttcttcgaggacggcgagcgcaccggctactggcgcaacgtggactccttcgagccgctggagctggaggcgggtgaccgcatcgagaatgtgagcttcgacctgattcccctggcgcccatcgatgatgacccggcgctggtggtgggcagtgcgtgcggctccaacgtggactgtcccgggggcgtgtgcgtgacggactatccgggcgggtactgctccatggattgcaccagctccgcgtgtccggcgggctcgcggtgttacatcgtggattcctcctcgggcctcaaggcatgtctggcgacctgcacgcggcaggtgggaacggggcagggggactgccgccccgggtacgtctgctacagcgacggcacgggttcgggagcgtgccagcccaactgccgcacctctggcctgacgtgtgggctgggacggacgtgcacggccagcggcttctgtcgctgaggaaggctcgagagcccgtgtccagagcggccgagggggagagcggtggacacttggccacagttcccaattcccaccgggcagcgacagcggcatcgtgcaagcaccttgtccttgatgcagcgactgaagagtgagacgcgcccgcaccacgagcgcaccgagacccaggtgcgtttgatggatgcggacctgacgcccactgcgtaccgacgtcacctggaagcgcttcacggcttctatgttccgctggaagcccggctcgccgggctgggccttgaagcaggcacctgcctccgtctccgcctgacatcgacctggggcggtgcgttcgggcgccctccaactgactgcttcgtcgacgccctgattcagcgcgttacaggacggcgggcgcgctgccacgcagcatgaagtacacgacgacgcccgtcgccgacacgtagacccagatgggcgccagccaccgcgtcaccttgcggtgccgcacgaagtccttgcgccacgtgaagtagaaggccaccagcgccatgggaaccacgggcatggacagcagcacgtggctggccaggatgcacaggtacagcccgcgccagtcccccacgtatcgcgtgtcgccatgcacgaagtggtaggacaggtagcagaccaggaagagcgcggacgcggtgaaggccgagaccatcaggtactggtggacctgccgcgcgcctcgtttgatcgccacccacccgccgatgagcagcgccgcggccgtggcgttgagccccgcgttcaccgctgggaggaagcgcaggttcaccccctccaccgggccgccgccgcgcaccagcagaatccacccgatgaacgccaatgccagcgcggacaccacggcggtgaagatgaagaaagcccggtcactcacccggggcggcagcgcggcaggggcggcgttcgacatgggccctatgtctcgcgtggcgggcttcgttgcaacccttgctaactggttgacactattagggaatacatgtgggatgaaatgttccactaggtactactggatactgaaactgtaattcctgcatactgagagtgtccccccgacccccccttccggaggtccccccgtgctcagtgtgcgctaccttgcctgcctggctggtgccgccttgcttctggccctgccagcctctgctcaagaggaggctgtctgttcaccagttgtcgcaaaggtgcccctggagcggcatctccggcagctgtcgctggacttgctcggccgtccccccacctacgaggagtaccaggccgcccaggccaagggctccatcggcgtggaagacatccgcgcgatgatgacgaaggacgagttcaacgcgcgcatccgcaactaccaccgtgcgttgctgcgctcgaacctctccggaagcctcaacaacaaccagaactcgcgggtgacgggtaacggcattgccaccgcttatggcgtggtcggcaatcccgccacgacgctgcgcggcgcgaacggcgcgacgtgtaactcagacatcgcgcaggaccagtgcctcacggcggagcagccagacgcgcacgcggcgccgctcaccgagcgtccccggacgaagtgccacgacgacgagggcgtgcctctggccgtcagctacgactacgacacgaactactacgcgtgtacgccgctcgcgccgaccacgccggatggcacggcgaagtgctcggacctgctgagcaccagccacccgaaacacgagtacctctacttctgcgaccagcgcggctcgggcagcagcgcgggggccttcatctgcgagccggacccggcgaagaccacgacccgggcgctgacggtgaaggagatggatggcgccaaaatcaaggcgttcaagcacccgaacccggactccaagccggcgctcaccgagctgaagcgctgcacgctggacctggagctgcgcaacggactcaagggcaactacggggttcagcgcggttgcgtcctgcgcgagggcttcgtgaacaaggccgcgccctactgggccaccgacaagacgccggagagcgtcaaggtgtgcgccatcgacgcgcaggagcgcacccacaatccgtggaacatggcgtcctgtgagacgtcccgcttctccaccgaccgcagctgcggctgcggcgtgggcatgcgccgctgcgagacgcccgccatcaccgcgcaggacatccgggacgtgcacagcctgcgcgtggccgccttcaacgacgagccgctgcgcatcgccgagtcggtggtgcagcgcgacgagccctacttcaacatcctcaccacgcgccgctcgttcgtgaacggcaccttgtccgagtacttccgcagccagcagggcgtgggcgtcttcaacgtgacgacgcccaccgcgcagggcgccgtgccggtggtggcctacaacgacacggaggcttgggcggagtacacgcgtgacgaggggcacgcgggcgtgctcaccacgccgtccttcctctaccgcttccccacgcaccgcgcgcgggtgaaccacttctacgaagccttcctctgcaagacgttcgcgccgccgccgggggcttcgtcgcccgcgccggaggacgcgtgcaaccgcgagaacaacctggcggtgcgctgcggctgcaactactgccacgccaccatggagcccaccggcgcgcactggggccgctacgcggagcgctccgcgcagttcctcgcgcccgaccagtttcctcgctacgacccgaagtgccgcgactgcgccctcaacaacgacaccaactgcggcggcgagtgcagccagtacatcatgcaggcctacgacggtgatggtgccagcagcctgggcatgctcaagacgtacctgtaccgcacggcggacgaagagcagaacatcgaggccggtcccgcgctgctggtgcagaagatgctccagtcgggtgacctggagcgctgcacggtgcggcgcatctggaccgagttccttggccgcccgatgacggcggaggagcagcgcctgtacctggtgcccttcgcacaggacttcgcgcgcaacggccaccgcctcaaggcgctcatcgagcgcgtggtgacgtccgacgcctaccggaggattgactgatgcgccgcctcgtcttgaccgccgcgctgctcgcgctggcctccggttgcacgaaggatgacacgcagcccgcggacggcatcatcgagcccatcgccaacccgcatcagcccggggacttcacgcccctgccggaccccgaggaccaggacggcagcgtgggccgcgccccgcgccggctcaccgtggcccaactggacgccgccatcgtcggggcggtggggcagcgctggagcgagctggactcgcgcgccacgtccatggggcgcgcggactatgccctggtggtgagcgagaacatcgagcccaacctggtgttcgccaagttcctggaggacggcgcgcgcaaggtgtgcatcagccaggcgtccgcggagatgcgcatgacggacgcgtcggcccgcaccatgggccggctgctgccggagaagtgggatgacctgacgaagctgaccgacgcggaggtgcgcgcgcagctcgtctacatgtccacccgcttctggggttcgccgctgtcgggcgaggagctcacgaagtgggcgtccttcttcacccaggccgcgagccgggtgcagaccctctcctcttccaagcgccatgagacgttggccgtggtgtgtatcgccatgctgacggacccgcgcttcatcacctactgaagctcggagtgaccgcgatgaagaagaaccgccacgacgagaattgctcccagggctgcgcccacggacgccgtaccttcctcaaggccaccgctggcttcatgggctccaccctgctgggtgggctgcccttccgcgccttcgcccaggcggcggagatggcgccggcggaccgctgcttcgtgttcgtctacttcaacggtggatgggaccaactgctggccttcgacccgagggacccgaccgagttcacggcggaccgtgcctcggagacgaaaatcctcccgggctacgaccagatcaacgacacccgcttcgaggcccggccgctcat

SEQ ID NO: 1108 - DNA, 14484 bp, Myxococcus xanthus
  unsure (1)..(14484): unsure at all n locations
gactccgcgggagccccttgtcgcgcatcagaaacgcagtccccgccatcgcgaccgtcatcgcggggaagagccacaggagggtggtcaggtccttgagctccgtgtcgatgcgagcccgccgctgcgccatccacgcgtccacgccgacactggccgcttcgatggcccgccgttgaaggccgcgcagggtcaagacgagcccgccagcgaagagcactccgaccgccgagacaatggcccacaaccgcaggggcgcctccggtgcgaacagagggcccaggaacacgccctgccccacgaaggacccgagcgcggcccacgggccgtatttcagccagaagcggtccttcgcgagcgcccgcgagacttccgcgtagcgcggcgccggaatgctcacgccgccaagcgcctggtccatctccgccgaaagtgcgagggcccgctggcactccggacacgtcgcggcatgctgctccgcttcctctttctcccgcacgtcgagagcaccgtggcggctcatctcgagcgcgagctgatatccatcgcaactcttcgaggtcatccctcctccttccgccagctcagaggcgcgaggaagaaatcccttcacggcaggcacttctttttcgaaaaacgacagaacccctcgaaatcacgaggggtttgcaagcccactcaccggggcttcacggcctcgcgaataacgacacctgctggaagcgcaggtcggcatgaatctgttccacccgcgcgtccgacagcgccccgattcgctctcccagacgcgccttgtcgaccgaggacacctgcgacacgacgacgacgctctgcttggggaggtttccctctcccacttcgagcagcacgttccccggctcgctggcccggtgcaggttcgacgtcagcgcacacacgaccaccgtcgtgatgcgtgagtgattgaagacgtcgtcctgaaccaccacgtgggggtgcgaatagctggggaccgggcctcgtgagtcgtcgggctccacccagaacacatcaccgcggttgattcgctcggggggcatgccctcggggtctcctgtgcctgcctccggtctggcggcccggccttcttagcgagcgcggaggcttcctccaaggcatccgccatcagttcctcaaggacaacgccgaccgggccaggcacgagaagctgggcttctacgacgggtggggcgccttcacgaaacaactcgcgaggcttgccgaacgcggcacctgacacggtgtagggtcggcccaaacgacccgagacgcgaatgccccacacctctccgtccctcgaatcgctgaccgaactcaccacccttgaggggctcctggcggagcgtggcctggatgcgctcctggccaccttcgacgaggtgctcgccgggacgcccccggacacacgcatcctcaagagcgaaagcctgtcggtcggccccaggaccttgcaggtgctccggcgcgcgctcgcgctcgacgcggcgcttctccgggcgcaccccgagacgctcttccaatgcctctacaaccgcctgcgctggttcgacgccccagacacggctgcgcacttcgcgcccacggacgcggggccctggagccacgcggaagcgcacctgtggaagctcgcggagcactggaggggacagtggaccgcgcgggagggcacgtcctgggtcgaatccctgcggcccctgcccggagcactggaaggcaatgaccaggtcctgcggcacggcgcccaggtgttgtgcgcggccttcagtccttcgggcgactggctcgccacgggctcctgggaggacgagcggaacgtccgcatctgggacgtggccaccgggacactcatccgccaactggcggggcacgagggcgaagtgcgcagtgtcgcttggagcccggacgggacgcggctggcatccggctcacgcgaccacgacgcgcgcatctgggacgtcgagacgggcgagctcctccacgccatgacacgccaggagggccaggtcacgtcggtggccttcagtccggacggccgctggctcgccgcggcgaacctcgggtggcgggtgcggctgttcgacgtgacctcgggccggcaggtgcgcacgctcgaagggcacgaacagtccgtgttgacggtcgccttccacccctcaggccggtggctggcgtcaggcgcgtcggacgatacggtgcgcatctgggacctggagacaggcacgcagaccgcccacatccgcagcaccacctccgtctcgtccgtggccttcagcccggatggcgattggctcgtgctgacctccatggacggcctcatccgggtggagacggcaggctggacgcgcgtgcccggggcgctgggccagggtccctattcccaggtcgcctggctcgaaggcgcacggctgggcgcactcgccttcaaccgggtggagctgctcgacgcgaggaacggagaggtgctccgggcgcatccctacccttccgacggccgtgagcgcggcgccgccttccttccgtccggcaagcgcttcgcgctgaccgcggcgaatgggcgcacgcatgtccgcgacctggatgcggaccccagccctaccctcctggccgaacaggaccgcgtcatgaacctgtggggacatgccgaaggggcatggggcattacacgcctgcactcggagacgcgcgtcatcgattcacaggggcaggccacggcactgcctcccggctctccggcggcctacgcgcagacctggcaggtcagtcccgacggcgcatggctggcccaacccgagctgtcctcacacgagcggcgctaccggctgggcatcctgctgctcgacgcacggagcctcgcccccgtgcgcaccctgctggcgccccctggcgaacaggccgcgaaggcccagacgctcctcgtcaacaaacttccgattgccttctctcccgacgggaagctgctggcggccgccatcgaagagggcgcggtgcacctctggcgcgtggcggacggcaccttgctgcacaggctgcgcggacctggaggtcccatcacctgggtggacttcacgccggatggcacctgtgtcgtgtcgggacatgcggccagcgaacgcgtgtacgtccacgaggtccggggcggcaaggtcatcgtcaacaccgaagcggtggtcgagccttcccccgcctatgccgcggcggccagcgcgcccgtcatcgtcgtgggccgagcgtcgggagagctcgtgctcatcacgctccccaccggcgcccaacaggtcctgacggtgagccaggagcccgtcatcgccctgggactctccgcggacggcacgcgcgtggcggcctccagcatggatgagtgcgtgcgggtcttcgatgtgcggacaggcgcacgcctgcatgagcttccccacccgtccctgcccttctccatcgcgctgagcagcgaggtgctcgtcaccctggccgaagacatgcacacgcgcgtcttcgacctcgccacgggcgaactgcgcacggagctcgatggaagcgtcaccacggacgacttcgtgtcccagcgctactgggagacgctgggcgaaggcccggtcaccttccacctgcaacgagacaccacgccccgggcccactttcaggatgcgatggaaaagactctcatcctgaaggacgggctcgtcctgggacggggccgcaccgagcgggacttcttgtacgtcctgaagctccacataccctgagcatcaggaacccgcggaagcctctctcccctctctgctgaggcagagagaggccccgcgacctacgtgctagcagtccttccaatccgcacccgcatagcccagcccccgcttcgcgcactggtactttccgtggttgcggcagttgccatacacgacattgggatagggacctctccagaccttatcggagcaccggatgaagcagcaggccttgagggcgctgaccgttccatcctcggtgctggggtccgcctgttccaggtactgctctggaatggcgatggactcctgcggctcctgcgactcctcgggcagcgggccaccacaccccacagccaacagcgcccccatccacagcggcaacgtgctcttcatttgatttctcatggtttcagccctcacgtgtccttgcacactgacaatggctagcagttccgccaggcgtgcccttgataggtgagcttcttctgcgggcagtagtaccttccgtacttcgcgcacaggtcatacttgatggagggaaagggcccgtaccaggtcccgctgcacttgacgttgcaacagatggcggaactctcgacctcgccctcaccgagatactcggcgggaatccctggcggagaggattcctcctcgaccggttcgcccggctgtggtgcctctccatcggcggggccgcatcccaccaacagcaccacgccagcaatccacgcgaaccaacgtccatggccattcttcatggaatcctcccaggctcaatccagacaaaaaggccgcgagccaccggcctcctgtctattggaccgaatcgaggttccagacgttcccgcttcacccctgcgtcattccaaatcaaacaagacagacaagctccgtgcagaagcctccagtccgctgcgacttcccgactggagcatgaaatgacatcagcccctctcaaagcctcaatctatgacgcggcggcattccggattccctccccccaagaatgcgggatggcgcggacgtgggccaaggggcgcaccttccccccgcccccaatccccctccgaagacgcgcgtttccaggggcatgcaatggccccaccggtgcgttgacgacggacgagggagcgaaaacccgttcgccgcgcggcccgtgacgtccggaccggtgtcgatggccgtgctgggcgcgagctgcgcggcctccacgttggcaacagcccactttttcatcggtgaattcctcgtcgagcaccgctcgccagaccttgagggtgtccccgcttgcgcccgcccttcactccaggcatcatttcagtgaacaggttcaccgaaaagaaggggggaggccatggcgacgcggaacaaggccggagcgacgggcgggcccaagcggggacgcccccggggccggacggagcagggccacgagacgcgccagcggctgtatgcgaccgcgctggggttcatctccgcgcggggctacgaggccacccatctgcgggacatcgccaaggaggcgggggtgagcgttggcctgctgtaccggtactttcccagcaagcgcgccatcgtcctggcgctgtacgacgagttgtcctcggcgtatgcggcgcgcgccgaggcgttgcccgccggctcctggcgggagcgcttcctgttcgcgctccgggcaagccttggcgtgctcgggccgcaccacgaggtgctcaaggcgctgattcccgtgctcgtgggcggagaagaggacggcctgttcgcgccgcagacggcgttctcccggcagcgggtccaggccgtctttgaagacgccgtcgcgggcgccacggacgtcccgagcaacgccacggtggcccatgcactgggccggttgctctacgtcgcgcatctggccgtggtgctgtggtggctgctcgacaagagcccacgtcagcgcgccaccgagggcctggtgtcgatgctggcgggcctactgccccctgcatcgctcctgctccggctgcctggtgccggaagcatggtcctgggcgcggacgccctctgccggcaggcgctcttcggcgaaccggcgcgtgcccaggcggaagaggtgacgcgatgaataccgcgacgctgggacatgccgaggtctccctgaacgggaaaggcacaggcgagccgcgcgcgagcaccgcatccctggtgcctcccgaggtgggccgcttgcgcttcgatgcggcgcggacgctgtggctctggggcatgctcatccccggtgtcaccgtggggctcgcggcggcgacgcccaccacggtggtggtgtcgctcctgctcaccttcgcgacgctctgcctgggacactcggtgggcctgcatcgcggcgtcatccaccgcacctacgaggcgggccctctcacacgcggcgtgctcgcgtacctgttcgtgctgagcgggctcggcggtcccctgtcgtgggcacgcctgcatgcggtgcgcgactactggcagaaccgtcccgactgtccgccctacttcgcctatgagcactcgatggcccgcgacttcggctggaacctgcacctgcgcttcgagcccgcggatgaccgggccctggcgcggcttcctccagacgtattgacggacccgtggctgtgcttcctggagcgcacctggccgctccacgtgctcgggctgacgggggtggtgctcgcggtgctgggccccgaggccgtggccctctgcgtttgcgcccgcacggccgccggcatcctcggacactgggccgtgggctacgcggcccatgtctggggagagcggcgctacgccctgccgggcgcggcggagagcggtacgaacatctgggtgcttggcgtgctgtcgttcggcgagggcttccacaacaaccaccacgccttcccaggctccgcacgcatgggccagaaggcacacgagctggacctggggtggtgggtcatccgagggctttgtcggctgggactcgtgcgtgatgtacgtacttgagcgaagcgccaggcgacttcacgcgtagcacggcggattgaaccgaggaacacggcgggcttccgggcgctgcatggacgcccccgcgtcaggtggccctcgatacctgagcgctcactgcgaggtcgcttccatccactggaccacgacctggcacagcgccttcttcttcgccttcacctccgccaggtcgcgaagcgtgacgatggctcggtccggggcggcccactgcagcaggccgctggtgtcgtcgaaggagaagccttgcgtcgccttcaccttcgcgccccggtggaagatgagctgaacgcagtccttgggcttcagcttgaatgtcacccggtcatcgtccttgaagcagaagcttggcgcgttccacttgatgcgctccgcgatgcctggatgggcggccaggatggcggtgcgcaggctttcgacttcgtccttccgggcgtgttcgagctcctgcatgaatcgttcgacttcttcggaccggttcgacacgcgcgtcgcctccctccagcaccatgacatttcgagcgggctggtggacgcggcataacccggcccatgagcgaagtcagcagcccgcaatccaaggatgctgggcgagtcaggggcctggtgtatggagcctcctcccccgccgtacccccaggaggaatcctcgatgcgtcgtctagttccagcccttctctccgcgagcctgatggtcggatgtggtcccaccggctccgagtccgagccgtcttcttcgtccacggagcaccaggacgcgccgctcaccaccacggacgtggacgtggccccggagtgtcagggcctgctcaccttcgtcaacatggcgtctctgtccacgctggacgcctatctccccagtgacgtcgcccagaacctcgtcggctaccgcgcgacggcgcccttctccacgttggcgcaggtgtccgcggtccggggtgtcggcccggtgcgcctgactcaaatcgagggtggcgcccgcgcgctgggctacatcaccagcacctgcgccggcatcctggacgagctcgcgctctccaccgatgacgcggcggccctggtcaacctggtgaacaccatcgacagcagcgcgttgtacgccgtcctgccgtacgcttggaacggcgcaacgaacctcctcaacctgcggcccttcacgtcggcgcaggccatctccgaggtgactggcatcggcacggtcagcctgcgcaacctccgcaacgcggccacgcagggctacgccctgacggcgctcatcgccgtgatcaacgcgcaggaggagagcctgtggacgtcccgcctgagccaggacttcgacatccaggacgtgattgacggcgctcacggcaatggcgaattcaagagcgcgcagtgcttcggcatcgaccccagcctcttccccgcgggtcaggtctggactgtccgtcccgagctggccacgggcaccgaggtctacaacgagatcaagagcacggtcgactacgcggaccgcaacgagccgctgccggagacgctctacaccgacggtctggcggagctgcaggcgcgcaccgccgggcgcaccttcaagggctgcttcatcagctacgggaagggcccgtggggcggcatccaggtcaagttctacgtcgacacggtgaccggataccgcatcctgtcggagcagcactggtcggagtgagccagccttgaagcaccccaggcccgtccatggggcctgggggtttcaacgggacgtcacccgcgagcctgcgcgtgattacggaatcgtggccgtcacggacacgcccgagtaggacgaatagccgcgcacggacacgtaccaggtgccagcctgggggttggagaaggagcaggtctcctcgttgccggccagatagggccggcagttgtaggcgctggtggtgggctgcgagccgctgcgcacatagaggtccgcgtcacccgagccccccgactgcaccaccttgagcgacgtcgtgccgctggggaccgtgatggcgaagtgcttccaggtgctggacgagccggacaggttcgtctgggtcagcagcgtggtgccgggcggcggggtcgtcccactgagcttggagtcgatccagctctcgaagtacgacacgcgcgcgtacatacccgggtagcgcgcgtcggcgcagccgtagccccagctcacgacgcccgcgagcttgcgggtgccattgtgattgacggtgagcggaccaccgctgtcgccctggcacgagtccttgcccggcgccttggcgccaatctgatccgggccaatgtactcattggggtagctttgctgcgcctccgtgttcgaaatcacgttgacgtccaccgtgcgcagggtggcggaccccgaaccaccggaggaggtcgcaccccagcccgtcacgcgcgcgaccacggccgggtcggtggcgccgctcgcggcatccgccgccgagatgcggggaatggccgcgacggtggtgccattgaggtccagcgacgtggccagacggagcagggcaacgtcgttgccggaagcgccgtaatcttcatgaatgatggtctgcgccacgttgcgcgtctggcccgtgctcgtgctcgtgctcgaggtggagcccgccacgatgctggtgacggcgtagccatccacacagtgcgccgcggtcagaatccaatccttgttgaggatggagccaccgcaccagtggccgccgtaccgcagggacacctgccacggattctcattgatggtcgtggtggtgccaccgacgatgtcctgctcgatggtcgccggcgccaccgactccgcctgctcctcgaccatctccggaccgcaaccgaccagcaacgacatcgcgccaactgtcgaccaccgccgcatgaccttcactgacatcatggagacctcgggtatctggggaagacgtgaaacggcaaagcacgactagccgacccacgcttaaaaaaccgtaacacacgatcttccccatctaccagccccgccccggatgaagcgctaccgctttcggaggcgctcacgttttgcgacatgcctgtttcattacatctccgccacactttggaatggggcggagcgttgatgacttgtcattggagccgcgggccgaagtgacgacggcgacatgaagcagcccggcggtgtgatgcgacacaccaccgggtccgtcacacccctgactacgggcggccttcctgccgcgtgttgctgctcgcggtggccgcggccgaggtggcgcgtggcagcttcggcggaggcggcttggcgaggctgtccaggaagggcatgaggttttcggcggcttgcaggatgtctcgctcgaagtccgtcaccccctgcggtgagccatccagcctcagcagcctgtcttgcgtctccgtgtgcccctcccagctcacctgggccacgggcccgggcgcgcccgtgcgcgcgaactggaccagtgaatccaccaggtgacgcatgaacgtcccgtcctcctccgtgaacaacgctccggtgggcggcacgtccgcggccgtctccaggaagtagggcacctcgcccccgtgaggcacacccagacgctgccgaggggcaagcatcttcgcgcggtactcgaagtagtagcgccacaccgcggcgccgcgctccgcgtggcgggtggccagcaagcggggcatgaccgtgaagacgaagtcgcgacacatccgccggccaatctcccggtcatcgtccacgtcggggtagagctggcggatggactcggcgaaggcgcccaggcgttcaaggatggtggcggggtcgattccgaacgaggacaccacgctggagtcgtcactcgtgctgccgaggatgagcggcagggagagttgctctccgcgcgcgaaggtctcgcggataggctcgggaaggacggagtctccgtagatgggactgggcgcgttcgcggtgtccgcggggagcatccagaacttctccggccccagctcgcgcaggtccttcatggtggccagcagccggtccagcccgttcctccacgcgaaggccatgccggccagccgcgcgtccgccaggggcttctcctggagcacgtacgcgctcatggccacgccccggcggaagaggttcttctcccgcacctgcggcgacgtgaagagcgacaggacgctcttggcgcccgccgactgtcccatcaccgtgacattgccggggtcgccgccgaaccgcgcgatgttgtcgcgcacccattccagcgccagcacctggtccagcaggccgaagttcgcgggcccacccggattctccttctccagcgccggatgcatgaagaagcccaggtgccccaggcggtagttgaaggtcaccagcaccacgtcgcgcgacgccaaatgaatcccttcatagggcggcagacggcccgagccgatgacgaaggcgccgccgtgaatccagaacaccacgggcagcttcgcgcccgcatccagcttgggcgtccacacattgaggaagagacaatcctcgtgcatctcaccggggtcgccaccgccggcctcgatgcaggcctgacgggactggtacgcggagaagccgaagttgaaggcctcgcggacaccgggccatggagtggcgcgctcgggcgccttccagcgcagcgctcccgtgggaggcatcgcgtagggaatgcccctgaagacagaaatcttcccttcgaccaggccctgcaccttgccttccttcgtggctacctcaggcgtcttgatgacgttcatcaaccggctccctttggtcgtgcgactggacgtgcgacaagtgaagacacacgcacccagactccagcggagaagccctcgtgcacccattcggtctagatgagcgagcgtgagatagaattgaatggcaattcctggcaacacacccctgccagaaacccgcattgctgaaatcgatcgctgggaacacgacacccgccccgccctggagtcggccggggcgcgggcccgggccttccctgctcccggaccgtaagccgcgccagcgtccgcgcgagccgctccggatggacgggcttcagcatcttgctcgcgtcaacttccggacactgtgttagggtggccgccgcatggcgatcgagaaggcgcttctgctcatcgcggatatcggcggatacacccgcttcatgagtcaccaccgcttcagcctcgcgcacgcgcaggagacggtggcgcagttgctcgaggccgtcattgatgcctcgggcccactcaagctcgcaaagctcgaaggagacgcggcgttcttctatgccgtgggcgacgattttcccgccttcgcccggatggtcgcggacatccgccgcgccttcgtttcacggcgagagcagttcatcgccgaccgcatgtgcaagtgcgacggctgcatgcaggtcagctccctgacgctcaagttcgtggcccacgccggtgaggtcgccttccagcgcgtgaagcacctcaccgagctggcgggcgtggacgtcatcctggtgcaccggatgctgaagaacgacgtccccgtcacggagtacgtcctgatgaccgacgccgtgcaccaggggctcgcgccggagctccgccagctcacccagggactggagcacgacttcgagggcatggggcgcacggcgacgcactacctggacctgaacgcgttcgtcctcgcggcgcccgagcccgtgcgcccgagccttccgcgcaagctctgggccaagctgaagctggagctgagctcgatgaagtacgtgctgggcctcaagcaaccctgcgagaacttccgcaacgtcgaggtcgtggacgcccagaagccgtagcgggcgcccgcgattcagggggcctccgcgtaccatgcaacgcgttaccctggcggccggggcgcaacggccaggacgaagcgcgcgtagccaatctccgccgcgttcttcatcaactccaggttgacccaggccacgatgtctccgaagggcttgccttgcagcggccaacgcgtgcgctccgtggagcggaggtcctcgtcgctgagttgctcgatggcggcgcgccactccgtgtaccgccgcgaaatcaagtcgcgcacggagtccgcggtacccggccactccacctgctcccgcgtcagggtggcatccccgaacgagtggttgtgaaccatggaccaccagaaccccaggtgccacgtgagccaggccacactcgccggccccaggtcgtaaccttcatgctcgggccactcgacatgccactttccatccggaccctgctgggcatggaggcccacggacgcgggacggcgcaggcaatcctccgtggtcaatccctccaggtgatagagggtgagtgcccaggcgatgtcgagttgccccaggagcgtgtctcggagtggattggacatgagcgcaggatagaccgacgtcccgctgccccgacacggaacctgcgccaggatttgaacccgacagaggggatgacatgagcgatgagcgattggtgctgacgcggggagacatcacccaggtccaagcggatgcgattgtgaacgcagccaactccacactgttgggaggcggaggcgtcgacggggccatccaccgagcggccggccccgggcttctggccgaatgccgaaccctgggccgttgccctccgggagaagctcgcatcaccggaggccatgcccttcccgccaaacacgtcatccatgccgtggggcccgtgtggcaaggaggaagcagcggcgaggagaccgtgctcgcgcgctgctaccggcgggccttctccctgatggaacagcacggccttggcaccatcgccttcccgtccatctccacgggcgcctatgggtaccccatcgagcgggcggcgcgaatcgccttgcgcgagattctggccgcgctccagcgcatgccgaccctccagcgcgtcaccgtggtgctgttcagcgacagggacctcgacgtgtaccaacgcgcacgtcaggcgctggagcccaccccttcggcctgaagggttcgcgacgcgccagactggcggggctcgcgcgcggagacggcgatgcaccactgcgcggcccagtaacacagcatgatggcgtagccggagcccggcagcgggcgtacgaagagcttgagcgccagcagtccgtcactgacggcgaatagcagcgcccccgcgagcgcgaacccctgcgcgcgacgcgaaagccccgggctccccagcatggcccacgcacgccatgtcatcgcacagatgacggcgacgtaggccgtcaccgggagcgccatctcacccaggtgagaccagagaaagacgctggcccccaccgccaggaacacgaagggcagcgccctgccccaccgcggctggcgtgacaccgtgacgtacgcggcgacgtagctcacgtgcgccagcaggaaggcccccaggcccgggaggaacagccctggccccacgtccagcagcacgtctcccagcagcgacagcgccaggccggcgaatatccaccgcccgtagcgtccgagcggcggccactgccacaggagtaaacagagcatgggcagcgccttcgcggccacccggacgtccgcacggaccacgtccagcgcgagggaggaccccaccgnccccgcgacccccaccgncgcgaggaacttcgtcgcactgccagacgcgctgcgcatgggcggcaccatacccc

SEQ ID NO: 1109 - DNA, 14077 bp, Myxococcus xanthus
gacgcccgaggcgctggactcgtcccgcacgtacagcgcgccatccttcaccaggaaggtggcgtgtaggggcgacacgaaggcgtcgtccgcgaacaggatggcgccgcgctggcggcccacgacgcaaccggtgacaggcagcttgtagcgctgaccccgggtggagcccgcgatgaccgcgagcccgaaccgggaggcggccggaggggcagggcgcggcgccgtggtcgccgctccggcccggctgggcatcgcactgtccggaactggcgggggcggacgggtggtggccgggcctgacgcgccgcccgtacgggccatgatgcccgggggggccgtgggggtgcgctgctgcggcggccgttccactgtcaggcccgcggcggtggggggcggcgtccgggccgaggggcgcaggcccggcggaatggcgctgggcgcgggcggaaccaccggctccgccaccttgccgcctgggaaattggacaccgcgaccggccggctgccgggcggcgtaccaggccgggcgacggcgaggggcggcttcgtggcggcggggcggggcgcggcagcgggctcgcccagcgcctggccgcagagcacacaggcagccgagcgaggcgagttgtacccgtcacagttcgggcagaccacggcgagggaggacagcaggagctgtgacatgtgcggaggcgaatctacggggccgtaaaacaccgggtcaacgaaagcgaacgcaccaactggggtgtcctagaggaaggtgacgtccaggtgtggggcaacgttgcccctccgttggtgcaaagttacgattgctcctcattcgatgattcgcctgaacgacatcctccaacgggtttcccagtaccaccccgaccccgacctggacatcatcaagaaggcctacgtctattcggccaaggtccatcagggtcaactccggaagtcaggcgagccctacctcgtccatccgctcgaggtcgccggcatcctgggcgagctcaagctggacgaggcgtccatcgtcaccggactccttcacgacaccattgaggacacgctggccaccgaggaggagctgacggagctcttcggttcggaagtagcccacctggtagacggcgtcaccaagctgtccaagttctccgcatccgccagcctgtcgcaggaggagaagcaggcggagaacttccggaagatgatcatcgcgatggcgcaggacatccgcgtcatcctggtgaagctggcggaccgcacgcacaacatgcggacgttggatcacatgtcggaggagaagcaggcccgcatcgcgcaggagacgctggacatctacgcgccgctggccaaccggctgggcatctcgtggatcaagacggagctggaggacctgagcttccgctacgtcaaaccgcaggagttcttcgcgctccaggcgaagctgaacaagcgcaagaaggagcgggagaagtacatcgaggacacgtgcgacctcatccgctccaagctggccgagcgcgggctgaagggcgaggtgagcggacgcttcaagcacgtctacagcatctacaagaagatcaagtcacagggcatcgacttcgatcagatccacgacatcatcgcctttcgcatcatcgcgcccaccgcgccctcctgttacgaggcgctggggctcgtgcacgagatgtggaagccggtgccggggcgcttcaaggacttcatcgcgattccgaagcccaacatgtaccagtcgctgcacacgaccatcatcggtccgctcagcgagcgcgtggaggtgcagatccgcacctcggagatgcacaagatcgccgaggaaggcatcgccgcgcactggaagtacaaggagggcaaggccgtcatctccaaggatgacgagaagttcgcctggctgcggcagctgatggagtggcagcaggacctgaaggacccgaaggagttcctggagacggtgaaggtggacctcttcaccgacgaggtcttcgtcttcacgcccaagggcgacgtgcgctcgctgcctcgcggcgccacgccggtggacttcgcctacgccatccattcggacgtgggcaaccggtgcgtgggcgccaaggtgaacgggaagatcgtcccgctccgctacaagatgaagaacggggacacggtggaggtgctcaccagcccccagcagcacccgtccaaggattggctcaccttcgtcaagacgagccgggcgcagcagcgcatccgcggcttcatcaagcagcagcagcgcgagaagagccttcagctgggacgcgagctggcggaccgcgagctcaagcgcttccagctcaacttcaaccggttgctcaagtccggcgagatgaagaaggccgccgtggacctgggcttccgtgtggaagacgacatgctggtggccattggctacggcaaggtgacgccgcagcagctgtcgcaccggctcgtcccccaggagaagctcaacgccgcggaggccggggggcgcgcggatgccaaccccgccgcgacaacctccggtggagccggcaactcggtgctgccgggcctgtcccgggtcaccgacctggcgaagcggctggtgggccgcagcaaccgcagcggcgtacagattggcggcgtggacgatgtcctcgtgcgcttcgggcggtgttgcaaccccgtccccggagatcccatcgccggcttcatcacccgggggcggggcgtcacggttcacacggtcggctgtgaaaaggcactggccacggaccccgagcggcgcgtggacgtgtcgtgggacgtccggggcgacttcaagcgccccgtcaccctgcgcgtcctcactgcggaccggccgggcctgctggcggacatcaccaacaccttctccaagaagggcgtcaacatctcccaggccaactgccgggccaccggagatgaccgggcggtgaacactttcgaggtcatcatctccgacctcaagcagctcaccgacctgatgcgaaccatcgagcggctccagggcgtctactcggtcgagcgcatctaaccgccttcgcctttcgtggtagagcgcccggaaaccccggcggcccgattcgggccgctctcaccccgaggtgcgccgcatggctcgcaaggcaatccactccgaccaggcccccaaggccattggcccgtattcccaggcggtgcaggtggacgccgggaagatgaccttcctctccggccagattccgctcgaccccgccaccatggagatggtgcagggcgacgtcgtcgcgcaggcggagcgggtgatggagaatctgaaggccgtgctcgccgccagcgggctggacttctcccacgtcgtgcgctgcaccatcttcctcaccgatttgggcgacttcgcccgggtgaacgaagtctatggccgctacttcaccggcgctccgccggcccgcgccaccgtgcaggtgtccgcgctgccgcgtggctccaaggtggagattgacgccatcgccgtctcctgaagcaagggctggaaagacgaaggccgccggactcagaggagtccgacggcctttgtcgcgtcagggcgccagggccccagcgggaactacttcgagtcggccaccgcgccgccgagcttcttcagctcctcgtcgatgacgcgcttgaacgcgtccacgggctgggcgcccacgagcgtgcggccattgatgaagaacgtcggggtgccggaggcgcccacgctggacgcctgcgccatgtcggcctcgatctgcgcgttgaacttgccctggtccagcgcggccttgaacttgtccacgttcaggcccagctcctgcgcgtacttctccagcgaggcgcggtccagcgcgcgctgattggcgaagagcttgtcgtggtactcccagaacttgccctgctcgttcgcggccagcgcagcggcggcggccaacttggcgttggcgtggaagggcagcggctggttcttgaaggcgaccttgatcttcccgccgtactggtcctccaactgcttcagcgtgggcaccacgcggctgcagaaggggcactcgaagtcggagaaggcgacgatggtgacgggcgcgttcttgtcgcccttcaccggggcgttgcccacgtccaccttctggaccgggggctcggccggagcgccaggggccgcggcgggcgccgtcggggcgttggcgacgttctccgcgttcagcttggcgtagagctcctcgggcttggtgccggcggcgagcagcttgtccgccttgccaatctcctcgtcgatgacgcgcttgaaggcctcgaagggctgcgcgccgacgaactcacggccgttgatgaagaaggtcggggtgccgttggcgcccacggcgttgccggcggccatgtcggcctcgaccttcgccttgaacttgcccgaatccagggcggccttgaacttggcgacgttcaggcccagctcctgcgcgtacttctccagcgaggcgcgatccatggccttctgattggcgaagagcttgtcgtggtactcccagaacttgccctgctcgtgcgcggcgtgcgaggcctcggcggccagcttcgcgttcgggtggaagggcagcggctggtgacggaacactacgcgcacgtccttggcgtagctctccttgatcttcgacagggtggggcccacgcggctgcagaaggggcactcgaagtcagaccactcgacgatggtcaccttggcgttggccgggccgaaggagggcgagtccgaggggatctccaccttgcggaccgtggcggcgggctgctgcggctgcgccttgggcgcggcgcgctcggagcccttctcgatgatcttcgcgtacacctgcgaggcgggcacgccgcccttcaccaggttctccgccttgaccagctcctcgtcgatgagggcctggaagttggcgatgggctgcgcgcccgacaggaagcggccgttgatgaagaaggccggggtgccgctggcgcccagctggccggccagggcctggtcgcgggtgatgatgtcctggaacttggggttgcccagctcagccttccacttgtccaggttgaggcccagctccttggcgtactgctccagggacacgtcatccagcttcttctgattggcgaagagcttggcgtggtactcccagtacttgccctgctcgccagccgccatcgcggcgatggccgcgggcttggcgcgcgggtggaaggagagggggttctgcttcatcaccacgcggagcttcttgccgtactgctcctggagcttctcgatggtgacgttcgcccggctgcagaaggggcactcgtagtcggagaactcgaccacggtgacgagcgcgtcggcgctgccgtgggtcggcgagttctcgatgggcaccttgaacacggtgggatccaccggacggcgtccacccggcgccggggcggcgggagagttcggtgcggccttggcgacttcggacttcgtggacgggccagtggtgacgcggccgccaacgaacccgagcaccaggccgaccagcagggccacgatgacattgggcttcataagtgggtcttgctccttcgccatggggccggcattgtgggcccgagcgggttttcaacgagggcagagggcggcggtcttaacagagggaattccagacgcgcaagcaagccgctctggccttccagggagccgcgccccctcaggggccccaaaactcgggagtcttcggaaaaattccgtcagagtcccgatcatggaagccgccgttcgcatcgacacccgcggggccttgtgccccatgcccatcctggaactcgccaaggccatgagagcactggcgccagggacgctcgtggagctcgtctccacggatcgcgggttggaggcggaccttcccgcatggtgcgaggctacggggaatccactggtgcgcatggagcgccgggagcgcctctacgtgggctgggtgcgcaaggcgggttgagtcgcctgccgccagcccacgctttgcttcagagcatctgtttgcttcagagcatctgcaggacgcgatcttccaggcgctggccgcggctgacgcccaggatgagcacgtcgtgctgcagcaggtgacgcaccacctggctgatgacctcttcgggcgccacgccgccgctgaagcgcacgcgcagcacggtgtcgctctccatgcgcgcgtccgtgatgtggggcatcaccgtgagctccgggatgatgacgctgccgcgcgcaatctggacgcggaactcggcgccctggccggtgagctcattcatgctccccgcttgggcgagcgtgcccttgtcgaggatggcggccgcgtcacacagctcctccagctcctggaggttgtggctggagaccaccaccgtctgccggcccttcatgtcgcggatgacctggcgcacctgggcggcgacgcgcggatccaacccggcggtgggctcgtccagcagcaccaacggcgggctgcccatgagggcctgggccatggcggcgcgcttggccatgccgtggctgagcgcctgtgtctggacgttccaggcctccatgaggcccaccttgtccagggcctcgcgcgcctcacgctccggctcggccagggcggacagccgcgcccagtacatcagcagcgcgcccacttcccagccgggcggcagcaccgcgtcctgcggcagcgcgcccaggcggcccttcagggcgcccggggtggtggggtccacatccatgaccttgagcgagccctcggacgggtagaggtagccgcacatcatggagaaggtggtcgtcttgccggcgccgttggggccgatgagcccgtacaccgcgcccttgggcacggagaagctgacgccgttgacggcgaccttggggccgaagcgcttggagacgccgaacagttcaatggccacgtcgctcacaggtccctcgcgcgcaggatgccgtaggccgccatcaggaagacgaacgcgaagaccgcgtaggcggctccgctcgcgccgaactgcgccaggcccggatgcagcagatcgctggcgtagtacgacggggacaggtagcgcaggaagcgcaggttgcccgtgtcaccggaggcccggccgatggtgtccatcagccagaagacgaacagcaggatgaagttgaagaccaggctcaccgctggtgagcggaacaggctggagcacagcgtcgtgagggccacgtaggccagcgagaagacgatggccgccagccagaacttcagcaggttgagcgccatggcggcgaagctgaagtccgggttggccacgcgggcgtagatgaagatggccaggtcgatgatgagcaccaggccgagcagcagcgtcgcctgcgtcaggaacttgcccagcagcaccgacgagcgccgcgcgcgcaccgtgaggtagcgcatggagcgtgggcccacttcaccgctaatctgatcgaagcccatcagcgcgatgtacgcgggcaggaagaagagggtgatcttgaagacgatcaacacctccagcggcacctgcgccagggcctcgatcatcgcggagtcgttgctggtgaggaatcccagcacgcccttgcgcatctcctcgttgagctgcacggaggcgctcgcatccgcgcccgcgccctccaactgcttggcgacggcgctgcggacttcgcccgcgagccagccgaccaccagcagcaccaacgcggagaacatgctgtagaggccgagcagcaccaccgtccggccgctgcgcacggcccggcggagctcggcgctccagatgaccaccgtttctttcaatccgtccaaagtgtgggcgaacctagcggagttgcacacccctccgccaagtttctgatttcaccgagggacggaagcgaccagggaggcatccgtggacagcgcgcccccagccggtaggatccagccgtcgctcacccccccggagccccccgtagcaatgcgcttccaccgccgtctcctgtccgccgccgtgctgctccccctggtcctcgtcattggagcgaccgagccggagcagcccgcgtccgccggtgcctccgaagacggaggggtgggggtcgccgcccctgacacgacgtcgcatgccgcccaggcggacgcggggacgtcgggggccgccacggcgtcccagggcgcccagcccgatgcggggacttcaggatccgccgccgtctccgccgccgcggtgctcgggggcgagtcgccggatggtggactggcggcgcttgccgcggagccggggatggtgccccccgtgcccgtgccctcgcgcgagaaggcgccgcccatcgccacggtgaagtcgcttcccaggtccgcggacctcatggcccgcgcggcgctggaggacgggaagctggtggtgaaggagaagggcggaaagaagaagcagctcaccatcgacccggtgctgcaagcgtcgctgacgcagatcctccgcaactacgagacgccctacggcgcggccgtggtgctggagccgtccaccggacgggtgctggcgttggcggagcactcggcggcgaggccggagctgcgagggctgccggttcgcgcggtgttccccgcggccagcatcttcaaagtcatcaccggcggcgcgctgctggaggccggcgtcacaccggatactgaagagtgcttccacggcggcaagcggcgcatctccgagaagcacctgcaggacagcgagcgggacagctcctgctattcgctggcgctggccatgggcaagagcgccaacgtcatcttcgccaagctgacgaacaagcacctcacggtggactcgctgcgccgcatggcggcccgcttccgtttcaaccgtgagattgagttccccgtgccgacggatgtgtcgctcgccgccatccccgaggagaccttcagcctggccaacacgggcgcgggtttcggggacgtgtacctgtccccgctgcacggcgcgctcgtcgccgcggtggccgccaacgagggccgctgggtggaccccatcctcttcgagcccgaaggaccggcgccgctgctcccggtggaaggcgagcccgtcctcacgccggaggttgcgaaggacctcacggcgctgctggaggagaccgtcaccagcggcaccgcgcgcgccgtgttccgcgagcgtggcttccgcgtggatgacgccgtgggcaagacgggctcactggcggaccgcgagcccttccgcgactactcgtggttcgtgggcttcgcgcccaaggacaacccgcgtgtcgccgtggccgccatcatcgtcaatgacccgaagtggcgcatccgaggcacctggctgggccgcgaggcgctccgcctggggctggagcgaatgcccgcgccggtggagatgacggccccggcctccgccgctggcaagcactgacgcttccgtcagcgcggcgtcagcttcaccagcgtcgcgtccacgaagccggcgaagaacttcagcgcatccagctcctgcagcggcgacacgtggacgatggcggccacgtcgcgccgtccatcgatgcgtgacagcaggtagcgctccggcgcggagagctggagcgtcttcaggtgcccgggcgcgacctggagcgtggggaccctgggcgggtcggccagctcccgccgcaggtgcaccaggagcttctcctgggccgccttgacgaactccgccgtgcgaggggagggcgacatctcgtgcgcccgccgcgccagcgcctcgccgtcccgcgcgttgcccgcgtcgaggaagagctgcgcggcctggagcacttcgtccgacgacgtctccgagccgatgatgccccgctctccgttctcctcctccaccacggacatctcggactcgggcggctcgtcggacaccttcaccgcgtccaggcggtagagcgcatacagccgctggtagaggaagaagtccgtggcgtgcagcgccagcgcgatgccgtcgatggtgaggccttccttgatgagctggacgatgcgctcgtccatgctcccgggctttcgctcgggcagcttgcgctcgtccaccgagagccggaccgcgccggaggggaagacggcgtggatggcctgccaggccgtctcccggaactcgccctcgcggtggacgtccagcaggtccacgctgacttccagtcccgcgacctctggcgccgtgtccgccgcctcgaagaggaagtcgccgtcctcccaatggaaggcgtcgagaatcatctcccggaacttgtggctgagcgtgccgcgcacggtggcttccggcaccagccccgtcatcaccagaatcttccccaggaagatgcgcgtctgcgcctgggtcgaaaacgccttctccaactggtcctcggtcaggtgccccatattgatgaggaactgaccgaagaactcgcgcggctggttggaactggcgctgaccacatggccttcgcgcagttcgagttgcttgcgcacgtccccacgctccaccttcagggaccccgtcgctcgccggttcccgagatagacgacgaggtccttgagaggcatcgtcgagaagtcgccagacaagccacgcattaaccgttcatcctgccccgcatgcgcgtcgatatctactcgaaacccaattgctctctctgtgacaaggcggccgccgtcgtggagtccgtgcgcgctcgcatccccttcgagctgcggatcatctccatcctggaggatgcggaggccttcactgcctggcgttacgacatccccgtggtcgtcatcgagggggtgccagccttcaagcaccgcgtggacgccgcggagttcgaggcgcggctgcatgaggtcaaaggtggcacaaccattgctaaatccgctgcccagcatgggtagccagcttcccttctctagtaaatccgaggggatgaggaagtcaggatggggttcgaggctgtaaatccggggtgggcctcgaaaagcggcggagaaaagttcacgcgggaaggtggaacggtgggtgtgcgaaggaagcgagtgggcaaggccggacagccgcccaccgtgctcgtcgtcgagccacgagcagcagacctggagcggacccggctgctcctggcggaggccggcttccgggtggtgcccgtgacacgcttcgacgcggcggtgccgctcttcgaggtcatccgcccggccgcggtgttgctggccgcgcaggcgcctgacttcgcggccgtccaggtcgcgcgccggttgcggcagctcagccatggcgcggtgccgctgctctacctggtggatgagcgggacgccgaggcccggcggtactgcctggagcgggggcagtgcgtggacctggtgccccgttcgggcagtggctcggagctggcgacgaagcttcacgcgcaactgaagctgaaggacgcggtgctgcgggcggccgcgggggaggaggccggcacggcccaggcgctgcatgacccggtgacggggctctacaaccggcccttcctgctggagttcatcagcctggaggcgcggcgggcggagcgctacggcggcggattctccgtggtggcggcggaagtggggggctggtcggcctttcgcaaggagtttgggcgcggcatggcggagcgtctgctggtgtacagcgcggtggtgttggggcagacggtgcgcgacgcggacgcggtggcacgggtgggggactgtcaattcgcgctgatgctcccgggaacgcccgcggagtcggttccggaggtggtatcccgcgtggcggcgcgcttcgacacggcccgcttccaggtggaggggaaggtggtgcgcacgtcgctggagctgggaacggtgagcttcccggattcggtgggcacgcccacgcagctgttgagcgcggcgcagcaggacatgcgacgcgcgcgtgagtttcgccggatggtcgggagcacgtcccggttgtcggtgtgagggtgggtcggacttcgatgcagcgggcgagtggaggcgaggggatggaccggatcgcggtgctggtggtggatgacgaagaggcggtgcgcacgtttctgtccgagctgctcggaagtgcggggtaccaggtgcgctgtgccgcgagtggcacccaggcgctggagatgctctcagggggctccttcgacgcggtgttgctggacgtggtgatgccggagatgagcggcctggaagtgctgcgccgttaccagtccatgggcggcggcgcgcccgtcatcgtgctcagcgcgctggcgggggcggacgacgccgttcgggcgatgaagatgggcgccagcgactacctggccaagccgttcggcaacgacgagctgcaggacgcgctggcccgggccctggggacgcgggcgccggagcgtcaggccgtggcgcccatcctgccctcgcgcacggtgctgccggtggtggattcggcgcaggagcagcgcgtcctcatctccacctcgccggccatgcgccgcgcgcgtgcgctggtggagcgcatcgccgacacggacgtccccgtgctgctgctgggtgagtccggtacgggcaaggaggtcatcgcgcgggagattcacgcgcgcagccagcggcgcaaccgtccgttcatcaaggtgaactgcgcggcgctgcccggcgagctgctggagagtgagctgttcggccacgagcgcggcgccttcaccggcgccactgccgagaagcccggcaagttcgaactggcggaccagggcaccatcttcctggacgagattggcgaaatggccatccggctccaggccaagctgctccaggtgctccaggacgaggagttcttccgcgtcggtggcaagaagagcgtgcgcgtggacagccgcgtcgtcgtggccaccaaccgcgacctggagaaggaaatcgcgctgggcaacttccgcgaggacctcttctatcgcctcaacgtggtggccatccgcctgccggcgctgcgcgagcgccgcgaggacgtggttccgctgacggaccacttcctcaagaagtacggccgaggctacctcagcggcgtgtccgagctgcccacggaggtgctgcacgccttcgcggactacgactggccgggcaacgtgcgcgagctggagaacatggtccgccggctgtgcgtgctgaaggacccgacgctggtgctcgacgagctgcgggccgcggtccgcgctcccgcgagcgcgccgtccctgcccacgtcctacgccggtgacgacggtggccccttcggccgcgcgcacgacgagggcttccgcacgccgccgcccgccgtgcaggtgctggagatgccgtcgcgcggcgccgcctttgggctggcgtccgtcgcgccgctggcgccgcccgcgcacgcgcccatggtgatggagtccgcgaacgcggtggtgtccgcgccgcgctacgtcaatcccttcgacgtgccgcagccgccgccgccgcccgcgcccaccggggagctgtcgctgaaggacatcggcaaacgggcggcgatgctggccgagcgcgaggcgattctggccatgctccaacgcaccgcgtggaacaagcggcgcgcggccaccaagctgcgcatcagctacaaggcgctcctctacaaaatcaaggagtgcggcatcatcgacccgcgcgcgagcgcggagctgtaggtgagccgtaaccgtcgcttgcactgtccccgcggtctcgctatcgcggggacatgacgcctcctctcgtcctcctggggtctgggtacacgctcacgcggctcgccgtggcggaggcccgcgccgggcgcgacgtgctggcggccacgcgcgacgccgcgcgccgcgccgagctggagcgcgccggagcccgcgtcaccgacctggaagacgcgctgacgcgcacggcgggggctcacgtcgtcgtctcggtgccgcccgacgcggggttggacacgcgcatcgcctcggcgctggccggccaggttccagcgcggctcgtctacttgtcctccaccggcgtctatggccgcgcgcggggccacgtggacgctttagagcacactagat

SEQ ID NO: 1110 - DNA, 15209 bp, Myxococcus xanthus
  unsure (1)..(15209): unsure at all n locations
ggtgtacagccacccggtgggcaaccagggccacgcgctgggcgcgagcatcgacttccgttcggccagccggcaggaagaggccaagacgttgcgcctcggctcgtacatcgccatcgagctgaacaccgccacgtcggtgccggagtgggacgggcagaaggtcttcgtgatgcaggaggacccggcctacctcaccgaggagggctggaagttcttcgtgtccaggcaggagtcgttctacctcctgggccgcgatgggcagggcgggcagcgaagtcagggcgcaaagggaggcaagggcgtgacgacgcgtggcatgcccatgctctgagcccggcctacgcgcctcgcccgctggcgtccgcccacgtgagtccgaagcgggccaggtacttcttcagccggtccgcgtcgttgacgctcttcttctgggcgcgtgactgagcgaacagcaagcgccccgcgtccgacaacgagcgtgatgcccggcagacgctcagcacgtccgcgagttggacccggtcgaaacggtccagctcgctggcgaggttctctcccagcacctccgcgaccaggtccccggcgacgaccgccgccttcgctccggagggccgccactgctcgcgcagccgttcgagctcctcgtccaccacgtcccgagtaatccgtccgcccgccgccagcgtggccatgcgcagcaccgccgcgttgaggtcccggaagttgcctgcccacctcgcctcggtggacgtggcgaagtccagaaagcgctcctgcgcctccttgttcatggtgacgcgcgtgcccacggcctcggaggactggtccagttcgaagagcaggttgggtggaatgtcctccgggcgctcgcgcagcgcgggcagccggaacgtccacaggttgatgcgcgcgagcaggtcctcccggaagcgcccgcgctcgacctcgacttggaggtcccggttggtgccggcgatgagctggaagtcgctctccacctctcggtccgcgcccacgggcaagaagcgcttgtcctccagcgcgcggagcaacatggcctgctcgtccgcgcccagctcgccgatttcgtccaggaacagcacgccgccattcgcctgccgcagcagaccgggcctgtcgctcagcgcgcccgtgaaggcgcccttcacgtggccgaagagcgcggacatggcgccgtcgccccggagcgtggcgcagttgaggtccacgaaggggcccgccacgccgcgccgcgacttcttcagcgcgtagatgcgccgcgcgagctgcgacttgcccgcgccggtggggcccgtgatgagcaggggcgcgcgggactggacggccacctgttcgatgcgctcgatgaggcggttgaacgccgcgttgcgggtgtcgatgccggacttgaggaaggccaggccttctcgctgctcctgccggaagcgcgcggccagggtgtcgtactgggacaagtccaggtcgatgagggtgtgcgtacccgcgcccgcgcggtcccgggggtcgggtgacacctggaccagcttgccggggatgagccggctctccaccagcaggaacatgcagatctgcgcgatgtgcgtgcccgtggtgatgtggaccaggtagtcctccgcctcggggttgaaggcatagccgcgcacgtagtcgagcagcgcgccgtaggtctcctccaggtcccacgggttctggatgcgcaggggcctgccccgcacctccgtctccggtgacacctggcggatgtcccccgccagtgtggccgcgagcgaggtcgcgttcggtggatgcaacaactccagccggtgcaccaacaggtcctcctgctggcacagcgccaccgtgggccgccaccgcgcccagcgctgcggcccctgcccgttgtccagcgtcgtcccgagcatccccaggaccaccgtcttgcgcgcgcgcgatttcgccatcgagataggattttatctatggggatagggaatgccagctcgcttggagggctcccctcggaagcggtgttggcacgccggctgctctaggcctcctccgtgatcgggacacagcgcccggcggacgactgaaaggtggagacgatgagccgcatcaacgggaactacgaggtgctgtcggacgaggcgggccgccccatcaaggcgtggacggtgggggttccgttcgaggacgaggcgaagaagcagctccgcaacctgcgtggcctccccttcatccacaagtgggtctcggtgatgccggacgtgcaccgcggctacggcgcgacggtgggaagcgtggtccccaccgtgggggcggtggtgccggcagcggtgggcgtggacatcggttgcgggatgatcgccgttcgcacgacgctgcgggcggaccagctcccggactcgctgcgtggggttcgctcggcgattgagcgcgcggtgccgcatggccgctccgacaacggtggccgcaacgacgtaggggcgtggcgtgtggcgcccgcgcggcaccagaaggagtgggcgcggttggtggaggggtacgaccgcatcgtcgggaagcatccgcgcatcggccgtgggccggagctgtcgcacctggggacgctgggaacggggaaccacttcatcgagctgtgcctcgatgagtcggatggcgtgtggctgatgttgcactcgggttcgcgcggggtggggaaccgcatcgggagctacttcatcgagctggcgaaggaggacatgcgccgctggttcatcaatctcccggacggggacctggcgtacctggcggaagggacggagcacttcgaggactacgtcttcgcggtgagctgggcgcaggacttcgccgcgacgaaccgcgcgctgatgctgcaagaggcggtggatgcgctgcagttgagcggtgagctgcctccgttcgagctgaaggacgcggcggtgaactgccaccacaactacatcgcccgtgagcatcacttcgggaagaactgcttcgtgacgcgcaagggggcggtgcgggcacgagagggtgacctcgggatcatccccggaagcatgggggcgcgttcgttcattgtccgcgggaaggggaacgcggacagcttccattcctgcagccacggtgcgggccgggtgatgtcgcgtgaggcggcgaagcggcgcttcacggtggaggaccacgtgaaggcgaccgccggcgtggagtgccgcaaggacgtggacgtcattgacgagacgccggctgcgtacaagcccatcgacgcggtgatggcggcgcaggcggacctggtggaagtggtccacaccctgaagcaggtcgtgtgcgtgaagggctagaaacccagaggtgaccatgccgggatgaagacaccgaggcgcccgcgctccccaagaggccgaaaggccgccaggatggggacgcgggcgccgctattttcacgggggtgtcagtgcgtgccgggtggttcgtgagtcgcgagcagcaaggaggaagtcgtcatggtgcgcatcgatggttcattgggtgagggcggggggcaggtgctgcgcacctcgctgtcgctgtcgctggtgacgggcaagcccttcaccatccagaacatccgcgcgggtcggaagaagccgggcctgctgcgccagcacctgacgtcggtgaaggccgcggaggccgtgggggccgcggaggtgtcgggcgcggagctcggctcgcgagagctgaccttccggccgagtgccctggccgcggggaactaccacttcgcggtgggcaccgcgggcagcgcgacgctggtgctccagacggtgcttccggcgctgctcctggcgaaggggccttccacgctgatgttggaggggggaacgcacaaccccatggcgccaccgttcgacttcctccagcgggcgtatctgccgctggtccgtcgcatggggccgtccgtggaggcgaccctggagcgtgccggtttcttccctgccgggggcgggcggttccgggtcgacgtgcgacccgcgccgttgaagccgctgcacctgctggagcgggggcgcgtggtccgtcgcgacctgaaggccgtgattgcgatgattccgttcgacgtggcgcagcgcgagctgggcacggcgggagcggcgctgaagtggcggcccgatgaactccggacggaggaactgaagcgtccgctggggcccggcaacgtgctggtcgccgaagtggagagcgagcacgtgacagaggtcttcaccggctttggtgagcgggggaagcgggcggaggccgtggccggacaggtcgctgaagaggtgaagcgctacctcgacgcggacgtgccggtgggcgagcacctgtgtgaccaactgctgctcctcgtggcgctggcgaagggcggcgtgttccgcacgctgccattggatgggcatgccgagacgcagctccaaaccatcgcccagttcctggatgtgaaggtgaaggtgcgggaggtgtctcgcgaggttcgcgaggtggaggtccgcgcctgagccccaggggcgcgtccgcttgcgggcggccctggggctgagcatcgcgcgctccgctcgnagggcagtcagnccccatgncgggtgggcatctccgtggcgcgcggtcaggcgccggcaccatgcatgtgcggaggagacgtccgcgtggcagaggtacctgaagtcgaaatcatcacccgggatttgcggcaggccgtcgtggtcggcaaccgggacgcggacgagagcctatggcaggcggggattgccccacgcaggctggcgtcgtctctcacggccgatgaggtggtgcggctggaccgcgccatccaggcggtgctcgatgaagggctccgcatgcggggaacccagcgagacctcttcggcgttcagggccaggcgaagcaccggcgcaacgtgtttggccgcgccggggcgccgtgcccgcgctgtgccacaccggtctcccatcaacgcatcggtggacggaacacgtactggtgttcctcgtgccagcccctggcgagcgcacccgaagtccccgcgcaatcctcgctgctctgaatcgcggcgcgtcgcgtggacccgttgatgccaggatccccgcgaggcttcctcgcgcccgtgcgttcgttccggtcaggcccgcatgttagatcacgtcccgatgccccgggttgctgccgcctgaactcaaggccagccccggagcatgagggggaacgatgccgtcaagaattgcaggtgggcttctagggcttgtgttgcaactggcgccgtgtgtgttgggaatgccgatggcgctcgccgcgtcgccgcgcgtttccggggaggtcacccacgaccttcccgtgagattcgaagactgcaagggtccgcctccggcggcgcgaacgacgacgcgtgcggtgcgtggggatgagctgcccgacttcgtcatcaccgatgttcgtgcgccatcgcgcgtctacgggcgggaccccttcgaggttgtcgtcacggtctgcaacatgggccgccgcgcggggagcgcggacgtcgaggtgttcgtgtcccgggacgtgtgcatcgccaaggaggacgcgttgctcggggccgtttcctcgggatgggtgggggccgggaagtgtgcgtcacgttcaatcgtcgccaacaaggaggcgtcccagtcggggatgtggttcatcggggccttggtggatccgcacgcgcgtgtggacgaggtctcggaggagaacaacgcgcacgctggcgactccgtgacgttcgacgcgcttcccgacttcaccgtggagtcggtggctgtgccctcggtcgttcgcccggagtggcctttttatgtggctgcccgtgtgtgcaacagaggccaagggtctgagcaggcgacggtatatctctatcggtcgtccgacgcacatatcgacaccgacgacgtcgtcatgcgcgaccagtcgtggctctttctcgatgccggacgatgcgaacgcgtcgtgttcgtcggggtgctcggcgaaccgggcacttcgtacctcgcgttcatggtggatccgctgaatgagcggcccgaggctgacgagaccaacaacctcagtgtcgtcagtcctctcgaggtgggctcgattcccgactacgtcgtcgcggcgctgagggcgccggccatggagtcgatcaacgggagccttcctgtgcgcgcgacagtgtgcaaccagggcacggctcccgcgtccgccacgcaggtgcaattccagcttcgtgccagtgagccctccgctgaaggcgtgttgcgtgtctcatcgcggaacatcccggccttggaggccaaccagtgcatcgagtgggaggagtcgctgggctccatggcgaacgcggcgcgaagctggcggctggtggccacggtgaatccggttggtgcgcagacagaggctcattcgggcaacaacgacaggtccgtgaacgtcctgctgggctcctcggcggacctctccgtcacacgcatcgagccgctgacgcacgcgctcgttccgggggcctccttcaccacggaagtcacggtctgcaatacgggaacgctctccgcgtcggcgctggcggttcatgtggcgctgtcggatggcccggaccctcgggcaggcattcgcgtggggacccgggcctttggcgcgctaggcaagggttgcgcggtgcttcccgtggtggggacggttcccacgcaggggttgcccgccactgtccatgtgaaggcctcggtggagctcgttgcgcctgtcgggggagaggcacacctggagaacaatgcgctgacaggccccgtggtggggctggggaccgggcctgacctggtcgtgacgcggatcgtcgcccaggggcgtgcggcgtggcccgaagggaagctgcctgtctcggtgacggtctgtaatcagggcaatgtgcggacgccgcgagcggccgtccagacgctcttcgtgccggaggtgctcccggagatctcggcgggcatccagggggcgaagctgtctgtcgagtcgttggcgccaggggcctgcatcacgttggacgcggaggcgagggtgccctactacacgggggcgtttcgattggcggcgagagccgacatcgacaacgccatcacggagttggtggagtccaacaacgacgccctgggggacatcatccaggtgacccagctcagtggattggtcgtcacggaccttcaagcgccgacggcgatcaacacgaacgccaccatcaatgccaccgcgacggtgtgcaaccggagcccggtggctcagcctggcactgcggtcgggctcgcgctgcgcacggaggatgactttcccgtctccgcgctctccgagtatgtcgtggttccggcgctcgttccgggtgcgtgcgcacaggcgacgctgcggggctggtccaacgtgccgcaggagggcgcctacaggctggtggcttatctcggagacccatgggacgtgtatgcccccgagcagtggcgcgccctcttgttctccgtgcccatcgccgtggggggctggagcgacttcgccgtgacggccgtgagtgccccggtggtcgtccaagcaggtgacgcgtattcgacggaggtctccgtctgcaatcgaggctttggtcaggcgtcggcctccgtgagggcctacttgtctcgtgacgagcacctggacccggcggtggatgtgcgggtcgggcagatgagcgtgacgcttgcccgggggcagtgccggacagtgtcggtgtcgtcgcgggccaccgtcagcagcggggacgtctggtacgtggccgcggacgtgagtgtgggtagcctcccggacctggtgtccgccaacgatggtcaagtgggtgctcggatggtcgtgacaccctgagcccgagaggggggcgcgggcgagtgggcagcggacacggtggctgttatgacagccccgtgtccgacgtcacaccccccgcgtcacctccgtttgaagccgcgctggtccgcgccagcgaggagctcggcttccccagctactaccagtcctgtgtgcgtccgttgctgcgcaacccggaaggccgctggccgcggtgctgtggcggcgggtgtgagccgtgcgcccagacgctcatccaggtggccctgcgcaccctggagttgatgggcacgccacgccagacgccgcttccggactgaggcggaggccacacgtatgtccgcaccgcacccgttgctgctcgtggatgacgacgccgcgttccgcaaagtctatggcgggctgctgcgcgatgcgggttacgaggtagtggaagctgcggaccggccttccgctcgcgcggccttcgatgcacgcgacttccccctggtgctgctcgacctgatgctgcctcccgacgggagcgtctccgcggggctggaggggctcgcggcgttgctgagcgcgaagcccgggacgaaggtcatcgtcgtgtccggggcaggggacacgcggcacacgctggaagcggtgcgcctgggcgcgtacgacttcctcaccaagccagtggacccggatgtgctgctggtggtggtgcaacgggcgctcgcgcgggtgacactggagcggcaggtggagacgctgcgcagctcgctcacgcgcgcggcgggcggtgtctccctggtggggcagagcgcgtccttcctggcggccacgtccctggcggagcgcgtggcggccagtgagctgccggtgctcgtcactggcgagaatgggacggggaaggagctgctcgcgcgcaccgtccacctcaagagccgccgccacgacgggcccttcgtccccatcaactgcggcgcactgccggagtcgctgctggagagcgccctgttcggccacgtgaagggcagcttcaccggggcgaccaaggaccaccgtggcctcttcgcggaggcggacggaggcacgctcttcctggacgaactgggcgacatgtcgccgtccctccaggtgaaggtgctccgtgcgttggagacgggcgacatccttccggtgggcgcggaccggcccgtccaggtggacgtgcggctcatctccgccacccaccaggacctggggcgcatgcttcaggaaggcgccttccgcgaggacctctactggcgcgtgaagggcgttgaaattcgcctgccgcccctgcgcgagcgctccgcggaccttccgctgctggccaagcacttcctcaatcagtgcgcccacctgtgcccggacgggcgcgcccggctgttgtcggacgccgcggcggaggccctgctggcccatgcgtggccggggaatctgcgcgagctgcgccatgagatgcagcgcgccaccgtgctggcgggggagcggcgcgaaatccagcccgaggatttgtccttcaccggcagcgagcggctgcacgccacccgcgcgccaggtacaacgacgctggctcagaaggtggaagcgttggagcggcgcgaaatcgaggaggccctgcggcgcctgaatggcaaccgcacgcacacggcggaggcgctgggcctgtcgcgccagggactgctcaagaagctggagcgctttggactgacgtgagtcagaagagccggacgcccaggcccagtcgtacgctgtagcccaggcgcgtgtggctttcccccgagcgctcctggaaggactccacgccgagctggcccgccgccagcgccgacaggttgctgcccaggtacacctccacgccgcctccgccgagcgcctggatgcgccgcgactggccattggacagaccgatgtccaccggcacgtccaacagccccagcacggacaccgtgtccgcgacgcgccagcccgccaccagcccgggcgatacgcggaacagcacgccggagtagttccggtcatccatgtacgtggcgcccgagttgagcaccacgcccaggcccagcgtgggcgccagggacaggatgccttgctccagcaccttgcgccgcaccgcgagctccagcgaggcggagagctggaaccactggagccgcgcgcgtgcctccagttcgaagccggagatgccttgccggaagcccacgccgatctccggtgcgcccacgaagccatagagcgccgtggctccgtccggcagcgtcactggcgccagcactgcgcccagcggatcctcgctcgtgccgcgaagaagcgccgtgtcagacgtcgtgacgcgcggcgtttcgtcggcgggagcaggggctggcgcctgggcggcggactccagggaaacgagcaacagcgcggacacgagtgggccaaagcagccgggacgcatcatgaatacaccctaccccgcagagcggcgggcggaaaccccaacgattccaggggcttgtcggcgccttgcgtatttgtccggcttggcgcgaagatttagtaattcatggctaccgcgctcccacaaccttccacgtatgccggaccggaagccctggccgaggcgggggcgcgtcgccatgcgtcacgaggccggccccgggtgttgctggtggattcggcgccgggcgcgcaggccgtgctggccgctgcgctggcggaagcgggcttcgaagtcctgctggtcgcgggcgcgcaggccgcgttggcgtcgctggcggaaggcggcacggcgccgcagctggtcgtcaccgaggtggagctccaggacggagacggcttcagcctgtgtggccaggttcgcgcggacgcgcgcacggcgcacctgccggtgttgctgctggctcggcgtgaagaggagttccaccgggaccttgcgggcggcgtgggcgcggacgactatctggcccatcccgtggacgcgcgagacgtggtggcgctggcccggctcaaggcgggccagtgcagcggtgacgcggccttcgcgtcggacacgcagcggctgccgctgacggacgtggcgcgagcgctgctggcgggcgtccgctcaggccgcgtggtgatggcggagggccagggctggttcgccttccggcacggcctggtggtggacgccgtcttcaatggcgagcgcggcagcctggccttccggcggatgctctgcttcggcgcgggtgattacgcggtgacgctggggcccgagctgcacaagggctcgttcaccatggaccgcccgtacctgtgcgagacggtgctgcaggggctggagcgcttcgacgcgctgcgtgcccgaggcctgccgctggcatctcggctgacggtggacttcgcccggctggcggagatgctggcgtcgttgccggaggacgtgggcgaagtggtgcgcctcttcgacgggcgccgcacgctgcgcgccatgttgctggagtgccagttcccggaggcggtggcgtacgaggcgtccacgcggctgttcgcgctgggcatcctggtgcccgcgtgcctgctggaggagcgcgagcgggcgcactgtggctccacggtgcccggcttcttcgagcccgcgccctccgtggacgccgagccggtggatgcgcgggagccggcccccgctgcctgcggtggggatggggcctccgcgcccttcaccctggtcggaggctcgcagcctcccgtcatcctggacttccccaagaaggtccccggcgcgtcgagtggcgcggagggcctggagggggctgtccggtccgacgacgcaggcgtttgaagggtttgactcggcggccctcggtaggggacaaggcccggcgcggggtgctccatccgctgggcgcccgttgaggcacacccaccatgtccggtcacaatcggtggtcgaagatcaagcgccagaaggccgcgatgggcgcgaccaaggggaagctgtactccaaggtcgtcaaggaaatcaccgtcgcgtcgcggctcggtggcggtgagccctccggcaatgcccgcctacgcgtcgcgctggccgcggcccgcgaggccaacatcccgaaggacaccatcgagcgcgccatcaagaagggcacgggcgaactggagggagagaactacgaggaggtgacgtacgagggctacggccccggcggtgtcgccatcctggtggaatgcctcaccgacaaccgcaaccggaccgcggccgacatgcgctccaccttcagcgcgtacgggggcaacctgggcgccgagggcgcggtggcctggatgttccagaagaagggcgtcatcagcgtgaagtacggcccctccgaggaccaactgatggagcaggccatcgacgcgggcgccgaggacgtcatcatgctgggggacgaaggctccgaggtgcgcaccgcggcggcggacctgcacacggtggcgggacggctccaggagtcgggcctgccgctggggcagcagcggtgggtgttcctcccccagaacaccgtcgcactggacgtggacacggtgaagaagctcctgaagctgctggacgcgctcgaggagaacgacgacgtgcagaacgtgcacgggaactacgaaatcgaagacgcgatgctggattcgttgttgcagtagcggagtcctggaacggagtggaacgtgcgcgtgcttggcgttgacccgggaagccggttcatgggcttcggggtggtggaggagaagcggggccggctggtgcacgtgggccacggtgtcatcaagggcgatccggcgttgccgctgtcggaccgcctgcgggacttgcacggcgcgctgacggcggccctggtgaaataccgcccggccgcggtggcggtggaaggcgtgttcaccttccgcaacgcacgcagcgcactggtgctggggcatgcgcgcggcgtcgcgctgctggcggcggcgcaggcggggctgcccgtcttcgaatacgcgccggcgaaggtgaagaaggcggtgggggcgggcggcgcggacgggaaggacgcagtggcgcggatggtgcggaccttcctggagctggatgcgtcggtgctggagcgcgcggacgcgagtgatgcgctggcggtggcgctgtgccacctcaaccatgggcgggccgcggtaccggcggcgtccgcgtcgggcaagaagcgcaagggcgcggcggcgctgctggcggaccggctggcgcccgcgtaccggcgtccggaggcgagatgatttcgcggttgcgtgggacggtgttggagaaggacctggaggacgccaccatcgacgtgggcggcgtgggttaccgggtgaacttctcctcactggcgctggggaagctgccggcggagggacagccggtggacgtgcgcgtgcgcaccgtggtgcgcgaggacgccttcgacctcttcggcttcctgacgaagggcgaggaagaggtgttcctgctgctcaacagcgtctcgcgggtgggaccccggctgtcgttgatggtgctgtccggcatggaggtgccggagctggtggcggcgctgtcgcggggcgaggtggcgcggctggcgaagattcacggcgtgggcaagaagaccgccgagcggctggtgctggagctcaaggacaaggtgaagacgattcacctggaagcggtgtcgcgcgggaccgcgccggccgccgtcagtggagcccatgcggacctggtctccgcgctgctcaaccttggctacaagcagccccaggcggagaaggccgcggacctggccagcgaacggctgggggcggaggccaccttccaggcgctgttccgcgaggccctcaaggcgctccgctcgggcggctgatcgctgcgacacatcgggtgtgacggcgctgtgacggcaaaatccgggagaacggctgggccgtaccgtcctctctcccgttgagagcttgaaagacgctggggccagaaggccccagtgttgccctgtcttcagaagtcgtcaggcgtcgcgtgatgacggacagcagacgcgatttcctacccgagtccgagtaggagcatccggcatgggtgacactttccagctccagcggcgagggccggcacggcgccgaggatgagggttgcatacatgacgtcatggcgtgccattcctgtggggctgttgctgctttgcgggggaactgcggggtgtgcgccgctggtggaaggtgatgcgggggaggaatggacgcgggccgttcccgggtcgcaggcacctgtcgacatgtcgaaggagtcgtcggggcgcaaggcgcccgtcctgtttccgcagccttgggcggtgtgcagcgacacggcccagcggctgcgtgacatccgaccgggactgacaggttcacagccgcaggaactggcgcgggcgggcgaggtgctcgtcttcagtgcggatgacggcgtgagtggccgcgagctgtgggccagcatcgacggggcgcggcagacgctccggctgaaggacctgcggccagggccggcgggttcgcagcctcggaacctgacgcgggtggggccctgggtcttcttcgtcgcggacgacggcgtgcatggcgcggagctgtggcgcacggacggcacggcggacggcacggtgctggtgcgggacgtgcggcgtgggacggtgggcgcggcgccggagttcctcaccgaggtggacggcgccctctacttcacggcggatgacggcgtgagtggccgcgagctgtggcgcaccgacggcacggagaagggcacggagcgggtgcacgatttcctgcccggcgcgggttcgctcgccctgagccagttgacggcgtggggcaagggcctggcgctggtgtccgccaacgccgcggagacggtgctctggtgggtggaccgccagggccggccgacgcggctgttctcccagcagggcgccggggtgattttcgggctgacgccggcgggccggcacctgttcttcctgttggacccgggcacggagcagggcgaactgtgggtggcgcgcacggcgccgccgtccgccgagcgggtgcggacctttccaggtgactacccggcgtacctcgccgcgctggatgacacgctgtacttcttggcgggtgcgagcgactggtacggcaacccaggcgacgcggtgcacggcggcgagctgtggcgcagtgatggctcggcgcagggcacggggctcgtcggggacctctggccaggcccccaggggtcgatgcccaaggagctggtcgcgctgggcggcgagctgtacttcaccgcggacgacggcgtgcacggccgcgagttgtggcggaccgacggcacggcgcagggcacgat

SEQ ID NO: 1111 - DNA, 17938 bp, Myxococcus xanthus
tgacaagggcggagcccccaagagccgtggcgcgggtcgtccggagcgccgtgagtggagcgcgggcggagacgccgcgccgcggactcgcgcaccgcgcgcgggtggcgaaggccgtccggagcgcaagtcgtggggtgctggcgccggcgccagccgtgccccgcggggtgaaggccgtccgtactcgccccgttccggaggagcgggtgctggccgcccggagcgccgtgagtggaagcctcgcgccgaaggggcagacgctccgcgtggccggggtggtcctcgccgtgagggctccgagggcggacgccccgcacgcagcacctggacgcccaccgacgaaagcgggaatccccgtgaacgcgtcgtccgggccggggctcgcaagggccctcccgccgagaagtccggcggattccaggactggggcaagaagaaggagcgggcgagcgccccgagctggagcaatgagcgtccccgaggcggcgcgggccggcctcctccccgggggcctcgccgtccgcgttgatacatgacgcggtggattgggcgggaatcgagggggattgatataacgggcgccaactcctacaccggagaccgatgcgaaccggcgcgcgccccctcattctcgcacttgccctgcttctcggctgcaacggcagcagggaccagcttctcgcggacctccagagtcctcgtccggaggtccgcgctctcgcggtgaagaagctggccgggcagggcaacccggatgacctcgtcctcttcacccgcgcggcgaaggacttcgccgccatcgtccgggccgaggccgccgtggcgctgggagagagccaggacgcccgcgtcgtggacctcctgggcgaactgctcgaggaccaggacgaagaggtccagggccgcgccgccatggcgctgtccaaggtgaacaacgaaaaggccaaggcgtacctcacgctccagtacggacggcggggccgggccacgcgtcaggtcatcgtccaggccctgaagaacgccaacgttccgggggccatggcggaggtggtcgccgctgaggcccgctcccagtgggaccgcaaccagctcgcgctgaccgaaggcgcgctgcccgagcgcgtgggcgccgccgaggagctgggcaagagcggccgtcccgacgccgtcaaccggctgctgcccttggttcgcgacagccaggtcatcctcgccgccgccgccgtgcgcgggctgggtgacgccggcgacaagcgcgcggtgagccccatcgcgttgctgttggaggagaacttcccggaactgcgcgagtccgccatccacgcgctgatgaagcttcaggatccggtggccacgcagcgcctccagttggtggcggtggagaagagcgccgtcagtccgctggccatcgacgccatcgtgtccttcccccggacgccgcagacggatgcttcgctgtgcgccatcgtcatggagggcgcaccggcggaggcgctcgtcgcgggccggagcatgcgcacacgcggcggctgttcggtggacaccattggcgagcggctggcacgtccggccacggccgccagtggcctccaggccgtcgaggggctgggacccgcggcgctgccgctgctcggcaaggtggtgccgtggctgagccattcggacgccacgctgcgcctgctcgcggtggaggccgtggcggaggtgggggatgcctccgtggtgcccgcgttgcagaagctctacgagcaggaggtcaagggactggaggcgctgcgcgccgactgggtgacccaagcgctcccggagaagttcggcgtggggttcgacccttcgaccatgccgcccaccccgtcgacacctggcctgaaggatgagcggccgtcgcggcacgcggacctgctggggcgggtgaaggagctcaatgccgcccgggtgcgtgagtccgggcgggacgtggtgcggcaccgtgtgcccaccgagctgtatgacgacgtggcgccggagcggctggtgccgctggcgacgctgctgcgcgcgttgggggcgctgaaggcgcccggcgccctggaactgctcaccggctacacccaggactccagcgccgcgctgcgcgtggcggccctggtggggctggcgcggctgggccccgagggcgtcaacgtggccaaggccgggctcgtcgagccggaccgcgacctgcagaaggccctggcccaagtgctggcggaggccggcgaggcggggcaggccgcgctcatcgagatgctgccgaagatggggagcgagaagctgctggtgttggatgcgctcacgcgcgccggcgccgtgccgggctccgcttccacgcagctccaggccgtggtgcgcgaaggtggaccggaagcggcgctcgcggcggccctgctgggacggattcaggcgaaggacgccgtgcccacgctggtgaaggcgctggacgagcccaacagcgtggcccgccgcgacgtgctgctggcgctggggagcatcggcgacgcgcaggcggcggacgcggtggccaaggacctgttccacgacctgcccgagattcgcgccgcggcggcttcgtcgctccggaagctgggcagcgccgcgcatgcggaccagttggaggccctcaaggcggactacttccggacggtgcgtgaggccgcgggcgcggcaccggcgtccgcgagcaccgcgtcggagggcgctccctgatggagttgcgcaagctcaaggacaaggcgtccgaggcattcaccaagggacgcttttccaaggcggcggagctctacgaggactactgccgggccgagcccaaggaccatcagtcacgcctgcgctccggggatgcctgggtgaaggcgggggcaacgggaccgggccatctcggcgtatcaatccgccgcggaaggcttcgcgcgcgaggggttccttccgcgcgccatcgccgcgagcaagctcatcctcgagctggaccccgcgcaccgtggcgtgcagcagatgctcgcggacctgtacgcgcgccggggaacgcccatgggcgcacgtgcccggggcccgatgagcagcgcgtcgtccgtgacggtgaagacgtcctccgagcctgctggggcgtcgcgtctgcccgaggcagtgcgcgcggccgtcgccgccattgatttgggggagaggggggagggtgcttcgccagccccgttggcggctggtggtcccgcggtggacctgtctgcggagctgcctccagagctgtcgttgtccaccaacgcgtccacgcgtggcaccgaagaagtcgtccactcggtcgaggtaggactggcgtcggaagaggggaccgctggcgtggagttgacgctggacgtggagcccgtcgtggcagggacgctggtggacgacgcgtgtggaaccgattcgatgacgtccgaattggccacgtctgtcgaggcatccacgatcgtggcggcctcaatcccgcccgcgatggccctccgtgagccagaagcgccgccgctcgcgacccggattcccgcggttcaacccggaggcgcgcgtccggcgacgagtgcgttgccgccaggactggcaccgcgcgcgtcgcagcggctgcccgcggtgggcgctgctcgcgcgcccgaacccgcgccgtccgcaccgccacggtccgtctcgaacagcggccgctggcaagccctgtcgtcgcccatcaccacgcaggcagcgcccgcagcttctgaagccgcggccgcctccgcgcccccaggactgcgggcgcgccgtgccgacccaccggtccccgcgggcgccaccgcgctcccgggccacgacctgtcacccgcgctgggcgcctccttccggacggcggcgagtccgtcctccttcaccgagttggagctggaagccgactccctgttgcacgcggtggagctggccgcgcaggcgggcttggatcggcaaggcctgggggccacgtccatcagcgacggcctcgaggaggagctctacagcctgacggaggaggtccctcccgacgcgggttccctggacgcgctgcccacgattccgctcttctcggacctgcctcgcgacgccttcatcgagctgttcgagcgctgcccgctgcggcgcttcggcccggacgagcgaatcatcgaccagggcagccacggcgatgctttctacgtcatctgcgagggcgcggtgcgcgtcttccggacggaggagggccagcgccaggacatcgcgacgctcgaaggaggcaccttcttcggagagatggccctgctgtccggcgcggcgcgcacggcctcggtggagtccgcgtccgacgacacccagctcctggagatctccgccagcgtgctcgccgagctctcgggaagccacccgcaggtggcccaggccctgaagaagttctgccgtcagcgcatgctgacgaacgtgatgaacacgtcggagctgttccgcctcttcgggcgaaaggaccggcgcgcgctcgtggagcgcttccgctcccgggacgtggagcgtgacaccgtcatcatccgtgacggcgacccgacggacggcctctatgtggtcctgtccggcgaggtggaggtgcgcaaggacggccacctgctgacgcagctccgggaaggggacgtgttcggagagatttccctgctccagaagacgcctgccaccgcgaccgtgaccgccacccgggacaccacgctgctgcggttgccgcgcgccgacttcgacgcgctcatgtgcagccacccgcaaatgctggccctgatctccgacctgagcgacgaacggctccggcgcacgcagcgcgtgctgaccgaagccggcgtcgaggaagacctcatcctcgtctgacgtcagcgcaccttggcgaggtagtcgtctcgcgtcaccagggccgcgcgtgtccaggagctccagcatggcccgaagcgagcgggcctgctgggccaccatccgctccagccccgccacctgctgcgtaagatcctccacgcgctgggtgagctccgtctcacggccgggctgcgccagggtcgccgaggccgcgcgcacggccatcgacacgggagcgctttcggccgggggcgccagctcgaaggtgggctcgtccatgccgaaggacagcggggtcgccgtcgtggaggtgacctccccgtggtagtggcggcggatggcgcgctcgatggacgaggcgctcgagacgaccacctggaggcgctggccacagtggaaggccaactcctggaacgcctccacgttggtggggtcggcggtggcgacggtgagcgtcttcgtggccggatccgcggcgatggggaagacggtgtagcgctcggcgatgtccgcccggagcgcctgcagcaccaccgcggacgctgcgtgctgctccagatccaccgtgggaatggcgagctgccgcgacagggcgtggaccatggagctttcgtccacgtaccccatctgcaccagggtgaggcccagcttgccgccccatttgcgttgttccgcgagggcggagcggagctgggtttccgagaggagcccggcgtccatgagaatctccccaagccggcgcttgcggccagggagcgagacagagggtgtgacaggcggctgtttcacggctgtgaagcatagcagccagtcaggcacgaccgcagaccagccaacacccaggaggccggggaggagcgtgagggacgggaatggggtagaacagtccctacatgacgcgacggatactgccgtttctcgcactgctgctggcttcgggctgtgcatcgcagcgcctggctggcgcggacctggaccgcgtccggcgtccggccttcatctcccgcatcgaggacggggccggccccaagagccacgtgttccgcgaggactcggcgtaccggaacaagctcaagaagttggagccggtggaggcggaccggcggctgacggtgaagctgcttcaagccgtcacgcgcttcgagatctccgagcgcctccgggtcaccacgttgtcgcaactgccgcgtgagttcccgtggacgcacgtggtggaccccgcgcgggtggcctcggtgctggagagcttcctggtggaggaggtgccggccaacgcgccagactacgacctggtggcgtcgctgggcgcggacaccatcgtcgagttcgtcatccaggactacggcatgcgcagcgatgacggccgcgcgggcgcgtacctgcgaggctatggccgcatgttcaccctggacgggcgcacggaggtgtggcgccggccgttcgccatggaccaggtggccgagggcaaggagcacctggacccgttcaaggtgggcaaggacccgtcactcttccgcgcggcgatgacgtccatgctggacgaggtggcgcgaatgttcgtgaaggacctgacgcccaccgaccgcgccggcgcgccgccgccccgggcttccgcggcggcttcggacgtggttcccggcaaggcgggcgccccggctccggcacccgaggcgacgaagcctccggaagacgagctggcgcccggcgagctgccggaccccgacccctgagtcacacggcctgattcagaacagcgcgtgctccaccaggagcacgctcagccccacgacgaagctgacgagcgtcaccgggaggcccacgcggaggaagcggaggaagctcatgttgaccttcccgcgcgcggcctcgaacacgatgaggttggccacgcttcccaccagcgtgaggttgcccgccagcgtggagcccagcgcgagcacgtgccagcccagctccacgtcgtgcagcgtgggcacccacgtccgcgccagcatgacgaagggcacgttgctgaacaggttggacgccaccagcgtcagccccgcgaagcccagcgtctccctaaggggcggacccgccatgaggggctcgaacaggacgcggatgtcctccgcgtagccgtgcttgttcacgccatagacgaccacgaacaggctcgcgaagaagagcagcagcacccagtccacgcgctccagcgcctcgcgtggctcgcggcgcgccagggccatcaccagggccgcgccggccagggcgctccagctcatgggcagcccggcgaagaaggccacgacaaccccggatagcaccgtcaaggtgagcaccaacaggccccggtccacgggcggaggtggagggttgggctcgaattgcttcacgggcaggtcatgccggaacagatacaggagtccggcggcgaccaccgctgtggagagcagggcaggcagggccatgtacgccgcgaagctggcgtaggacagcccggaggcgccctggatgagcatgttctgcgggttgccggtgaaggtcgccaccgagccgctgttgctgcccatgcacaccgcgagcaggtacggagccggcggcaggcgcgcgtcctccacggtggccagcaccaggggcgtgagcatcaaacacacggtgtcattcaccaggaacgcggacagcgcggccgaaatgaacgtcacggcgagcagcaaccgccggggcgtgtgcgccctgcgcacggcccacgcgcccgcggtgcggaagaaggacgcctgggacatgtacgccgccagcagcatcatccccagcaggaggacgatggtgtccgcgtcgatggcgtgacggttcgcgtcggcgctgtggttgaagacctcggccggagtgacgacgccgaagacgaccatcagcacggcccccagcagcgcgcccccggggcggtccagcttcaggtacggaaggcgcgcaccggcgatgaagacgtaggtgaacaggaagatggcgagggccacggcgcggcacactagtggagtgcccgcacgtccgcctctgcgcgtattggctggagctcaaaccaatgaggtgcgctcccgcgttgtttgcctcggtatacgtctgtacagtgcccggcccatgaagccagagaaggaaccgggcgctttcggaggggcccgtcgcacgccgtggaacgcgcctcgcgggttggactccgtgctggaggggtggcggtcggaccggcagctccgctcctgcttcgtcctggatgaggccacccccgcgcgggcgggcgtcttcgcgcccataccggaagaggtggcgccccaggtgcgcgacgcgctcgagaagcggggcatccagcagctcttctcgcaccaggcggaggcgtaccggctggctcgggcgggccagagcctggtcatcgccacgcccaccgcctccggcaagagcctttgttacaacctgccgctgctggaccgcttcgcgcgggagccccaggcgcgggcgctgtacctgtttcccaccaaggccctgtccagagatcaggaagagtccctgcgcgcgctgatgcgcgaggcgggcttgtcccatggcgccatcaccttcgatggtgacacgccggcggatgcgcgccgggccgcgcgggagcgcagcggcgtgctgctcaccaacccggacatgctgcacacgggcatccttccgcatcacgcgagctgggcgcgcctgttctccaatctgcgctacgtcgtcatcgacgagctgcacacgtaccggggcgtcttcggctctcacctggccaacgtgctgcgcaggctccagcgcgtggcgcgcttccacggcgcggacccggtgttcgtcgcggcgtcggccaccattggcaatccggaggcccacgcgaggcggatgctcgggcgggacgtgacgctggtgtcggagagcggggcgccttccggcgagcgccgcgtcatggtgttcaacccgcccgtggtgaacgcggagctgggcatccgggccagctatctcaagacggccgcgcggttgacggccgacttggtacgcgcgggcgtgtctaccctgctcttcggacagacgcgcaacaacatcgaggtgatgttcaagaccctccgcgaccgcttgttcgacgagaagttggatccgtccctcatccagggctaccgcggtgggtatctaccgggcacgcggtgcgccacggaggcggcgctgcgggcgggtgaagtccgctgcgtggtggccaccaacgcgctggagctgggcatcgacatcggctcgctggacgcggtggtgtgcgcgggctacccgggttcggtggcggcgctgatgcagcgattcggccgggcagggcggcgcggtgaggggagcctggcgctcctggtgacgtcgagcgcgccgctggaccagtacctcgccggcgacccgcgcttcctcgtgggctcgccggtggagcacgcgcgcatcgacccggacaacgtggagatcctggtccagcacctcaagtgcgcgtccttcgaattgccgttcgaggagggagagcccttcggggacgtaccgccggagtccaccacggaggcgctcgggttcctcgcgcagcacgaggtggtgcaccccaccgtgggcgaggcgggtcgtcgcgtgttccactggtccacggatgcctatccggccaaccacgtgtcactgcgcagcgtcggctgggacaacgtggtcatcatcgagaaggggacggaccggacgctggcggagatggacttccgttcggcgcacacgatgctgcacgagcaggccatctaccaacacgaggccgagcagtatcaggtcgagcgcttcgactacgagaaccacaaggccttcgtgcggaaggtggcgccggactacttcaccgacgcgatgacctacgtgcgcgtgcacgtcatccaggaggaccaggccgcgcccatgggcccggaccttcaggcgggcatgggcgaggtgagcgtcatcgagaaggtcgtggggtacaagaagatcaagtaccacacgcatgagaacgtcggttacggcgacgtggcgttgccggagatgcagatgcacaccacggcgctctggctgacggtgccggagacggtggtgcgcgccatgcgggcgccgcgaccggcggtcatcgacgcactgcgcggcctgaccacggcgctgcgcacggtggcgtgcgtggggttgatgatcgaccctcgggatatcggcaagacactggggagccgggatgacgcggaggggccgccacgcaaggatggtggcgtgggcttcgacccgacgctgttcttgtacgacaacgtgcccggcggagtggggctggcggcgcggctgtacgaccagcgggacgagctgctgagccgtgcgcgccgactgctggagtcgtgcgcgtgcgaggatggctgtccggcgtgtatcggccctgccgcgggggcgatgccgggacaagcgcccgtggacccgcatccgcgcaagcgactggcgctcgaagtgctatcggcgctgggcatcgcgggaatgcagtaaccgggaggcgcggccgtggacctcaagcgcaagctggcgcgcctgacgagcgtgggccccgggggcaagtcacccccgaagccccccgtggcggagccacaggccgagcccgccgcgcgcgctgattccatgcccgcgcctgcggccgaagcgggcgtacccgacgcgctcgccgcgcagttggcgaagttggttcaagcccggcgcatggaagcgccgtccacgcccgccggcgcggaatcgcaggtcgcccgcgcggagggcacggtggaggccgcggcagcacgccccgtcacggcttcgcctccagccgccccccgagatccccgcatcgacagcctgcgccggatgctgtcggactggtcggagcgtcagggtctggccgccgcgcgccggggcacgccaccgccagccccccctggcccgctgcccgtggagtcccgtgccacggcccacggcacggtccacatctccgagcgcatcctctccccggaacaccaccacggctccgcgcctctcgccgcggccctggacgtggagggccccctggtcgccagcctcgcgctgcacgcggacctggcgggcgtggacttccaacggatgctcttcctggacacggagaccaccgggctcgcgggaggaacgggcaccgtgccattcctcgtggggctggcatggttcgagggccgctcgctcaaggtgcaccagctcttcctgcggcgcctgggagaagaggcccccatgttgcgctcgctcgccgagcgcatggccgcgtcctcctgcctcgtcaccttcaacggcaagagcttcgactggccgctcctgcggacgcgcttcgtcctcaaccgcgtccccgcacccgtggagctgccccacctggacctgctccactgcgcccgccgcgtcttcaagcaccggggcgccggcacgcgactggtccacttggaagaccaggtcctcggcttccggcgcgtcgacgacgtggacggctcgctgattcccgacctgtacttccgctacctgcgcggcggagacggctcggcgctgacgcccgtgctggagcacaacgtcaacgacctcctcctcctggcggccctgctcggtgagctggtccgccgcttccgagcagggggcgcagacgcctccgtgccccgggacgcggaccctcgcgacctgctcggcttcgcgggcgtggcgctccgggcccgcgactacgcgcgcgcccaggccttcgctcgggccgccgcggcgggggacaccggcgccgtgggcatcgaagccctggccctggcctcccggctgtcacgcaaggcgggtgacgcctcgaccgctgcggcgcacctgcaccaggcactgaagaccgcccagggcttccaggccgcgacgctgcacctccaactcaccaagctgtacgagcatggcctcaaggacctcgcgcgggcgctgcaccacgcgaagctggcctcggcggcggagctgcccgtggaccaccaccgccgaatccttcgcctggagacgcgcctggcccggagcacccgagcggcctcgctggacctgggaatggggagccctcgctcaggaacctgacgattctgggcttccgcaccactggaatcggacagtcgatccgggcgggacgctcgcctcattgtcagacaggcacatgattgaggcacacgccacggccgtgcgctatgagggccccatgaaaattaccaaggacagcgtcgtctccatcgatttccgcctccacctcggcgacggcaaggccgtggacgagagcgagccgggggagccgctcgtctatctgcaggggcacgaggaaatcgtcccgggcctggaaaaggcgcttgagggcaagtcgcgtggtgacaccctccaggtgacggtgggtcccgacgagggctacggcgactatgacccggaaggcatcgaggaagtcccgaagacggagttcccggagggcctggagctggtggcgggcggcgtgctcagcgccaccgacccggacggggacgaggtggacttcttcatcaaggaagtgaaggccgactccgtgctggtggacttcaaccacccgctggccggcaagacgctgcacttcgaggtcaccgtgcgggacgtccgcgccgcgacggccgaggagctggagcacggccacgcccacgggccccacgactctcactgattcggacgggcgccttcgcgggcccctccttgcttcgacgccgggcgtccccaagacaggacgcccggcggaagtcctccgcctagccgcccaggaagtcggacgtgaaggcgaaggcgcccatcatgtagggcagggcgccgccacggttcgggtggttcaggtaccacgcgaagttcagcaggatcgtcggccggttgaacgacgagccctcgcgcgtgttcagggcgtacgccaagatggggccgatgcgcgtgtggctgttgtccacgttctgcgctccgcccgagccattctcgtagcgcggccacactccgctgaagcgggcccccagcgtgagctggggcgtcgtcagcatcatcaggtcggtgtcattggtgaacacccagccccggccggggatgagcgtgtccagcagcgcgtcgtagaaggacgcaccgttgccctcgcgcagcgccacgttccagtactcgatggacgccttgctccgcaccacgaacgagccgaagcgcgcctggagcgtgggctccaccatgtagtggtgaccggaggtgctgtacgcggcgtcctccgtcaagtcgcgcgcgtcgtcggagaagtccagcatcgggttgttgtacgactggaggaacccgaaggtgccgaagtaccggacgtactcataggtcgcccgcaggttgaagatggccagcggctgaatctcgaagacggggccaatcttcaccgaggccgggttggccttgatggcgaacgcgccgttgacgaagttgtcgcgcgtcaacatggactcgccgtcgaacatccgcttctggaggatgagccggttctgggtctccatgcccagcgggttccaacgcaggaagttgatgttggcgaaatacaggcgggtgtcgggccccagcggcgggagcgtgggggccgtgggtgcgtcggtgggcttgggggctgtctgcggagtcgacggcagggcagcggcttcgggctcttcggcggcggctggtgcggagaatcccaggcaaagtgacagggaaagcacagacagcggtcgacgcagcgtcatcgagacaccttctcggggagtgacgtgggggtgcggtgtacagcggggtcctgctcatccgcgtagcgccggctgacatagaagccgaaggccgccgcggtgaagtacatgatgaggctgtagatggccgggggaatggccatggtcgagttcgccagcagcgtcgggctgagcgcgatggcaatcgcaagcattccgttgtgaatgccaatctccatgccaatggcaaccgcttgccgccggggcaggcgcagcaggatgggcacgaagtagcccaccccgaggctcaccaggttgaaggccagcgccgccgggcccacctggcggaagaagctgagcgcattcgcgcgctccgtgtacacggacgctgcaatcaccgcgacgaggaagagggtggacaggatgcgaatgggcttgtccatgcgctgcgcgacggccgcgctgcgcgagcggatgaacatgcccaggctcaccggccccagcacgatgagcaccacctgcacgatcttcgcgaactgcatgggaaccgcgcggccctcgtccatgaagtgcgccagcgacaggttgatgatgagcggcagcgtgacgagcgacagcgcgctgttcaccgccgtcagcgtgatgttgagcgccacgtcaccgcgggccaggtggctgaagaggttcgccgtcgcgccgccaggggaggccgccagcagcatcagccccaccgccagctccggcggtagacggaaagcgtgggcgatgagcaggcacgccaccggcaacaccaacatctggctgccgaggcccaccaggatggcgcgcggatagacaatgacccgcttgaagtccgccagcgtcagcgtcaggccaagcccgagcatgatgacggccagcgccagcggcatgagtaccgccgtgaatacattcgactgcattcgccccccggatggagtgtccagcgttgagcattagcgtcgcgcaagagggcggggcgcttcaagcgtctccgctctcaaaggttgctaaaagtggaggctacccatgacgccgtatgtcattgatgcactgcggcgctgcgcatgagtcgtctattctcatcgtgaaccgacacggctccgcggtcgggcgggacccggcaagggaccatgcacagggcgccgcttcccgagacaccggtgcccgggtcgattacgacaggggccatgagccgagtcctggatgagctgttggcgctccttaaactggagaaaatcgaggaaaatctgtttcgtggccggagtcaagacctggggttccgccagctcttcggcggccaggtgctggggcaggcgttgtccgcgggcagccagacggtgcccgccggccggcatgtccactccctgcacggctacttcctgcgcccgggcgacgcgacgcttccagtcgtctacacggtggaccgggtgcgggacggcggcagcatcaccacgcgccgcgtcgtggccgtgcagaagggcgagcccatcctgacgatgatcgcctccttccacggggacgaagagggctttgcccaccaggcgcccatgccggaggtgccaggcccggaggcgctggcctcggagcaggagctgctgagccgcgtgtccgcccgcatcccggaagccctgcgggagaagttcctgggggagaagccgattgagatccggcccgtggcgccggaggatccgttcaacccggaggcgcaggcgcccatcaagcacgtgtggttccgggccaacggcgacctgccggaggatccgcaggtgcatcggtacgtgctggcctacgcgtccgacttcaacctcatcagcaccgcgctcctgccccacgcggccagcttcttccagccccgcatcctgggcgccagcctggaccatgccctgtggttccacggagacctgaaggtgagcgactggctgctgtactccatggacagcccgtgggcgggcaacgcgcgcggcctgtcgcgcggcagcgtctacacgcgtgacggccggctggtggcctcggtggcccaggaagggctgctgcgcatccgcaagcccacggcctgagaaacggggacgacaccccacaccggcgtgtggggtcgagccccccgccgcgccctcgggaatccacgaggactgcaactctccggaattcctggtgctttcaggggtggcaccctcgttgctgagcaatgcggcggctcagacaacaaggacccccccgtgccgaaatcgagaacctgggagctgtcgcgacgcagcctgctgcggggtgccgcgggagcggcgcttgcattgccctggctggaggccatggctccctcaacggcacgcgcgcaagcgtccggtgcgaagccgccgctgcgcttcgtgggcatgttccactccgcgggcgtcgtcccgaaccaatggtttccgacgaccgaaggcgcgaactacgcgctgacgcccacgctgtccccgctggccccggtgaaggatgacgtcctggtgctgagcggcatgcggctgggcgcgtgggactactatgagcgcacgcacgaaggcggcttctggatgatgctcaccgcgtccgagcgcatcgtcgcgggcagcacggactccatcgatcaggtgatcgcgcgcgccacgtcggcccaggtgcgcgtgccggcgctcacgctgagcgtggagaacaacggctactacaaccccggctaccgcgacgcgaacggggatggcttcatcgacccgaagacgtcgtcctatgacgacacgcaggaccattgcagcggcgaggaccactgcatggtgacgttttcccgcggccggcggctgcccaacgtctacaacccacgcgtcatcttcgaccggctcttcggttcgcttccagccgaaggacccacggacgcggagcggcgcctctggatgtaccggcgcagcgtgcttgaccggatgacgggccaggcgaaggcgctccaggcgaaggtgggccaggcggacaagctccggctggacgagtacctcacgggcatccgcgaaatcgaggtcgccatccagaaggcagagcagggtgctccggccgccgcgtgcaccacgggcgcccggcccgtgggcatccccatggatggcacggcctacgccaacctgatgtgcgacctcatcgtgaagtccttcgagtgcgacgccacccgcgtcgccacgctgatgctcggcatgtgcgtcagcccgatgatgttcaccgtcaacggccgggccttctcccaccacggcgatgcctcccaccacggtaacgatccggtgaagctggcggccaaggtggagatcgaccggtggcaggtggcccgcttcgcgcacctggtgcaacggctgaaggcggtgccggagggggagggcacgctgctcgacaacgtggcggtgttctactcgagcgacatctcgcacagtgactggcacaaccactacgacatgccggtgctgctcgcggggcgcgcgggcggagccatccggccgggccggcacatgcgggcacaaggcaagcggtgtggagacgtgctgctctccatcctccaggccttcgagattccacgaggcaccttcggaccgctggcacagggaccgctcgccgggctggcgtgaggggagaccgcacatgaagacccgctcactgctcttcggcatcccgttgctgctcaccgcgtgctcggacgaactgcccgtcgcgcgcacccaggaccccaagcccgtcgtcgccgcgcagaactgctcggatggcgcgcattcgctgcgccggctgaaccgcgcggagtacgacaacaccgtgcgcgatctgcttggcgagacgggccggcccgcgacgaccttcccggcggaccccacgggccacggcttcgacaacgaggccagcctgctgggcatgtcccccgcgctggtggaggcctatgaggccaccgcgggccgtctcatcgaccaggcctgggcccgggacggcgccgccagcgccggaggtggcaccgttcgcatcgaggccgagtccgccagcgccaccaccggagccagcgagcagaacggcaccgtgtggaacctgtggtccaacggcgacctctccgccaccttcaccttcgcgcaggccggcgagtaccagctctccgtgcgcgcgtggggcacgcaggcgccgccggacccggtgcggatgcagtggctgctggatggcgtcgtggtggcgtcgctcgacgtgccggccaccacgcccacggtgtacacgcagccggtgcgggtggactcgccggggcagaagcgcttcaccgagcgctttaccaacgacaccta

SEQ ID NO: 1112 - DNA, 16833 bp, Myxococcus xanthus
atgtccttggcatgtgtgagcgctacgtagagcagccggcggtaatgggggtcgtcgtgctctataagaaccgcgcgcaccgtgtcgaacggcatgcaggtgtagtcctcaacagaatcagcacctctcggtcgcaggtacatcccatgcgggcgctacaagtggccttggccgtaggtcctaggcatagggacacccatatagggcaccacctccgctggctaatgcagtcccttggcgctgtgcatggtcagcagctgcaccgcgcgagggtcgctcgcgtccagcaggtcctcctgggcctctgtggggttgttctccgccagcatccgcagctcgcgagagaaggcgacgcaaccgcccgtgccgcgctcgtcccgccgcgacgccagcgccagcagcttctccacgttggcgctggcttgctccgcatacggcgagcccgccagcgcttcgcggtagcccgtcacgtccagcgcggctaccaacagctccctcacgcccatccggtcgcgctcgcgcctcaggccgggaagcgcggcgaggaaacgctccagacgctgccgctcacgctcggacaacgaaaccaacacctccgggtccgtcaaccggggcgacgacaaggacaggggcgcgtctcccgccaggaggaacagtgacgcgtccttcaaccccaccaagggtgagcgcagcaccgccgcgaaggccaaagcatcctcggcatccgccagcagcgcgagcagcgaggccaggtccaacacctcctgcgcgccgtagaagccacggccgcgcagcacgcggtgcgggacaccgtggcggatgagcgcctgccggtacacctccaggtgcgtgaaggtccggaacagcatggccacgtctccgccccgagcaggacgcaacccttcgccatcctcacgcgcgacggacgcaggtgcccccggcgccagcaggcaccgcagccggcgggcaatcgcgtccgcgtccagccagcgcaggtccgccgccgtgtccgcttcctccagttgcaaccgttccaccactggcgtttccgacagcgacggcctcaccgcggcgaggtcgtcctgctccggaacgtagatgacctcgaagggccgaggtgcccgggcatccgcggcgacgagcacccccgcgaaggtgcggttgaagaacgacagcagcccgggcacggagcgacggttgtgctggaggaagccgcgcgtgccgccctcgtccaccagcttcttcgccagcacggagaagacggacacgtccgcgccacggaactcgtagatggactgcttgcggtcacccaccgcgcagaggaaggcgggctccagcggcagcgccgtcaccaggtccgcatccggcgccagctcgcgcgggccgtcctcgcgcttctccgccagcagcagcaccagctccaactggaggcggttggtgtcctggaactcgtccaccagcagcgcgccgatgcgctcctgcacctggcggcggaactcgggatgcgcgcggagcaggtcgcgcgacttcaccagcagggacgtgaagtccagcacgttgcggcgggacaactccgtgtcgtgccgcgtctccacgcgcgtcagcaactcgcggaacgtcacctcgaagggcgcggtgcgccatgcggcccaggcatcatccaaccggggcacggagccatcgctcttgccgaagacgcgccagtagaactctcgcacgggccccgcggcccccttactgagccgcgcgaagttgcgaccgtccgccttgaagcacgcgcgcagccacgggaagcgctcgccctgcccgaagttctcaggcgtcatgccgttgagcgcgcgctccagcccgcccagcaaccggctccactcgcccttcgcgtccaggccccgcgcctcggcacacagctccaggcaccgcgtgacggacgactccagctccgcgcgcgcttcggcggcgtcactcacggcggcattctccgcgcgcaacccttcctcgcgcagcttgccgtagacggccatcaacgcggccaccagcccgtcggagaagcccgaaccggagaagcccagctcctggcacagctcccggacctgcgcgtcaccagcctccagcgcgtccagcaccacgcgctcgcagacgtcctgcaccagccccgtcgcctcgagcgagtccagcacctcgaagttcgggtcgatgcctaccgcgggcggtgcgcgccgcagcaactggccacacagtgagtggaaggtgcccaccgtggccgcgcccagctcctcgcgcagttgccgccaggcatccggcagcgggaacggcttgtccaaccgcgccagggattcacgcaggtccacttcctggtccaggcgcgtatcgccctgggccagcccgtccaggcgctggcggacgcgcgagcgcatctccgcggcggccttgtccgtgaacgtgagcatgcacagccgcgacgggcgcaccgcaccgccggcgacacgcgcgccggccagcaggtgcaacgtcatggtgaccaggctgtacgtcttgcccgcgccggcgcccgccatcagggcgaggttgcgctccaacgcgaagagggatggctcgctgctcatcccccgtcctccgtgatgcgcctgtccgtaatccgacacaccgcgcgatagccacacgtcccgcagtcctggggccgcgcggcgaactggccctgccgcagcgtgcccaccagcgcctccacggcgttgggcaggttgaggccttccttctccgccaccttcgcgcggacctcggggtccttcgacagcagctcgtccagctccgcgtcggagatgacctcggacaggcggatggccatgcccgtgcgcaaggagaaccacgcggcctgccgcgcttccgtatggccgctctcgcgcgccgcgtagaggtacagcgggagctggaagtcggacgtcagcagccgctccttcagcgagcgcttgtccagccggcccgacttgtagtcgatgacgcccacctcgccgcccgacttgtcgagccggtcgatggtgccctcgaagtacacgggctcctcgcccgcgtgaaggacgacgttgctccacttgtcgtcacgggcggcggggccgaagcggaactcgaagttctccggcgtcatcgtgtcgaagggcaggccgcgccgctcgtccacgaggatgcggcgagccatcgctcgggcccgctcatgcgccagcttccatagctccggatgtcccacgtggtgcacgcgctcgaagtccttgatggcggccttgagcgcggcgtccagcacctcgtccggaacctcctccggcgccttgcccaacaactgcttctccttcagggccgcgaagacctcctccaccaccttgtgccagaaggtgccgcggccccgggcgtcgaactcctcgcccggcacgtccggctcggccaccttcaggccatacgaaaggaagccctggaagccgcagttgccgaagcgcgccagcgcagacgcggagagcggccgggtgatgtcgaaccggaacgtctcgcgcagggactcgcgctgcgtgtcgaggtccaccgagccggagtacgggccgggctgcactttcggatcgccgaagaagaacaggcgctccatctccacttcggacagctcgcgcgcgcccgcataccaggcttcgggtgcgaagcggcgccgaagcaccgcggccgccgcatcgggttcggtgacgcgcagcttgggctgggacagggcttccagcgccacgcagcggcgcagctcggactcggtgagcacttcgtccagcggtggaatgggtgacagcgagcgcggctcccacttcagcgcggtgagccggcgcacctcttccaggaacgccgatggcacctgctcctgaccgcccgcggactccaccgcgaaggacaggctgacgttcgcctcggcggcagcaagtgcgctggcgaacagcaggcggtcttcggtgaggcgccacgccgcgcgctcgtcgaactcgccgcccgtgagccggaagacgtcgcggcccagatgcttgttgagcgcggcgcgctccgcgtccgccagcaacggagacggtgcgtcacgcccggggaagcggccttccgtcagccccgcgaggaagaggtcctggaaggaacggcccggcaactcggccacgtcgagcacctcgacggcggcgccacggggcccgcgcggaggcaggtgcgcatccgccatcgcgtcacgcagccaacggccaaacgtccggcggcgcatcttcggtccgccgcccaccgccttcatcatccgcgtcaggccctgcacccgcaggcggagcgcttcgcgcgcggcatcgtcccgagcccgcgcatccgccgcgcgcgcgcccaacccaccctcctcgcgcggcgccaacgcgccctccgaatccacgaggcccagccgctccaccacctgccaccacgccgcgagcaactccgcggcggtgccttcttcgggaatgcggcggcaggcttccaccaacagcagacagcgctcacgcagcagcttcacggcgtcgacgcgggtgctgtcctgcgccttgcgcgtaccgttgagcgcgagcagccgccgggccagcccgtccaagcgcacgtcgtaggcgccccggcctcgcaccgcgcccagccggtcatcacgcacggcggcctgggcaaagagcgtcgcgggcgcatccggtccaccgcgtgacagctttggcgcgtagcggctgcccatcaactccgccatgcgctcgaccgggaagccatcctccaccagcagcggcaggtccagcgccagacgcacgggcccagcgagccccagcggctcgccccagggtagacgcaccggcacgcccagctctcccagcgactccgcgagccagccggcctcgggccccagttcgcggtacgccaccgcgatgtcgccgggcgccacgccttcggccagcaagcgccgcacgtcccgggccaacagacgcgcctcgtcacgggccgtggccgcgttccacacgcgcagggacggcaccgcgtccttcaacacgtcgcgcggcgcccggggtgagaagaggtggcgccccaggtcgatgaaaggccggccttcgaaggtgacgtccgccttgaagaggtccacgtgcgtcatggaatcgccgcggttctcgaaggcgcggaacagcgccgtcagcgccgcgtccgccgcgggcgagccacccaccggtgtctccacgcgcaacgtcacccgacgggactcgcacgccgccgccaacgccagcaacaactccagccccgagggcctcacgtcgtacacgccgtgcagcacgagcgtgctcagcccctcccaccccacgggccacgcgcctcggcccagcgcctcgcgtgcaccgcgcagcacgtcctcgcggtcggcgagacagagctccgccatccgctgttcgtacaggtggtacaggcgcgcaatcacgcggattcgcgtcctgcgctcctggggcaggatttccaccgcgtcctgaagctcccgagcggacaggcgcccggccttcaggtccagcaccacgtccagcgcggcgcgcgcgaaggcgggctctcgcacatagtcgccgaaaggtgtgggccccagctccaatcccagggaggccaccaccgctcgcgccgccaccgccgggcatggacgccggttgagctcccgcgcgccgcccagcgcctgcagcatctcctcccaggtcagcaggtgcgcgcccacactcaacccgctggcgtcgcccatggcccgcaacgcggcctgacgccggccggcgtcggggtacacgtggagggtgtggccagagcgaaagggcatgcggggcggattctagaacgaccgggcgggtgactttcatgctccattcaaggcccgccgcccaggtcatttccgtgcctgcccggccgctgtccgcgtattcccggccagtccatcgatatccgcgccgcgcctcccgggtttacagcgagtcgcgggggctatgagcgcacctccagtggcagctccaactcgagttgtgtgagcggagtcgcccccaatcccgccccctggaagaagcgcgccagggggccttccggcacgacggcgctcacggccagcgccttcccgggccaccgggcggcaagagcccccaggagcctgcggccagcgccctgccctcgggccgagggctccacccccacggaccggacgaccagcgtgggcgccgacacatccgccaccatcgccaccgcggggcccagccggaatgctcgcgcgggcaacgccaaccccatgactgtcgcgggagccagttgccagggcaatccttcgggaagcagccgcgcgcactcccacgggtcgacttcctccagcgcggatgcccccacccagggctcgggcgtccccatgaagcccaccagccggcgcacgcgctggaagcccaaccgttcgtagagcgtcaccgcgggggcgttctgttcaatgacctccagaagcatccgggtgtcgccacgcgctcgcgcgtcctccagcagtgggcgcagcatggcacctcccagtttgcgattccgccaggcgggcaccacccccatgcccgccacgcggctctcccgtccccggcgggccatcaacacgagccccacgggctccccgtccacgcgcgcaacgcggctttcctcgagcgagatgtgctcactgcgcacgcgtgcatcgaacaggccgggggcatcgggcacggtgacgaaatacccctcgaaggcgcgggcaaacagcgtggagagggtgcgcagtggcagttccgacgcggaagtcaattgcatgagagggcacacctccaaagacatgcgggtccgagtctacgcaggaagtcatgtgacttcgctggaacccgacgggattgcgcccctatgctgccagccgtgcgccttccttatcgagcgtttgccgttgccgtccttctgagcgtcgtccccttcgcccccgccgccgcgcaagacggctcggacgagccgcggctccatgagctccgcttcgactggacccgggatggcgtcagcaccggcgtggcgggcgtgctgtggatttccagtgaggcgttcttcaaagacaacctggccccggcgcagtgccgctggtgcgaccgcgcgccggatgggacggaccgcctcaaccggctggaccgctggggacgcggcatcgtcgggtcgacgccgtccgcccgcaaacgggcccacaactggagcaacatcatcggcttcggcgcgctgccggcgggagtgctcggcatccagtacgccatgggccatggctcgggcgctccgactcgctacttcgcccaggacgccaccatcatcgtccagagcgcggtgttcgcctccctggcgaaccagacggtgaagttcatcgccggccgcgagcgccccttcgtccacgtgctgcccgaggaccagaagggcctcaccgaccaccccagcgacaacaacctgtccttctacagcggccacaccaacctcgccttctcgctggtggtgtccgcgggcaccgtcgccgcgctgcgcggctacaagcaccaggcgtggctctgggcggtgggcctgcccgtggccacctccgtgggcctgctgcgcatgggcgccgacaagcactacctcacggacgtggccaccggcgcattgctcggctcggcgttcggcgtcgccgtgcccctgctgctccatggccggaagggcgaggcctcgccggacatccagtcagggcagatccagatggcgcccgtggccagcgcgcggatgatgggcatctccggcaccttctagttccgcgccggcatcgcctctccgaggccgaactccgcgggggcgccctctccctccgcggccagcgggggcagcgagttcatgtcccagcgctggccggcggtccacgagatggcgcccgacaggccccagcccgcgcgcagggcctgacggtcctcgtactccaaccagaagatggactcctgggccctggccgcctggtccaggcaggcgatgcgggtggccggacgtcccgggccctccagcgtcaccgcgaagcccttgtgcgagtggccgcacagcatccacttcggcaacaccgtgtccacgagccgccgcgtcacgggattgccaatccaataagaggggagcggccttggcggtgacgggttctcctcccgcgcgcgctggacgatgcctcgcggccattcgtggaccagcatcaggtccacgtcgcggagctccgccacctgttcgacctccggcgtgcggaagtagccggcctgcttcaccatgtccggcgtggagggtggcttcagtggctggtcgacgaagcgcggcgcgtggatgcctgacaggtacgccacccgcagtccgcacagctcgcgaaccccggctcggcccaggtacgtcacgttcggcgccagcgtgccgcccagttggaggtcgtgcagcgcctcgaagtcctcgttgttacccccgatgaagtacaggggccgcttcacttgccggagtccatccgcgtattccgcgaactcggcgggcatggctcgcttggcggccttgcgccggtggtcatccgagcggcggaaggcttcgacgtcgcccaccgccagcaccaggtccacccggcggccacgagcctgctcaagcgcgtccagccacgtctccacacggtggaagcggccatggatgtcgcccacggccgcgacaagtaggggttccggcatcttgcttgaaaggctgcacgcgccgtaccgccctgtcgagtcgagatcatctcatgtcgccaatgcctgacagaacgcaacctccccgggcggccgaaccctgggcccagcggatgacgcaccccgtccaacccgtgccattgaagtccgaaagcggccagacagcggccacccggtatgggagtttgccctccatgaacggcttggacgccagcgcgtgctaccgcgcgatgcagacccgagatgcccgcttcgacggccggttcttcaccgccgtccggacgacgcgcatctattgccggcccatctgccccggccccggacgccccgggttcgagaactgcaccttctatccgagcgccgccggggcgcaggaggcgggctaccggccctgcctgcgctgccgcccggagacgtcaccggacctcgccttctggcgggggacctccaacaccgtcgcccgggccctggcgctcatcgccgagggcggcctggatgacgacgatgccggggtggaggagctcgcgggccggctgggcgtgggcgaccggcagctgcggcggttgttccagcagcacctgggagcctcgcccgtagccgtcgcccagacacggcgtgtgctgttcgcccggcagctcctgcacgagacgaccctgcccatggccgaggtggcactggcctcggggttccgcagcgtccgccgcttcaacgacgtgttccgcgccctgtatggacggcctcccagcgcgctccgccggagccgagccccggtgggcgatgccgccgcgggtgtcacgctcttcatcccctaccagcccccctatgactgggaagcgatgctggcgcatctggaggcacgggccctaccgggcctggaacacatcgaggccgggcgctaccggcggaccgtggcgaccgcgggcggtcagggcgccgtcgaagtcttccgagcccctggacgcgacgggttgctcgcgacgctccgcctcccccaggttcaggccctgcccacggtggtggggcaggtccggcgcgtcttcgacgtgggcgcggacatggacgtcatccgggaacacctgtcccgcgacccgcacctcgctccgctggtgtccctgcggccgggactgcgagcgccgggaggctgggacggcttcgagctcgcggtccgggccgtgttgggacagcaagtcacggtcgccgcggcgcgcggactcggggcgcggctggtcgcggcgtatggcgagcccgccggtgtcgcatcgacgggagacgcccggctgatgcgcacctttccccggccggagagactggcgcaggaggacttgagctcgctcggcatgcccgccgccagggcacggaccctgtcgagcctggccgcggcggccgcagcggacccgaggctgttccagccacgcgccacgctggaggaggccgtcgaacgcttcaaacgcatccccggcatcggagattggacggcgcagtacatcgcgctgcgcgccgtgcgcgaaacggatgccttcccttcggcggatgtcgcactgctgcgtgcgctcacgggcgaggatggcgtgcggccttctccagatgaagcgctccgccgctccgcggcctggagcccctggcgtgcctatgcagcacagcacctctgggccgcggatgccgcccggcccggacccacaccccacctttcccgttcctcctcgcgacagagagatgacgatgcccccaccgctgcgtttgctcatggaccgcgcccccacgcccatcggctcgatgctggtcgtctgtgacgaagcgggcagcctgcgcgcgctcgactgggaggagtacgagccccggatgctccggctgctgcggctccactacggcgtgaacggctacgtgctcgagcccgcgagcgaccccttcggcaggacgaccgcgatgcagacctatctgcgcggagacgtcagcgtcatcgactcgttgcccgtggccaccgcgggtacgccattccagcgagaagtctggcgcgcgctgcgtgacatccccgcgggcgccaccacgagctacggccaactggcccagcgaatcggccgccccaaggccgtgcgcgccgtggggatggccaacggcgccaacccgattggcgtggtggtcccctgccaccgggtggtgggggccaacgcctcgctgacgggctacggcggtggactggagcgcaagcagtggctgctcgaccacgagcgccgccatgcatcgcgcgggacgacgcggccaccaacgcgctgatgccgtcgggcgcctcgtcctgaagacagacgcccggcggcatcacgctccgcacgccggttcagccgcagcccagcgggtacgtcacctctaccagcgaacccgcctcgggcgccgtgaagcggtcgaagaggatggcattctcgcgggcgtcgtactcccaaccggacgtcacgcggacgccgtccacatcaacgacgatgctgcctggagcttccggcgtctcggacagggggaacttgcggttcgcgccaaaggtgctgtcggacagcttctccaacgagctggcccagttcggcgtgcagatgctttccaccacgccgcccgtggcctccgccagttggatgtagcgggtgcccgagctgctggacgtggggcacctggccaggtccgacggcccgacgatggcattgacgctcagcttcgagcggtcattgcccttcagcgccagcaggtacgtctcgtagaaggacaccggctgcgcgctgaagtcttcctcgtccgacacgaagatgatggccaggcgggcatcctcgcgcaggaagcctgcgttgccgtcgttgggctgcgcggtgcgcgggtcatcctcgttatagagcagcgggtccgccaacgcgcggtaggcggcctccagtccctgctcgttccaatggcagacacccacgcgggtgttgctggcgaagacgcccgcggcatccggcgtcgccggggtgatgatgcgcggccgggagccgtccactgggaacaggcggccattgtctccgccctgcgagccgcccgggcactcggaccagccgcccggagacgggtccaagcccgtggtggtgacgccgatgcggtagtccaccgcggcgccgtccgccgcgctcaggaaggccgcgaagttctgccccaggttctgctgctcctccatcatcgaccccgagttgtcgaccacgaagagcacgtccaccttcgcctgtgactcctggaagaagcggtccgtctgctccgcctgcgtcacgccccatcccaccatgcccaccgtgtagacggagccatccgccagggtgaaacgcaacgccgccgtgtcagcgccgtcatccaccggggcataggtcgccgtcagcgcgcgcgcgctctggctcgccagcgtccacggggcgttgccgccaccatccacggtgaactcgcccgcccctgcgtcgatcgccacctggctcacctggatgggcccgacacacgagttcacggccaccaactcccgtgtgcgcgggccgcacgccagcttggtaacgccgaagtccaccgtggtgggctgcaccgcgaagcatcccacgacgccctcgccctgcagctccaccagcgggtgcccttgcgtggggctgttcacccaggcctcggccagccccgagaagccgccttcctcggagggcctgaagcggaccaccagcgtcgccttcgcgcccggctccagcacgccgttgcgcacgggagacgcggagaacaccctgtccgaaccctggacgagctgcatcgacgccaggtagcacgcctccgtgcccgagttccgcagcgtcacccccagcgccacctccgcgcccaccggcaccttgccgaagtccagttgctggggcagcacgtactggcacggcgcgaacacccggctgcgcccctccagcgccaccgcctccgtggccgcggagccgctgtcacgcaccgtgacggagagctgtcccttgctggcgtccgtgctccccgccttgggccggaaggtgacgctcacccgggcattctgccccgcgggcaccatcacgctggcgggcgcctgggccagggtgaagtagccgccctggtgcgtgtcgagttggaggtcggtgacgctcacgtccgcacggcaacggttgtagacggtgacgtcgcgcgtcgccgtcatgccctccgccaccgttccgaaagccagccgccggggcagcaccgtcacgcacgagccgccaccttcacccgccagcgacaccttggggcccggcgcgctggagccctgctcgcgcacgccaatctccacccgcccgtcacgcaccttgcccaccgccgccggcgtgaaggcgacgcgcagctccaccgccgcgcccggtgccaactgcccgttggccaccaccggctcactggcgatgcggaagacgccctccgagctgtccaccaactgcgagcccgagaagctcagcggctgcgtgccctggttgcgcacggtgatgacctgctccgccgtggcccccagcgccacgcgcccgaagtccacgcgcagcggcgtcacctccagcctggacgccacgcccgtgcccgtcagcggcaccatcaccggcgcgcacccgtcacacaccaccacgtgcagcgccgcctcggccgcgcccagccggcgcggggcgtaggccacaggcaccaccaacgcctcgcccggagccagcgaggagggcaggccctgcccggcggtgaactggtcggcgtccgcgccctgcaccgacagcgtcagcgaactgtccacgtccgatgggttgcgcaccgtcacctcgcgcatctccaccaggcccatggccacgttgccgaaatcgagcgcctccgaggacacctcgatgaaggccttcacgccgcgcccggacaccggcacgcgcccaccgacctcggcgtcggtaatgatttccaccacgccctgaatctcgccctctacctgcggcaggaagtggatttcgatgtcctgctcgccacccgcggacaggatgaagggttcgaagggaggaatgttgacgttgggcacgctggagacagcgccttccacgcgataggaagcccggcccgcattggcgattcgcagcttgaacgtcttggtatgccccagcgccgcgggaccgaagtccacagtctcaggccggacgacgaaggcgctctttgccctctgagaggcgggccgttcacacgcccctcccgccaccatcaccgccaccaatgccaccagcccaaacgccctgcgcataacgtcctccccgccccaccgggagacgccagggacacaccctggttcacctcacggctcagcgtggggccctttgcaaccccggtgcccggtccgcccacagagaggcgaggggcgctcccacgcggcacaccccaggcctcgcagggaaacgccagagcccacccgggaaatgcaggtgtccttccgcaggacactcctgaaattccttcaggaactccagatgccacacaggcgaatcctccgtccgggcggggcaggcagccaggcggcgcgacttcgcccactctgcgtggactagaagaggctcgtggatttcagggacgcctccccgcctggagggtcgccagatgtgggatgcggggcgcaacccaggacgttcccctgcatccggaacggttccgacgtgtttccccctaccggaacacctattcagtggtagatcgcccgcccatgtccgagcccgacgtcatttccctcagaggcgccaaggagcacaacctcaagaacgtctccttggacattcccaagaaaaagctcgtcgtcttcactggcgtgtcgggttcgggcaagagctcactcgccttcgacaccctctacgcggaaggccagcgccgctacgtggagagcctctctgcatatgcccggcagttcctgggacagatggagaagccgaagtacgacaccattcgcggcctgtcgcccaccatctccatcgagcagaaggcggccagcaacaacccccgctccaccgtgggcaccgtcacggaagtgcacgactacctgcgggtgctttatgcctccatcggggtgcagcattgccccaactgtggcgtgaaggtgggcaagcagagcgcgcagcagattgtcgatgaaatcctcaaggcccccgcgggcaccaagctccaggtgctggcgccgctggtgacgaaccgcaagggcgagcacaaggacctgctcgccgaggcccagaagcgcggcttctcccgtgctcgcatcgacggcgcgctcaagagcctggaggagcgcatcgagttggataagaagtccaagcacgacatcgcgctcgtcatcgaccgcgtggtgctcaagccggacgtgaagacgcgcctcaccgactccgtggagacggcgctgcgtgagggcaagggcacgctcatcatcaccgacgagaagggcacgcttgcctccgaccgggtgatgtccgagctcaatgcctgctccaagtgtggcctgtccttcggtgatttgacgcccgcgtccttctccttcaacaaccccctgggcatgtgcacggactgcaacggtctgggcaccaagccggagatggacccggacctcatcgtcccggacacgtcacgcagcatccgcgatggcgccatcgagccgtgggccggcagcatgaaccgcggtgagggctggacggccgacttcgtggagagcctggccaaggccttcaagattgatctggacgtgccctacgcgaagctgaccaagcgcgagaaggacacgctgatgtacggcgccagtggcaagtccttcaccgtcgcgtggggcgagggcggcaagtacaagatggaatgggagggtctggtcgagcgcatgatgcgcaacttcaagacgaccacctccgaggcgcgccgcaccgagctccagaagtacttcagcgacaagccctgcccctcgtgcaagggcgagcgcctgaagccagagagccgcgcggtgaaggtgcacgggcgcagcatcgtcgagctgagccggctgaccatctccgactcgctgggcttcctgggcgacatggccctgtccgcgcacgagcggaagatcgccaccgagctgctgaaggagattcgcagccgcttgtccttcctggtggacgtgggcctgggctacctgatgctggaccggaccgcgtccacgctgtcgggcggtgagagccagcgcatccggctggcgtcgcagatgggcagtgagctgacgggcgtcatctacatcctggatgagccctccatcggcctgcaccagcgcgacaacggcaagctgctgctgacgctcaagcgcctgcgggacctgggcaactccgtcatcgtcgtggagcacgacgaggagacgatggaggaggcggactggctggtggacttcggtccgggggcgggcgagctgggcggccaggtggtggcccagggcacgccggagcaggtcatggcgaacgaggccagctccaccggcgcgtacctctccgggcggcaggaaatcgagattccacaggagcgccgcaagccggacccgaagcgcaagctggtcatccagggggcgcaggagaacaacctgaagaacgtggacgcggagattccgctgggcgtcttcagcgcgattaccggcgtgtccggcgcgggcaagtctacgctcatcaacgagattctcttcccggccctggcgcggcacctctacgagagccgtgaatccccgggcaagcacaaggccgtgctgggcatggagcacctggacaaggtcatcgacatcgaccagcgccccatcggccgcacgccgcgcagcaacccggccacgtacaccaagctcttcgacaacatccgcgaggtgttcgcgatgacgcccgaggcgcgcgcgttcggctacgggccgggccgcttcagcttcaacatcaagggcggccgctgcgaggcgtgtgaaggcgacggcgtgaagctggtggagatgcacttcctggcggacgtctacgtgccctgcgaggtctgcgccggcaaagcgcttcaatgaggccaccctgcgcgtgcgcttacaggggga

SEQ ID NO: 1113 - DNA, 14367 bp, Myxococcus xanthus
tgctgcccacctgcgccaccaccccgtgcgaacccgcctccgtcgcggaggcgtatgcccgcgccctcgaggaagggcgtgtcggggacgcgttcgcgctgactgtgggggggcccgagaggaggcggcgttcctggagcgctattccgatgcgggggctcgcagcgcgagggccgcggacgtccgcgccggcgcgccgctcctcgaggcgcgagcgccctccttgacggtcgcgcagtccacccaggggtggcgtgtcgtcgaggcccggcccgcggatgtgcctcgggccgcccttcgccaattcatcgacagcgtggaggcccgtgactggacggccgcttggggccaactcgccgggcccctgcgcgcgcgttacaccccggagcgccttcgcgaggatttcgagcgcgaaccgcttgcgaaggagcgtctccgccgtgctcggctcgcactcaatacgcatgtccgtgtcggcgcgggtgaggccgtgttcccgctgggcgacgaacgcgccgtccggctggtgctggaagaaggggagtaccggatcgcggcgctcgagtgagtccggcgttacggcggggcgggcacgtagagccggctgggtgtgccctcgtagtcgatgacgcgctcgaagcgcattccgctgcgctccgcgacgcggagggatgcctcattgtcccggtggatgatggcgaccacgggcacgtcgggcaggtgacgctgggccagcgccagggccgtgcgggccatctccgtcgcatacccggtgccccagctccggggcgtgaagcgataggcgaggttcagcaccgtgcgtccttcgagcaccttgtggcgcacgccaccgaagcccacgacgtcacccggggcttcgcgccgcaccaccacccagtagcccacgccgtgacgggaccagtcgtccagccacagcgccagttgcttcctcgcgacgtccaacgagggcatggggccggaaacgctgaaccggttcgtctccggatccgcatgcagggcgaacacgtcgtccaaatcgctgtcgcgcacggcgcgaagcagcaggcgttctgtggtgatgttctgaaatgcctggagcatggctggcaaggtgcgtcgtggctagccggccgtgagcgccggtggcgccgcgatggccgggcggcccgcggacagggcaccgaggatcgctgccgcacccagggcgtggataccccccacccatgatggaggcatccacgccacgccggctcccgccaggaacgccaccaccgcgagcgcggacgacaggctccatgcccagcgcttgcgacggaacaggaacaccgtcgcgacagccaaggtcagcccgtacagcagcagtgccgcggccagggcccctgacacctcggcggccatgagcccggcaagcaccaggtaggggaccatcagcgattgggcgatggcggcccctgcgatgaacccgctcatgcgctgagaagactcggtgggagtgtcgctcacgctgcaagagtatcgcgtcggaattccgatgcgccagcgcgttgcggcttcccacgatggatgccttggcgcggccgccactagcgtcccggcgatgcatatccacttcgatggatccaggtactggggtgtggtgttggctgccgtggcgctggcggcgtgcaacgtgggggacccgggtgaggatgaaatccggctgggagaggcggggcaggcgctgtcctgtactgtgacccgccaatgtccgggagccgctcctgtgtcctgtggtgccaccaacggcctgtgtctctcgggggacagcaacgggggttgggtgttttgtgggcagggctacacctattgtgccgcgccttgtatttgcggcggcgagcggtacgtcgcgacgcgaggtgtcaatcatccgctccgctgccaccgtgccatggagaccgctcgggagcaggcctatgcggaggcctcggcggcatgccccgcgggatactgcaacgcggtggagcaggagttgcgctgcgagcagacgccgtatggcgaccaccacgcgctctttcagttgacgtactcctgcaaggacccggtgacctgccagtagcggcggtgtcagcacctcaaggcaagacggggccgcgaatgcgacccccgccggtgtcgtagcggccatccggcacgttcaccgcgtgcccccggcgtttgatcgcggcaccggcggcgccgccggtcgacgcgccgagtccaccacacgctcccgcggggtcgccgggctggccaaagcctccgccatccccgccgagcatgtcgtgcgagccatcgcccctggagtcgcccgtccggccgccttgacctcccgcggtgccgccggccctgcctggttcgccggtgcgcacgccgttgtcctggccgcaatacgccagctcttccgaaccgctgagggaactggcgccttcaccccccgcgcctccgacgaagccggcgccgccgccaccgcccgcgtttcggttgcacccggacccgccggtaccaccaccgccgccgccccagatgttgccgcgattggtgagggtggctggaaccgtgagctcaatggccgtgcctcccggcagcccgtcgcgattgcacgagcggggccggcctccgcctccgccattgcctcccgagccgccgttgcctccggcgcccacgatgttcgcatggttgttgatgcggaccgttgaccccgaagcgagcgcgcctgtctcaggtctcgctcgaaatgcgaatcgcacgaatgtccttgcgagcgagcgctttcggacagccggattcggcactccgggtccgtctccatcgtcagcccagccccgaagcgccacacgccgtgcgttgaggtcgcgaggccacccggcttccgggcgggcgcgggcgtagggggatgactatgatgcaccggtgcacgccaccttcctggccgtcggactgctgacgctgccgggcgcgctcggaacggagctgcgccgggatggctattcgtttcgcccaccgaaaggcttccacatggtgcggtgggagcagtacgccggctcgcgcgtgggcgcggtggcgctggacccggacgctccgcgcgccttgtcggcggccctcaccgacggtgatggcccggacgcagccacgctgctcgtgtccgtggtggggcgcggcttcagcgcgagcccctccgaccgggaagagttcgcgtccgcggtgatgcagcactaccagcgcgagctggggctctcgcttgcagcggaacgcgtggagcgcctgggcggggtgacaccgcgtgtggaggtgctggggacgctgcgcgaggcggggcaggtccgcacggtgctcgtcgcgggcctggcctcggagggggagcacgccgtggtgatggtcagtgcgcccgcggtgcggtggcaggcgctggagccgcaagtgcgcgcctcgctggagaccttccgccacgagccgccgagcgcgggtggccccgtcccacgccgggtgctgggcgcgctggcgggaaccctggctggagcgctggtcgtctcgtacacggcgtggcgccggcggcggctgcgtcacgcggcgggcaaccccacgtagtcacgcgtgccccgcgtggacggtcagtgcacggagaggaacacccgggcctgcgggactccgcgtgagacggtatcgaagtcgcggaagaagctgtttcgctcgaagaaggtgaagctggcgcccaggcccaggttggcgaacaacggcacgtccagcagcaaggtgccctcatgcaccaggtggttgccgtccgcgccgttgagcgtgtgcagccacgtgctgcccgcgtgcagcttgaggtactcccagggccagcgcccgtaggacgcctcgaagtggaagcccaggcccgggccgtagtcgtagtcgcggcccaccttgtccgcgtactcggacgtgatgcctgcgagcaccacgcctcgcagatgaagcgccaggcgcagctcacggcccccctgcgtcaggtaccggtacacgagccctgcgccgatcgactgaccgcccagctcgtaggcctgcgtgtcgttgtagtcgaagtgctggaaggcgccgagcagcacgcgctcgttcccactgttctccagcgggagcatcgccagcgcgcccttcacctcggcgcggctgatgagtcggttttcgccggtggtgaactgcacgcccatgttgaaggcgtcgaagggcgtgtccaccgggaagcgcacggcatcgccgtagcgcaggtccagctccgcgaagaactggttcagcgtcgtgcccgcgtcgatgttcaggtagccggtgcgcgccagcacggcgaacacgggcggctgccagtcctttggggtgggcgcgctgcgccaggcatccccgcgcaccacgcggttgaagcctcggatgggattgagcaaccccgcgctcacctcgcgggcgacgcgccgggttcccgtggcgcgctggtccagcagcatggaggacagccggtagatgacctctccatgggcccacccacccatcgtggtgttgatgaggtcgttgtaggagggcagatggttctcggcgaacaactcccactggaggctgcccaccagggtgaagcccatggcgccccagtagttgaagccatggtcccgggcggcgttgaagtacgtgctgccgtggtaggggtgcgcgaactgattggtactgaaatcatccttgtcccagacgaatcccatttcgaagttggttcgccatgcgtccagtccgacccgggcaaagtccttgttcatgatgtatcggttgaagccccacaccgtgaggttgatggccgtcacttcacccagggcccaccagaactggcgaggccggggaggtggggcggcggcctcctcgtcctcggcgcgtggcgcatccgcgggaaactccgccgcctgggcgagcgagggcagcagggacaccagcagcgccaccttccgccatcgcgccgcgggtccgcgccggccgcaccactggctgtgacgcatgccggctcccccacccgaagggtgaagatggggaccccgcgcgcggtgcgaccatggaccggcggcgcagggccgcgtcggtgggtggacggaccgcccggccgcctgcctggcgcgagacatgaggctgcacgtccgtcggagggcgcggtggggtagggtgcgccgcatccatgttcgccttcatcctcgcagcggtgctcacgcagtcgccggtggtgccggcggcgccgagcccgcctcccgcacctggcacccccgaagccgtgcccgccgtgcccttgagcacgctgccacccgccacgcacgagctgttccagcgcatcgagggacaggtcgcgcaggtgcgcatcatcgagcggcgctctggcacgcgctcgtccatcggctcggccttcttcgtgtcggccgccgggcacgcggtgacgaactaccacgtgatttccgacgtggtcatccacccggaggactacacggcggagctggtcctgaagggcggcgcagagcccgtgccggtgcgcctggtggacgtggacgtcgtgcacgacctggccatcatccagacggccaccccggtgcagagcttcttcgacctggacgaccgcgagccgccgcagggcgcgcgcctgttcgccatgggcaatccgcgcgatctgggcaccaccatcgtggaggggacgtacaacggcttcatccacgacgcgctctatgagcggctgcacttcagcggggccatcaatccgggcatgagcggcggccccacgctcacgggagagggccgcgtggtgggcgtcaacgtggcgaccatgggcaaccaggtgggctttctggtgccggtgaagcacgcgcgcgcgctgctggcccgcgcgctggaagccaaggactccggcgcgcaggcgctgctggataccgtgcgcgcgcagctcctggacaaccagcagcgcgtcaccgaaaggctgctgggcgcgcccgtgccgcagcagacgctgggcagctaccgcgtgccggggcgctggggcacgtttctcaagtgctggggggacacgccgcatgaccccgaggtgccgtacacggtgacgaactaccagtgctcgtcggaggaggacatcttcgtgtcctcgcgccaccggacgggcgtggtggccttcctgcatcaacacgccaccagccagaagctgggggcgctgcgcttctccgcgctctacagcgcgctcttctcacaggacccggacgcggtggaggccacacggcaggacgtcaccaactaccgctgccagtcggagttcgtggacgtggcgggcctgcccgtccgtgccgcgctgtgcatgcgtgcctaccggaagttccccggcctctatgacctggtgctgcgcgcggccacgctcaatggcagcaccagcggcgtggacacgtcgctcacgctggctggcttcaccgcggacaatggccgcaagctggcgcgccgctacctggaggggctgtcgtggacgaagtaatcttcctggaggtgttggaaggggactccgtccaggcccgtcatcgcctggagcgcttccccgtcaacgtcggccggggttacggcaacgacgtcatcctggatgacccgaaggtctccgccgagcacctgcgcatcgagcgccgcgaggacggcacgctggtgctgcgcgacgtgggcagccagaacggtacctaccgcgtggagccctgggcgcagttggccgagctggagctggccacggatatccgcgtgtcggtgggggacacggtgctgcgcttccgcgcgcgcggtcacccggtggagaagaccgtcgtggcggcggcgcccaccgcgccgaggccacgcgtgttcgagcagccccgctacttctccctggccctgcaggccctgctgggcgccagcctgctggaaggctacctggccaactacgggcgcacggactggggggagctgacggtggcgctggtggtgccgctgggcatcaccttcctgtgggcgggtggctggtcggtggcgagccgcatcgcccggcgccagttccactaccgcacgcatgccaccgtggccgcgctggtgctgctgggctccgtcgtcatccagccgctgctcacgctggtgggcttcagcctgggggtgagcggcaacctggcctgggcccaccacgtcgccttcctgtcgctgatggcctgggggctctactggcacctgcgctacgtgacgcgctgggagccggggcggctcatccgggtcatcgccgtcgtcacgctgtcgtttggcgcgctgtcgcgggcggatgcatggctgggcaacgagtccttcagcacggagctgggcttccgccggtcgctgctgccgccggtcttccggctggtgggaaccgagcccctgggatgacttcttctccgacgccgtgaaggtccaggaacaggtggacgcgctggcgcgcgacccgtgagccggcaggggccggcaggacgtcacgggcgggacggcggatgtcagaccgggcaggtaggaatgcccggatggacgtccatcaggagttgaggcctgtcatcggtgcccggtggtcgcaggtccggggcgtgcagggggaacggctcgcggccggacaccgggacggtgggctgacgcgggtcttcgtggcgccggacctggcgtccttccgggtggtggcgcgggggctgctggcgcggggcgaacctccagagcgggtgcgcttcgaggaaacgcgtggacgccagggcatgtggctggaggccgcgcgctgggaggcctgggggcgcgcggcgtccggggtgcctcgggacttcgtggggctggcgcagaaggtggtgtgccaccgcgagccggcgcgctgggcgctgctgtaccgcgtgctgtggcggctgacccatggagagccgtcgctgctggagtgtcacgacgacgcggacgtgtggcggctgcggtggctggagcaggcggtgcggcgggacacgcaggcgttgatggcggccttgcgcttccgccgggtgtggcgggacgggcgcgaacaccatgtcgcgtggtaccggcccgaacatctcatcgtccgggacgtggcgccgttcctcgtgcgccgcttcccggccttctcctggagcctgttcacgccagacacctgggcgcattgggaccgggagcggttgaccttcgaggaaggcggggcgctgccggagtgggcacgcgcccgggtaggactggcggcgtcccattcgcatccacgggcgggcgcggagcgcgcgtccttgctgctggtgggggcttcacccgtggacatcgcggagccgcctttcgcgggctccgcgggagcgctcctggaggtcgtgttgggccgcgcggggctcacgcgttccagtcgccgggtggtgcggccgtgcggggacggatgccgctcgcggcacggagtgctccctccgacggcgcggggggaagggcgcacctgccgtcatgggctggagggcgtggtggcggaggtccgcccgcggatgatcatcgcgctggggcccgtggcggcgcaggccttcttgggggtggggtttcgcatgcacctgagccgggggcagctgctggacacgcggtgggcggagggctggatggccacgtttgaccccgaagcggtgcttcggcttccggaaggccgggcgcgggcggaggcgcgcatccacttcgaagcggatctccggtcggcggcggcgtggctgcggcagcggctcacgggggacgcgcgggcccggcgcgtggagggtccatgacgccgcgggcccgggtgcatctcgccggagcgcaggaggcttgcgccgtgacaggttcgcctgtgtcagcgtcccgtcgacgcggccgtgcgctcagagtccacgcacggcgtgaggctggtagggggcctccaaggccttcacttcgtcggcggtcagcttgaggtccaccgcgcgcaccgcatcctccaggtgctccagcttcgtggcgccgatgatgggcgccgtcaccgcggggcgcgagaggagccaggccagggccgtctgcgcgggaggcacgttgcgcttctccgcgacgctccggttcgcttccgccacgtcccagtcactggcctggtcatagagcatgggtgacagcgtgtccgacttcgcccgcgtggtggcgtcccggtccttcagcgacttgcgagagcccgcgagcaggccgcgagccagcggcgaccaggggatgacgccaatgccctcggcttcgcacaggggcagcatctcccgctcctcctcgcgatagacgaggttgtagtggccctgcatggacacgaagcgcgtccagccgcgcaggtccgcgactcccagcgcccgcgcgaactgccacgcatacgcggaggacgcgcccaggtagcgcaccttgccctggcgcacgagctggtccagggcggccagcgtctcctccagcggcgtgttcgggtccatccggtgaatctggtagaggtcgatggcctccacgcccagccgcttcaagctggcctcgcagccctggacgatgtgcttgcgcgacaggccccgcatgttctgcccgtcccccatggggaagtagaccttggtggccagcaccacctcgtccatgcgcgcgtaacggcgaagggcacggcccgtgatttcctcgctcgcgcccagtgaatacatgtccgcggtgtcgaagaagttgatgcccagctccaccgcccggcggaagaacggctgcgcggcttcttcatccagcacccaggggcgccacttgggcgtgccgtagctcatgcagcccaggccgagacgagacacacgaagacccgtgcgtccgaggttggtgtatttcattccgttggttcctcattcattcagcgtggatggcggcgcgcctcgttgtgtcactgggcgtgtcatggctcataccgtggaagaccggggcgcgcgcgtaccaggccttttctggttacttggaatccggtagaaagagccggaatccaaggggcgctgttcggagcgatgcggagcgtgcccctcgtgcttccagcaggggatgtgacgcggcgttccgggcggtgcctccaggcagtgcttcgggactctcgacatgcaccttccgacccgcgccgaccccgcctccgaattcgtctgcccagaggacgtcaccctcgtggatatgtgtcgggctcgcgccgccgcgcagccagacgactggatttatacgtttctcgacgaggcgggggagcaggctgtctcctacgcggagttggacgcgagcgctcgcgcggtggcggcgctgctacaacgacacctggcgcccggtgagcgcgcgttgctgctgtacccgccgggccgcgactacacgttgggtttcctggcgtgtctctacgcgggcgtggtggcggtgcccgcctatccaccggacccgatgcggctgggccgcaccttgcccaggctccaggcgctggtggcggactgtggcgcccgggtggcgctgacgacttccggcatcgcggacatggtggagcccctcacgcaaggggcgcccgacttgcgggcgttgcgctggttggccacggactccgtgttccagcacgaagcggaggcctggcgcgcgccagtcctgcggggcgactcggtggcgttcctgcaatacacctcgggctcgacggggacgccacgaggcgtggtgctgcggcaccgtcatctgctgcacaactcgtggttgattgcccggggcttcgacacccgcccccacccggtggccgccctctggctgccgccgtatcacgacatggggctgattggagggctcatccaggcgctgtaccgcgacatcccgtcggtgctgctgcctcccatgtcctttctccatcgcccgctgcggtggctggaggcgatgtcgcgtttcggtgcgacggtctgcggcgcgcccaacttcgcgttcgacttgtgcgtgcgcaaaaccacgcccgaacagcgcgcggcgctggacctgagcaggctggaggtggcgttcagcggcgcggagcccgtacgcgcggacacgttggatcggttcgtggatgcgttcgccccggcgggcttccggcgcgaggccttctatccttgttacgggctggcggagggaacgctgatcgtctcgggagggacgcgctcggccgtgccggtggtgcggcgtttcgctcgtgatggcctgctgcgcggcgaggcgcgggcgcccgaggtggatgctccagcgacggcgctggtgggatgcgggcaggcgctgggcggccaggacgtgcgggtggtggacccggaaaccggccgtccatgtgcgccgggccgcgtgggcgagctctgggtgcgcggtccgagcgtggcggacgggtactggcagcgccccgacgaaacggagcgcacgttccatggccggctggcgggctcgggggagggcccgtacttgcgtaccggagacctggcggtcatcgacggcggcgaggtcttcatcaccggtcgcttgaaggacgtgcttgtgttgcgcggcctcaactactacccgcaggacctggagcacgccgcggatcgctgccatcccggcgtgcgtcccgggtgtggtgccgcgttcgcggtggacgctggcgacgaagagcggctggtcatcgtgcaggaggtcgccgcgaaggtcgccacgccggaagcggcggccgaggtcgtcgcgagcatccgcgcggcgctgggcgaagcgcatggcctggccgtccatgccgtggtgctcatcaccgccgggacattgccgaagacgtcgagcggcaaggtgcagcggcgcgccacgcgtgaggcattcctggcggggacgctggacgaggtgcacggatggaaggaggacgccgcggcggcgtccttggacatcaagcctgacgcggcacccgaagcggcggacgtgctcgcggtgctccggtcccggctggcgtcactgcttggcgcgaatggaccggcgctgagcgtggatgtgcccctgacgcaccaggggctcgactcgctgagagcgctggaggtgttgcacgccgtggacgaggcatggggcgtgtctccacccatcacggcggtgctccaggggcagagcctccgcgaactggcgcggtgggtcgagcgggcccggaccgagggcgccgaggcgcggcccgaggctccggctgtcatgcccggcgaccccgcggccttcgtttccgatggccagctggcattgtggttcctccagcgcatggctccgggcagcaaggcctaccacgtgtcccaagcggtgcgcttcgtcacaccagtggaccccggagcgcttgctcgtgcgttctccgtgctcgttgcccgtcaccccgcgttgtcgtccgcgttccccgaggtgcagggggcgccagcgaggagagcctgcgtcgcgccgccggagctggcgcgggtggaggcgtccacctggacggatgaagcgctgcgtgagcggctcgatgcggatgcgcgggaggccttcgacatggagcggggcccgctggtgcgcgcccggctctacaccggtgcgccacgcggggacgtgttgctgctcgccatgcaccacctggtcacggacttctggtcattggaggtcatcgcgggggaactgggcgcgctctacacggccgaggtccgaggcacgccgtccggcctgtcgccgccgccacccgtggctcccatcctcctgtcgttggcgcggcggtccacgggagcgcagggcgaagcgctcctggcctggtggcgtgagcacctggggggcgagctgcccgtgttggagctgcccacgtcgttccctcgacccaggctccagtcgttccgaggggcgcaggtgaccttccgtctgccgcgcgagacgtccacgcggctcaaggccctggcgcggacgcacggcgccacgccgttcatggtgctgctggccggttacctggcgttcctgcggcgctactcggggcaggaggacctcatcgtcggtacgccgaccacgggccgcccgcgagcggacctgtcgcgacaggtgggctacttcgtcaaccccgtggccctgcgcgcccgggtgccgcgcacgctgtccttctctggcctggtggcgcgggttcgaaccaccgtgctggaggtgctggagcatcaggatctgcccttcacgcggctcgtcgagcagcttcagtcgcggcgtgacccgtcgcgcgcgcccatcttccagacgatgttcgccttgcagtccccccgtaccgagaacgagctcctgggcgcgttcgccgtcggggcttcgggcgcgagcgcccggctgggcgatgacctgacggtcgaatccgtcccgctgagccatcccggcgccgccttcgacctcgcgctgatgatgacggagctggaaggggccttcgtggcgaggttggagtactgcgccgacctcttcgacgccgcgaccgccgaacggatggcgcgccacctgggggcgctgctggatgccgccgtggcgcagccggaggtgccgctgggcgacctgcccctgttcgctcccgacgagcgccgcacactgctggcgctgggacggaggacacaggacacgcggggcgcgctcgtgcccggcatcattcaccgaatcgaggactgggccgcgaagacgccgcaggcgcctgcgctcgtcgcgggcgcgtcgagctggtcctatcgtgaggtggcggcatgggtggcccggctcgccgcgcgcctgcgacgccacggtgtcgggccggaggttcgtgttggcacgctgctggagcgcggcagctccgagcaggtcgtcgccttcctcgcgatcttgaaggccgggggcacggtggtgccccaggagccttcgtatccccccgcgcgtgtggcgtggacgctggcggactgcggcgcgcgcgtgctgctggcccaggagcgctacgcgcagcgcctggcgttgcccgaaggggtgacgctgctgccgtgggaggcgcacggcgaaggcgacgacatgccggacatgtccctgtgggaggccggcgagccacctccggactgcgcggcctacatcacctatacgtccgggagcaccggcaagcccaagggcgtgatggtgccgtaccgcggcaccgcgcacctgtgcgagtcgatggtgtcggacctgcctgtcgggcccggctcgcgggtgttgcagttcgcctcgcccgcgttcgacatgtcggcgtgggactacttcctggcgctggcctcgggcggcgcgctgcacctgtcaccccggggtccccctgcgggtgacgcgttgtaccggatgttgcgcgagcagcgcatcacctcggcgacgttgccttcccct

SEQ ID NO: 1114 - DNA, 17503 bp, Myxococcus xanthus
tcgctgcttgaatcgctggcactcggggcgtgcgtggtcggcgggctggtcgttgtccctgacaaagtccaggaggatgccgcaaaagggcaccgacatcgccccggactctggcaggaagatgcggtcataccggccgaagacgcggtgcttcgtcacgtacaggcggccaccgatgcgcgcgccggggagttgctgctctccctgctcgcgtggcagcgcaatcacgaagctgtagttgtagcgcgccgggcccgggtggtcctggatggcatccacaatgacggggaccttgtccccgggcttcaggcccaggcgctccatctgcagcaaggcgccccgggggcacgttccctccggaggcatccacttgggccgcgccggcccctgcgcggacgcggaggtggtccggcagcccgccgccaccaggagccccaggcccaccaccgtccaccgtggccagcgcatgcgcaccatcgcctccctcagaacgtcccgatgctgaagtggaactgcgtggtggcctcgttcaccgactcgtccgggtccaggttgaagcccacgtcgaaggccagcggccccacgggcgtcacgtagcgcaggcccgcgcccgccgtgtagcgcagccggcccgggtcgaactgcgtccggtccagccacaggttgcccgcctcgaagaagagccccaggtccacggaggacagggccggcaggcgcagctccgccttgcccagggtgaagagctcgccaccctggctcgcggggacctgcccggcgagcacggccttcagctcagcggagcaccccgacggcgaaatcagcgcacggcagtcacgcagccgctgctgcaacgcgccgcggacgtcctccggtagcacaccgtcctcacggaagccgcgcaggctggacgaaccacccaggtagaacagcttcgagccaatggcctgcgcctgctcctccaacgggatgatggtgcccgcgcgcgcggacagcgccacgctcgcccgccgtcccagcgggatgtagccactgaggctgcccgacagcttcacgccgtcgatggggtacgcatccacgcggttacccgccacgtccgtgggacgcacgctcaagccacgggtgaactccgcgctggagacgagcaccacgcccctgcgcgggttggccgggtcatcccggaagtcgagcgtgacagaggggcgcaacgaatgcagcgcgaagtcgccgaacgggtagcgcagccgctcccggtcggcacggttgagcagctccagcacgcccgcgcgcgagcgcagccggttgttctccacttcgtaggacagcgacaggttgagccacgtcgccgcggcccagtccatggcggccgccgccgcgaaccgcgaggacacgtaggaaggccggtggatgcgctcgccaatgaggtccaggcgggcgcccacctgcagcggcagcaggaagaacagccgcggctgcgccagcgcgaggttgccccggcctcccaggccattgagcccctggagttccacgtcacatcccggagcgggaccgccaccgggcaccgtctgctggcaggcgatgcgccggtcccgagacagcgcctccgcgctccagcccgcgtagttgatcttcccgcgcgccagcaggctgagccccaacccgtccaggttgcggtaggccgtgtcgagcgtgatgcggggaccgtccaccaggaagtagccgccggacacctggccatccaaccggggccgctcctggaccgtcaccagcacgtccttggtgtcctcgcgccgggtggggtccgccagcgcgatgtccacctgacggaacacgcccaggcgcgccaagcggcgctggccctccgtcagctcatccagcgcgatgggcttgccctcctccaccgcgaggttggccagcaccaggtccgggtccgtgcgcgtcaggccctgcaccagaatcttcccgaccttcacctgcgggcccgcgtccgcgcggaagatgacggtcgcctgcgttccgtcctcgcccacgcccgtctccgtggtgacgcgcgcgaagagtagccctgccgccccagctcctgctccagctcctgctccagcgcctgccgcgaggactccaccgtgtcgaagctcagcggcgcgccctcgcgcatgcgccggcccatgacccaggccgtcagacccggtggcacgccctcgaagtccactttcaccaggcgcgcctggggcccctcctccacgtcgaagtccgcgaccgccgtacgccccacgacatccaccgtcaggccccggaacgccaccaccgcggagaggaagccctgctcgcggtaggcctcgttcatggcctccacggcctccagccacgcatcctccacgtacacggtggacgctggcggcggcggcgcgacgcccgggagctccaggccgtgacgtccctcggtgttcagcgggtcgtcgagcatccgcaggtccagctccggccgcgtcatgcccgccagcacctgctccgcgagcagcgcgcgcagcgtctccaccggcagcccgcggttgccgtggaagcgcacgtcggccacgcgcagcgggtgcccctcctccacgtcgaacaccagcgccgccacctcgccatccggacgcagcacctcgcggggccgcacgcgcacgtcgtggaagccgcggtagcggtagaaggcctccatgcgtcgcgcgagccggccagcgacgacctcgtccatgggctccgaaacgtcgtgcgccagcacgcgctccagcacaccgtgggggaagtggcggttgccgtggaagcgcaccacatagcgaggccccgccatcaggggcaccgccaccgacgcgaagctgccctccaccagcaccgccggcgctcccacctgggcgcgccagtagccctcgccacgcagcaaggtgcgcaactcctccaatgagctggacaggcgcgcccggtcgaacacctgccccggatgcagcgccagcacctccagcaaccgggacagcggcaggccagggctgccggagaaggtcacctgccgcacccgcgtgggcaggccttcgtccacggtgagcaccaccgcgatgccatccgtcaccggctcctgcgtcacggagactctcgtcgagtcgtaccccttgcgctgatacgcctggagcacggacgacaccgcgccctgcagctcctccgcctccagcggcccgccctccagcaagctgctggcctccagcagctccccgtccgacagcacggagttgccttcgaagcggagccgcgccagccgcgacacgggcgtgagctggaacatcagccgcaccccgcctcgcaccggctccgtgcgcgccaccacgtccgtgaagcggcccgtggcccacagccgctccaccgagcgccgcaccgcgcccggcgtcagcgtctgccccttgcgcaccgccaccaggtcgctcaggccctgcgcgtccgcgcctccgggcaggtgcagctccacggcgatgacctcggcgccgaagccaacgccgtcgtccgcctgcgcgcgcgccacgcccggcacgaggacgcagagcaccagcgccagcaccgcgagggcccggactactcgacctcccagctcagcttcagctcgagtccgaggtttccaaacgaggcttcgttgttctcgttgtcccactgggcctgcgcggagagtcggtcatcgaaacggtactcggcccgcgcccgcgtgccgcgcccgctcacgggttgagtcataccgattttaagctgctcgctcaggaacttcgactccagttgcgcggtgggctccgcttgccgggtggcgtcgttgtaggtggtcgaaatctgcagggacaaatccctcaacaccggattgctgggcaggaagcgctggagctgccggtccaggcccgacacgttgaaaagggcctcggccgccaggccggcgctcgccgaggccgcggtatcctggtctgacgaggtgaaccccagagtgaggagcgagacgatgtcgccctccaccagcgccggctccgaggagaggagaatctgcgggtccgccggcttgccgaaggcgtgcagcttcaccacgtactcgcgcacctgcgtctgggcctggacctcgaagacagggtcgatttgcgtggggtcctggaattcgagctgcccttgactgatggtgaaggggttgttccggaagaaggcctggctgccctcggccagctccacccggcccagcagtcccggccgcaggtccgtccccgtcaaccgcacgtcccccagcaggcgggccttcgccaggttgttgtccacgcggacgtcgccgaagtggacgttcacatcccagatgacccagggcttcggaggctcaccggacgacgacaacgagcccgccgccaggtgggtggtgcgcttctgcatcgtcttcagcagcgcatccacgtccagcgccttctggtagcgcatcttcacgatgtccatgccaccggtgacggtgaagcccttgggcggaccaatcacttggagcaggccggagaaggtcgcgggcaggtcctccgtgagccggtaaggcacctcgtccagttggatggtgaggcccagccgctgcggcaggaagcgctccagccgcacgtcgccgcgcgcggacacgcggccgtcgttgagctggccctgcaggtgctccacgagcacgcgctggcccgtcatctccacgcgtccggccatgttgcgcacctggacgggccagtcccgcagcgccagccgcatgtcgaacagctccgcggagcccaccacggagggcttctccagcgtcccggaggcctcggcgtccacggtgatgcgcccggaggagcgctccaccatggcgggcatcaacgactccagcaggcgcaaatccaacccgccccgcagcgtcacgttcaggccgcgcgggctcatccacccgcccagcgacaggtccacgtgctgccccgtgaagcggaagggctgcacatccgtccgcccggccgcgtacgccagcacgatggggcccgcgttctccccgcgcaggtcgtcgcgggagaggaccagccgctccacggtggcgttcacctgcgagcccgcgggctccaagagcaggcccttggcgctcaccgtgcccgacagggacccgctgacgcccgcccacagcggcgcgtccggcagcagcgggcgaatctccggcaacgagaacgagccctgggcttcatagggccagttctcctgcaccttcatgcggatgcggccggtggcgtccccgaaggggtggccccacacctcgaagttcttccccaccatgcgcccggtgaggtccatggcgcccaggttccgctcggcgaaggtgacgcgcggcgcgcgcagcgtgacgtccaccaccggcacgtccgcggtgcccgacacgacgccgtccatcaccatggtgccctcgatgcccatgcgctcggcgagctccgggtccaccgcctcggccagcgacagaccgtctccgccgaagcggtagtccagcccgccctcgaacgtgaaggtgccctctgcccaggtgcggcccagcggccccgtgagggtggtgcgctccagcaccatcgccttgccatccacgaagcgcagccgcgccgcgccgtcacccatgcgccggcccaggtaggtggtgtccttgacgtcgaacgccaccagcccctccagcttctccacggggctgtccacctccacgcggccggtggccgttccacccaacgtgccctgcatcaccgcgagcgacggactcaggcccgccaccacgtccaccaggtcctcgttgcgcccctgcgggacgttcacctccaggcgcaggttgagcagccgcccgaaggacacgcccgccttgccgtagtactgcgtgcgccccttctgaccggagaaggcggggaacgtgagcaggctgtccttgtaggccagcttcccctgcatcacccccagcgacaggttccagaactcgaagtcgcggaaggacagccccgcctccaccttcacgtccgacgcgggtccggtaatcgcgtaggtggcgtggccccgtccggcccagggcaggcccgcgatgtggccaaagtccgccaggtccacgtcaccctgcccatggatgtccaggcccaacccgcccgccagcaggagcacgacgtcgcccgtcacgcgtgagtggcccacctccgcgttgacgtggctgaaggccacgcggtccgcctggagcttcacctgcgcctgcgcgcgggccttgtcgaactccagaatcgtgagcccgtccttcggctgcgtgtcgaacgcatgcgtggccagcacgaacttcccggtccgcaggtccaacggccccgacagggagaagcgcggcagcaggttgccggacagccgcgcgtccagcgaggccgggaagtccacccaggagcccttcacccccgcccggtccaggatgcggcccaacgacgcgtcctccgtcgtcaacgacacctccagcgggaagttcggcgtgagccccagccgccccgtcgcgcgcaccttgcccgcgcccacgggcagggtgagctcctccagccggacgtcttcacccgagtacgacaggcgcgcgtgcaggttcgtcgggccgaagtccccgtagcccaggctgttgcccgacagctccagcgacaccgcgggagacgccaccttccccgcgatggacacacgcgaccagaggtgccccgtcgcggggctgggaatcagccgcgcctggtagagcgcgcgcagcggaaggaacacctgcgcgtccagggccagccgcggcgcgcacagcgaatccacgcggccggacaccgtggtggtgatgtcgtccagcgacacctcggcgcgctccaactccagcagggcctcgtccgggtccaacgcgcccgcgatgaccagctgccccaacgccagctcacgtccgtccgggcccaggcgcacccggccgcgccgggcctccacgtccagctcgatgacgccccactgctcgtcccagcgaacgtccagttcgtccacctccacgcgccggccctcaggcagcgccaggcgcagctccgcgccggagatgtcgagcttcgccacgcgcaggtgctcgagcggctccaggaagcagaagttggacttgggctccgacggcgacgagggctgcgacaagtccagcgccacgcgcggccgggatgccttcacctgggccagcgtcagccggccctgaagcggctggagaaagccgagctgcacctccgccctgtccacggccaccagcggcgaatccgtgccggggaggaacaacgagaagccgtgcaccaccacgcgggagcccagcgggtccaactcgcagcggccgagccccacgtccaggcccagcacgtctggcaggtgtcggcggcccagcgtgcacgccacctcccaggtctccggcatgcgcaacaggagcacgctccccgacaagacgaggagcaccaacagcagcgccctgcgcgcaccgtggcggctctgagaagacaaagccgctacagcttacccagcccttcgaggtagcggtcgatctccgcgaggtccaccttgctgctcgtcgtcctggggagcgtcgacgcccgaagcgctcggccgctcggccgcttgcccggcgggcgtgttcaccccaagcaggcccaagttcttcccgatgcgatgcaccagctgcgcggacaccgtctgctcgcgcgcgaggaaggcctcgaagagcgcgttgtcacacagcgtgttgatgacgcggggcgagccggacgagtgctggtgtacggccagcagcgcctccgggctgaagggcatgcgcgggcagcccgcgagccggaggcggtgcttgacgtaggcctcggtcgactcggcggtgaagggctccagccggtagcgcatagccacgcgctgcgcgagcggcgggtccagcttcaggttcttttcgatttccggcaggccgaagaagacgaaagagatgagcttgcgctccggcacttccaggttgagcaacccccggaactcctccatcagctcgcgagtctccagcatctgcgcctcgtcgatgaggacgacggccttcttgccggactcgtagatttggagcagccgctggtacagctgcgacagcagcgccagcttctcctgcgccggattctccacgcccaactgcagcgcgatgcggcgcagcaaccagttggcggtgatgccggagtggatgatgacgagcagcgcggcctcgtactcggactccggaagcgagtcgagcatgcggcgggccagcgtcgtcttccccgcgccgatgtcaccgacgaggatggacaggcccttcatgtagctcaccgcgtgcatcagccgggtgagcgcctgcgagtgctgcgccgagttgtaatagaagcggctgacgggagcgttggagaagggctcctgggtcagctcgaagaagtccaggtacgtagtcatgggctcgccggacctcgcggggtgcaactacaggtagccgaccttgcgcgccttggacgcgccagccgctggtatcggagtggtgggcgccgcggcccccgcgggtgcgggcggactgctggtggcctgggccccattgccagaaggcgtcggaagcggatcctccaccggcgccacggaagccgcaagccgggacacgtgcccggcgacatcgcggtacttcccgtccatcgcggccacgcgctggtagtggaagagcgccttgcccgcctccccctgggcctcgtaggccgccgccagctcgaagccgagcgccttggccgcctcgcccgtggcgtgggggttgcccagcccctcgcggaaggcctccacggccgcggaggcgtcgccgcgcagcagttggagcatgcccatcatggtgatgcagtccagctcgcgcttgccgcccgcgctgccctggcgggccacgtcgaactcgtggagcgcgtcgtcgagcaggcccatttccttgtacgcgatgcccaggtcgtaatgcgtgtccacgtcctcgggcttcaccaccttggccaggctcttcttgaactcggagaagacctcctccaccgagtactggaagtcctcttccgcaggcagcgccgaggccccggcgtcatcgccgaagttgtcgatctccccggccagctccgccgcgaggtcgaacgcgtcgcgctcgcccgtggtctcctcggcgtcctcgtagccgtccgtgacgggctgcacgctcggaatctgcgccggctccgcggccgcgtcctcctgctccgcgccgcctcccgcctccgccgcctccagccgctccatcagctcggctgcgcgcgcgtggcccgggaaggcaatcatcaccgtctcgagaatctcgcgcgcctcttccagcagcccctggtcgaggaagaacgacgcctcgtcgcactcctccgccgcgggctcctcttcatcggcggcggcctcgactgccggctcgggctcgggttccggatcgggctcgacctcgaccgcgggctcctcgtaggcgaccggctcggacagctcgtccgcggacaggtccggcgcgtcgtccacgaaggactcgtcgtccaccgtcacgatggcgtgcgaggccgtgggctcctcgaactccatcgggtcgcccagcgcgggggccccgaacgggtcctcgtccaggtcggcagccgtcaacggcgcggcgcccacgcgcgtgggcacattctccaagtccagcggtggaggcgcctcgtcgtccagcgcaggcacgtccagcgagtccagcgtgggaacctggagcgtgtccggcgaggcctcgtcgagcagcgcctgcgtgggcgcgtgcatctgcgtgggctgcggctcgtcgtcgtccccgagcgacagcgcttccatggacgtggcggcgccgtcgtccaccagcgactcgtcgtcgagcgagtacgccgccacggcagccaggtcatcatcgctggaggcgacgagcggctcgtcatcggtgacgctgaggcccggctcgtcggacagcaccaactggtcgtcgtccgtcaccagcgtctcgtccaccgacgccgccgccaggtcctccggatctggcgtgccgtacacctcgaactcacccgaagtgatggcctcgcccaccagcgcctcttcgctgatgacggcggagtcgctgtcctcctcgatgacctcgtccgaatcgctcgagggcagcgtcgtcagcgccagctcgtcaccgggcgggtgcaggagcgcgtcttccggcggcggcgcgacgagaatctcgtcgtcgctggagtccaccaggatggcgtcctcgcccaccgactccaccacggacaccgtcggcgcggcgaccacgggccccgtcgtgcgcagcacggacagaaacgcgggcacctcgggatgggcgggattctcctggaggatggtggccaggtacggctgcgcgcgctgcacgtcggccgtgcgcgtacacaggcggagcacattcagcagctgctccgatgcctgggccatgttcccggacgcgacgtagatttgatacgccttctcgtgggcgtcgaggttctccggctcgacggagaagaccttgcgcaggtgctccagcgctttgtcgtggagtccgtacttgacgtagacgtccgtctccgtgagcagcttggagagctgctcgcgccccatccccgccggagcgggaggtgccacgggcgccggcgccggcgctgccgccgtgggctggggcgcggggcgcggggcgggctgaggtgccgccgcgggctggggcgccgccggagcgggctcgggcgcgcggcgcgcgaccaggtccgggtcctcggggtccagcacttcaatctgcgtccagacagcctcggcctcggtgacgcggccgcgctcctgatgaatcttggccagctccttgtagacggagatggtcttcgacgtctggcccaggccctggaacgcctgcgccagcagcgtgagcgtctccacgtcgcggccgtcggccttgaaacacacctgcagcttcgccagcgcgcgcttctggtcgccgcgctgcaggtacgacgtggccagctccttcgacagcggaaggttgtccggctccagcgcggacagccgctcggccacgcggagccagtcatccgcgcgactgttgcgcttgaggtactcggcggcgcgcttgaactcctgggccgcctcgcgcgtcatgttctcgcgcgcgtacagctccgccagcttgatcttcgacgccacgttctccgggtcgagatccaccatcttcttcaaggtatcgagcgacgacttcgtgtcgcccgccttgtcgtagtggttggcgacaatctggaagtacgccatcgcctcggacatcagcccgagctgctggtgaagctccgccagcttgaggttcacctccagcaggttcggattgagcttgaggacttgcttgtagagcgcgacggccttgaggaagaagccgtccgacgagtagctctccgcgaccttggtgaagaaatgggcggcctgcgggttgtcgttcttcttctggtacagctcccccatcttctggaggacccggatgtccttcgggtcgacctccaggaccttctggtactccttgatggccttgtcgtaggcgcccttcgcgacgagcttcgcggcggcttcgatgatcttgttcttgtccatcgagcggtgggcttccagcaggccgaaaccccttgaacttcgcgggtttccatcctcagcaagggggagtgtcggaggctaacggaaagctccgacgcgggtcaagaaacggcccggctccccccgggccggatcacctgctcgcgtagcggcccgacaagcgggaatccgcaccacgtggatgggtgctacggcgtctcctcgacggccttcttcagccgccgggagcccgtctcgctcgcgagcaagcgctccacgaaacgggtgtcgtaattgccctcctggaaggactcttccgcgagcgcggcccggtggaacgggatgttggtgcggatgccttccacgacgtattcgcccagggcgcgctgcatgcggcggatggccgtagcccggtcctccgcgtggacgatgagcttcgacaggaggctgtcgtagtacggcagcaccgtgtagttctcgtaggcgcccgagtccacgcgcaccccgtagccgcccggcacgctgtagccggtaatcttcccgggccagggggcgaaggtaatcgggtcctcggcgttcacccggcactcgatggcgtggccacgaatctggacgtcctcctgcgtgaagcgcaggggctccccataggccaggcggatctgctcgctcaccaggtccacgcccgtgacgagctccgtcaccgggtgctccacctggatgcgcgtgttcatctccatgaagtagaactcgccgcgctcgtcgagcaggtactcgatggtgcccacgttgttgtacgcgagcctgcgcatggcgttcacggacacctcgcccatgcgcttgcgcagctccggcgtcagcgccggcgacggactctcttcaatgagcttctggtgtcggcgctgcaccgagcactcacgctcgttgaggtggacgatgttgccgtgctcgtccgcgacgatctggatttcgatgtggcgcggcttctccacatagcgctcgatgtagaggtcgccattggagaacgacgccacggcctccgcctgggcggtggagaaggcctgcgccagcgcgcccggctcgcggacgatcttcatccccttgccgccgccaccagcggccgccttgaggatgacggggaagccaatctcgcgggcgaaggcctccgcctcacgcgggtccttcacggtgccggggctgcccggaagcagcggcagtcccgcctcgcgcgcggcctggcgggcgcgcaccttgttgcccatcagccggagcatctccggccgggggccaatgaagcgaatcttgcagttctcgcagacctccgcgaactcggcgttctccgacaggaagccgtagcccgggtggatggcgtccgcgcgggtgatttcggaggcggacagcagctgcgggacgttgaggtagctctccttggacgccggcgggccgatgcacaccgcctcgtctgcgaagcggacatggagcgcgttggcgtccgccgtggagtgcaccgcgaccgtggcgatgcccaactcccggcaggcgcggatgacccgcagggcaatctccccgcggttggcgatcagcaccttcttgaacacgtgggtgtctccgtcagggccgtcatgaggagcggctcgcccgtgggatacgggcggcgcgccagcctcatcttcaggccacttcgatgcggaacagcgcctgaccgaactccaccggccggccgttctccacgaggatttccgccacccggccggagacctcggactcaatctcgttcatcagcttcatcgcttcgatgatgcagagcacctggcccttcttcacgatggagcccacctccacgaagggaggctggtccggcgcgggggtccggtagaacgtccccacgaaggggctcgtcacctggtggccaggcttctccaccggcttctcggcggccggagccggcgcggcgggagtagcggccggcggcggcgcggcgacgcgaggagcggcaggggcggtgtactccaccccgacactcgcggcgacgggagccggcgcggcgtggtggacgatggtcgtctcggggccctggccgcggcggatgaagagcttctcctcgccgcgcttccagaccagcctcgtgacgtccgaggactcgagaatctccacgatctgctgcagggcatccacgtccagggacgtgccacccgtgtcagcgggaccgctcgaggcggcctccgtccgagcgggcgcctgggcccgggtcgacttgcgcttcgttgccatatctcgcgtccccttccctccggcgtcgctgccgagctgcgtactagcccctggtggccacgcgcgtcaggtacttaccgtcgcgcgtatcaatcttcagcacgtcaccctcttcgatgaaaagcgggacgtagacggagtagccggtctccaggacggcgggcttcagtgcgccggagacggtgtcaccgcggatacccggatcgcactgggtgaccttgaggtccacggagttcggcagcgtcacaccaatggccttgccattgtagaagaggacgctgacgttgatgttctccttcaggaagttcttcgcctctccgagcaccttctcaccgaggaaggtctgctcgtagttgcgggtgtccatgaagtagaactcctcgccctggacatagaggtactgcatgtccttctcctcgatgtcgggcttgcccaccttctcaccggacttcagcgtgggctggagcacgcggcccgtcaggaggctgcgaatcgtggtgcgcacgaacgcggagcccttgccgggcttgacgtgctggaaatcggcgatttcaaacggctcaccgtcgatttcaatcttcagacccttgcggaactcggacgtatcgatgacaccggccatggggaccgactccttacagactcgcagcagcgaaagcttgaaaagtccggggtgtctagcccatgcgccccttccatggaaggggaaagcagcggcggaagcgtcgcctggatgactgccggccgggcatccgactagagctcggcgcgcaccttgggtgcagtgacgcgcagcacgtagcggcccttgccgaagttaccatccgcgtgaagggcgagcaccaggaagtagtccggtgacaccagccgcatcacggtcagcaccttctcactgttgacgctgacctcgctcacggtgcccgtcttgagggtctccgcggcgttgcgcaactgggtgaggaggttggcgtactccacccaggcgccgttgaggtccagctcggcgctctcatccttctggaaggtgtcgacggagatgccgtcaaagcccatcacgctgcacgcgagggctccttcgacctggttgaccaccgactcgaggtgcgtgcggaaggacatgggtagaggctcttagaaagacggccggggcccggtcaagggccccggcggacattgggactacgtttcctcgggctcggtgcactcgggagggaagccatcctgcccacccggaagcccgcagggcccggtgggcacgagctgcgttcctgcctggcaagtgaagcccgaatggtagaacgtgacggggtacgtggcctcgttcgactcggtcgacttgccgttgacggtcttaccgatcagcttcagccgaacgacgacgcttacgggcgcagtgccgccaccgccgaaataggcggcgaggtcagcgctcgcattggcccccagcagatccaggaccgcactgctgctctgcgtcgcgttcgctggcaggttgaaatagtaggggtagacgtcactcctgagcgtcggccccgtaccttgcgtttcgtagttcaactcgacgttgttgacgtagatggaagactcgtcgccaccacctgttacgggggcttcaccaacgacgacctcctgagtcgagaggctgttccggaccgtggaacgcagcgaggtaacggcctgacgtcgataggtccagtgacccgcccgaactggcgagccaggactggttgaccgcacaggaagcatccggaatgaacgcgttgaaaacctggatgtctggagcactgtcagcgcatccagtcatggtcagtgccaacggcaccgcgagatagaagttcttcatgagcgaacgctctcctgcaagaggacgcaagggcaacccttacagagtctgcgcaatggtctgccggttcagaatgcggggcgtgatgaagatgagcagttccttccgggtgtcggtctccgagttgttcttgaagagcaggcccagcaccggaatccgcgacaggaacggcgccgaattgacctgcgttgcgcctcggcgaacgtagatgccaccgatgaccgtcgtgtctccatccttcaccagcacctgggtgttggcttccttgcgctggatggaaggctgaccgttggcacccgtgctggacgggtcaggctggttgttggacgcattgatggacatcagaacgctgccatcctgggtgatgtgcggcgtcacctccaacgacagacgcgcttccacgaaggtggtgttcacaccctgcgccgacgtctggctgaagggaatggacacaccctggctgatgcgggctgtgttgttgtccagcgtcgtcaccttcggcgcggagatggtcttcaccgagccctcgttctctgccgcagacaggcgcaggttgagctgaagcgccccgcccgccgaaccgaacgtgaatcccatggctccgcccacaccctgtccagtacccgtgggcagattgaccgcaaagttcggattatcaggaagccctgcgccggtccccgtaacgccacccgtcacggccaggttgttcgggaagatgaggcccgttgagtttccagtcgcctgccccgcgcgagcctgaccaccccactgaacgcccagcgaccggctaaaggaggtgttggcttccacgatgcggctctcgatgagcacctgcggcgtctgcgtatccaggctgcgcaccaacgagcgggcgcgctccgtattggaacgcacgtccttgacgatgaggacgttggtgcgctgatccaccgtcaccgaacctcgctcactcagcacgtccttcaccctcgccgccatatcggcagccacggcgtagttgaccgggaggaggttgaccatcaggtcctcctgctgctggagcgacttcttgcgctcttgacgcagtcgggcctcctcctcgagcgtcttcagcggagcgattcggatgatgttgccgaactcctccttgcccagcgccttggtacggaggacgagatccagcgcctgatcccaggggacattgcgcaggcggatggtcaccttgccactgacatcatccgccaccacgatgttcttcttggagatctccgcaatgacgcggaggagattctggatgtcgatgtccttgaactcgaaggatacgcgcttgccacggtagcgggcctgctggggcgcgccctctgcggcgtaggcaggcgcctcggtggtgaagccagcggtgcgctgagccacgggcacctgctccgtgttcacgcccttcacatgcagacgccacgacagcgttcccgcgctctgggataccttttcttcaatggcaccatcggcggccaccacaagacgcaccttgccgcccgctcccgggacactgaaggcgctgatcatcttcaccggcgtatccaacgcgctggtgtcgaggctgcgctcgaacttcttcggaaggcgcgcgttgtccagcgtcagcaccgcgctgcgaggatccagccagtccaccttgcacccggaggtgcccgacagcttcatcacaatgcggccccccgagctgctctgctggaagcgcacatgcttgac

SEQ ID NO: 1115 - DNA, 15312 bp, Myxococcus xanthus
gccatgccgcccccgtcggccgccgcaccggcccctggggctcgtccgctgattcaagtgcggcgcatcaccccgcccgggcgcgcgcccgcgcagagcgcgccctccatggatgccgatggcggcaccacggactggatgatcatgaggagcgagcggcgtgagcagggcaaggccgacgccatgaagaagaagcgccaaaagggaggaatcctctccaacttcttcggcggcggtcagtctccagattcgctgaaggaggcagagctcgaggaatccgacgcgtaccgcgacgaggctccggccgccgagggcggtgtcgacacgggcgcggagagcctgctgtcccggcagctcgccaacgggctctgggaaggcaccggcgagggttccgagcccgtgcgacaagcgcgtgccacggcgctggccttgctgacgctgctgcgcgagggcatcaccagcagccatccgctgcatggtgcgcaggtgaagaaggcggtggaggccctgctgtccctggccgccagcctgagcggcgatgcacaggtggcggagctggcgctgggcgtggcgtggctggccgcggcgggaccgcgcacccggggccgcatcgagcaggccgcgaagccgctcgccgggctcaacggccggctgggcaacgaggtggccctgcgcgagcacgtcgacacgctggccgcgcgctgacgcaccgcgaaaaggcggcggcatggctgatacatgccgccgccgcgcttcgcatacagtgacgggcgccatgacgctcgccacgctcatcctgcttgccacgctctccgctcagccctcggaggctcctccctcttccgaggccacggcaccggagacagtcaccgcgccgcccctggtgtccacgcccgatgcctgtgcagcgagctccgaggcggattactcggcgggcttcgatgcgctcgtgagcggcaacgacgcgaaggcgctggagctgttcgagcgagtgctcgcggcctgtccacagcacccctatgccaccgagctggcccggctctcccggacacggctcgcgcctgggggtcggctggccaccggcgccgcgagcgagatggggcgagagccttactccagcgccgcgcgtgcctctctcgtcgtggtgcagacgctgcacggggtcgcacaaggcatcctcctgtgcgccatcggagattgtagcggccagggttacgccgcggtgtcactgctgggcgccggagcgggcgccgccagttcgctgctgctcacccggggcggggtgacggacggacaggccgccgtcatcaactccggcaccgtgtggggcttctggttcggtatcgcgacgctgctcgccttcgacctggatggtgaccatgccattggcgccgccatcctcggcggggcgggcttcaccggcgtgggcgttctgctggcgcacctggtgaaccccacctccggacaggtgtccctggccaactcgggtggcctctgggcgggcgcggtgacggcgctgttcctggcgacttcggacaacactgacttgaagcgtttcttcgccgtcgagctgggcgccacggccgcaggcatcctgtcgatggccatcctgtcgaagtatgtgccggtgtcccgaggccgcatgctcctcatcgacgcgggcggcatcctcggcgggctggtgggcgcgagcgccctctacctcaccgcgggcaatgacgcgggagacgccatcctcgtgggcagcggcgtcggtgtgctgggcggactggccctcaccacgtacctcacccggaacttcgacctcccggacgcgccccaggtggcgctggcaccgctcaccacgccacgcgggggcacgggcctgtcgatggtgggccggttctagcctcggtcagcggcggcgcaggccgtagatggacatgacaatctgctcgaaggtgcgtgagggcagcacggtcttcgccaccaccgccacgcgctgcgccagttgggccaccgggtagcgcacgtgaggcgctccgcgctccatcacctccagcaccttcttcgccacgtcctcggcggcgaggccgccgcgttcgccggactcgatggccttcagcacggcctcgaagcgctcccgatacgcggaacccgcgcccgccttcgcgacacacacgcggttctgggtgagctgcgtccgcacgtctccgggctgcaccagcgtcgcctcgatgccgaactcggccacctcctggcgcagcgcctcggtgaagccctccagggcgaacttgctggcgctgtagagcgactggaagggcaaccccacctgcccgcccagggagctgacctggatgatgcggccggcgcgccgctcgcgcatggaaggcagcaccgccttgcacacgcgcagcgcgcccaggaagttggcgtccaactgcgcgcgcgcttcctcgatagaggtgtcctcggcggcgcccgcgagcgcatgacccgcgttgttcaccaccacgtcgatgcggccctcacgcgacagcaccgtcgccacggctcgctgcacggagtcgtcttgggtgacgtccagctccagcatccggtagcccggaggcgcggcctccacgggacggcggctggtgccgtagacgatgtggccacgcgcgctcagcagctccgcgcacgccttgccgatgccggacgacgcaccggtgatgagaacgacacttccctgcgaaccggacatccaggctccgtgcgacagtcttcctggcgcacaaaccacgggtgcacgaggcccggcaagagcctctcaccccgcgtcacgggggtacccggcgactcagaccgtcttgctgcgcgcctgagcggcgacccccggctgcgcatcctctccggagatgacgacctggtggcgctgcacctcgcgcaccatgaagaaggcggcggcggacaacacgcccaggtcatccagccagccgagcaccgggatgacgtccggcagcgcgtccacgggcgacaggaagtagaccaccgccatcacgccggcgagcttccgccagagcgctacgtgcgggtcgcgcacgtaccggaagaaacggctccccattccacgaaggcctgcgatgttcatgcctacctctacgcacgagggacccgggtgattgcggcctcggcccacacccagcgtacgccgtccggccgcccggaggacagccaggctcagtccgggatgtcctccagcaccatcgcgcggcccaccacctccagcctcgcccggtcacccgcgcgcagcggcaggtccggcgcgccgcgcacggtgagctccaggccgttgcacgccacggtgaactcggcggaggggccctggaactcgcgcgccagcacctccgctcgcagcgcgccgcccaacgcgacgccgtccgtgtccggcaccagtcgcatcgcctctggccgcagcgacagcagcacgttgcccttcgctggcgcgcccgtcaccggaaggatgccgagcagcgtccgggcgccattgccgaagcccacgcccggcagcaagttggtgccgcccaggaagtacgccacgaaggccgtgcgcggcgtggcgtagacagcctccggcgtgcccacctgctccacctggcccgcccgcatcaccgccaggcggtccgcgaagcccatggcctcctgctggtcatgcgtgacgagcatcaccgtggcccccagcgacttcagcacccgccgcacctccattcgcgtggaggcccgcagcgcgctgtccaggctggagaagggctcatccagcagcagcacccgcggcccgggggccagcgcgcgggccagcgccacgcgctgctgctgcccacccgagagcgcgtgcggcatgcgcgactcgaagccctccaggccgaagagcttcagcatgttgctcgcgcgggcgcgggcttcctggcgcggcatcgcggtgaggccgaaggccacgttctccaccacggacaggtgcgggaagagcgcgtagtcctggaacaccatgcccacgctgcgctgctcggacggcacgaaggcgccaggactggccagggtgcggccgtccaacgtgacggtgccgctgttggggcgctcgaagcccgctaccagccgcagcgtcgtcgtcttgccacaccccgacgggcccagcagcgccaacacttcgccgggctccaccgccagggacaagcggtccaccgcggcggtaccgctggaggaataacgaagggtgacgtcgtcgagcgaaagcagaggcatggcgggcggcgcaccctaccgcgttcccgggggcccgggcgctttggcttaactcggagacgagccgccctcttgcgacaccaacagccccacacccagcgtggagacggccatcagcaccagcgccggcagcgcggcctcggcgaagcggccctcggccgtggcgccccagacgcgcgtggcgagcgtctcgaagccgatgggcgccagcagcaacgtggccggaagctccttcatcgccgtgaggaagacgagcgccgcgcccgccagcagcccgggccgtagcagcggcgccgtcacccggcgcagcacgccggacggaggctggcccagcgacgccgcggcctccggcaggtgcgggttgagctgaagcaacgacgcccgcaccacgcccaccgcctgcggcaggaagcgcaccacgtaggccagcaccagcatgaccagggtgccgtagaggaagggcaccgtctgcacgcccaggaagacgagcgacagcgccagcacgatgggcggcagcgcataacccgcgtaggacacgcgctccagcgccaccgtgaggcggctcgggtagcgcaccgcgaggaaggccagcggcaacgcgcccaccaccgccgccaccgcgcccaacatggaagcactcaccgagttccacgcgggccccatcatcggccccgactccaccgacagcccttgcacgccccaatagacgagcacgccgaccgggagccccacgcccaccgccaccaccgcgccgcacaagagcagcgccggcacgcgccagcggcccagttgtacgagcgaggaagccctggccgcgcccttcgcgctgcggtggtagcccgcacggccgcgcagccacaactccagggccagcacgcccaccgtcacggacaccaacgccaggcccaacagcgccgcgtagctgcggtcgtacgcgccctcgtactgcacgtagatggcgcgcgagaaggcgtcatactgcaccagcgcaaccgcgccgaagtcggagaggacatacagccccaccagcagcgcgcccgacgcgaaggcaggacgcagcaggggcacggtgatgcggaagaaggcccgggcgggtgtgagtcccaggctcctcgccccctccagccacgccgggtcctgagacaggagcccggcgcgcagcgcgaggaagaagtacggatacgtcgacaccgtcagcgccagcagcgctccgggaaagccatacacgggtggcaccggaagaccccagcgcgtcaggggttcctccagcgcgccgcccacgccaaacgccgccagcagcacgtagccgctgacgaacgtgggcaccgccaacggcacacacaacaacaccgtccacagacggcgccccggcaggtccgtgcgcgcggtgagccaggccagcggcagcgacagcagtgccgcgcagcccgtcaccgccgccgcgagccccaacgtgcggcccaacaggccccacgtcttgtctcgcagcagcaggccccatgcgtccgcatccgcttccgcggcgcgcacgcacaggtatatcgcgggaaccagcgccagcgtggccatggccacgccagccacccataatcccaccggggcacgacgaagcatcagaggacgccagtatcctggagcagcttcacggtgccgcgcaggtcatccagcctggacaggtccaggtcgggcgagcccaccttgtcgagcgccggcaggccctcagccagcttcacgccagacaccagcgggaactcggacgtctcctgcgcgaagtacgtctgcgcgtcggcgtccagcaggtacgcggccagcttcttcgccgcgtccgtgttcttcgagcccttgaggatggccacgcccgccacgttcaccagcgcgcccgggtcacccgccgcgacgaagtagttggccacgggcaggtccgctttgttcttcttcgcggagtacaggtagtagtggttcacgaagcccgcgtcgatttcaccgcgccccagcgcctcgatgatggcggagttgttcttgtagacgcgcggcgcgttggcctggacgcccttgagccactgcgtcgcggcctcgtcgcccttgagcagccgcagcgcggtgacgaaggactggaacgaggcgttggtgggcgcccagcccaggcggcccttccacttcgcatccgtgaagccaaggatgctcttgggcagcgtgtccgccttcaccttcttcgtgttgtaggccaccacgcgcgcccggccgctggtgcccacccacacgccctgcggcgagcggaagcgcgcatccaccttgtccagcgtctccttgggcagcacctgaagctgacccgccttcgccagcgcgccgagcgcccccgcgtcctgcgcgaagaacacgtcggcgggcgtcttcgccccctcctccagcaacgtggccgcgagctgcggcgtctcgccgtagcgcaccttcacctcgacccccgtcttctcagtgaacttcttgaggagcgggcccacgagcttctcgttgcggccggagtagatggtgagcgtctccgccgcgagcgcgggggaggccagggtcaggaccagggaggccaggaggagtcgtaccatgagccggcaccctaacggacggcctcccccgcttccaccgattgcgcgcgggcgcccggtgaagcgcgaaacaggtgacgaccgcgctccttcgctgcccggagtaacctcgtgggccgcaacctcccgccaccgtggagacaccatgccgcgcccgctcgtcgccgcctgtgccgccgccctgctcgccgcgccctccgccctcgcgcaggcgcctgcgtccccgaaaccacccgtctccacacccaacccgatgaaggacgccgccgagcgaacccggagcgcgctccagctcacacccgcgccccgccccgaggacgtgcgctccatcgattccctcatcgccgcgctgtacgacgtcatcagcggcccggcgggccaggctcgcgactggcagcgattccgcgccctcttccacccgggcgcgcagatgattcccatccgccgcccgaaggacggcaaggggcctgcggccacgcccttcaccccggatgactatgccacctccgcctcggtggccttcgacaaacgggggttcttcgagaaggagacgcgccgacaggtgtctggctatggcgacatggtccaggtgctgagcgcgtatgagacgcgtgaaaccgcggacgggccggtgatgaccacgggcgtcaacagcttgcagctcgtcttcgatggccggcgctggtggattctcaacatcgcctggacggacgacaaggccgcgggggttcccgtgccgaaggacttcacccggaagtagaacgcgcgccatgggtgacgcgtccctgcgcgatgtgctggtggtggggagctactgccacgacctgctccggcatggccccgggcgggaaacacatgcgctcggcgggtcgacggcgtacatcgcgtccgtcctggatgcgatggggctggagtacgcggtggccgcggtggccggcgaggacttccgttacgcggaccaggtccggcatccgccgcgcatcgttccgggaacgcgcaccacgcagttcatcgcggacttcgagggagaggcacggacgcttcgcgtcagcgcgaaggcggagccgattcgccctgcggacatcaccgtggacgcacgcgtggcactggcgtgcggggtggcgggtgaggtgctgccggagacgctgctccatgtctctgagcgggcgcggcatgtgctggcggatgcacaggggttgattcgggcgctcgatgatgacggacgggtgctcaatctccgcctggaggacacgcctttcgcggggctgctggagcggcttcgggtgctgaaggccagcgaggaagaagcccgggcaatggacatcgagcgggtacgtcagcggacgtgcctggtggtgacgcgtggggcgcggggctgcacggtgttcacggcggatgcgcgcatcgacgtgcccacggttgcggtggaggaagtggatgccacgggcgcgggggactgcttcatcgcgggcttcacgctggggttgctgcgaggactgccgttcgaacgctgcgccgcgctggcgaactggtttggcgcgcaggcggtgacgcaggtgggtgtgccgaagctggatgtcagccggcttccaacggaactgcgataagcagcattcaatgaaaagccagaacactgttacgcccttgggatgtgtgctcgtaagccttgccctgggatgttccagtggcgcgcactccaccgggagaagaggcgaaccgtacgcacttgcttcctgctccgattccgtatcgtgctgccttcagcgattccccggcatgcccgaagcatgtggactttccgctgccgaggccgctgtgctcatgaccggcgcccaagcagtaacgaacaccgcatcggtcgagtgggatgactcacataatgcagctctccccgagtggaagcgaacgtgcattcgtgcctatggcgactgcaaacaggatggctggaagggccactgttactcctgctttcaactgtgcgagggccaacaggaatggcccggcgacaaatgctatcccgtgggaaaatagcgcatggctgaagaactcgactgggacccgattcgcgcccttgcgcgccgagtgctgcgcaatggagagcccctgatgctcaccatcgaagtgcgggaactcctggcgcgaactgctcgtgaagtgggcctcagtcaagccgatgcgacttcggctcttgcgtcggacacgagcgccctggaactcctccgagagtgctcgcgtcgcatcagcgaagggtccagccggatggtgaatgcacttcaccggatgtaccagcacaagcgcgcgggtgacctcgacagtgcccgccaggaaatgcgggacgtgttggccgccgaggaggtgccgcactaccgcgccgttgcgcagggccaactcaacctgctggatgatgagccttgaatgacaacggggacgcgacttccgccgcgtccccgtcagtcagccttccggcgattcaacgagcaactcagccctgcgtgggctcctcgccacccggggtgccaccctcctcggacgccggggctgactcgacagcggcttccgcaggcgccgcggcctccgccgtggcgtccgcaggcacagcggcgtcagtcgcttccggagcgttggcctccgccgtgggcaccgcgccctcggccggcgccaccgcctcgccgttctcctcggactcgtcgctctcgggcagcttggagatggccatgaccttctcctgctcgttctccagggcaatcagccgcacgccctgcgtgttgcggccgatgacggagatctccttcacccgcatgcggatgagcatgccgccgttggtaacgagcatcacctcgtccgcttccttcacctggagcagacccaccaccttgccgttccgctcggtggtcttgatgtcgatgatgcccttgccgccacggccctgctgccggtactcggcctcctgcgtccgcttgccgtagccgttctccgtcaccgtgaggatggccgcgtccgtctccaccacgtcggcgcccaccacctcgtcgccgtcctccagcgtgattcccttcacgccgtaggcctggcggcccatggagcggacctccgtctccgggaagcggatgctcatgcccgacgccgtcgacagcaggatgtccttgctgccgtcggtaatcatcaccgccaccagctcgtcaccgtcgtcgatgcccagcgcgatgatgccgctggagcggacgttctcgaacgcgctcaggtccgtgcgcttcaccacgccccgcttcgtcacgaagaagacgtagcggttctccgggaagtcacgcgtcaccagcacctgcgccaaccgctcgccctcgccgaactgcaccaggttcaccatggccttgccgcgcgacgtgcggctggcctgcggaacctggtgcaccttcagcgagtacagcttgcccttcgtggtgatgggcatcaggtacgcgtgcgtgctggccacgaacagcttgctgacgaaatcgtcttccttcgtcgcagcgcccgtcttcccgcgcccaccgcgcttttgcgcccggtactcggtcatcggcgagcgcttgatgtagcccgtgtgcgacagagtaaccaccatcgtctcttaggcgatgaggtcctcgctggtcatctcatccacggcgccagtgatttccgtgcggcgcttgtcgccgtagcgctcgcgaatctccacgagctccgtcttgatgacgttgagcaggctgcgctcgttggccaggatgtcctgcagccgcgcgatgtcgcgcaccaggccgatgagttcgcggaacagctcctcgcgctgcaggccggtgagccgctgcaggcgcatctccaggatgttctgcgcctggccctcgctgaagcccgcgccctcgtacttgtgcgccaggcccgcgtagctgggctcctcgttgcgagcgcgcgagacgagcagctccatctgcgccttcgccttgtcgtagtcgatgcgctggagggtcgcgaagcgctcgtgctcgtacagcgagggcgacaggatgttcatcaggccccagcgcgcctcgtccgggtccttggacgcgcggatgaggctgaccaccaggtcgatgaggtcctgcgcgacgagcagaccttcgacgatgtgcatgcgcgccagcgccttgcgcagctcgtagcgcgtgcggcgcgtcaccacgtcacggcggtgcgcgatgaaccggtccagcatctccttcaggttgagcgtgcgcggctgaccgccgtcgatggccagcatcaccgcgccgaaagtcgtctccagcgacgtcatcgcatacaggttgttgagcaccacctgcgaaatcgcatcgcgcttgagctcgatgacgatgcgcatgccctggcggtcgctctcgtcgcggatgtcgctgatgccctccagcttcttctcgcgcaccagctcggcgatcttctcgatgagccgcgccttgttcacctggtacggaatctccgagaagatgatggcctcgcggtcaccccgcttggaggtctcgatgtccgagcgcgcccggatggtgacctggccgcggcccgtctcgtaggcgcggacgatgccctcgcgcccggtgatgatggcgccggtggggaagtccggaccggtgatgaactccatcaggtcccggaccgtgcagcccgggttgtcgatgaggtgcagcgtgccgctgatgacctcggtcatgttgtgcggcgggatgttggtggtcatgcccaccgcgatgccgctgctgccgttgaccaggaggttggggaacttcgacgggaggacgagcggctcttccagcgagtcgtcgtagttgggaccgaagtccaccgtctccttgtcgatgtccgccagcaggtcctccgccagccgctccatgcgcacttccgtgtaacgcatggccgctggcgagtcgccgtccaccgagccgaagttgccctggccgtccaccagcaggtagcgaaggctccactcctgcgccaggcgcaccatggcgtcgtacaccgacgagtcaccgtgcgggtggtacttaccgatgacgtcacccaccacgcgggcggacttcttgtaggcccggttgtggaggttgcccaggtcattcatcgcgtacagcacgcggcgatgcacgggcttgagtccgtcacgtacgtcgggcagcgcgcgccccacgatgacggacatggagtagtcgagatacgaacggcgcatctcgtcttcgatgttgacgggaatgagctctccagcgctgtccggggggggaggcgcggagggcgatgccggcttgtcagtcgtgtcgtcagccatgagctctggaagtctgcggaggggcccgcgaatgggggccgccatccagtgagtgagcgttcgtaacccctggatttcccagcgtcaacagaggaaacaaggggctctcgccccgaacggcgggatgcctggaaggggctcttttttgaacgcttgagcgagcctttttcagccctgcggacgcaggggagcagccaggcgctccgcttcggctcccaccggtccttccgggtcccgtttctttgctttttcgaacgcggccagggccccttcccggtcgcccttcagcttcaaggccacgcccacgttgaggtgcgcggagggaaagtcacggtccatggccacggcttcccggaagagcaccagcgcctggtccacgtcgcccgacagcaaggcctccttgccggcctggacgcgcttctccgcgtcattcacgagctccacctggaacacgctgccgcccaccacgttggcgacaagcacgcgcaggatgccgccccagtagaacgtgagcccctccgcggccaccacggcggccagcggcaggtccggaagcagttgcttgccccggaacttgaagcgcacccgcgtgtagcggcccttgttggcccagtggaccatctccccctggagcttgcgcagcccttcttccatgcgcttggggtcgatttcgaagggcaacacgcggcccgcggtctcaccggacgggagtgccttggggcccgggcgtccaggggtgggctcgtcggcgaggatgggctcagcttccagcacggggggccgaggaactttgacggcgggctcaaacaccggcgcgctggcgcgacggggcgcggcgctcgtcctcaaggcggccttcttcggggcagcggccttcttcgccttcgccttcgacgcggcgggcttcttcgccttcgacggacgcttctgggaagtgctcttggccatggacacaccttaaacgagccacggcgacaacgcttgcatggtgccgcccgatggtgggcttcgcacggttcttcgcacgcacgccacacgacttcacgccgcgcgcgtcccttcccaccgggcgcgaggggatgatggcgttccttcccgaaaggactgctccccgcatgactcgcgtccggcacgccctgctctccgccctgctcctcgccacccccatcgccagcgccgcgcccgccgaccccatcgcgtcccaggacgactggccccgcctccgcaaggagcgcatccagaaactgctgccccaggccatggcccgcgccaacgtggacgcgtgggtggtcatctgccgggagaacgacaacgacccgctggccatccacgtcgggtgtgagaacgccggaggcaccgccgccttcctgttcctcaagcaggacgcggccgtgcgcggcgtggccctgtcaccggaaggcgaggccaccgcgctccgcgacgtggcgccgctcgatgaggtggtgccgctgccgcgcggaacgaatctctacgcgcagctggcctcgcggctggcggcggcgaagccgaagcgcatcgccgtcaattcgtccacgtcggtggcggtggccgatggcctgtccgccacgcagcgcgccgcgctggagaaggccctgacgcccgcgttgcgcaagaagttggtgtcctccgaggacctcgtctccgagtggctctccgtgaagctgcccgaggaggtggacatcctccgcaaggccgccgcgctgacgtcccagatggagatagaggcctaccgcgcggtagtgccgggcaagacgcgcgacgtggatgtggcccgcttcctccgccagcgcatggcggaactgggcgtgggcgacgcctgggcgccggaccagaaccccaacgtccagagcggccccacgcgcgggcactcccacgccaccgagcgcgtcatccagccgggtgacttcatccagacggacttcggcatccgcgtgggcggcatgtgggtgacgaacatccagcgcttcgcctacgtgctggcgccgggcgagacgcatccgcccaaggaggccctggagaagtgggagaagggcaagaaaggcagccggattgcattggccaccctgaaacccggcgtgcgcggctgggacgtggacaaggcccagcgcgactggatgcgggaagccggctccgcgcccgtcatgtggggaacggggcacccggtgggctactgggcgcatgacgtgggcccggcgctctccggcgcgcagcagggcaagcccgcggcgggacaggcggcgcgcatcgtccggcccgggcaggtcttcgccttcgacgggttcttcgcgtggccggacggcggcgagggcgagcagcgcatcatcgccgtggaggagatggccgtcgtcaccgaaacgggtgcggaatacctcatcccaccccaggaagatttggtgctcatcccctccccgggtccttcccgccccgtgccgtgagacatgtctcgcgtgacaatctcgtgggagaagcttgagtaggatgcgctgaaccgctcgcggagagggcccgatgcagaacgtgctggtgattgacgacgacgccttcgtgctctcggtggtgagggacatcctccagagcgcgggctacggggtcgtggcggtgcagtcacccgcggaggcgttcaacctggacctgtccagcgtctccgccatcctctgcgactacaacatgccggacatgaacggctccgacgtgctcacggtgatgcgggagctgaaggactgccgggtgccgttcatcttcctcaccggacacgaggagctggatgacctcgtgtccgtggccatccgctacggcgcggagctgctgcccaagcccatccagcccgtggagctggtgcggctgctcgtcaaacagctcgcctccgcggcctgagcgcgatgtgtccacgcgctgcgccacagatgacaatggctgcccgggtgcacccaagccccctcgctcgctccgccttgattggatgagagagaaagacaaatggtgaccgcataccctcactcagggtaaaaataggatatcgggaaaggactgccatgaaagagccgttttggaccctgtacctcaccctgacaggtgcacgggacaccctccggacatctggtactacaacgtcaagttgcggaacga

SEQ ID NO: 1116 - DNA, 15377 bp, Myxococcus xanthus
cgggccctttttccccggagagcaccaccaggcccccaaaattccccgcgtcccctgaaggtggttcatcccctggtggggccagttccgtgcccccgggtacttgagtccattcaacgggtgacaaacagtggcatcattccgttgctaccagagcgtgtctatggtcacggtcgggtcctttttcagcagggggcccccgggaatggcctttcccgatgtctgccctatattcgttcaagcgtcggcttcccccagaaaggtgggcagccccccgtgtcccagcgagcctcagtactggttggtccagatgaggtccaacccgcccgagcgcgcgtcgccgtactggccttccaggctccagcgcgtgcccaactggtactcgaagcgcaccgcgttggcgttctctccctgctggaggttggcgcccacgcggccggtgtagccgacgtagattttgtccgtcacgtaggtacctacttccagcttggtgcccgcgatgccggaggcccccgcctcgatggagaccacgtccaggggcagcttcgcggccagggccttgcgggcctcgttggccaccagcgagcccaccacggacgcggcctgcgcgctggcattcatggaggcaccggagctgcgctccagcgtgcgccggcccgtcgccagcagcgtgtagatttccgactccggcagcggcgggtcactggtgggcttgagcgtgatttcccgcccctggccccggatggtgacgaacacggtgaccttggcgctgtcgttgcggtgctcggcggtgacgttgatgtacggcgccatggccgggccggtgaagcgcacctggctgtcgcgctggatgtcgaagcggcggccgagcacgtccacgcgcccgcgcagcacgcgcacttcaccgaacaggcgcgccacgtccgtgtattcgacgcgaaagtcatccgacagccccagctccgcgttgatgtcggagcccttcacccagagattgcggggcgcattcacattcacccagaacacaatgggtggcgtggccgtttcctcctcgccttccgccgccacgccctccgccggggccgcgccttccacgggtgtcccgtcgggattcgccgggggctgcgcctgggccgcttccttgcgcttcttgcggttcagcggctctccgttgcgcaccagcaccacgtcaccgggccgctccagcgcctgcaggtccttgcgcttggcttccggcagctcgatggtggcctcggggatggtgacgttgcgcaggttgacgagtcgctgggacagcgtgccctccaccttcgcgcgcaggctcaccagcgccatgagctggtcgtcgacgatgatggggaagttgcgcatcaccagcggcgggtcggacgtcccggggctggacagctcgtactcattccgggtgttgagcaccgcggtcagcggcgagttgaggttgagtgagccgttgccggccttcgccgacagcgtcgtgacggcgatggattcgcggctggccttcagggcgagctggatgtcgcggtactcgcccaggcccatcagccccagcttgccgtccttccactccaggctgccgttgatgcggggcgcgctcaacgtgccggcgacgctggcgtccgcctggagcacgccgccgatgctgcgcagcatctccaccgtgccggacaggaaggccgggttgaagttgcgcgccttgagcgcgacctccaccggagcgttgtctgtctggaggccccggttgagcgcgggcagtgacacgtccaggcccaggcctccgttcaccagcatggtgccgccgcccggctcggtgagcagcaggtcgaagcgggagcgggtgtccttgtacgtgtagttcaggcgcacctggcccagcccggtgttgcccacgcccaggtcctgcacgccggcggtgagctccatctgcggcgtgtcgagcgtgccccgcgcgcccagctccatggccagcacgccctggatgccctggggccggccgccctgcggtggcggcgcgccctccgccacgggcgacgccggggtggccacgccgggaatctccttcagcggcaccgggcccacgcggccggtgatgtcgaagggaatgtggccgtagacctcgcggtcctggagcgcgcccagcggggccgccagcgtggccgtcagttgcgccagcggtccgtcctggcgctgcgcgttcagcgtgagcttcacgtccttgtcgccgcccacgacgctgagctgcccgttcatgggcggcagcccgttcatcgtcaccgcgttggcctgcacgcgcagcgtcgcgtggggcaccaggaccgagccctcgaagtccaggtgcgccgtcaccgtgccgtccggctgctgcacgccgctcatgcccttgagcagggtgaggggcaactgcgtcacgcgggcctcaacgcccagcgtcgtcgccaggagctcatcgggcgtgggcggcttcgccatcagcccgcccaccgtgaagggcgtccgcagggccaggtacgtctgcgagcccaggccctccacgtccaggcgcgcatccagcgtctggtcctcgcggtcggacgcggcgcgcaggtggaaggccagcggctcgggcagcgagaagcccggcggcggcgactggtagcgcacgtcctgcccgcggagggtgaagtccagcaggggctcacgcgcggggccttccacggtcagcgcgccagccagccggccgctggcgctctggggctggcccgcgagcttcatggcgccggcgatgtccaggtcctccagattcaggcgcacggacatcacatcgcgccggcgcttgagcacgccctgcaccggcacgtcgaactcggcggcgagccgcgccacgggcaggctggccgccagcgtcccggtggcgcggtccttcacgtagcgcgccttcagcttcgcctgaagcccctcgtagccctgcgcgctgccgtcttccagccgcaggtcggtctccgcgtcggggcgcgccatcgtcccactgacggcggcgtggcccgtcagcctgccgcccaggcccagcgactccgggacgaaggccctgggcagccgcgacaaatcgaacgcgtccaattccacgcgcgcattgacgcgctggccgcgcatcgtgccctgcagcgacagcgtctgcccctccgacgcgagccgcagcgggggctccacctcgacgttgcctccgccgaagcccacgtgcgtgggcgcctggagcgtccaggtggcctccggccagaacagcgccaactgccggatggccagcccctggcgattgccgtccaccaggccactgagcgtgagccccagctccgcgtctcccgccacgcgcacgctggcctccagcgcacgctcctgcgtggccagcgtgacggcgacgtcgcgcaagtctcgcccgcccgccttcagccgggacaccaccagcgtggcgttggacgtgagggggtggctgacgtccggcatctccagcttcagggatacgtcctgcgccgccacatcgccgtaccgcagcgccgcgaagccgccgtcgaccttcacggcgggcgtgcgcagcgggcccttcacggagaagtccaacgtgccgttgcccgccatgggggccaccacgcccggcatcagcttggacagcatctgcgagagcagggcgaggttgccggcggtgaggccgccttgcaggttcaccgactccgcggtgccgtctcccttggcctgcagggccacgcccggtgcgagcatccgcagccgcatcagcgaataccggccctccttcgcgcgggcctccagctccaccggacccagcggctggcccaggtattgggatggggacacggtgagcttcacctcgccttccatcgactccaggctcgtgcctccgcccttcgcgtccaggtccgcggcgatgcgcgtcttggggccctgcgccatcagctccgacaggtccacgtcgcgcgccttcacggacaggccgtcggtgcgcatccgctccaaatccatgccacccttcacggacaaggaggcgctggcggccttcgcggtgacgtccacccgcgccgcgtcgccgtccagtccggcggagccctccgcggacaccggcacccgcagcggccaggtgggcacgaaggcccgcagcaggtcgggcggcgcggacaggcgccgcagctccagtcctgcttggagccggccctccggcgcgcccggcggcgtctctggagggagcttcgcgcggccgctggcgtccagcaccagccccgcggcctccaggtcgacatcgccttcgaaggcgccctcttcgccgcgggccttcagcgccagccgcacgggcccgggcacgggacgggcgaggctcgcggtggcgtccaggttcgcgcccacgccctgcgtcgcggcggcgtagcgggccgagccccgggcatccaggtcctccagccgcacccgccgctcaccgccttcgggcaacgcctggcggaagtcgacatagccgtcctcgagcacgagctcgtgcaagtccagcgtcagcgagccgcggccctgggagggctcctcggggctgggcgtgcggggctccaacgcgcgcgtcaggttcagtccgcgctcgtcctgggccagatacaggcgcggacgctcgatgcgcgcggaggggaggttcacgtgctggcgcaccagccccgccaggccgggcgcgcacgttcacccgggcgatgtccgccaccagctcgccttcgggggcatacagcttcacgtcctcgaggatgacgccgctcagggacaggtccaggcgccccagctccagccggccggagagctgctcattggccagcgcgagtcccttctggacgagccaggcctctccgcgcgacgtcgtggcgaagacgagcacgcccgcgacgacgagcacgatgaggcccacgaggcccagcaggccccacagcacgcggcggccccagcgcgcgggccggcggggtgggggaggcgcggcgctcggggcggattccgtcaaaacgcctctccaatcgacaggtgcagcgcgcacagcccgtccggagcgcccgcgaacgcgccgctgggcgtcgtcggacccgtgggcctccaccggcttccgatgccaaagcagcctccggcttcgggatagatgtatcccggggtggaaacgggcaatccctcgccaatgttcaaccgccgggcgatgtccagccggatgggcccgacgaccgtcagataccgcaggcccatgcccacggcgtggtagtgctgggggccgaagagcttgggccggttcgcgtgggagaagtcctcgatgcccaccaggcccgtgtcatagaaggccgccaccatcaggctctccgtgaactggtagcgcatctccaccgaggtctcgaagaggctgttgccacccacgggcacggtgtcccattcctcgtcctggacgacatccgggttgccgtcgccgtccacgtccgccgtgcgctgcagggcggccaggggagacaggcgctggccgttgaagccgcgcatgaacgtgccaccgcccgagaagaagcgggtgacgatggagctctggctgccgcccgcggggttcagcgtgcccgcgcgcaccttcgccgccaggatgaaccgcttgtcctcgccgaacgaacggtagacgcgcaggtcgggcagcaggcggacgtagttgaagtctcccatgaggggcgtgcctccgcccttctggacggagaaggagatgtagtagccgtcgcgtggctcgatgacgtcatcgcgccggtcccaggtgaaggccagctccaggaagctgagcgccacgttgcactgcgcctggccctcgccgcagcccaggacgatgggcggcacgcgggagtcggcgctgacgcggccgctgagccggtacacctggaggttgtacgacgggaagatggagaagtcggggtgcggctgccagatgacacccgtctggagcctgccgccccagaagtcataggcctgctccaggcccttctccacgctgagcgagttctgcgcccgcaagtccctgaagaggaagcggggctgctcgtactcggcggtgacgtcgaagacaggaccgtccttgttgaagttgaggacgttggggatgaaggcgtagcccagccggccgcggacggtgaagcggcgcaggccgccgccgaagttgcggtgggtccattcgcccaccgcgcggacctcctgccgggccgcgtccacgcccagaccgccgcccagccgcacggagcggaagggcgcctcgcgcacgtccaccaccaccggcaccgtgccggattcgcggtccggcgcgccgcggttcaccttcaccgcgccgaacacgcccatgcggaacacgcgcgcctgcgcgttggccagcgccgtctcgctgtaccagtcccccttcttcagcgcgcccgtcacctgttcgatgattcggcgcggaggcacctggggattggcgtccgtggcgacgaaggtgttgccgaagcggtagcggatgccgggccgggtgcgcaattccaccaccgcctgccttgtgtccacgtccacccggacctcgccgtcgacttcggcctcggcgtaggccagctcgcgcagccgctcctggacgcgggccttcgcttcctcccaggactcttccttgaagacgtcgccttcgtgcaggggcagtccgtccagcacgtacttgcggtgctcctcgcgcacgtcctccggcagggtgtccaggcccgtcacctggatttcgctgatgcgggtgggttcgccctcctgcacgctgatgtcgatggcgaccttgtcgtcaccggccggcttcacctcggcgtgggtgaccttcgcctggtagaagccctgggcctggtagtaccgctcgatgcggcgcaggtccgcctgccacgcattggcgtcgaagtagctggggccgccaaagggccagaagccccagaagggcgtggcggtggtgaggatgcggtccttgatggcgccttcgctcacctggtgcgttccctggatttccaggtcggtgaccttggggcccgaggggggcggcgcattcgtggtggcgcaggccgcggtgagcagcagcgcgagcggagtggcaaggcggaggtatctgagcaggtcggcggccacggggtgtttcatagctggaaggctcgcggccccaacacttcttccgtccaggatggcagtgctttgtcgcataccgggacgtcggggcaaaccccagtgtccggtctcgcggaatggcgcctcgcgaagacgtgcaagccgctcccgcctggcccaagatggggggccatggcccagtcccggcgaatcagaagcctggtgttctccgtgctcgcggtatgcgtgtcctcgtgtggtgtctccgaggacgaggcggtgcgccccaaggagggcgagagcttgtcggacgcgccctactgcggctcgttcggctgcgtgaacccgtaccagttctgcgcggaaatcttcctggagttcggccgctcgccgcccatctgcgtcttcgacgacatctgcgagcggctggagtgcgccaactccaaccgcacctgcgccctgttcgacggcttcccggcccaggtgaagtgcatcaaaccgtgaggccgtcgcggccgcgcgtgtccgctcacttgggcccctcgggcggacggtgtctcagcgccgcgcggacgcggtgagccaggccagccgctcggcggcctcgcgcgtgcgcgaatcggtgagcaggtcactcacgttctgttcgatgcggtaggcccagttcgaatcgctcatggagccgggcaggttgatgcggtcccgggtgccgagcacgtcctgccagggcaacacgcacaggtcgctgttggcgttgagcgccgaggccagcatggcccggtgcacgtccggggtgaactcgcgggtgatggccacgccgttgagctccggccatgagcgcgccgccgcctgccgctcgtggtcgcccgcgccctcccaccactcggccatcgtgtccgtgtcatgcgtgccggtggtgaccagggacaccgccgggaactggcgcgggtcgcggtagtggttgtcgtcgcgctcccagcgcatcacccggtagccgggcagcttgagctccgcgaggatgtggcgcacgaagtgtggaatcacgcccaggtcctcggcgacgatgccggcgccctcggacagcaggcggaaggtcttctcgcccaggcggcggtggctctcctcgtccggcgggatgaagcgcccggtgggcgtctgcgcgtcgcgaatccactgccggaagtaccccaccgcgtggtccacgcggcgcaagtcgtagtagctggccgccttcttcgcgcgcgtcttcagccacgcgaagtcgtccttctccatggccgccaggtcgaagtagggcaggccccagtcctggcccgtggcggagaagtcatccggaggcacgcccaggcgggcgtcgcgccgcaggatgtccgggtgcgcccacacgtccgcgctgtcctgaccgatgatgaacggctcgtcgccgcacaggaggacgtccttggcgcgggcctgcgtccgcacctcgttccactgctgctcggccacccactggagccaggcgtggtagcgcacgcggcgctccagctcccgggacttctgggccagggcctcgggttgacgggtgcgcagcggctccggccactcccaccacgggcggcgctcttcctgctcgctgatggcggtgaagagcgcgtagctctccagccattcgccctgggcgtcgcgccactggcggaaggtcttcgcccgctcggactggggcgcccagtgctgcgcttcgaagacgtcgaaggcgcgcgcgaaggcggtgtccttgagggggaagaccaggtcatagcgcacgcgcggcgcagagcgcgcctcggccaactgggcgcgctgcgcgtcggacagggccgcctcgccgccggccgcggtgaactccggcagccgctgcaggtcgatgaagaggggattgaggccgaaggccgaacgcgtcgcgtaggggctcgagtcgcccggcgcggtgggcagcagcggcagcaccatcagcatccgctggcgggcggacttcatccaggtgaacagtccctccagggcaccgaagtcaccgatgccaaagtcggtctgtgagcggagggagaaaagcgggagcaaaagaccggagagccggccgggggtggacatggtgcgatgcaatctgccccagccccgcgccggtgggaactgtggacgctctccgagtgtgtctgggttcttcgctttccggacggaagggccgttaacatccaggtgtgaactggttgccggagtctttctacgcccgtcccgcgctggtggtcgcgcgggagctgctcggcgccttgctggtggtggaggagggcgggcagcgccgggtgggccgcatcgtggagacggaggcctatatcggcgagcacgacctggcgtgccacgcggccaagggactcacccctcgcaccgaggtcatgttcggaccggccggcgtggcgtacgtctatctgatttatggcatgcaccactgcttcaacgtggtgacggatgccacgggggcgggcgcggcggtgctggtgcgggcggtggagccggtggagggcctgcccccggggacgcgcacggacgggccgggccgcctgtgcaaggcgctgggcctcacccgagcgcacaaccggcggggcctgtgcacgcccgtgctgcacttgcgacccgggacgcctgttcccgagtcagccgtgtcccgggggcctcggattggcgtggattacgctgggacctgggccgccgaacccttccggttgtgggtccgggacagtcaacacgtcagcaaggggccgccaccggggcgccgcaagcccgcttgacggcgggctttctggctggttgggtgcgccccgccatgtccgacgaggccgtcatgggcgaggaccgtcagctcctcgctcgcgcacaggatggggatgtttccgccttcgaggccctggtggatgcccaccgggacaaggtgtatggcctggcgctccggatgacccgttcggaagccgacgcggccgaaatcacccaggacaccttcctgtccgcctaccaacacctgaaggatttccggggggatgcggccttcggttcctgggtgcaccgcatcgccgccaaccatgcgctcatgcgcctgcgccaccgccgcgtggcccaggcagccgagcaggagctccagggcccggagttcaccgagcggggctccctggcggattatccccagacggattggagccgggacgccgaggagaaggccctggacgccgagctgggctccgccatccagcaagcctcggaccgcctgcccgaggggtaccgggaggtcttcctcttgaaagacgtggagggcctcagttacgaacagattgcagaggcgacgggggactccatccccgccatcaagagccggttgcaccgggcacggctcgcgctccgtgaagccatcgacgctttctacaaccgggatagccgcgagttgtgaaacgcgacgaagcgctcggcatcatcgagaggaacgagggcgcgccgcagccagccgaggttcggatgtacaactgcaaagattccatcaacctcctgctgcaattcctcgacggagagatgtctcccgaggacacacagcacttacgtgagcacctgcgcggttgcagtccctgtgtggacttcctgcgcacctaccgggccacacccgggctgtgcaagaaggcgctggtggcgaagatgccgaaggaagtctccgagaagctcaccgagttccttcgctccaaaatcaagtccgcctcgtgaacctgaagtccttgtcgttgcaggagttggaggccgcgctcgcgccgctctccccgtcgcccgccgccgtccgcaaggtgttcgcggccgtcttcgcccacggtgcgcagtccgtggaggacgtcgcttcggcccgtcaggtgccgcgccgcgtgggagaccacctgcgtgcccacgcggagatgccgaagctggcaatcgtcgagcgccgccgcgcggacgacggcttcgtgaagtacctcttcgactcgccgctgggcggacgtatcgaagcggtccgcatccccatcttcgatgagaagtacgtcatctgcgtctccagccaggtgggctgtgcgctggcgtgcgacttctgcatgacggggaagttgggcttcaaaaggaacctccagacctgggagatattggaccaggtgctccaggtccgggaggaagcggaccggccggtgcgcggcgtcgtcttcatggggatgggggagccgctgctcaactacaaggagacgctgcgggccgcggacatcctgcggcaccctgcggggttctccatcgcgggcgaggcgattaccttctccacggcgggccatgtgccggcgatccgccgctacgtgcgcgaagggcatccgtaccggctggccttctccgtgacgagcgccatcgcggagaagcgggcgaaggtgctgccgattgagaagacgcacccgctgccggagctcatcgccgccatccgcgagtacagcgaggtgcggcgcgagcgggcgatgatcgcctatgtcgccatcagcggcttcaacatggggcgcgaggacgccgaggcgctgaaggtcgccttcgagggcatccgcatcaaggtggacctcatcgacgtgacggaccccaccgggaagtacctgccgcccacgcccgaggagctgagcgccttccgcgaccacctccagattctcaagtcgccggtggcgcgtcggtactccggtggcaaggagattggcgcggcgtgtggcacgctggcggccacgcagtatggcggcacggtgatgccgcggcccgccgaggcgcctccgtccacgacgccatgacgcgggccccgcgtgggccccggggatgttcaccggtggcggggccagggcggaagcacctttcgtgttggcggcttccgacttaaatccgacggagcacgactcgccggaggtcgcacgctcggatggtggaatacatcgaccagctcatctcggccctggggcccctgggcctgctcgtgctggggctggcggcgatgctggagtacgtcgtgccgccctttcccggagacaccatcaccctgctggggggcgtgtacgcggtgcgtggttcgcagccgtgggtgctcgtcttcctggtggtgacggtgggcagtgtggtgggcgcggccatcaactacgcggtggggcactggctggcgaagcgcttcgacgcccaccccgaacgcagcttcttgggcatcacccatgcgcggctggagcaggttcaagcgcgcatgcgcgtgaatgggccgtggctgctgctggtgaatcggttcctgccgggcatccggggcctcatctttgtcgccgcgggcgcctctcgcatgccgcgcttcaacgcgctggcgctgggcgcggtgtccgccatggcacataccgggctggtgctggggctgggcgcggcggtgggcggcaatctggagcggctgacggcgctcgtcacccggtaccagtacgcggtggtgggactggtcgtcattggcgccattggcgtgggcatccggatgttggcccggcgccgtgcccccgcgccggggccttgagttcgtctcaggacggcgccttggcgttgcattgcaggggcgcgcggccccgcgcttgagtcgcggacatgcatccgcaggcgcgttcctggagtccattgtgggtggcgctcatgctcgccgtgggcgggtgccagtcgggggactccgggatgggaggctcgcgtcaggggttccggccccgggatgcggtggtggacttcggccgtgtgctggaggggacgcaggcgcgccgcgcggtgacggtgctggccacgggccgagtgggtctgacggtggcggcatccgtggaggcgcccttcgccgtggtgacgtccgaggtgagcatatctggcggcggcgcgaccgaagtggaggtcgtcttcaccgcggggcatgggccgtcggagggaatgctgctgttgtcaggcgcggggctgacggagtccgttcgcctcacgggcctgggcatccggcccacgccgtgtccggagcgcccctgcttcgactcccgcttcgacgtggcatccgggacgtgcgtggaggcgccgctggaggaaggcgccgcgtgcacgccggagagccgctgtcaggtggatggccgctgccaggcgagcgtctgcgtgggccacccgaggacgtgtgatgacaacaatccgtgcacggtggatgcctgttcgcccacgcaggggtgtgtgacgtcgcgggtggcgtgccccgcgccgcagaacccctgcaaggtgggggtgtgcgaccgggacgagggctgcacggcggtggacgccgacgacttcagtccttgcggcccggcggactgtcagaaggcgcgtctgtgcttcagcggcgcatgccgggaggtgacgccacccgagggcttcgtctgcgcgcctgctaccgcctgccagggagaagggacgtgccagggcggcgtgtgtcagcggccggaccctgtcgagctcgcgccggagctcagcctggagctggaaggcgtgccggtggaggcggacggtgggacggtattgctcgtctcggaagacgctctctacacctccgtgtgtggcggggacgcgggctgccagttggtcgcgtacacgcgctctgggctgctgcggtacgcgtcttcgtacccggatgggggtgcgcggacgctgctgtccgcgtcggatgcgggcgtggtggtccatgcgccagaggggctcgaggcctatgcgccgcgcggctccggtgcgcgcctgtggcaggcctcgtgggcgtcgctaggggcgggcgagggcctgccgctgggaggcgccgccgcgagccacatcgcactcacgcacgaggaggacatcctcgcgtacgtcgcgtggcgagccgtgccggatgccggcggcgtggatgatggcggcaccgcgcctgaatccgcgaggctcgtctggctgtcgggtcgcgaggacgctggcacgttgctgggcgcgtcacaggtcgaagcctggcgaggagaggcgcggctggggctggacgtgctggggacggcctatctctacacggtggatgggcgactggcgcgggtggaggtgtcgccaggagtggcggatggcggtggggggacggagttgaagctgagcgcgctgctggatggcggtgttccggatggaggtgcgtcactggccatcgcgggtgggcggctgctggtgggagcgcgagcctttgtgccggaggatggcggcgtgcccgtcatgctctccgaagggggcggtggagccagcgtgcgggtgcccatcgcggagccggcgctcctgtcctcgggtggccagcctggccagctcttcgcgcgggcatgtgcgcgcacggacggcgttccctgcacggcgcgggaggagcgtgtcgtgcttcgcgccgtggacccggagtccggccacgtggtgtgggaggtggatgcgcttccggatgaggtggcaccgggcacggtgtacgaagccgcgttgctccaagggggcgcggtggcggtgctcgctgacgccgaactgccggagggccaccaggcctggatacagttctttgctcaaggtgcccgagtcggcagttgcccgcttcccagtcgcccgcgggtggcgggtgccgcgttcctggggcagcacctgtatgtcgtcttgaaccgcgatggcgtgtggcgactcgagtcctacggcctggggcgggacttcatgacggaagaccgggggtggccgcagcgccatggtggacccttgcggatgaaaaacgaatctccgtgatgccggcgccgcgcgccacccgtgccttgggctgtctcaggtggcggagatcgggtcgacccagaggtcttcgaagcgcacctggggcggcgtctggtgcacccgcaggctttggaccgcgggggtcgcggccgcgtgggcgcggtcgtggtacagcgggatgagggggcagtcctcctggaagagctgctccgcgcgcagatagagctgacggcgcagctccgggtcgatggagacgcgggcctcggcggtgaggcggtccagctccgggttccggtagcccatgggcaccaccgtctgggcgttggacgccaggaggaagtacaggaaggtgtccgggtccggagtagtcggccagccagcggttgcggaaggcggggagacggccctcggtcccctgggccgtgtattcctcgcgcgccatctgagag

SEQ ID NO: 1117 - DNA, 13855 bp, Myxococcus xanthus
ctctccccgcccctgcgacgccgccgtgatcctcttgcctggggccgtgcagggtcgccatcgccatggcctgcctggggtccacggaggccctgcgccagttcgtgagcggcttcgccgtgcccttcgagccctccctgctccccggccgcgtggagcgcttcctcgcgctcctccgggacggcgacctgctgcgcgcctggggcctgatgagcgcgaagctggccgccctcaacctgctgcccctgcccgcgctcgcaggaggcaccttcctcctcctgccgtggcgcaagggataccccgtctgggccggcctgctcggaatcctcggactcctggccgccgtgccgtgggtcctctacgtgctctacgtggtcatcaaggcgctcgtctgacgcctactcctggcgctgcaacgccaaccgcgcccccagtgcgacgaacacgccacccgtgacgcgcttctgccacgccgccacgcgcggattgcgccgcatccagcccccaaaggcacccgcgaacgcagccagcagcaccagccacgacgtgcccgtgacggagaacatcaacccgagccccaggaactggagccctgtcgagcccgcggacgcgtccacgaactgcggcaggaaggccaggaagaacacggccaccttcgggttcagcacgttggtgacgacgccgtcgcggaagatgcgccacaggccagcgggtggcagcgcctgcaccgcctcggccacggtgtccttgctgcgcagcatctgcacgcccatccacacgaggtaggccgccccaccccacttcaccacggagaaggccaacgccgatgtcgccagcaacgtcgacagcccgaacgccgccgcggcgatgtggaacaggcatccgacgaagatgcccagcgcggagacgatgcccgccttacgcccctgccccatgctccgggccagcacgaacatcgtgtccggcccgggcgtcaggatgagcgcgagcaccgccaggaagtaggccgtgaggcgcgtcgggtcgaagaacatggcggctccagtgggggcacgactggccccgattgccagtcaccgtacctgccggagaccgccgagcaaagcgacccgcagcatcagacgggcgcgcgcgtgcccgcccgatcctccgcgattcgcgcctcacgctcgcgccgcagcgcccgctcggcctcctccgcgctgatgggcacggcaggccggaacaccgtgcgatacaccgccgccgcggtggcgcctcccaggagcggcgccacgatgaacagccagagctgccccatgggcacgctccccgcgaacaccgccggccccaggctgcgcgccggattcacagacgtgttcgtcaccggaatccccaccaagtggatgagcgccagcaccaggccaatggccagccccgcgaagcccaccggggcgcgcgcatccgtcgcgcccagcaccgtgagcacgagcaagaaggtgagcgccacctccgtgaggaaggccgctcccatgttgaagccgtcaggtgaagcggcgccgtacccgttggtcgcgagtccctcggtcaccgccgagtacccaccgggcatgcccttggcaatcagcagcaccacgcccgcgccgaggatggcccccgcgcactgcgccaccacgtagccgaccgcgtccttgccctccatcttccccgacagcaagaggcccagcgtcaccgccggattcacatggcagcccgagatgggcccaatcacgtacaccatggccagcagtgacaggccaaaggcgagcgcgacaccttggaagccgatgtggtcgcccgccagcacggccgccccgacgccacccaacaccaggacgaacgtcccgatgaactccgcaacgtacttccggacggcgtcgttgttgcgggggttgcccgcccgagccagcgcggccctgtccctggatgcatccatggtcagcctcgattcgcgcggccagacgccgcgcttcagcgaattcttccaggcacgctgcgcatggaccggaagacgacaacgcgaagcaccgcgtcacggccgctgagcagcccccgtgagcggcccatggccctccgtctcccctgacatacacagacatgccctctttgaccttcaggcataggaaagacagcctggataggccgtctccacctggaaaggacttgtcgaaggctgcaacgctgcttctcgcggtgacgacgtgctccatccagtgcggcggcgtggagcgccgctgcccgttccgagcatcacctgaagaccggtgcggcgccgcgcacgagggcggcgccagcacccggccgggactacttgttcttcatcaccccgatgaaggggatgttccggtacacctcgccaaagtcgagcccgtagcccacgacgaagaggtcatcgatgacgaagcccttgtagtcgatgtccaccttcgtccgggcgcgcgagggcttctccagcagcgtgcacaccttcagcgacgcggggtgccgagcgcgcaggttctccagcaggaactgcatggtgagcccggtgtcgatgatgtcctcgatgatgagcaggtgcttgccagccatcggcttgctgacgtcggtggtgatgcgcacctcgcccgtggactccgtgccgccctggtagctggagacgcccaggaactccaacttcaccggcaggtcgatgtacttcgccaggtcgatggcgaaaaacgccgagcccttcaacacgcagatgagcgtcaggtccttgcccgcgtagtcgcgcgtaatctccgccgcgagctcgcgcacgcgcgcctgcaacttgtcctcggaaatcaggacaccgacttcctgctcgtagaacgccaaggattcctccgctacacgtacgcgttgttcatgatctccccgaagccgccgcctccggggacgatgtactgccggtcatccaggccccgctccttctcccagagcgcgcccggctcggtgccgaacacctccggcggggacaggccccggtccaaccggagcgcgtagatgatgacgtccggatggtccgtggtcatcttccgcaggtactccggcgtgacgatgaggttcagggtgatgatgcgccggggcgtcccgggcaccttgttcttgtagagcgaaatcgccgtggacaggctgccccccgtggcccccatggggtcggggaacaggacgaaggcgtcgtccacgtcgccgccaatcttcgcgccgccaatctccgagcccaccaccgcctccgcggcatcaatcatgcggctcatgatgatgtggtcctggcgaaccaccgtcgggtccagcgtggcgttcatcaggtcgtacgtcacctgcgacggcagcgtgcctgcccgggcgatgttcaccgtcaccacccgcacctgcgggtcgatgacctcgccctggtagagcccctgaggggtggagtcgatcatccgcgtgggcaggctgacgttcttccgcgggaactccgcgttgagcaccgtcttcaccaggtcgacgtacagcgtctccaccaggcggttgatctgcggctggatgacgcccttcgaacacagcgtggccagctgggtcaggagaaagggatttcccaccaggtggacgtgaggcccatagtggtggggcatctcgttcagcttgaagggaacgttggagtacagggtgtcgcgcatccgttcagctcccgctcagtcgaacagttccaacgtctgcggcggcgtgccctccgccggttccgccacgtgacacttgcggcagcgcggttcgtacgcgcccgccgcgcccaccaccacccgctcaccactggacacgatgcgctgggagcggttggccggattcccgcacaccacgcagatggccagctccttcgtcacgtactccgacaccgccatcaactggggcatcggttcgaaggggcgcccctggtagtcctggtccaggcccgcgcagatgacgcgcaggcccttgttggccagcgcctccaccacggcgaccacttctgaaccgaagaactgcacctcgtcgatgcccaccacctgggtgtcgggcgcgagcctgtaaaaaatctcttcagcccgctcgatggcggtggacagcaccttgtgctgcgagtggctcaccaccgcggattcgtcgtagcggttgtcgatgcgcggcttgaagacctgcaccttctgcttgccgtagacggcgcgttggacgcggcggatcagctcctccgtcttgccggagaacatcgaaccgcagatgacctctatccacccgatatctttggggaattggtgcaaggaacgctcacgggccgggggcggaaagggcgcggatagtctgccacgaccccaggggagtcaacttcccgccacgcccgtcccatagccgaatcgtccccggatgtcgcccgcttcctcgcctgcccgtcacccggccccgcgggcgttggcaaggctcttgaagagcattggctacggactggcgaagggggatgggcgtggcggcgacgatcggacagatgcggggtggggcgtggggcaacagggcttctttctacctgtcaccggcgtccgtcgcgttgttgatgctgaacctgctggacgggctgttcaccctcttcttcctccaactgggcgtggccgaagagctcaaccccatcatgcgggaggcctatgagcagtccccgctcttcttcatgttctccaagctggtcatcgtgaacgcgggcctgtggctgctgtgcatccaccggcacctcaaggccagccgcatcgccatccggctgggcgccgccgtgtatgccgtcatcgtggtctaccacctcgcgttcctgacccacctggtcatgcactggccgcaaatgctgacctagcctccactcgcagcggccgactgtgggggcattgaacagtggcgcaaatctctctcgcgcccgcgcttgcatttggcacccggtatgtcccaggcttcccttcagctccgacctttcgggttcggggggggaccatgaacatcaccgacgtccgggtgtttccggtcgaagaggacaagctcaaggcgtacgtcaccatcaccttggaccactgcttcgtcattcgcgatttgaaggtcattcacggctcgaccgggctcttcatcgcgatgccagccaagaagcggaaggatgggacgtacaaggacattgcccacccgctcaacgcggatacgcggagtcaaatggaacgcgtcatcctgatggagtacgagcgacacctccatcaggcgcaagccgggatgctcgtcgcagcgccagcggacctcgactaacgacttctttccttctgtccgcgtccaggttagtcagcggccccaccatgcagccgcgtgacttcaaggtgttcgccgggaactcgaatcccggcctggcgcatcgcatctgcgagtacctcaagcgccctctgggcaaggcggaggtcggtcggttctcggacggggagattcacgtcgagatcggcgagaacgtccgcggccacgacgtcttcatcctccagtcgacctgcccgcctgcgaacgatcacctgatggagttgctcatcatgtgtgacgcgctcaagcgggcgagcgccggctccatcaccgccgtcattccgtactacgggtacgcccgtcaggaccggaaggtggcgccgcgtacgcccatcaccgcgaagctcatcgcggacctgctggagtccgcgggcgccgggcgcgtggtgtccatggacatgcacgcggggcagatccagggcttcttcaacatcccctcggaccacctctacggctcgccggtgttcctggaagacctgcgcaagcgcttcccggagtcgcaggagctggtcatcgtctcgccggacgccggcggtgtggagcgcgcccgcgcgtactccaagcggctgaacacgggcctggccatcatcgacaagcgccgtccccgccccaacgcgtcggaggtgatgaacctcatcggcgacgtgagcggcaaggacgcggtgctggtggacgacatggtggacaccgccggcacgctcgcccaggcggccgcggcgctgaaggccaagggcgcacggcgcgtggtggcatacgcggtccaccccatcctctccggcccggccatccagcgcatccaggactcggtgctggaagaggtcgtcttcacggacaccgtgccgctgtccccggcggcgcaggcctgctcgaagatccgcctgctcaccaccgagcgcctcttcggcgaggccattgcccgcatccaccgcgcagactcgctcagctcgctgttcgtctgagccggcgcgcgcttgcccgccgggcggcttgactccaggccctccggctggcatgtgcacgaccctccatcggaggccttcacaggcgccgtcttcggggcccgccactggggcgggatgccgaggggcgccagggccgccggtggcacccgcagtcccatccgtgaggattccatgtccgtcaatacgagcaccctcgaggccaagccgcgtgagggttccggcaagggcgttgcccgccgcctgcgcgcccagggtctgattcccgccgtcgtctacggaaagcacctggagaagccggtgcacatctccgtgaaccccaaggcggtccgccaggccatcaacaccccgcacaagttcaacaccctgatccagatcaaggtggagggcggtgaccgccaggtgctcctgaaggactaccagatggaccccgtcacccgcgccatcctgcacgccgacttcctggacgtgcgccccaccgacaaggtgaaggtcaacgtgccgctggtgctctccggccgcgcgcagggtgtggcggacggcggtctgctgacccaggcccgccgtgagatcgaggtctggtcgcttccgggcgccatccccgagaagatcgaagtggacgtgacgccgatgaagatcgctgaggtgctccacatcaacgatctgaagctgcccgagggcgtgtcggtgaagacgaacgtcaactacaccctggccgtcatcagcgcgccggaggccgtggaggcgggtccgggcgcggcggctgccgcggcggctccggccaaggacgcgaaggcggctccggccaaggacgcgaaggccccggcgaagaagtagtctgtcgccttcagcggtccttctggagcggggccggcccggtaaggggctggccccgtttctcgtttcgggagccacgtcatgaagctcatcgtcggactgggcaatccggggcgcgagtacgagcggcaccggcacaacatcgggttcatggtggtggaggcgctgctgtcgcgcgcgcgggcgcagctcaaccaggagaagttcgcggccaaggtcggccagggcaccctggcgggcgagcgcgtcctcttcgtggagccccagacgttcatgaacctgtcgggccgctccgtcgcggaggcggcgcgcttcttcaaggtgccggtcgcggacgtgctcgtcattcatgacgagttggacctgcccctgggccgactgcagctcaaggccggcggcggcagcggcggccacaacggcctcaagagcatcgtctccagcctgggcgacgagagcttcatccgcctgcgcttcggcatcggcaagccggagggccccaatgcccgcgagcgcgtgtccgactacgtcctgtccaacttcgacgacggcgagcgccgggagatggatgcgctcatcgaccgggccatggacatgacggagctgtggatccgcgaagggctgtcagtggccatgaaccggttcaaccggaaggcctgaggcaggcccccaggctcccccacgggctggcggacggggcgcccggccgcttgacttggcggggggccccccatagaaggccccttccctcatcggggatgacccggtgggatgttcttttccagcttcccgtgttggtacacgggacgtagcgcgagggtgacgggcgcgcggtttcccgtccccggcggtgggcctctcaggtccgctggccgtttccccgctctctggattcaccggagggcactcgaccccaaggggagagaaaacaatggctgagacgcaggccgcgacgcggcttcgtgagtacgagaccatcttcctggtcaagccggacctgacggacgacaacgtggacaagctcaaggagcgcgtccgcggcatcgtttcccgtgagggtggcaaggtcatccgcttcacggtgtggggcaagaagaagaccctgttccccgtggcgaagcagccccgcgccatctacgtgcacacccacttcctgggcggcgcgaagctggtggcggaaatcgagcgcaacctccgcaacctggacgaggtcacccgctacatctccgtgaagctcgcggacgaggtggaccccgagacgcgtccggtgctcgaggacgtgaagctggccggcgacgtggaggagacccgtccgggcgctcccgcggagcgcgagggtggcttccgctccgagggttccgaggagcagggcggcgactccgaggaggagtcgtccgaggaggcctgagcgccttctgggtcaattccctagagaccattccaggatacgagaacgctcatgagcaacggaacggatagcaagacggcctctgccccccccgcccgcagcggtggtggcttcggcggtggtggttcgcgcggtggagaccggggtgaccggggtgaccgcggtggtgatcgcggcgaccgcggcggcgggctgggcggcgacgacgacaagcgcggtggtggccgcggcttcggccgcaagaaggtctgccgcttctgcgcggagaagaacgcgtcggtggacttcaaggaccaggcgacgctgaagtacttcgtgaccgagcgcggcaagatcatcccccgccgcatctccggcaactgcgccaagcaccagcgcgaggtggcggtggccatcaagcgcgcccgtggcatcgcgctcctcccctacaacgcggtggtcggctagtccgccggtccgcacaggagactgaacatgaaggtcattctgcgtgaggacatcgagaacctgggcaagtccggggaactcgtcaccgtgaaggacggcttcggccgcaacttcctcctgccccgcaagaaggcggttctggccagcgagcagaacctccgccagttggagcacgagaaggcggtcatcgccgctcggaacgccaagctgaagggcgcggccgaggagcaggcgaagaagattggcgccatcaaggtcagcatcaagcgccgcgtgggcgatcaggacaagctgttcggctccgtcacggcgctggacatcgcggaggcggttgccgccgagggtcagagcatcgaccgccgccacatccacctgcccgagcccatcaaggccctgggcaactacgaggtggagctgcgcctgcaccgcgacgtcatcgcgaagatcaagctcgaggtcctgccggagtaatcctccgcgggcttcactgaagtgagagagggccgtccggggcaatccgggcggccttttcctttgcgccccaccccgcccgtccggctcacacccccgtgaaaccggctggcgacagatgcgtggagcgctcggggcgcggtgcgtatcccggagcggaaggaggctcgcgcatgagcaccaccgcccccccgcacctcaccgatgagcaccgcccggacctggactggctccgcgtggtggccatcctcctgctgcacctgttccacaccgggatgatgttcaacacctgggactggcacgtgaagagcgcccaagccctgccgtggctggagccccccatggaggtgctgcatcacctccgcatgccgctgctgatgtgcatctccggcctgggcacagcgttcgcgctgcggcggcgctcgctgggcaccttcgccggggaccgcgcgaagcggctcctgggcccgttggtcttcggaatgttcgtcgtggtgccgccacaaatctacctggagcggctccagcgagggacgttccagggcagctacgcggacttctacccgtccgtgttcggcttcgtgccctaccccgccggcagcttcagctggcaccacctgtggttcgtcgcgtacctcttcatctactgccttctcgcgctgcccctcttcgcggcgctgcgcacggcgagcggccaggtctggctccagcgcgccgaggcgtggctgagccggggctggaacgtggtgtggctgttcctgccgctcgcgctcaacgaggtgttgctgcgccgcttcccccagacgcacgcgctgctcgacgacccgcgagccttcatccacttcggcctcttcttcatcggcggacacctgctgggccggtgtcctcgcgtcatggagcacctggtggcccggcgcaaggcgctgctgggcgcctgcggcctgctcttcgccgtcatggtgccgccgaacgagtacgccttcccactggagacactgggccgcacggcgctgcagtggctcttcatcctcacggccctggcgtgggcgcgggcctgcatccacgtccgccgcccctggctccggcacgcgcgcgagcgggcctacccgttctacatcctccaccagacggtcatcgtcgtcgtcggcttcgcggtcgtggactggcccgtgggcccctggggcctcttcctggcggtgctcacgctgacgttcggtctcacctggggcctgtgtgaaggagtggcccgggtgccctggctgcgagcgtgcttcgggatgccggctcgctcgaaacgggccgcgcccatccacgccgccgccccagtgcatactgcctgacgacgcccatgacgccctctccgccccaggccggcttcgactggaagtggccccgcatccgcgcgaagccggcgctggcgctgttcggcttctgcctgctcatcggcctgtggatggggctcacgctgtggctcaccatcctcggggacggcggcaccctcccgggctcccgtcccttcctctgggaaatcaccggggcgctcggcatctgggccgtcttacccatcctctacacggcggtggtcaacgcaccgagccctcgcgtgggatgggggcgcttcctgggcattcatgccgtggccttcgtgctcttcaccggcctgcacaccgcgctgatggtggggacgcggcagttgctgtacgcgctgctcggctggggcacctacgactatggcgcgctcgccttccgcatccccatggaggcgcagaaggacctcatctcgtacacggtcaccgccacgctctggagcttcctccaaacctggaaggagcgtcaggcgcgggcgctgcgggaggccgcgctggaggccgagttacgagcggcccaactccagtccctcaccggccagctccatccgcacttcctcttcaacgccctgaacaccgtcagcgcggtgatgtacgaggacctcgcgcgcacggaccggctgctcagcgacctgggcggactgctgcgcgccagcatggagcggcgcgaggccacgtggacgctggccgaggagcgaacccaggccgcgcgcttcgtggccctgctggccgcgcgcttcggcgagcgggtgacggtgtgctgggacgtggcccccggcctggacggcgcccaggtgccctgcttcgcgctgcaagcgctcgtggagaacgcggtgaagcacaaccaggaccggacagagccgctggaggtgcgcatccaggcccgggaggacggcaatgggtggcggctggaagtggaggacacggggcgcggcttcggcgtggcctcgcccgcgtccggccccggcgtgggcctgtcgcacctggagcgcatcctgacgctgctccacgggggccgagcgcggctggagcggagccacggccccgagggcggcgcgcgcgtgtcgctgtggctgccccgggagaccgcggcatgacgcgcttccaggtgctcgtggccgatgacgaagcgcccgcgcgggcgaaggtgaagcgcctgctggcggaggacgcccgcttcgcgctggcgggcgaagcgacggacggcccgcagacgctgcggcaggtgggcaccctgcgcccggacctgctggtgctcgacgtgcagatgccgggcctcaccggcttcgaggtgctggaggccctgggcccggagcattgtccggccgtcatcttctccaccgcgtacgacgccttcgcgctggcggcctttgaagcgcaggcggtggactacctgctgaagccctacgacgcggagcgcttcggccgggcgctcgacaaggcgcacgcggtgctccgcagcgggatgccggacaccgcgcggatccagtccctgctagcggagctggggcgggcccccgcaggccgtccgttggagcggctggtggtgaaggtgggcgaggcctgggtgcccctgccgctggcggacgtctggcacctgtcagccgaagacaagtacgtgcggctctacacgggccaaggcgagcacctggtacgacagacgctccgcgccctggaggagcggctggacccctcacgcttcgtccgggtgcaccggggcgacatcgtcaatctggacgcggtggcccgcctggagccgtggagccacggggatggaatcctcgtcctcaaggacgggagctccgtcgtactcagccgcacctggcgtgaagcgttcctccagaagtggggactggaggggtaagcgtcactgctacagggctgtggcagcaaatttggttgtgtcagccctgcctgtagagtgggcgggctgccatggagaacgtccacgagttcagagagggtcggaaggtccacgaggacctcgccgcggagcgcgccgtgctgggcgccgtgctggcggacaatacgctcatcgccgcggtaggcgaggtcgtccacccagaggatttctccagccccgcgcacgcccagattttcgaggcgatgctgaagctcgacggccagtcgagacaggtggaccacctgacgctggccgaggagctgaaggtgttgggccacctggtgtcggtgggcggcccggcctacctgatgcgtctggaccaggtggtgcccatcgcgtccaacgcggtccagtacgcgcagatcgtcaaggaccaggccatccgccgccgcctggcccaggcgggcagggagatccaggacctcgccagccaggagacgggcgagctggaggtgctgctcgacgaggccgagcgcaaggtattcctcctcgcggagaagaagcgcgagggcgacctgcgcccggtcagcgagctgatggagcatacgctcgacctgctcgacaagatgaaggcggcggccacgggcatcacgggcctgtccaccggctacatcgacctggacaaccagctcaccggcctgcacgccggcgagctcatcatcctcgcggcgcgtcccggcatcggcaagacgtccttcgcgatgaacatcgcggtgcacgcggcgctgaaggagaacaaggccgtcggcatcttcagcctcgaaatgcccgccgaccagttgctgatgcgtctgctggcctccaccgcgcgcgtggacatgaagaagctgcgcggcggccggctgacgccgcacgacgaggagaagttccaggagatggcgggcgcgctctacaacgcccccatctacatcgacgactccggcggtctgtccccgttcgacctgcgcgccaaggcccgccgcgtgaagcagcgcgacccgcgcctgtcgctcatcgtcatcgactacctccagctcatgcatcagaagggcaaggtggagaaccgccagttggaggtcgccgaaatctcccgcgcactgaagcagctcgccaaggagctggaggtgcccatcatcgc

SEQ ID NO: 1118 - DNA, 14342 bp, Myxococcus xanthus
gctctaaagacaccgagctggtggtgttcggcgatggcctgctggacgctcgtggccacgtcgtcgggcgaaacctcctggcgggcggagacctcgaacgccacggccaggtgctcttctccgtccacatccacggagaacgcggcactgcatccggggcggatcgcggggtggctctgctcggtggtctgttcgaggtcctggggatagtggttccggccacggatgatgatgaggtccttggcccggcccgtgacgaagagctggccgtcacggaggaagcccaggtccccggtgcgcaggaagggcccttcgcctcgcgccaggcgggcctggaacacccgctccgtctcctcggggcgtccccaatagccctgggccacgctgggcccggacatccaaatctcccccacctctccgtcggcctggagcgtgcgcgcctggggatccaccaccacgagcgactgggtgggaagctgggtgccgctgctgacgagcgtcaccgtgtcctgcccggtgccctcgtcccggggggcgccctggccgtgctggagcgcccgcgcgtcgaagtggcccgtccgcaccggttccgccttgacgccgcccgcggcgatcaacgtggcctcggccagcccgtaacacggatagaagaactcgggccggaagcccgcgggttcgaaggcgcgggcgaagcgggccagcgtctcgggccggatgggttcggcgccacagaacgccacctgccacgtgcgcaggtccaactgctcgcgctcctccgggcgggtcttccgcacgcagaggtcgaaggcgaagttgggaccgcccgcgcaggtgccgcggtgccgctcgatggcttggagccaactcagcggtcgttgcaggaaggtgatgggggacagcagcacgccgtgaaagccgttgtagagcggctggaggatgccgccgatgagccccatgtcgtgatagggcggcagccagttcaccgctacggacccctcgcggagctccatgcccaggccaatcaggtgcgagttgtgcaccaggttgccgtgcgtgagcatgacccccttgggcgtgccggtggacccggaggtgtactggaggaaggccagcgtctgccccgtgacttcgggttctcgccagccgtcctcgcagcccgcctccaggaggtcggtggccagccagcggcggtccctcagctgcgacgcctgctcttccagcgagtcgaccagcgagagaatcatctcggtggtgagcacgatggatgcccgggcatcggtgaggatcgcctggagccgcggcagtgagcggttgaggcggctgatgtcgggcgggtaggccggaacggcgatgacgttggcgtagaggcagcccaggaaggcggccacgtagtccagccccggagggtagaggaggatggcccgctcgcccgccgcatccatccgctgaagggaggccgcgatggcgcgcgcgcgacggtccaactcccggtacgagatgcgcgtctcgtccgatgcgtcgtcgcccacgaacgtataggcgatggcgtcgggctgagtgctcgcgcggtgacgcaggcaatgcaagagggtgggactccagggggcttcttccctcgcgctcgcgagcagcatcggcggagacctccggcaaagatggctgggcaggaatcaggtggaccgcggatgtcagagcaccagcgtgtcggcgccgtggcggagcacggttctctgggcgccgctctggatgtcgagtctgaagaactcggaggcgaagtcgcgcaacttcggaccaaaggccttcattacgtccgtgttacccaactgaagcgtcgctccgtcgcggccgagcgcatgttcgattcgcccctgcaggcgctcgaagatggccaggttggcgcgttcgaggcgcagatactccgtcagggcctcggcgaagggacgcagcgcggggccggcggggcgggccttctccagcagggccatcacccgcgcgggggtgtcctcggggaaggtcagggcctcgagctcgcgggtctgcgcgcccaggccctggccggagatggcgtgctgctcctggtccaactccgcccggaagcgctccaggtcccggacggtgcgctcgcggacctcctgctccgcggcggcgacttcccgggccagcgagctgacctgctcctccgtcctgcgctgataggcctccagcgccgcggcgagctcgcccggccccggctctcccgcgcgcggttgggacagctgcctggacagctcgtgggcgagcgaggtggcccggacgccgaacaggtacttctgcgcgtccaaccccatcagcaggttgccgtactcgaggaaggggcggctcaccagcgcactgacagggcccgggtcggcctggggcgggagctggccggagatgaggacccggaaggagtcctcgatgagcccgcgcggccccgcgcacaccgagttcatcccgatgaagagctcgttcgcgtcggtgaactcgtagagcaccgccgggtcgagcgcctccatctggtcgtacaggcccgcggagatgatgatcaacacctgcaggtgggccacgcggttgatgcccaggagcatgcggtagaggatggccgtcaccgcgggcaggtggccgtcctggagcggaagttgcccgcgccgcagcaggtacgcggagagggcgacccccagccggctgaacttccacaggtcgaccatggtgatggggccgtcgagcgggcgctgcgcctgtttcaggtacgcgttgcgaaggacggccagcccgcccaccaccgcgggccagtgctgattgaactggcgcagcgaggagacattcatgggatgggcgtgcttgcggcggctgcccgcgtaaggacattcccgcatctccatgggcacgccggcctggacgtgggagggcgccatctcctctcccaaggggcgtccctcgtcgtccttgtaaggcagcagggcgcccatcaacgacgcccagtagaactccggcgcctcgtgggccttggggccgaaatagccggaggcatacagggcatcgacagcgctcaggtcgcgaagctggctcatcggaacggctcctggtggatgcgtcggttacttcggtaggaccttcagtttctggcggcccgccacggtgagcaggctggaggtgagcgtgatttcgtcacccgcgttcaccgagagggcccgcggcaggtccctcaccgcccagccccagtgcgtccggggcgagaagggagaggtggacagcaccaaccggtcgtccaggtgggccctgaagaacatcaggagtgagcccagccgcccgccggcccgtatcttcagggatgacagcgtctcgcccgccgtctgcgcctccaggtcacccgccaggtcaatggtgcgcaccacgcactcctccgaaagaatggcttgctcgaagaagcccacgcggaagtcattggcccggcgggggaacgtggcgtcgtcattgatttcatccgcctgttccagcacgtgcaggtagggcgagaagtcgaggccatacatcccggagaactcacgcgcttccaacctggcgcggtgggcgatggagggaacgaactccggctccaccccaacgcaacagacttctattttgtgaggaatcaaggtgccctggcccgggcggaggaagcgtctccttgcgtcatcgatgtatgggatgacgttttcgaagaaggggtcgatgcccaggatttcgtggacgatgacatccacgggttcggggagctggatgtccttgctgttgccagtcaaaagcgtgacgcggtcctccatgccattggcccggaacatcatccgtgcgagcgcggccacctcgctctcttccaatgcatagacatggcgcgcgccgccctgcgcggcgaacatcgagaggatgccggtgccacagccgaggtccgcgaccaccttgtcccggacgtggggcaggatggcggagcggtacgccatcacccgtactgaatccctcagcatccaatggtgcagcgcgaatgacgcgaagccggtcgacgccggcacatagccgctgtcctcggcgcggtagtcggcgcgcacgggggtgaggatgttgtttcccctgagccgctcgacggcttgtgcgaaggcttccgggctgagcgaccgctcctgccgcacggtatggagcgcggcttcttgcgttcgtgcgtggctgaaggctcgcaggatcgcgaggtcgtcttcctcgaggacgcagggggaacgggaaaccgaattggccgcgacgagctggcccgctccgtcgagctggatgaagacggagcgggaaacgatataggcggtgtttgaaggcacgtcgctccccaggcgaaccgcggcgcgccctcgagggcagcggccgcgaatggttatgtgcttgggaggcattactatctgctttccttatcaatgcaagcgctgttggtggatgcgtttgcgttgtaaaacggctgccgcgctggaatggaatatgtttgcgctggaggaacgcggctccgggggcgctgatggacattggctgcggtgtcgtgacaatgattgttagagtccggcttccgtcgggagaggtatgaacgccaagcaccccattgccattgagcgaatttccagtcccacgcccgccttcttccgtgagcattatctggagaagcgccgcccggtggtgctcaccggagtggtcagccactggccggctgtgacgcgttggagcgcggactctttcaagcaacggtttggagaccaccgcgtcgtcgtcgagcgaagcagggcctcggtgccgtcgaacgatcccctcgagttcctgcgcaaccgctactacgaagaggcccggcttggagacaccattgctcggatgatgtctggcgaacatccgccaggggcgtactacgtgacgtatgccaacatcttcgatgcggcccccgaactgctcggggacttcgaatcaccgccgcaaacctggggcatcccgccgcattaccctcgagcgcttcaagaccggctgaccttgcgtcccggcttctggctcgggcccgcggggaccgtgtccgcggtgcatttcgatcggcaggagaacttcaatgcccagatctccgggcgcaagaagtggacgctgtactcgccccaggattcgcgccacctgtattacccggcgctcgacatgcccaccgtcatcttcagccccgtggacatcgaggcgccggatgcacgaaggtttccgcgcttcgcggaggcgcagccctacgagacaattctcgagcctggcgagctgctgttcatccccgcgggctggtggcaccatgtccggacgctggagctgtccatttcgttgaacttctggtggtggacgctcgcctcggtgggcaccacggcccgggtgaactaccacttcgcgcgcaagcagttgctgcgcatcctgggccgccagggggcgacggcggcctccatgccggtgggttgatgaatcctggcgggcggggccgcgctgccttggcggggcaccgcgggcccctccttcaaacggggtggcgttcagactcgcttgaaaatggcatccatggcgcagcttgcgttgtagccgaagaaatcggtgtagaaggtatcgacccggtaggcctcgcggtggtgccagagaaacctgccgagttggtcttcgacgagcgactcttcgcctgacacgcgtccgctttcggggtcctccacgatgacgtagtcgcccggccggaggtattcgtggaggtacgtcaggattccgtcgacgttgacatgggcgtcttcgatgaaaagccaggggtgaggtgctgctctcagcagttccggcgtgaagaccttctgaatcttgtggctgtccccctgcatgaagctgacccgcggatgagagacgtctggcttcaccaggtcatatgtgtggatatggcagtcgagttccagcgccgtgagctggtctgccagccagagggcgccgccgccattcgcgctttcgctttcgaagatcgtgcgcggccgcaggtccgacagcaggcgtggatagagcgccaggtcgtacaccgtcttgaacaaggggatgcctcgccatcgcatgcaatcggagacgccctggctcagcgcgaagacggtgtcggggacgtcccggccgagcaggggggggcgttcgaagtagtccacgagtctgccctggaccctgcggcgcaggtgcgcatggaacatctccatcatgcgcacggtctgatcgtccggaggcgcgacctgctcggtcgccgcgcgctgtagcaggggaagcagcgtcttcatcaccgtgtttcccagataggtgttgaccccggagtaggtgtggtcccgttggacgtccgcgatgaagcgccgcacctcttcctggaggcgggcgcctcccggcatgggcggctgctggaaacagcccaccgtgtgtccggggccatggctttcgagccaacggccggcgggttgctttttgatgcaggcttcgcacgaatccatggcgcattcaaagcagtggaaccgcggagcgtcgtccaatcgttttccacagtgattgcataagaatgctgccagtgatgcgaagcccacgctcctcgggtcagcagccttcatggtatgtcctttcaaggccaggcagggcgcgcggcgccagccgggagtctggtgaataccttctcttatctcataggcgcattgccatgcagaatgcctccaacggtattgagcgcatcgacaatccgactcctgaggagttctatcgggaattcgtttcgaaaggccggcccgtcatcctcacgggaatcgcatccacatggcccgcctgtggccggtggacgccacgcttcttcgcggacaggtttggagacacgcccgtgcaggtggaggtccagcgcagtcaggacccgatgctgcactggggggagaaggaggtgctccagacgacgctggcccggtatgtggaactgctgtcgtcggaaagcccgaagtactatttgaacttcgcttcggtgatggcgcagttgcccgagctgcatcgggatgtcggctcgttggatgcctaccaggtccatcaccggccctaccccgagcgggtgcgccgcaagctccggctgtcacccatcttctggttcggcccggcgggcgccttcacgtcgctgcatcgcgacccttccgacaacctgctggtgcaggtgctggggcgcaagcggttgacgctcttcgcgccggaggacacgcccaacctctacgcgccgtggcatgagaactgttcgagcgggcgctgcctggggggatacagcccggtcaacgtcgcgcagccggacctggagcgcttcccgcgcctgagccgtgcgcgcggggtggacgtcctcctaggccctggggagatcctcttcatccccatccactggtggcactacgtgtcgtccgtggacgtgtcgatttcggtctcgtactggtggttccgccggctgtcccagtggcactggtcgaccgcggcctgggtgcccctgcgctccacgctggagtgccaggtgcgccagtggtggcgcgcgcgggccgcctgaggtccggagcagggcgcagcaaacgaaaagcccctggaatctcaacgattccaggggcttctgtgtggccagggtcagacttgaactgactacctgcggattatgagaccgccgctctaaccaggtgagctacctggccgtaagtgggatgcaacctacggcttttactgcggaacttccactgccttcctacctgctcgcccgctgtccgtgcaacagctttggtaatggggcgggtccttcgcgcttcggggcggctctataccacatgacgggcggagggcaacgggaacgacacggccaaccttcgcggggccagatctcggtcccgagcgatctgctcgccagacgtggaaatgggttttcttcctgacagggcgcctcgatcccacaggaaatgcaaggtgactttggggtcgattgaggcgcggcatgcgtggcgtgcggtcgccacagccggggggctccagcaacaatcaacgtaccctccaccagatgtgcgtggcgggattgggcatcacgcgctgcatcctggccgtcttggaagacgaactgcgacagggacagctcgaagtgctcctaccggaacggtggctcaggctgtttcgcgaaccactgcttcgcgttcagcaggtgcaggtcctgtccgccgggtttgaattcgattccaccggtgagggcgcccagggtcgccaggagcgcgccctgcagctctccgcctgcgaggtccaggtgtccttgcagggagaagccgtcaccgtccgccttcagctcgcgcagttggagtccgccttcgtcaatctgcacccggcccgtcacggtgacgtcccggatgttgagcagggacgtcaggaagcgcggcagattcttcgcggacgtgagcagcgcggcgacaggttgtgtgtccgtgagcttgctggcgaagtgtgccgacagcaccgtcggagacagggacagtcgggcctggggcagggtgaagacgccgctccaagcgcggatgggcacggggccattcgtggacacattcgtcagccggagcgtcgtccccgtcagggccagggacttcgtgtcccacgacaggttccgtgcatccacgtccgcctcggcgcgcagcaggaccttgatgtttcccatgcgtccggagacgaggtcggagtccacgctcagccgcagcgagtcctggaccttcgcgaacttcgactgctcccggctctgcaccgtcatgaacccggagtcgatttccatcgtccgcgccagccaggggttgagcatcctcaagtccaacggccggctcctggccacgcggaggtccggctcgagctcccaatccgactgctccgcgctgcgacgcgcgaggacggtgagggtgatttcagggacctctgctcccgttccttcgggaccggacacccgcacgggcgcgaaggaaagcgttgccgtccctttccgcgcgtcctggctctccgaagccagcgaggccttgagtgcccagggcgcacgcgctcggatgggaccggcccgcacgttcaactcctggccctggacgtcaatgcggctgtcatcggccagccctccgtctttgatgcggaggtccaggtccaccttgccttcgccccctttcagggagacggcgttgttcgaccccaggtgctcgttcagccagtccagtgggagcagctccatctggcccgtcacctgtgcgctgagcgcccgtgagaggtcccagccctggtcgtccgtgaaggggacttcgagccgtgccttggcctccaggcgctccagccgggtgacaggtttccggtcgaactccatggcaccggagaccacgcgaatcgagggcgtctcgacgtggatgcgctcccggcccttgatgtccagcgagccttgcacgtccaggttccccacgaagcggacccggccgaagtccaactcgcgaacctcgtggaccgttacgtcggccagttggatgacccacgggcggtagtccgggcccggtggtggttccttctcgatgccgaatgacggttcaatccggaagcgcgcgccatgcccgtcgatgcgctgcacgtccacgcgcttgctcagcagggcggtcagcgacacgttggcctccaacgcgtccaggttcacctgccaccactggttttgattctgctgggtcagcgtgaagtcgcggaggtggagctgtccgaagggccagagccaccacgcgcgcttccaggcgagctcggtccggctggtggaccggcgcatgatggcctggacggcgcccaggttgagcgccacgttgatggagacttccagcaccacgagtgcgcccagggtccacgcgacggcgcgcggccaccgtttcttgcgaggggctgtgtcctggacctctggcggcgggatgagcgtcatgtcgcgggtacccggtgggatgtccagggggagcggcgcgggtgctgtttcccgcctccctccggatgcctcagccgccgcgcgcacacaaggcgccagcaggcccgcgagtccgattcgctcccggagtgtccgcgggtgagccgatgccagagggccaggttctggactgggaagggcgggggattggtggaaggctcggcgcatggactcggacacgcggcaacacctcggcaacctccacggaacggcagcgccagcgaaggcctgacccgcgcgtcacgaaaggttcctcaccgtgaatctgctgtacgccttcgggctcttcgttctcaccgcggtggccgaggtggtgggctgctatctgccctacctctggctccgtcaggggaagtcacccctgctcctcgtgcccgcggcggggagcctcgccgtcttcgcatggctgctcacgctgcatccgacaggcgcggcccgcacctatgcggcttacggcggggtgtacatcgccgtggcgctcgtctggctgtggctcgtggaaggggagcgacccacgacgtgggacctcgtgggcgcgctcgtcgccatcctggggatggcgatcatcgtgctcggacctcgcaggtagcgagggcctgcttcaacatgccgcgcgggacggactacgcggcccagcgctggaggctgccctccacgtacttcgcccggcaggcgcgccgctggaccttgccgctggacgtcttgaggacctcgccctgctggagcaggacgacctcatggacgtccacggagtgcgcggcggccacggcctgccggatggtcttctggagcgcgctcccgttcagggactgggcgccatcaccctgttcggatggagcgaagcgggcgctgacctccaccagcaccaccagccgctcgccctccgggtggtcgacggagaacgccaccgagcagccagggcgcagcgccgggtgctggctctcggccgtcagctcgaggtcctgcgggtagtggttccgaccgtcgacgatgatgaggtccttgatgcggccggtgacatacagatcgccgtcaatcatgaagcccaaatcgccggtacgcaggaagggaccttcctcgctgccctggatgcgcgcctggaaggtctctgcgttcgtctcctcgcgtccccagtagccgtgagtgacgtggggaccggccgtccagatttcgcccacctcgcccggtgcgcacgccaccagcgtctctggattcacgatgcggatgaggctgtcaccccagctccgcccggagctgacgagcgttcgcgcggacgggcccggctgggcggccacggcgcggttctgctcgagcgccgccgaatccacggtgaggtggcgtggcaactcggaggtgatgcctcccgacacgaagagcgtcgcctccgcgaggccatagcagggatagaaggcctcccggcggaagccggcgggcgcgaaggtgtccgcgaactccaccagcgtctccgcccgcacgggctccgcgccattgaaggcgacgcgccacgaactcaggtctagcgaagcgagcttctccggcttcacctttcgcgtgcagagcgcgtaggcgaagttgggcccgccgctcgtcgtcgcacggtacttcgtgatggtgttcagccagcggatggggcgctgcaggaaggaccacggggacatcacgatggagtgcgatcccaggtacatcggctggagcaccgtgccgatgagtcccatgtcgtggtacagcggcagccagccgcatatcgtcggcgggtcgtcgtggctgaagccctgccggatcatctcctcgttggacatcaggttccggtgcagcaccatcacgcccttgggcgtcgacgtggagcctgacgtgtactggaggaaggccagcgtgtcgccggtgatggcggggcgcttccagccatcctccagcccatcctccagcgcgtccgtcgcaatccagcggatgtccttcaggacggggtaggcctccgccagtgcgttcacgctctccaggatttcgtgcgtggtgagcgcgaagcgtggcttcgcatcctggaggatggagaggatgcgcgtgacggcctgtagctgcgcgggaggataggctggcaccgcggccacgcccgcgtacaggctgccgaagaacgccgcgatgtactcgagccccggtggatacagcagcagcgctcgctcgccagcgcccttgtgctcctggagcgccgcggcaatggcgcgggcctggcgatccaaatcgccataggtccaggtggtctcctggccttcgccatcctggaggaacgtatatgcgcgggcctcggtctggttcgaggcgcgccagcgcagcaggtcggtcagggtctgtacggaacggctgggactcggcatggcgggtctccttgggaagtcgtgggaagaggggagggttcaggggctcgccgcgggttcggcggaaggcgcgtcctgagggggcacgtccagctcacgcagcgggcggtagagcgtggccagcagcgtcatgaggaccgccagcacgcccgcgatgaggaacatcaaggcgatgcctcggcccgggccctcgccgacgaacgcacccagcagggggacgagctttcctcccgaggccatggcgggttcgaaggcgtggtccgccagaggcccggcgatcgtgtacgccagcggcaacatggccccggtgatggtgctggtgaaagcgaagacacggccgcggagcgccaggggcacgatgcgctggaggagcgtctggctggagccgttgatgatggggaggccgaagaagaacgcgaaggcgacaccggccagcacgggaacggaggtggccagcccgacgcagatgagcgcgagtccacaggtgagctggaacccgagcaagccattcatcagtcgcttggggccgccccaggcgctgatgaccaggctgcccgccaacatgcccacgccacccgcggtggtgagtgcgcccagggtgcgcacgtccgcgaaggacaggaccagcggggtgacgaggacctcgaccgtgccggtcaggaagttgctggccgcgaggaagccaatgagcgccaggagtcctggggtggcgcgcaggtaggcaccgccagcccgaatcgcctcgagcagcggcacccgctcctcgccagacgacgacacgaggtgctcccgggggattcgcgccaggagcaggggcagcgcgccgagcacgagcgtcgtcgcgtcgatgagcaggatgcccttgagttcgatgagcttccatcaggggcgcgctcaacatgggggccaccagttgggagaacgcgagcccgacctgcaccaatccgttggcccgccccagatgttgcggcggcaccaccgtggagacgagcacgccgaaggccggctgctggaacgcgctggccgtcgacaccacggcggtcgtgacgtaggcgtgccagggttggagcaagtcattgaacagcaacagcgccagcacgaggctcgacaggccggcggccgcgtcgctgagcaccagcacccagcggcggttccatcggtccacgagcgcaccggccactggcccgagcaggatggcgggcagcgtcgcggagagcatgaccagcgcgtactgcgtcacgtcgcccgtcgtcttgtacgtccagacgccgagcgcgaagctcgtcagccccgagcccagcagtgacaggacctgtcccagccagatgacgacggcggacttcatggggaaggacggcgccgccgtcatcgaatggctccggctcggacgaggccctggcgcacgaactccgccagcacctggacgtgcggcgcggccagcatcgtcatgtggtctcccggcaccgtcacgggcgtgacggccgtggaggcgtggcggccccagccccagctcgggtcgtccgcgaaggactcggggacgatgccgtcttcctcgtgccgctcctgggcccggaagagggcgacgggaacggggaacgtgtcccgggggacgtaatcaatctcgtacgcggccttgtagacgtcgatgaacccttggacctgctggctgtccgcgccgtcggggaggagccccgcctggaccagcctgtgggtcaggtactctcggcgcgcttcggcagacagcggacggagcgcctcggcggagatgcccaggtccacgccgtagagacggccggccgtgctcgcgacagaggccatccagtccgcgtcagcgaacggaggagcctcgctcggcggggcctcgttcaccgggacggtggtgttgaggatgcccacgaaagcaatcgacttgccctgcttccggaactgctgcg

SEQ ID NO: 1119 - DNA, 16584 bp, Myxococcus xanthus
tctaaagaccggcgtgcgcgacttcggcgtgttcgtggacctgggcggcgtggagggaatgattcccgtctccgagctctcgtacacccgcgtcggccacccgagcgacgtggtgaaggtcggcgatgacgttgaggtcgagatcctccgcatggaggccggccagcccaactcgccggacaagtccaagcagaaggagcgcatcacgctgtccatgcgctcgcgccaggaggatccgttccagaaggcgctgtccgaaatcaaggaaggcgaccgcctccagggcaaggtcgtccgcctgcagcagttcggcgccttcgtggagctgcgtccgggcgtggacggtctggtccacatctccgcgctcagcgaccgccgcatcgcacacccgcgcgacgtggtgaaggaaggggagaccatctgggtgtcggtggagaagatcgacacgcaggagaagcgcatcggcctgcgtcgcatctccgaggaagaggcgcagcgtcctcccgaggagcgcacggcgcccgccgctgaagccgccgctccggcgcagcccgccacgccccgtcccaaggtgggccaggtcgtcgtgggcaaggtggaccgcatcgagccctacggcgtgttcctcgcgttcccgggcggcaagggcttgctgcccgcgagcgagacgggcaccgagcgtggcaccgacctgcgcaagcactactcgctgggccaggaggtgaaggtggccatcctggacatcgacgcgtccgggaagatccgcctgtccgtcaccgccgccatccgcgcggaggagcgcgccgaggtggaggcctggcagaagacgcagcagccgcagggcgcgggcaagaagggcttcggcaccttcgcggatctgctcagcaaggcgcgcaagtaattccctgtctccagcgctgatttcgttgatgtggtcagcgctggagaaaggtgttgacggtccaggcgagggacggtacttaccgcctcgcctctctctgccgcggggtggagcagcctggtagctcgtcgggctcataacccgaaggtcgcaggttcaaatcctgcccccgcaactcgttgtttttcgaagtctgattggaatcgcagtcaggtttcgagtagttgagtctcaagacatgtcgcggggtggagcagcctggtagctcgtcgggctcataacccgaaggtcgcaggttcaaatcctgcccccgcaactcgttgcacgttgaatcgctgaacccaaacatgacgcggggtggagcagcctggtagctcgtcgggctcataacccgaaggtcgcaggttcaaatcctgcccccgcaactcaggtcggcccggtcattctcatggaatggccgggccgatttcttttgcgcgtctcgacgcggcgactgtcctccggcacggctgcccatcgtccggccgagcgcgttgtgttcgctggtgaaggcgtacccggcaccacggtccatcttcctcataggggattgcccccaccggtgatgcgcggctcacgccgccgacaacgacgaggaggagtccatggacgccgacatcacgcatgtcctgctggtcggaggtacggggcgttttggcggcaggttggcgtcggcgctgctggcgcgtcccggcatccacttgcatgtgttggtacgtccgggcacgcgcagcgacgcgctggtgcgtctggcggagcatggggtgacgttggtgagcgggacgctggatgacatgcgctcgctcgattcggccttggagggcgtggatgcggtggtctccgccgtgagcggaccacccgaggtgcaagtggcagggcaactccggttgctggactccgcgcggcggcatggcgtcatccgcttcatcccttcggactactcgctggactacaccgacgcggacgcgggtgacgccttcatggatgcgcaccgccgtgtcgcggacgccgtggtgaagagcggcgtgccgcactccttcgtcctctgcggcgcgttcatggagacggcgctgtcgccgcaggcgcaggtgttcgactttgagcgcggcgttgtctcgtactggggcacgggggacgagcccttcgacgtcaccgcgatggcggatgcggcgcgttgggtggcggaggtggtggtggatcctcacgccgcgggccggcggctggagttcgtgggggacgtggcgacggtgaatgacgtggccgccctgtacgaagcgctgaccggtcagcgcctgcgccgcctgtgcagggggagtgtggaggaccttcgccggcagctcgtgcgcgcacggcccgaaggcgtgtccgttcaggtgtcttcagcggagctgagtctgctctcgcagcttgcggggaaggggagactgcgcgaaccggcaaatgccgagtacccgcggctccggcccatgacgctgcgcgacttccttgaagcacggtggatggtgtcgacatccgcgcgggcgacgttgccactcgcttcacagccgtagcccgcgagcatcgcggacactcggtggagtcagcgcgtctcggtggcggtgcgctgcgggctcgggtcgcacgccagcagggcgcactgcgtcgcgggcgcgcactgatcatcacagcagcgcagatgtccccaggggcagccacgggatgtggccgtgctgtttttctcctcggaggcggattgcgtcgcgctgcctgagtccttcgcacctccgttgccgcgcgacatggactcaggtgtcgctttacccgggtccatggtggcttcggcacgcgggaacgggcgttccgcggtgcccagacacccagtcgcgccaagcacaagtgcccagaacaccactccccagggccctgcgcgtccataacccgtgctcatggctcccccatgttcgacgcaacctgccgtaattgcggaattctgcgctccattggaaaaaatgcggcatgtcgccttttaacttacatccgatcgggcactaatctctccgccaggtgacaatctgtcacttggtcgccttctgaccgtgactgggagtttcggcgatggggccggaaccttggacccaggctgtaaggagggcgaccacccccgccgtcgtaaatggagtttccccacgtgagaaggttggttgccacgctgtccgggcttgccctggtactgtccggtaccagttccgtcgcccggacgctgccgaactatgatgcactccaggacgcgaagcccgcgggccgtgccgccgcgggattcaagccggtcaacagcagcctgaagggggcgcgggtcgcccacaaggactcgctgaccggttccccgacgttcatctggacgcacccgacctcggagcagacgaagctccgtggcgagtacgcgaagatgtctcccgccaaggcggcgctggcgcagatttctgcccacgctcctctctacggtctcgcttcgtttgaggccgcgggcgcgacggtcaccaacgtcagcaccaacacgcagggcgtgaaggtcgtgacgctggcccaggagtcctcgggaatcgaggtcttccgccagtcgctgaaggtgctgctgaacaagcacaatcaggtggttgccatctccggcagcctctccaagcacggttccgcggagatccccaagggcaaggcgcgcttcaccgtgcccgcgaccgaggcgatcgccgtggcctacaaggacctcacgggcgccgcggctggaccgcaacctgctcacccgcgtgagcgacgcgaagaagggcgacaagtactcgcacttcacgctggccagctacgcgcgtccgctcgaggaggggtttgtcatccccgcccgcgcgaagcaggtctacttcccgctgcctggcaagctggtccccgcgtactacgtggagatcaacacgagccgcgcgaacagcgtggactcggactacttcgcgtacgtcatctccgccaccgacggtcagttgctgatgcgcaacaacctgacggcgcacgcggagttcagctaccgcgtgttctcggacacgacgccgccgtacaccccgcacgacggtccgatcggcagcggcggtacgccgcacccgaccggcaacccggacggctaccagtcgccgtacgttccggcgaacctgatcaccctcgagagcctcccgttcagccggaacgatccctggctgccggacggcgcgacggagacgcagggtaacaacgtcgacgcgtacgcggacctcgccgatccggactactacagccccggcgacctccgtgcttccgtcacggccccgggcgtgttcgaccggatcatcgacttcggcatccagccgaacgccaacaacgagcagatcgccgcggcgacgacgagcctgttcttcctgaacaactggctccacgactggtactacgacgccgggttcgacgaggcctccggcaacgcccagcatgacaacttcgggcgtggcggcgtgggcggtgaccgtctgcatgcgcaggcgcaggactacagcggcaccgacaacgccaacatgcgcacgccggcggacggtgcgtcgccgcgcatgcagatgtacctgttcgccggggcgcgcaactcgcgtctgacggcgaacgctccggcggaggtcgcgggtgactacgagggtggcgtctcctccaccttcggtccgcagaccttcaacgtcaccggcgacgtggtcgcggcgctggatgccgtcaacaccgccggcccgacggaccgtgacggctgcaccgcgctgaccaacgcggccgaggtcgttggcaagatcgccatcatcgaccgcggcacctgcggcttcgtcgacaaggtgaccaacgcgcagaacgcgggcgccatcggcgtcatcatccacgacaacgtcgcgggtcccacgatcgacctgggcggcgactccaccaccatcaccatccccacgcttcgcgtgaacctggatgatggcaacgtgctgcgcagcggcctgccggcgctcaacgtcaccctgtggcgtggcccgaccgcgtggatcgacggcaccatcgacaacgccatcgtggcgcacgagtggggccactacatcagcaaccgccttgtcgcgaactcgtccggtctggtgaacaaccagggccgctcgatgggcgagggctggggtgacttcaccgccctgctgatgatggttcgcgccgaggacatcaacgtcccgtccaacgcgaactggaacggcgcctacgccgccgcgggctacgccacgcgcgcggacgcgaactccgagttcttcggtatccgccgtggcacgtactcgtcggaccagaccaagaacgcgctgtcgttccgtcacatcatggacggcgtggcgctgcccacgggtgtgccgttcaacggcaacacgggtcagccgaactcgcaggttcacaactccggcgagatctgggcgacgatgctgtgggagtgctacacgtcgctgctccgcgcgcatccgttccaggaggcgcaggaccggatgaagagctacctggtgaacgggtacaagctcacgccggcggcccccacgtacctggaggcgcgtgacgccgtcatcgcggcggcctacgccaacgacccggcggacgccgagcggttctggacggccttcgccaagcgcggcgcgggcgtcggcgccgtggctccggaccgctactccacgaaccacgccggtgtcgtggagagcttcgtggtcggttcggccatccagattgtgtcggccgagttcatcgacgacgtcgaggctggctcgtgcgacctcgacggcatcctggacaacggtgagacgggccgcatcgaggtcaccgtgcgcaacgcgggcgcactgcctgcgtccgcctccagcgtcaacctgtcctccgccttctcgggtctcgagttcggcaacggtggtcaggcaagcttcccggccatccccgtgttcggtacggccacggtctccatcccggtctcgctcacgggcgcgacgggccagcaggacgtgaccatcgacatcgcggcgcgtgatgcgggccaggcgatccccggcgacatcacggacagcatcatcctcacgacgcacttcgacgagcgtgagaactcctccaacatcgaggacgttcagatctccccgtccaagctgccttgggaaaccgagtacgacgaggccctgaccccggccgcgttcagcgtggtcacgttcccggacggcaaccgcacgttctacgcggagaacaccgcttcctacgccgacgttcgcctcatctcgcctgagctgcacgtcagcgcgaccgagcccttcgtgatcaacttcatgcacgcttgggacttcgaggatgactacgacggcgccacggtcgaaatctccgaggacggtggccagacctgggtggacatcggcgatccgatccacaactcggttcttgagacctacccgggcaacctgaacccgctggctggcaagcccgcgctgtccagctacaaccctcagttcccgggcatgctccctgcgaccatcgacctgggcacggcctacgccggcaagacggtgcaggtccgcttccgggtcggtacggacgagagcggcggctacacgggctggctgctggacgacctcgagttcaacggcatcacgaacactccgttcgccaccatcgcgcccgaggatggcgtttgtgtgaacccctggcccatcgccaacgccggtccggaccggtccatcgcgccgggtgaactggtgagcctctacggttcggctgccgatccggaaggccagccggtgaccttcacctgggcacagacgtctggccctgcggtcaccctggcgggtgccaacaccctgaacccgtcgttcacggcgccgcaggttaccgagtccaccgcactggtgttcacgctgaccgtctccgacggcgtcaagacgtccacggactcggtgaccgtgacggtggcgctccccaacaatccgcccaccgtgaacgcgggcctcgacggcatcgtcgaggagcgcgctgagtacacgctgagcggctccgccagcgatgcggatggcaatgccctcacgtacctgtggacccaggtctccggtacgccggtggcggtgaaggactacaccacgccgacggcgacgttcatcgcgcccgaggtcacgctggatgagtcgctggtcttccgtctgacggtcagcgacggcatcgccacggtgaacgacacggtcaccgtgacggtcaccaacgcgaaccgcgcgcccatcgtctccgacacgtccgtggccttcgccgcgggcactgtcaccgtgacggcctccgcggtcgacccggatggtgacgcgctcagctacagctgggagcagacgggtggttcgacggtcgccatcaatggcgccgacacgtccgccatctccttcgccaccccggtcccgggttcgtacgagttcaccgtgacggcgacggacggctcggcctctgcctccaaggcggtgccggtgaccatcatcgatggttctctgccggcgaactctgcgccgaccgtgaacgcgggcatcgatgccacggcgaacgctggtgacgtcgtgacgctcagcggctccgcgagcgacgccgagggtgacacgctgacgtaccactgggagcagatcggtggcacggatgtgaccctgacgggcgccgacaccctgacgccgtcgttcaccgcgccgagcacggccagcggtaccacgctcggcttcatcctgacggtcagcgatggcacctcgaccaccagcgatgccgtgcgcgtcatcgtggcggcggacccgggtgccaacccgagcaacactgctccggaagcggacgcgggcgagtcggccatcgtggcggagggcgccactgtgacgctcaacggcacggcgaccgacgctgacggtgacacgctcgtcatcgtctggacgcagatcggcggcacgcccgtgacgctgtctgacgcgtcctcgctgacgccgacgttcaccgccccggcctcctccgatccgctgaccttcctcctgatggtcagcgacggtacggcgactgtcgtcgacgtgacgtccatcagcgtgaccgaggagaacgtcgcgccggtggcgtccgctcgcgcggtgctctctggcaaccagacgtcggccacgctcgacggctcggcttccagcgacgcgaacggcgatgtgctgacgtaccgctggacgcaggtctccggcccgaacgcgaccatctccggcgcggaccaggcggttgcggtcgtcaacctgcctgacctcgacgacaagacggcgtcgttctcgttccgcctgacggtgaaggactccgcgggcaccgagagcagcaccaccgtgcagttctccgcccgcaacggcggtgacagcggtggctgctccgcgacgggcgcgggcgctccggtcggcatgatcggcctggcgctgctcggcctgctgcgccgccgtcgtctgaactgagacgcgcgggtcctcctcctgcctccgggtgggaggaggcctccgcggggcccggatgaagtgagtgtccgggcgccgcggaacgccgactgaagatgaatttcctggcggccggctcccggattcaagggggccggccgtcgacttttccgggccgaggcgccgcggacctcagaggggccgcacgtgctccgcgaggcgtccggtggccatcagctcgtgcaacgcgtcgcccatgcgctcgctctcggagaccacctggttccaggcgcgcatgcgctcggcgtccttcatccgttcgaagtcgacccggtctgggatccggccgccaggaaggcgggccaccagctccggagacggggcgatgagcagcgccctgcggaagttctggggccgtgcccgccgccaccgcagcgacttgtcgaaccagcccggcaccacgtacgggtagaagtgcgggtacagcaccaggcccgtgcctgggccgaagtccaggtccaggtggtagtcgaccacgccgccgtcgcgaaacacgcccgcgggcgcgccgggaatacgcacgccactgaagagcagggggatggagcctgacgccagcagcgccagccgcaggttctcccgcgtcagtggcaggtgggtggagggcaggtcgttgagcccggtgaaggggctggtgtccccggccgtgtggaagatgacgcgctccatgtggagccccagcgtccgtcggctgaccaggttgcccagggcgcagagcacgagcccgaagagctgcgcccccgggccttccattcccaccgccccccggcacagcgcggtgacgacatgcagccgtgcccaggggtggtccagaatctccgcttcaccatcctcgcccagcagcgcatccaggatgcgctcgcaggtctcgctcacctgggtgggcgtgggcttgggcggatagcgttggtcgatgtacgccgcctcgaagcggcgcaaggccagcaccgggtccttctgggccatgcaggcgagccgccagcttccaatggaactgccgatgaggtggagggggcgcgagcggttctggaagaggccggcgaagagcgcccggtccagtcccgccagcaccagccacttcggaccgccggaggcgccggggacgacgtccacgtcgtccccgcgcaagcctcgttcgcgaatgagccggagcgcgtccggcccggccaggagcgtgaggtgggaggccatatcggcccgccaacctaacgaagccccaccggggttgcgactcttcgcgtgccgccggggtgctgtagcctccccaccatgaagaaaaccgcagcctctcccggctccccggtgggcctcagccgccgcaccgtcctgcgcggaacggccgctgccacggcgctcgcctcactggatgtccccgcccatgcggccccgacgccggcgcggcccttcgagctggccgaggccaccgtggtggacctccaggccgcgatgaaggcaggcgagctcaccgcgcaaggcctcgcggagcgctacctcgcgcgcatcgccgactgggactcgcgcgggcgcctgccgctgcgctccgtcatcgagctgaacccggacgcgctcgccacggccgccgcgctcgaccaggagcgccgcgagaagggaccccggggcccgctgcacggcatcccggtgctcctcaaggacaacatcgccaccgcggaccagatgcagacgacggcgggttccctggcgttggtgggcgcgcggccgtctcgggacgcgttcatcgtggagcgcctgcgagccgcgggcgcggtcatcctgggcaagacgaacctgagcgagtgggccaacttccgctccacgcgctcggccagtggctggagcgcgcggggtggccagacgcgcaacccgtatgcgctcgacaggacgccttcgggctccagttcgggggcgggtgcggccacggcggccaacttctgcgccgtgtccgtgggcacggagacggatggctccatcgtgtcgcccgcggcggccagcgcgttggtggggctcaagccgacggtgggactggtgagccgctccggcatcattcccatctcccacagccaggacacggccggccccatgacgcgcaccgtggcggatgccgcggcgctgttgagcgtgctcgcgggcgtggacccttcggacggggcgacgggggcgagccggggcaaggcccatgcggactacacccggttcctcgatgtggacgggctgaagggcgctcgcatcggcgtgccccgggagcgcttcttcggctaccacccggccaccgacgcgctcgtggaggaggccttggccttgatgaagtcccgcggcgccatcctcgtggacccggcgccgattcccgcggtggcgcaggtggacgcccccgaactggaggtcctcctctacgagttcaaggcggggctggaggcctaccttgcgacgttggaggaggggacggccccgcgcacgctcgcggagctcatccgctacaacgaagcgcacgcgccgtcggagctgccgtacttcggccaggagctcttccacatggctcaggccaaggggcccctgacggacaaggcctatctcaaggccctccaggcttgccgccgcctgtcgcgcgcgcaggggctggacgcggtgatgaagaagcaccagctggatgcgctggtcgcgccgacgcaggcacccgtggggctcatcgaccccatcaacggtgaccactggctgggcagcagctccacgcccgcggccgtatcaggctatgcctccatcaccgtgcccgcggggttcgtgtacggcttgcccgtggggctgtccttcatcggcggggcctggagcgagcccgtcctcttgaagctggctcatgcctatgaacatgcgtcgaagcaccgccgcccgcccaccttcgcggagacggcggacctgcgggtgcacgctggcgcgggaagcccacccgcgaagccctgactcagggctccggcgacgtggcccagggcgtggtggcctggagcacggcttcttggagcgcctccgtgcgcaggtgcgcgatgtgctggtactccgggtccgccaccatctgtaggaaggcggcgcggctgggatagcggaccaggagcaccgcgtcccatgtctgtccgggatcggccaccagcgccgtggagccgtctccggcgtagaggggctgggcgcccaccttctggatgaagggcatcaccgcgctcgcataggcctcataggacgcgcggccgccttccttgaagcgcaccaggttcaggatgaccacggggcctcccggatcctcccgcatgaagcgttcaacgtcggtgtgctgaggatcgacggccatggtgcctcctcggttcgggatgaaagctattccaacgtgccaacggagctgccaccgggctgctcgcgctggtggtcgagatacgcggcgaagcctgccttggattggatgcggaaggcggggattcgggcgagcgcctcgggcgggaagacgtattgctcacacacgaggctggcgcgggtcgcgccttcctggctgccagtgaagggccgcacctcgtgttggaggtcgccgcggaagtgcaccagcaggccctcgcgtgggcggatttcacccacgggggtgtcattctggagaaggcgcagctcaccaccctgggcgcgctcggggacctggagatacagcacgctcacgtgccggggcgtcgcgtcggggacgccgctgggctcctgcagtgtcgcgtcgatgtgtcgccccacgccgcgccccgcatcgagcaacaagaggttgagatagaatgcattgggggcgggccgctcccgccgcgaaccccagagccgctcatgccaaggcaacaatcctgtcgcatggagcgggtccagcacgtgggccaggtagggcaccaggaaggggaagcgggcctccaacgtggcgcggccctcgtgcgtgaagatgaaggcaaacccccggctggcctggaacgtccccatcaacggactgcgtgccacgaagcgcgagccgagcagggcggtccgcagttcgtgaagcgcgctgcggggcaaggcctctcggcgggtgatgtaagcacgcacggggagactcggacttcagggtgaataagagaaccgtagcagttttacagcctaccttataggttgcagcttagccgatgctactcaactccttggagacggacacatgagccagcaacctcgagcctctcacgcgcctccgcccgccgctctgcagatgacgcaaatggtctatggcttctgggtttcccgaagccttcaaatcatggcggaactcgagctcgcggataccatcggtgatacgcccaagacggtcgaggagctcgccgaggcgagtgggactcatgcacccacgctgcgccggctgttgcgactgctcagcggcctgggtgtgctcgtgaaggatgagtccacgcagcgctgggccctcaccgagctgggcggaatgcttcgcaaggacaaccccggctccgtgtatggctcgctccgggcgcatggacacatcctgtcgtggcaggcgtggggagacctggtcaccgcattgaagacgggcaagcccacggtcgagaagttcatgggcgacacgttcttcaactacatgacgacgcatcccgacgtcgccgccatcttcaatggcagcatggccgcgtaccagacgctgaacgcgcccgccgtggtgaacggatatgacttctcctccgcgcgcagcatcgtcgacgtgggcggcggtacgggcatgctgctgacgcacatcctcaaggccaatcccggcgtccgtggcaccgtcttcgaaatgccacacgtggcggtggaggcccgcgagcgaatcgccgagcaggggctgtcgccgcggtgtgacgtcgtcgctggtgacttcttcgagtgcatcgttcccgaaggcaaggacgtctacatcctgtcgcagatcctccatgactgggatgacgagcagagcctgcgcatcctcaagtgcatccgcgcggcgatgcgtcccgactcgcggttgctcatcgtggagacggtgctgcccggcgacaacgtgccccacttcggcaacctctacgatctggccatgctcgtgctcgtgggcggccgggagcgcacggggccggagtacacggcgctcttggagaaggcggggctgagactgttcaacgtcttcccgacgacgatgccgcccagcgtcgtcgaagccgtggtggcctgaaccaccagcggtcgctgtgaggcgggggctcagtggtccgcccgcctccggcgctgccgggacgtgtcgagcatgttcagcaaggccttctccgaacagtggaggctcccgctccgcgtctccgccagctcgtccacggagtcgaaccaggtgttcaccacctggccgcgctcgaacatggcgcgcacggacgggtagatatgcgaggaccgcgccaccgcggggggcccaggtactcggcggcctccttcacggcggccaccatggtcttcgtgagcaccgtcttcttcaccgggccaccggtgtctccggagggcaggggccgtactctcgcgctggatccgcttgagttgcgtctcgggccgggctgctggccggggacgggactgccgggttggttccgcgtgaggggccgtgcgccttgcgtcaggggaatcccgcccgccccatgtgagccgtcctcccgtggtgctcaggggggggccgcgcggcaacgcaggtgccgaccggccgcccgcccagggacagggcagaaaagcgcaaggcgcgttttcgatgggaatgacattcgtttagagtggggagcaagccgtatgagcgccttcctcgacaccattctggccttcccgaccgccatcttcaccatcgtcctcggcgtggtgatgacgtactggctgttcgtcatcgcgggcgcggtcggcatcgacctgttcgatggggacatcacgctggagtcgggcggcaaggcgctgagcggggccatcgagggcggcggcaaggcgctgggcggggccatcgagggcggtggcaaggcattgggcggggccatcgagggcggtggcaaggcattgagcggggccatcgagggtggtggcaaggcattgggcggccgcgaaggcgctgggcgcccatgacgcggatttcgacgtcgacggtggcggagtcctggcggccatgggcttcgcgggcatccccatcaccgtgtccgtgagcttcgtggcgttcatcgcctggctcctgtcggtggtgagcgcgcagccgctgcacgaggcgctgggcgggatgatgccgtcgtggctgttgagcagcgggctggggctggcgtgcttcgcggcggggacggtgacggcgggcttcgcggtccgacccctgcggccggtgttcgtgaccaggcgcgccccggggcgcgacgcgctgatgggccgcgtgtgcaccatctccagcggcagcgtgacggccaagacgggccacgccaccttcgaggacggcggcgcgggcgtcatcctcaacgtcgtctgcgcgaagcccaatgaactcaagcgagggcagccggcgctgatcctcgcctacgacgccgagcggcgcgtctacgaagtggagccggtcgactggctgctgccggaggagatggagcagctccaggatccggcccgcgccgcggcattggctcgcgtgaaggcacgaggctgagtcttaccggtcgcgccgagggggcgaccgtcacattcgacgccggagggcttttgcgggggatctccggcgcctgatacaaggcccgctgtcatcatcaatcaggaaatggccatggaccccattaccgcggtcgctgccggcatcggtggcatcatccttctcggaggcatcctcctcaccatcgtccggctctaccggcaggtggaccagggcaaggtgctcatcgtcaacacgctgaagaacgagccggtcgtcaccttcaccggcgcggtggtgttccccatcatcaaccgggccgaggtgatggacatctccttgaagacggtggaaatcgaccgccgtggcaaggaaggcctcatctgccgggacaacatccggggtgacatcaaggtcaccttcttcgtccgcgtgaacaagacgcgcgaggacgtgctgaaggtggcgcagaccattggctgcgcgcgtgcctccgaccaggagacgctggagaacctcttcgaggccaagttctcggaggccctcaagacggtgggcaagagcttcgacttcgaggagctctacaccaagcgcgaggagatcaaggaccaggtcgtcaacgtcatcggccgtgacctcagcgggtacatgctggaggactgcgccatcgacttcctggagcagaccccggtcgagatgctggacaaggacaacatcctcgacgcgcagggcatccggaagatcaccgagctgacgacgaagcagaatgtcttcaccaacgagctgcgccaggacgagcgcatggccgtcaccaagcgcaacgtcgaggcggatgaggccatcttcgccctcgagcgtcagcgtgaagaggccgccgcgaagcagaagcgcgagatcgacagcatccaggcccgcgagacggccgaggccgagcgcgtgaagcaggaggagtacgccaaggcccagctggcgcgcatcaaggccgaggaagaaatcaacatcaacgagcagaacaaggcccggcagatcgaggtcgcgcagaagaaccgcgagcgcgtggtgggcgtggagaccgagcgcgtggagaaggaccgcgccctggaagccatcaaccgcgagcgtgagacggagctgcagcgcatcgccaaggagaaggcgctcgaaggcgagaagaagctcatcgccgacgtggtgcgggcccgcatcgccgtggagaagacggtggcggaggaggaggagcgcatcaaggacctgcgcgtgaaggccgaggccacccgccgcaaggacgcgctgctcatcaccgccgaggcgcaggcgcaggagaagctggtcaaggacatcaaggcggccgaggcctccaacgaggtggccaagttcaccgccaaggagaagctgacgctggccgaggccgagctggaggccgctgacaagac

SEQ ID NO: 1120 - DNA, 16423 bp, Myxococcus xanthus
actcaggccatggtgggcgcgccgcctgggccgggtgcgtcgatgccgccggagggggccggggttcggccgccctcagcgacgggactgcctgcggtgcatagcgcgccgggtgtggggactgctggtccgcaggttcctccggggatgctgggcgcagcgccgtcgtccgcgcccggaggggtggctgttccaccagggatgatggcggtacgtcctccgtccgcgacgggactgcccgcggttcctgggccacacggtcgggtgccgccaggcatggcgggcgcacggcctccgtccatgacgggtgtaccggcagtgccggggcctcgtgggccggtgcctccaggaatgacgggcgcaccgcctccggcgacgggtgctccggtgcctccggggatgatgggcgcacggcctccgtccatgacgggtgtaccggtagtgccggggcctcatgggccggtgcctccaggaatgacgggcgcaacgcctccggcggcgggtgctgcggtgcctccggggatgatgggcgcaccgcctccggcgacggttgcggcgggtgctccggtgcctccggggatgatgggcgcaccgcctccggcgacggttgcggcgggtgctccgatgcctccggggaagatggggcatcggcctccgtctgcgacgggactgcctgtggtgtcgggacctcctggcatggcgggtggcgcgtccggacctgctgtgccagttcctcctgggatgatggggcatcgcccgcagtccgcgacgggcttgcccgccgtgccggggcctcatgggccggtgccgccgggaacgatgggagctcggcctcctcccgcgcccgggccacacgggccagtccctcccgggatgatgggaagtcgtccgccgtccgcgacgggcctgcccgcggtgccggggcctcatggaccggtgtcaccgggaatggtgggagcacgcccctcgtcgtcgggcctgcctgcgatgcctgggcctcatgggggcccggtgccaccgggaatgatgggagcacggcctccgtccgcgcccggattgccaggggcgcatgggccggtgcctgcgggcacgatgggagcacggccgccacctgcgccgggcctgcctatgcctcacgggccggtgcctccggggatgatgggatcgcgaccgccgtcgtcgccgggactgcctgcggtgccgggggggcgcggggcgaagccaccgggaatgacgggcgcaccgccttcgtccgtgcacagggggcctcaggctcctgggcctcacgggacgaagccaccgggaatgacgggcgcaccgtttgcgactgcgcacgggggggccgatgcccccgtgcctcccgggacgaagccaccgggaatgacgggcgcaccgtttgcgactgcgcacgggggggccgatgcccccgtgcctcccgggacgatgccaccgggaatgacgggcgcaccgcctgcgactgcgcacggggtgccagatgcccccgtgccccccggggcggtgccaccgggaacgatggctgcacagcctgcggctgctcacggggggcccgatacccccgtgtctcccggggcggtgccaccgggaatgatgggcgcaccgcctccgtcagtgcacggggggccccatgcccccgtggctctcggagcattgcctccggagatgactgctggggcttgggccgtcgccgggccggggatgcaccgtcctcactcgcctcacggacagacgcctccgggctcattgcccgtacctccggccgcaggtggtccgcctgtggccctgcagggcgcacccacgccgggcatggcgcggggcccgtcgagcggaccgcccgcgcaggtgtcgccggcgccgccttcaggcgtggtcgctgcgcatccagcggacatgccgtcgcagctccccatggggatgccgcctcccggagcgatgccgcctcccgcgtcactgggggatgcacggcccgtggaagcggacatgccagtccctggcaatgccgctgcggaagctccaaggaccgacgagccagtcgagactcctccagcggaagcacacgctgccccgtcctcggctgccgcggatggaacggaacctccgttccatctcgaggaagacctgggggcttcggggccgagcggtgttccctcggcgccggacttcgattcaagccggatgccggttcctcccggaatgtcgcccgcggttcatcgcgggcacggtgtctcgcctgctcccttcgcgactgaaggacgagagtccccccacgagcgcggcgcggtgccccaactggttgacatccctgctgcgctgccggctcaagagcacgtgccgtctgctgtcgacgcgagtggggctctcgagcgggcgttgcccacggactctgacgtggtgttcgacgtcgaggccgttgccgtcacggcttccgacgtggtgtcggcgacccctgtcgcgaccgaagatgcgtcggcggtggacgtggaggtgcctcccgagacgccagacctcacggatgccacggtcgtggttgagccggtcattgccaccgacgccgcagttgggccgcaggcagttgacgaagccgctgtggtgacggcagagggcgccggtgcggaatcgggtggcgtcgcaagcgaagccgttggagtgacggcagcggacgtcagtgtggaaccgagtgaggagccgtcggccagccccattcacgacgaaccgaacgcagttgttgaggcatcggcagcaagcgcggctaccgctgagtcggaagtagcccgtgttgcgagtccggacgttgaagctgtagccgcatccgctgtgttggacgcggccaatgtcgccacctcaagcgttgatgacttggcggcgggggcatctttctccgcacaggatgttgctggtgatgcgaatgcggtcttggccgtatcggcggccggtgccgcttgggcacagccggaggactccgttgggccaggtgcgaacgttgatgcatcggccgcaagcttcgttactgcccatccgaatgactccggcgtggcaagcgcgagcgttgatactcccgccgcaaccaccgaggccacctcgacctcggatgcacctgctgctgctgctgccgcgccggatgtctccggtggttcgagtggcattcgttcggttggcgccgagccgcatgctgccggtgtgaacgatgcggcacccgaagcgtccgcccttggcgagtcgtcggcggcattggggcctcatggctccgtggaaatggcagctgcggcgctcgaccgtgagcacgctccgtcgtccacgaatgtggaaggtgcagcggttccttttccgggcgttgacgcacgtccggccgcagaagtggcgtcgaccgtcgagctgacggatgcgtcagctccagggccggatgctgggacctcacagcacgcggccgcctctccaactgagtcggcgaacgctgacgctttgagcgcggcgggctcgacgtcgcccgatgatgtcgcgtccgcggagtcgattcccgaaccggaagggactgagcaatctcccagtgtggaagcgctgccggaggcctcgcaggcccactccggtccagtcctcacgggagaatccgcggaggcgtcgtcgtcgttggcttccacgacgccagccgaagcgcagcgtccagccgagcccgtcatcgtggccgatgccgttggtcattccgctgcaaccgaaacgctggcaggcacggagccttccgaaaccgcagcggcgaactcggaactcacgagcgattcatcctcaccggccacgcaggagtcagtcgcggacagcccgtctgcggaggcgacgccggttgccaccgtagacgccccaaccgccgtaacaccgagcgatgcgcctgacggcttcgtggaggcggctgcggcaaccacagagaccgagccaactccgtccatcgagtccgctcccgccgccacgccatccacgggcgaacgggccgcgctgcccttcggcgaggtgacgcagccattcggcctcaagttggacttggcggccatcgccagcgagtccgacccgacggcggaggatgcttcaactggcaagcacgcggagacgccaacgcaggacaccccggcgccgcgcaaggcacgcggcttcgtcgtcgcggagcatggcgaactgctcaccacccctgctgcccccgcggccagcctcgacgccacggagcccgccgcgcatggcggcgctccctcgcccttcgtcgagactcccgaattcacgactccacccgtcgctcccacgccccgggcgcccattgaactggatgacctgtccggcgcatccgacgagccgatgcagctcgcctcgacgtgggagttcgtgggctggcagggcggcgatgacacgggccccattggccacgtcccggagacgacctgggcggaccgcggtgtggacctcgacggcccggccatatcgcccgcggcgaccgaagtgcctctggcttcggcgtgggacttcatccagcagccctggcagcccacggcggcggagccttcggacgtcatcaccacgctcctggccgcggcggccagcggggccacggaagtgcccgtgggtggcccttccgtgacggcggagcacgtgttgtcggcgctcgatgtcgtgagtacccaggggacgctcggcagggtggtgctggcgtactgcgcgggccgcttccagcgcgccttcctcctgggcgaaagcctcggcctcgcgcgggtggggcatgcctggggcccgggcagcgacagcgcggcggttgcccaactcaaggtcgacctcgaagcaccgtccctgctgcacaccgcgatgacgtccgcgggtgccagcgtcttcgacgcaccggcctgtccccaggacgaggccatcttcgccgcgctgggcggggagggcgcttcgcgcctggctgtcatcgccatccggagccggggccaggcggtggcgttcatcgtcgcggaccacggcgcggagcccatcgccgcgctcgcgctcgatgaactcacgcgcatcgcgcagaaggcctccgaggccttctcccgtcttcccacccggagcgcctgagcgcgagccggaggaggggagacgcaagaagggctccagagccaggtgctccggagccctcttcacttcaagaacggcgcgtcgcgctcaactgcagccgctggtcgcgccgcagttgctgcatttgtagcaagcaccgctgcgcaccatgatggcgccgcaggtgtggcacggcggcgcgtccgcctgattcagccaggtggaccgcttcgaggtgttggcgtcggaccgctgcaccgaagccgtccgcgcgggcagggcttcccgcttcggctgcacgtccacccggtccagcaccgcgtcctcttcctcgctcggcaggaacttcaactccagccagcggaagatgtagtcggtgatggacttggcgatggggatgtccgggttgccggtgaagccgctgggctcgaagcgggtgtggctgagcttgtcgaccagcaccttcaacggcacgccgtactggagcgccagcgacacgctggtggcgaagctgtccatcagcccgctcaccaccgagccttccttcgccatgacgatgaacagctcgcccggcaggccgtcctcgtacatgcccaccgtcaggtagccctcgtggccgccgatggagaacttgtgcgtgatggagcggcgctcgtccggcagtcgccggcggaccgcgcggggctccggctggacggcgggggcgggctcgggggccacggtggccttggcggcgcgcgtgtccttcaccgtctccttcgacgtgttcagcggctgcgtccgcttgcacccgtcgcggtacacggcgatggccttgaggccgcgcttccacgcctccatgtacgccttctcgatgtcctccaccgtcgcgtccgacggcatgttcaccgtcttggagatggcgccggagaggaacggctggcaggcctccatcatctggatgtggcccatccagtggatgctgcgctcgccctgggccggcttgaaggcgcagtcgaacaccgggaggtgctcgggcttcaggtgcggcgcgccctcgatggtgtcctgcttgtccaggtagctgatgatgtcctgggactgcgtctgcgggtagcccagcttctccagcgccagcggcaccgtctggttgacgatcttcagcatgccgccgcccaccagcttcttgtacttgatgagcgcgatgtccggctcgatgccggtggtgtcgcagtccatcatgaagccaatggtccccgtgggggccagcaccgtcacctggctgttgcggaagccgtgctcctcacccagcgcgagcgcgcggtcccacgcgtccttctgcgcggcgaacaggccctggctcacaccctccggggcgatgtggtacgcggccttgcggtgcttgcggatgacgcccagcatcggctccgcgttcttcgcgtagccagcgaaggggccctgcttctccgccaggcgggcgctcatcgcgtaggcctcgccgcacatcagcgaggtaatcgcgccagcgtagttgcggcccgcgggtgagtcatacggcaggccggacgccatcagcagcgcgcccaggttggcgtagcccaggcccagcggccggtagtcgtggctgttcttctcgatgcgctcggtggggtagcgcgagttgccgacgatgatttcctgcgccatcagcaggatgtcgaccgcgtggcggaacgccgtcacgtcgaagtcgccatcgatggtgcggaagtgcatcaggttcagggacgccaggttgcaggccgagtcgtccaggaacatgtactccgagcacggattggacgcgttgatgcgcgccgtcgtcgaacacgtgtgccagctgttcaccgtggtgtcgaactgcatgcccgggtcgccgcacaggtgcgcggcctcggagatctcccggaacagctcgcgcgcctggtaggtgtccagcggctggccatcgcgcaccgaccgcgtcgtccaggtggcgtcatccaccaccgccttcatgaacgcgtcggtgacgcgcaccgagttgttcgagttctggaagaacaccgacgagtacgcctcgccgttgaaggacgggtcgtagccggcctcgatgagcgcccaggccttcttctcctcgctcgacttgcagcggatgaactcgaggatgtccgggtgctcggcgttgaggatgaccatcttcgccgcgcgacgcgtcttgccgccgctcttgatgacaccggcgaaggcgtcgaagccgcgcatgaacgacaccgggccggaagcggtgccaccgcccgccagcagctccttgctgccgcggatggtggacaggttgctgcccgtgccgctgccgtacttgaagagcatcccctccgtgcgcgccagcgtgaggatggagtccatgttgtcctccacgctgttgatgaaacacgcggagcactggggctgcgcctccacgccaacgttgaaccatacgggcgagttgaaggacgccttctggcgcagcagcaggtgcgtcagctccgcgtggaaggcctcgcggtccgcgtcccgcgtgaagtagccaccttccacaccccactgggtgagagtgtccaccacacgcgccaccagcttgcgcacgctcgtttcacgctccggcgtgcccggcgtgccgcggaagtacttcgacgcaacgacgttcgtcgccagcatcgaccaggacttcggcacctcgatgtccttctgctcgaagacggccttgccatcctcgccggtgatgctggcgctgcggtattcccacgccaactcatccgcgggatccacgcccggtgtcgtgaagaagcgctccaccgtcaagcccgtcgccgccacgcgcgccttgcgcccgccgcgccgctccttcccgttcgccgtggacttcgagctcagctctttatccatgtcgccaccctccgcgagttcactgtgagttctgatgcaaaatttgcaaaacgctaacgtcgcgagatcccgatggatccgatggatcagcccgacgtgaaacgtgggtgacatcagatcggattcgcgacgacgaagcaggggcgagcccggcccctcggctgttcttgggagatgcccgccagactgccggacgaggccatggatagactcctgtagcacctccgtcaaagattctatcgatacagcaaatggtgtccgtcaaaatcatacccaccatgaattgtgtacagcgatgaggtgggcgtccggtgtctgcctgcctgccctgctgctactgcgttcagcgagggagcccgatctagagggccgcgcctgccctggcaacacatgctttgcagtgcctgaatccagatggcgagccatgtattgtcacttcgagccaagcgagcgtgatcactgggagacgtttgctgtgagtctgtgcacgactcgggcgggggcaaccgtgctgatccgccaggggaggtggatcagccccgttggcggtccgttggtgaacgcggccatcgattttggtccgggcgcgcgttaggaggcggacatggctcctccctaccagcgccacgtcttcgtctgtaccaaccgccgcccggacggaaatcccaaggggtgttgcgcctccaagggagcggaggaggtccgcgccgccttcaaggcggagctcgacaagcggggcctcaaggggggcatgcgcgccaacgcggcgggatgcctggacacgtgcagcttcggtgtcgccgtcgtcgtctacccggaaggcacctggtatggcggcgtcaaggtggaggacgtgaaggacatcgtcgagcagcacctgatggaaggccgccccgtggagcggctgctgatgcccttctcccgcaagaccgtcacttcgggctaaagcaagcttctcggtattaacccgaaatagtcgacgcctgcctctgtctgcgtgaacccgcagacgagccgcgtggaacccttgtcgagaagcccggggcaggcctgcaccgggcttgggctcggcatgtgtccagcgcggcgaggagcacatgcatgcgtcgcagttggtgggcctctggcctgatcgccaccgccttgtccgtggctggctgtgattccgaagtgccgtcgtctcacgttcgggacatgacggcgttccaggatgcggccctggccgcggagtgggcagcgggcgtcgcgtactccgtgggaacgcgcgtcacctatcaagggcgcctctatgagtgccgccagccgcacacgtcccaggcggactggacaccggtggcggtggcctcgctgtggttggacctggggcccgcgggcggtggtgagccggacgcgggcagcggcggaacggacgcgggcacgggcggggacgtcaccgcgcccaccgtgggcttgagtgccagtgcctcgcgcatcatcgccgtggggccgctgagcctgacggccacggcgacggacgacgtgggcgtgacgcgggtggagattctggagaacggtgccgtcgtcgccaccggctcgcagttcagccgggccttcagcggttgggagcagaacggcacgtatgtctacgcggtgcgcgcctatgacgccgcgggcaacgtggggaccaccacgctcaccgtcgtcgtggagattccaggtgggccgccgccgggaggaaagcgcatcgtcggctacttcaccgcgtggggcatctacgcgcgcaactaccacgtgtccaacgtgcagccgtccaagctcacgcacatcaactacgcgttctccaacatctccggggatggacgctgcatcctcggcgacccgttcgcggacatcgacaagagcggcggctggcagggtgagtgggaccccggtcagttgcgcggcaacttccgcgcgttcaaggagatgaagcggcagaacccgcacctgaagctgctcatctccgtgggcggctggtcctggtccacgcacttctccaccgtggcgtcctcgcctgcttcgcgcgcggccttcgtgaagtcctgcgtggacctctacatccgtggccagtaccccggtgtggaccccgtcaacggcgagggcgtgttcgacggcatcgacatcgactgggagtacccggtcggcggcggcctgccaggcaacagcaacagcccggctgacaagcagaactacacgctgctgatgcaggagttccgcagtcagctcaacgccgtcaccacgcagacgggcaagccgtacctgctcaccatcgccacgggcgcgtcgccggacctgctggagaacaagcaggagacgaagaagctgtccgacgtgctcgattggatcaacgtgatgtcctacgactaccacggggccttcgagagcacggtgaacttccactcggcgctccatcgcgtcacgggtgacccgggcgcggccacgggcttctacacggatggctcggtgtcgaagatgctggcgctgggcgtgccgcccgcgaagattgtcgtcggcgtgcccttctacggccggggttggggcagcgtgcccaacgtgaacaacggcctgttccagagtggtgtgcccacgcgcggcacctgggatgacggctcgtcgggtctgacgggtgtgttcgacttcaaggacatcaaggccaactacgagcgccccggttccggttacacgaagttcttccacccggaggcgaaggaggcctacgtctacaaccctgccacgggcatctggattgggtatgacgacgtgcagagcatcaacgccaaggcggactacatcctgaacaagaacctgggcggcgcgatgttctgggagttgagcggtgatgacggctcgctgctcgatgcgctggcacggaagctgcgctgacccgggctgagcctttgacaggcattgtaagcgtgtcgtgaagccatacgccgggggacttctgttccccggcgtcatggcgttagggtttgccgcatgtccttcgcggcagccgtcctgctggtggtgctctccagctcttccgtggccgccgagccgtggaccgccgtcgtccgggtggcctccgacgaggacaccgccttgctcgtgcgagtgcgggggcagagcagcgatctgcccgtgcgtctcgaggtctcgtccggagcgccgctcggagaatttcgcgagggcccatggctcgcggcggaacggctggccgggcgccaccaggcccgcgctgtcctctggttcgtgcgagagggcagcgacgttcgcgtccaggtggccgagttcgacagccggcgtctgttctcccgggccgcgcggatggggcagtcgccaggctccctggaatggtccacgggggcggaggcgctggcgctggctgctcgctccgcacttcgcgcggtggaggccggcgcgccgctgggtgacgtggtggagttggcgctgccgcgacacacgtcgaacggcgaggggactgacaccggggtggggcatcgcatcgatgatgcggcctccagtgatggggccgcgctggggacgccctcgtccgagggcgccgacgttgcgctcgcggaggcagtgggctcggcttccgcgcgggaaggcgtgacgtcacctcgcgagggcccgaggctggcttcggccgaggagtacccagcgcgccagatgtggctcacgttggggggccatgccgcgctggatgggtacacgcgcacgggccaccagggggtgatggtgggcgtgggattgcagccgggccggtggcggctgcgagcgcaagtcctggccagtgtgccgacccggcttcgtgatgcccggacggagttgacgctggggcagcatgcggcgtcggtgtgggcggggctgccctgggcggcgtcggagcgattggatgtggaggccgggctcggcgcgggcgcggtggtcttcactcgccggacgcaagcgctgacggaggaggtggaggctgcacctccgggcacgatgttggccctgctcatgggccccgagctccgcgcccgctggcggatgggggcgcgtgtcggcctggaggcgagcatggccgcggaggtcctcctgggacggcccgagcttcgctacgccatcgacggaaacttcgtgtcacgcggtgcgggttgggccgtccgcccccggctggggttggcgatggtggtttttctttgagcgccgatgacccgattggcccggtgccgtcctccatggcggcaatgaggagctcgggctcacacgcagcggacccacgtcgtgcggcggaagaccctcgcatccaggccgccatccagggcgagcgagaggcaaccggcgctttgctgatggagctgctcccccgggttcgcaatctcgtgcgctacctggtgcgcggggatgtggacgtggaggacatcgcccaggaggcactcatcgccctggtgcgggggctgccgtcgtatcgcgctgaaggccgcttccaatcctgggcggatcgggtggtggcgcggacgacgttcgcatggctgaagcgctcccgaggccgggatgcccagcacgcggatgcgccggtggagctggtcgcggttccctctgaggatgccctgccggacgagtatgttcatcgccgtcacatggtgacactcctggatcggctttcgaatgagcagcggcatgcactggtgttgcatcacgtgctggagttgagcgtgccggagatttcaacggagctgggcattcccttcgagacggtgcgcagccggctccgcttggggcggacggcgctgcgctcgctggcgaccgcggagggagacggaggggaggagcggggatgagtgacttcagggaagagagggatgacgccctgaatgcgctggtcctgccgttggacgaaggcgtggggccggcccgacgcatctcccgggaacggtcggcgcggatggtgctgaccgcgctggaggcaggcgcgttggtgacgccgcccgcgccccggccactcggcaagcggccccccgtgtggttgatggcgggagcgctcctcgtcgcgggcgccgccgcggcagcggtctggaacttcacacgctcgagccgggcgtcgacgtcgcaggtggaatcggctgcgctcatggggcccccgcggttgggcacggagtcacgacggatcggcagcggagtggttgacgcggccccctcgcggttggatgccgtgtcagacgaggcttcgcccgaaacgccggtggtccctgccgcgtccatcgctgaagccgagccggcgcgtccgcgcgcgccactggcttccgtgaagtcggctgctccggaagacctcttgctcaaggccaatgcgctccgttccgaggggcggtggaaggaggccgaggcgctctacctacgcgtcattcgcgccgagccatcatcgctcgcgtcatacgtcgcgcgcgtcgcctcgggctcgcttcggctggagcacctgggggacgcgcgaggcgccctgcgccagttcaaggcggcgcttcgggtccagccgcgcggtgtgctcgaccaggaagcgcagcacggcatcgccgaagcgcaccgtgttctcggtgaccgagacgcggagcgcagcgcgctggaatcgttcctctccacccatcccgattcgccgctcgtgccgtcggctcgcgcgcgcgttcgggaactcaccgcgccatgaacaggcgatggacgttggcggtgctactggcggcgtcgatgggaagctgcacccgtggggacctggtggccaccgtccagtcgccggacgcaggacacgtgggctcctcggtggatgccggtgggcccgatggcggcgagccgcctgccgattgggaggcgtactgtgcggggcgcgggcctcccatcgtcgtcggggatgccgataccgattcgcaggtgtgcagtggacgtctggcggagcgaaccttccgtcatgcgctgtgcacctgcgaggggctcgccctgggtgcgtctttcgaaacggatgcctttcacggcacctcggagaggtatcagccaggaggcgcggggggcgatgtcggggtgaatggcgcgctgtcggccaatgacgcggtggcggtgggaggctcgctgaggattggcggtgcgggaggcgcccagctcgggcagacgttccgcgtgggtgaggcattgcactgcggtggtccgcttaccggcaacccagtctcggccaccgtagtgggagacgcccgcgtacgcggtgatgtcgcgttgcccgccttcagcgtcggtggcgtgctcatggttccagcgggccacgtactggggccggtggacgcggctgaggtccgtcgcgagcccgtggaccccgtcatcccctgtgcgtgtgatgcggcgtcccaggtggatgtctccgggctcatcgcccggcacgtgctcgacaatgacaacgtggccatcggcctcgacgccacggcgatggaggacatcgaaggcgaacgcgcgctggagctgccgtgtggccgcttccacctgacgcgcatcaccggcaccgggcgcgccacactcacgattcgcgcgcgtacggcgctcttcgtcgaggacgtcgtcgacctgggcgaaggactgtcggtggacgttcaggcacctggagagctggacttgttcctcggggggttctgtcgcggtggggggcccgctcacgttggggtccaccgccacgccttctcgcgtgcgagtgtacgccgcgggctcgaacgtgctggcgctgtccgcgggcagcttcctcgcgggcaatctctatgcgccccgcgccgtactcagcctgagcgggggcgccgaggtctttcggttctgtgttcgtccgtcaagtcgaggcttcggggccgctccgactgcactacgacgcggacattcgcgatgcgggcgccgagtgcatgggcgattgaggtgcacgccaccggccctgcgtatccgtgtcaggccgccatcgtttgttcgaaggcccggagtcccgcgtcacgcgcgcaggggcggcggctcgatgctcctgttcaccgccttatccggactgcaccccacgggtggctggtgacgtgtgtgtaggtctccagctttgcgccgttgttcgcgaaggggaggctgcacatgaagtgggaagtgaaggccggcattgccgggctgttgttcgggtccatgctggtcggctgcggggtggcgccggaacaaggagaactgggtggcttggaggacgtgacggcggagtcgtcagcgagcgccgagaccgggctcgatgcacatcgtggctactccacgccagtcgcagtggctcgatatgggcacgcggtcgcgtacggcgacggcaagtacttcgcggtctgggccgacgtgcggaccggcggcatctacggcacgcgggtgaagccagacggcaccgtgctcgacccgcggggcatccgcatcaacttcggcgaagagattgggcgtcgaccggccatcgccttcaacgggacgcacttcttcgtggtttgggacaccatcaacggagtggatggtgtgcgcgtgaagccggacggtaccgtggtggggccgatgtttttagcagtccagtcggacgaagtcttcgatccagcgcgagtcgcctgttccccgaaaatctgcctggtgacgtacaccgtcgccggtgacgactcctcgaccatctacttcacccgggtgtccaaggacggcgtcatcctctcgacggacgaccacacgctcaacgcctccaacaccttcgcggatgacgcgtcgtcgacttggaacaacagcaagaaggagttcctggtcgtctggtccgtctagcagggtggtggcccggagaacgccgatatctacggcaacagggtgaaggaggacggcaccatcctcgatggcgacggcttccccatctccacggaggagggcgcccagacgacacctgacgtggtgtggacgggcaagagctaccaggtggtctggaccgatgaccggaatgggaacccagacatctacggtgcgcgtgtgagcaagacaggcacggtgaaggatccggacggcatccccatctccaccgccgcgggcgcgcagaccgccccgcgcatcgcccaccacaatagcaagaccctgggcgtctgggaagacactcgctacgggccccacagaattttgggggccccaaagggcgagaacgggaacgtgtgggacccctcgggcttccctatttccagcgggttcctgccacaggagtacctgccggacgtcgccttcggggctgacaagttcttcaccgtctacgccgcccaggccgtctacgacccctccgagccgcacttcatcctgggcacgcgggtgacgcaccaggcgcaggtgaaggacgtgcctgccttgccgctcacgcgccagcgctgagccgttgagggagagggcatcgccgcgtgcgaggcggcgttcc

SEQ ID NO: 1121 - DNA, 15338 bp, Myxococcus xanthus
aatttgaaactggtttcccgtcatcgacgggaagctggggtggcgccgatcatagtccgcctcatagcgctggaccaccgccgcatccttggcgagccgtgcctcgccgaacgacgagtacgtcacggagggcttcgtcgcgacacatgcgcccaggaagagggcggcaacgaggacagcgcagcaggatttcatcgacatgtgcctcacgagaaagggaagggcgcggaacgctacaccggcttgctccctgttcgtcgagaccacccctgctggtgatagggccacaggtggggcgcgcaagccccacctgtcccaggggctactgcgcctgcggcagcggcgaccagtccggcgtctggtacgtgcccttctcggtgcgcagcgggagctggttgttgccgtccgccgtcatgacgtagagctgcgagccgccattgcgcgtggacgtgaagacgatgagccgcccgttgggagagaaggcgggctcctcgttgctgccctggtcctgcgtgaggcgcgtcaccttgcccgtctccacgctgacggtgaagaggtcgaaggcgttgcgctcgtcgcgagcggtgaagacgatgaggtctccgcgcggcgaccagtccggcgtctggttgtagttgccctggaaggtgagccggcgcacgcccgtgccatccgcgttcatgatgtagacctgcgggctgccgccccggttggacacgaaggcgatgcgcttgccatccggcgaccaggtggggctggtgttgaggccgtagggcgtgtcggtgagcgcgcgcgcgccgctaccgtccgcgttggccacgtacacctgggcgctctcgccctccgccagcgagtacgcgatgcgcttgccgtccggggagaaggccgcgccggtggccatctgcccaccggagatgacggccttcgcctcaccgccgggggactgcacgtagatgtccgggcgattcttgcggtacgtggtgaaggcgacctgcgagccatcctggctcagcgcgggcaggatgttgatgccgcccttggtgagcgcccgggcgttgccgccgtcccagtccgccacgtacacgtcgcggttggtgcccgccttgcgcacgtaggtgatgcgggacaggaaggggctgggctcgcgagtgaagtgccggtagagcgcgtccgccaggcggtgcgccagcagcgaggcgttgtcggcgggcgcgtccttggacaccttcaggtcctcgcggccggtgcccacgttgaacaggcgcagctccccgcgcagcacgccgccgtcctgcgccagcgacaccttcacgagcgcttcggcgcccacgtccgcccagcggctgaagttgatgctggccgcggccatgccttccttcgcgtccgccgtgaagcccttgcggtccagcacctggaggatgccggaggcggtcaggtcgaagctgaaggccgaatcgaagggcgccaccaacgccttcgcgccgtcgttctgcgtcaggggcgcgggcaccgccacgggcagtgggcggaagttggcgccggagatttcgatggtgggcgcctgcgcgagcgcgacgacggggaggaggagcagcagggagaggagcagggctttcatagggcgttgaacaccaggttgacgccgctcttctgcagggcgttccggagatggtccggtggaggagaaaagggcgcggccttgcgcacgtccgtgacgacggccgagtcgaagaggtcgttcccactggccttggtgagactcacgtccagcacttcacccgtgcggctcaggcgcaccgccaccatggccttgaggtgcagccgctcggattcgggtatggtgtccgccacgctgtagtggcggcggacctgcgactggagcaggccgaagtagcgctcgccttccgcggtggccgagtctccgtctgggtcgccgtcctcggcgccctccgcctcctcgggctccgccgccttggccgtcttgtcgaaggcaccgaagagccgcttgcgccgatcctcgcccgtcgtctcgcccttctgcggcgtgggcttggatgtggagggctccggctgcacacccgggatgggcaccgccaccttggcgggggagggctccgggggcggggcctccggagcgggcttgggcgcgtccaccttcttgggcggcggtggcaactgctccttgcgcggcagcagcttggagtcgcgcggcttgcccaggcgcaccagcgtggcgcgaatgggcttggtgtccaggtccaccttgggcgtggcggagaagcgcgcgtacgcaatcgccgccaccagcaccaggatgtgccccacgacggacaccaccacgaagcgcgacatccgcgtggagcgcgtgacgagcaggctgtggcttaccgcggagggcgtcatgggctagcgcttcgcttccttcgacttgcctttgccggtgttggacgtccgacccgcggtcgacgggtccgtgatcatgcccacgttgccaatgcccgcgcgctgggccgcggccatgacctccaccaccaccccgtacggcacgtcccggtccgcgtggagatagacttccttgtcggcctgcgccttggcgttggcggcgagcttctgctccagctcctccagcgccacttccgcgtcaccgatgtagaccttgcgccccgcgtcgatggagaggaccagtttcttctccgtggcctccaccggcgcggccttggtctccggcaggttcaccttcacgccctgctggatgaggggcgccgtcaccatgaagatgatgagcagcaccaacatcacgtccaccatgggcgtgacgttgatttcgctcatggtggtgcggccaccgccgcggttgcctccgcccattcccatggtggcccccggctaccggaagaagtgacgcttgatgatgttgaggaagtccgcggagaagttcgacatctccgtgtcgaacaccttgatgcggctgacgaacgagttgtaggcgaccaccgccggaatcgccgcgaacaggcccgcggcggtggcgaagagcgcgttgcccaccggcgcggccaccgtggccagcgtcgcgttgccctgctcggcaatctgattgaacgcgctcaggatgccgatgacggtgccgaacaggcccacgaagggcgacgccgcgcccacggtgcccaggaaggacacccggttctccagctcggtgatttgcgccgtggaggcccggtggagcgcgcgctccacgttctcgatgccgcccagccgctcggccagcgcgccttcggtgccgccctccttggcttgcgccagcttggtcagctcttcatagccggcgcagaagaccttcgacagcggcgagccgtcgagcttctgggccgtctggtagatggcctccaggcgcgaggccttccagaaggtgtcgaggaaggtgagagactgtgcgcgagccttggcgagctgggacgccttcatggcgatgagggcccaggaggccacggatacgcccatcaggagcagtaggactgccagctcgatgagggaggcgtcgcggatgatctccacgtagttcatggcgccaagcgccaggggcaggtggggcgtcatggggagcagcgcgtaacactccgataagacagggtcaaacaatggggaaacggttgcttgcttgagctggattgcccagggcggtgaataattcccgccgccgcccgtcggatggggcagaagcgggccgaacacctcactgccccaccgacaggtgccccatgaactcccggttgctggtcgcattcctctgcttgtttgcgatcctccctggctgtgtcgtccatgaagagccgtgctgcgatgtgccccgctacgagggggacgtgaccttccgctggagcttcggtggtcagcgctgcgacgatgtccgcgcggtccagggcgtcaacgtcgtcatccccggcgaggtgctggccaacgacggccgctacaactgccaggcgaacggcttcgacggcatcgtcctccaccgattcgcgccggggacctactcgttccgcctggaaggcgtcggctacggcaatgagttgctgtacgagacccatggaaccttcaccgtggacggcaacgtgacggtgaacgtggacctgaccccgacgggcgctccgccgtccttcgcctacctgagctggctcttcccgccgaacagctacagccccagccccaactgcaaccaggcggggatcacccacgtcgaggcgagcgtggatggcggtgactgggcgcgcttcgagtgctgggaagggcacgccgccaaccagattcgcacgccgtacctggacccgggctaccacgggttggagctcgtcgccgtcgataggaatggcctgccttggtactacttcgggggcgacatcctcacccagttggggcagccgacctcccacaccgggtcgatgtgggccattggcggggcctctgtccggtgggagctgcgctcgcgttacgggaaccgccagacctgctacgaggccggcctgcagcgcgtgggcatcaacttccgagacatccacaccggcgaactggtgtacggcgacgtcggtgactgtcacgactgcgtcgatggcccgaatgaaagctcggtggtggtgtaccagttcctgcggcccggccgttacgtggtggagatgtacgccagcgctcgcgacggtcgcgagtacttctcgccgaacaactcgcccgtcatcgacgtggtcgcccaccagttcccgggcccgaactcctcgctgccggtgtacctcatcgaggactgagcgcggcaggtcggctaggcagtgaggggagggccgggatgatgcatcccggcccttcgtgcgttcagcggggctgacgctggcgctggcatcaaacgtgatagggacacgctccatgcggcaaggcagccacagtcccattggtgtcttcgattcaggcgtcggcgggctcaccgtcctcaaggccctcatggcccggctcccccacgagagcacggtgtatctgggggacaccgcgcgggtgccctacggcaccaagtccggcgaggtggtgacgcgctactcgctgaagaacgcggagtttctcctggagcgcggcatcaagctgctggtggtggcgtgcaacaccgcttcggccgtggcgctgcccgcgctggaggcggcgctgccagtgccggtggtgggcgtcatcctccccggcgcgcgggcggcgttggcgcgcacgcaggggggcggggtgggtatcatcggcacacccggcaccatccgctcgggggcctaccagcgtgcccttgagtccgcggacccgcgggtgcgggcgaaggcccgcgcctgtccgctcttcgtgccgctggcggaagaggggtggaccacaggcgacgtgcccctgctggtggcgcgcgactacctggccgagttcacccgcgacggcgtggacaccctggtgctgggctgcacgcactacccgctgctcaagggcgtcatcgcggaggtggtggggccccaggtggcgctggtggactcggcggaggccaccgcggacgccgtggccgcgctgctgtcggagcgggatggactggcgccggcgtcgcgaggcacgccggagcacgcgtactacgtcaccgacgtgccggagcgcttcatggaggtgggggcccgtttcctgggccggcccatcaccgcggcggagcaggtggacctgaccttctgacgggggcgcgccgcggacgcacgaacgcccgccgcggcaggccgggcgggcgttctggtacggcggaggactacgggcgcgtggaggcgggcttctcctgcacggtggcctgggtgagcagctccttggccgcctggaccaccggggcctcgctgccacccgcggcgaccaccagcgcgcgcgccgcctccgcgccgatgtcgtcctggcgcggcagcaggcccgtggcccaggtgatgagccgctcggcggtggggaagaagtggaccatcgtcagcggcttgttcatccagcccacggtgatgcagtagtacttgttgtacggcttggtgtggtgaatgcggtggtggtcggggggcaggatgaggtgcacgcgctggaggaagccgacgagcgcgggcggcgagtccatgtgcgaccacttgtggaactggttggtcgccatcacccagaaaatcatcgcgcctagaaaggacgcgcagaacacccagcccgggccgctcatgggcaggcacagggcgatgatggccaccggcagggagatgaggcagttgttgccgttggtctccacgaagtcgtggcgggtgatggccttctcgtccacgtggtgctcgcggaaggggcggatgagcgccttgcccagcaccggcatctccgtggagccccacgtgtcgcccatccagtggacgaagccggagacgaagtccgcggcgaggtagcccagcagcaccgcgctgagcagcagccacgtgccagcatagggggtgccccacagccggtacaccagcgccacctccagtgagacgaaggagacgatggcggcaatctccatcgcgcggatggcgggcgagtacccctgggccagcacctgggcgtcttgctggcgcaccttcttttcaatctcttgggtcttcatccgggcgtcctcgccgttggtgggggtgtcgagaaccccgtccgtcagcctgtacgtatcccagccgctttcagcttttcaacggaactgccgggcaatcgccgtggcctgcacggttggtgggccagggagtcactcgtgtgcgtgtggcaccacgaaggatgcgagcaggtcacgcttaccttgtgtcgtgcggatgcggctgctacggtccgcgacttcggcgatgacgaaaaccttcgaaaaagccgtcaccggcttcaatcacaacatcaagcacaaggggaaggtctaccacgtccagactgaggactcgggcgtcaacaacccccacatcatcacccacctgttcgtgggcgggaacatcctcgcgtcgaagaagacgtcctacgcggacatcctcaacgcggagaacctcgcggaggtcgtgcgtgagttgatggaggagcagcacaaggagatgctgcgcaacctcatcaacggggtgtacgacagctacgagtccaccgcgcgcagctaccagcccggtcagctcgcggcggacacagacccggcgcaggtgaagctgcagcccggccagtccatggtgcagcggccgcctccgcctcctcctcccgtggcagtccccgcgcctgtggtggttcctccggaggtcgccgcggcgcgcgccctcaaggagaagccgaagatcaacgagattggcgtggagacgctcttcggcgaggacctcatctccgagaagagcctcgacgaggtcatcctcagttacctggcgggtgagggcgagcagtagccgcccacgcggtcttccggatgtgggcgcctggcgtgcccgtccggacatgtctccagggcttcgtacggcctgggcgagtgggcaggagtccctctcgcggggcgtgcgtgggggatgccgtccgggcgtggtaggttggcggccttccgctcgccgccatgattcagttcttccacgtatacaaggcgtatcccggcgacccaccggtgttgtcggacatcaacctcaacgtggagaagggcgagttcgtgttcctcacgggcccttcgggcgcggggaagacgacgctgctgaagctcatcttctgcgcggagaaggccaccaaggggcagattctcgtgggcggccgcaacatcgcccgcatccgtgagtccgcggtgccgtacctgcggcgcaatatcggggtggtgttccaggacttcaagctgctgccgcaccggacggtggaggacaacgtgtccttcacgctggacgtgctgggtgtgccccgcgcggaggcgcgcgagaaggtgcggcgcatgctcaagctggtggggctggagcacaaggcgggctcgttcccgctgcgcttgtcgggtggagagcagcagcgcgtcgtcatcgcgcgggcgctcgtcaatgaccccaccatcctcctggcggacgagcccaccggcaacctggacccggcgctcaccgtcgaaatcatggacctgctcacgcaggtcaacgtgcgcggcaccacggtaatggtggccacgcacgacgcgacgctgctgtcgcgttaccagaagcgcaccgtgcgcctggagcgcgggcagattgtgtccgacgaggacggcgtcaaggcggcgcgccggatggtggtatgagcgcgctgtcgaaggtgacgtacttctgccgctcggcggcggtggggctgaagcattcgcccttcgtgcacttcatcgcggtgacgaccatcgccatcgccttgttctccgcgggcatggcccggggcgcggcgcgggtgctggacaacctcctggcgtcgctcggcggcgaggtggaggtgacggtgtatctgtcgccggagctggacgcggacgaggtccacggggtgcgtgccctcgtgctggcgctcagcggcggtgaggtgacgctggtgtcgccggacgccgcgctctcacggctgcgcacggagctgggcgacctgggcgaggcgctggcggaactgccagagaacccgctgccggtgtcgctggagctgcgcgtgccgccggagcggcgcaacccggacgcgctcctggcgttggcgaaggcgctgcgagcggcgcctggcgtggccggcgtggactatggcgaggcggcggtgcagcggctgtccgccatcgcccgggcgctgcgcttcggttcgctggtggccttcgcggtggtgctgggcgccaccgtggtcatcgtggcggcgacgctgcagttggccatctattcgcggcgcggcgagattgaaatccagaagctggtgggcgccacggaccgcttcgtcaaggcgcccttcctgctggagggactgctccagggcgtgttgggcgcggcggtggcgctcttcgggctctgggccttcggccgggtgctcgggcccacgttgggcgcgctcttcgcctttctgttggggcccggcgtcgcggcgccgtgggtggagccccggctggcgctggagctgctgtgcgctggctgcggcctgggactgggcggcagcttcgtcgccgtggggcgcttcctccgcgtatgagccggcgcctcctcctcctggcactggggctgtgggcctcgacggcgacggcggctcaggcgacggcggccgaggaggccgaacaggccgcggtgcgtgagcggctgagcgcgcagcgcgcgacgctggcgctggtggaggcgaagaagctctccgtgctggagggcgtggagctgatgcaggagatggccgccttctcccgccggcgcgtgcgctcgctggaaggggacctggcggtgttccgccggcgcgtgctgctggcggagcgcgagcaggccgtgctggccgaggcgctgaagctgcaactgcgccggctgtctccgcgcctgcgcacgttgtaccgcctgatgcgccgccgcccgctggaggtgctgctgtcggccgaggacttcgccgcgctggtgtggcgcgcccgggcgctggaggccagcatgtccggcgacctggagctgctgcgcaccgtgcagcgtgttgcgcggctgcagcgtcaggcgacgcgcgagctggagcggctccaggcgtccctcgccgcgcgcatggccttcctccaggagcaggagcggctcgcccgcatgcagcaggaagggctggaggaggtggtaggcacgctcgcgggcgaggcggagctggcccggcgcgcggtgcgcgagctggagcaggccgacgcggagctgacgcgcatggtgcaggacctgaaggagctgcccgcgacgagtggcttcggcgcgcttcgaggcaggctcccccggcccgtgtcaggcatcgtcgaggtgggcttcggcaaggtcgtcaacccgcgcttcaacactgtcaccgtccagaagggcctggacatccgcgccgccgcgggcacgccggtgcgggccgtggccgagggcaccgtcgcctacgccggcgccctccgcggctacggcaacctgctcatcctggaccacggcgacggctaccacaccctcatggctcacctgtcctccattacccccgagctgggcggcgtggtgctccccggagatgtggtgggcgaggtgggggacactggctccctcaagggggcctacctgtacttcgaggtgcgcaaaggcgggcaggcggtcgaccccgccctgtggctggttcccgggtcctgacgcgttgcagcaagttcgcggacgcgttgttattgtcgtgggacccttctgcgaggagcaggcgagcgcatggacctgatgggcggaatgcaaaaggcgctgcggcacatgctggtggcgcgtggtgtcgagtccacgacagtgcaggtcggtgcccagacggtgcaccactacgcgttgacggggcagggcaaggggccacccgtggtgctggtgcacgggctgggcggctcagcgaacggctttggacgcacgctcttcgggatggcgaagcgcttctcgcgcgtgtacgccccggacctgccgggacacggattctccgtggagtactgcggcggcgaggtctgcgtgcgcaaccagttcgacgtgctgcgcgcctatgtggaagaggtggtgaaggcgccggccttcgtggtgggcaactcgctggggggcgccatggcggtgaacctggcagcggagtaccccgaatgggtccgcgcgctggcgctggtggctcccgcgggtgcgcagttgccggaggcggagaacaccgcgctgctcaactcgttcgtcgtgaagtcccccgcggaggcgcgtgccttcacgcggcggttgttccaccgtccgcccctgcccgcgctgctgttcgcctacgagctgcggcacttctacgacacacccaccgtgcgggcgctgaccgcggaggcgctggccacgcgcgcctgcctggagccggagcaggtgcgcaacctggccatgccgctgctgttcctgtggggcggcagtgagcggctgctaccgtcggagacgctgaagtggtaccgcgcccacctgcctgcccatgcgcaggtgcgcgtggtggatggcttcgggcacgtgccgcaattggagcgtccggacgagctggtgtcgcacctggtgcgtttcgccgactcggcggagctgtgagggccgggtagactggtacgagccttccggggccgccccgggaaaggacgtaccgacgtgacgggttcctcccagccatggcgcgcggcgctgaccgccttcttcctcctgagtgctccgtgggcgcatgccgcggagccgctcaggaaggacgcggggacggcgggccgcgcggagcaggccgagcgcgatgacgccacgtaccggcagctggaggtgttcgcgcgggtgctctcctacgtggagaacaactacgtggagtcgccggaccgccagcggctcatgtacggggccatccagggcatgttggagacgttggatccgcacacggtgttcctcccgcccgacgtgtaccgggagatgaaaatcgacacctcgggcgagtggggcggcctgggcatcgaaatcgcgcgcaagggcgagcgcattgtcgtggtggcgcccatcgacgacacgcccgcggcgcgcgcgggcatcaaggccggcgatgagctggtcggcatcgacggtgagcggaccgagggcatggatgtggggcgtgcgctgcagaagatgcgcggcccggccggcgggcgcgtgctgctgaccatcatgcgcgagggcttcagcgcgccgcgcgaaatcgccatcatccgggaccacatccgcatcgtgtccgtggagggcgcgctgcatggtggcatcggccatgtgaaggtgaagaacttccaggaccgcaccgacctgtacctccgcaaggagctggaccggctgcgcgcgctcaacggtggcaaggagctgcgcgggctggtgctggacttgcgcaacaacccgggcgggctgctggaccaggcggtggcggtgagcgaccggttcctgccgggcaacctgcccatcgtctccacgcgggggcgggatggccgaagcgccaccgtggagcgcagcaaggaccgcgacacggagaaggactaccccgtcgtagtgctggtcaacgcgggcagcgcctccgcgtccgaaatcgtggcgggcgcgctccaggaccatggccgcgcgaccatcctgggcgcgcccaccttcggcaagggcagtgtccagacggtcatcgagttggaggatggctccgggctgaagctgaccatcgcgcgctactacacgcccaagggccgcagcatccaggagcgcggcatcaccccggacttcctcgtccccgacgagccaggaggcaaggtgccgcgcgacgtggtgcgggagaaggacttgcggcgccacttccgcgccgagccgacggcggcgaccgagccggccgcgccggagcctcgagggctgccggagaatctcaagccctgggacgtcaccgcgaaactggaagactatgccttgagggtcgccctggactatctccacggaatggcatccgctcccgcgcgcactccatcccgggcagcgggtcgttgaggactccttctcacttgcatttcgccgtgcagtccgtttgatgcgcaacgggcaaaaggtgaacgagagatgcgaccttcgaatgtgcgagcggttcacgccgcgttgagtggatggctggtgggactgctggccgtgggacccgcggcggcgcagacgccggtgtcctcgcggctggtaccccgggccttgagcgcggcgacggcggacgcgccggccgatgcggcatcggtcaccgtggtggccattgcgttggacgcggaggcccgtggcgacgcggcccggctggcgcgcgaggcggagctggcggtgacgcgctcggggcggctgaagctggtgcgcctgtcggacgcgctggacgcggacgggcaacgcgagcgccaggcccgtgaggccgaggccgccgaggcgatgaaggcgggccaacgcgcctacgacgagctcgacaccgagaaggcgctcgagcacttcgacaaggcggtgcgcggttacgagggcgccgacctctcccagcgcttcaccgagctgagccgcgcgcgggtgatgaaggccgcatcgcaggtggccaacggtgagaacaccgccgcgcagttggagattcgcaccgcgctggcgctgaacccggaggcgcgcttctcgcccaacttcttcccaccggaggagatgaccttcgtggagaaggagcgcaaggcggtgctcaccggcaccaagtccagcctgcgcgtgagtaccgagccggtaccggcccaggtgttcgtggacggccagttccggggcatctcgccggtggacgtcgccgacctcacggccgcggaccactacgtgacggtggtggcgccgggctacgcgctgacgcagcgccgggagcgcgacggcgaggtcagcctgacgttggcccccgtggcggcgcagaagggcctgcagacgttcaccgagcaggcggcgcgcaagccggagagcccggagcgcgacgcggccctgcgtgagctgggaacgctcgcgggcctgtcccaggtgctggcgctcctggtgctccgggtggcagggaccgcgccgctggaggtgacagccctgcgcctggacgtgtcggatggccacaaccaggccttcgcgctgggaacggtgccgcgcggggaggggctggtggatggttcgcaggcgctgctggcgcagttggtgtcggcggatgcgccgcgccagggcggaaagccggtgacgcacttcgcgggtggcgtcagcaacacgcgccgcaccgtgggctacgtgctgatggccaccggcgtggcgctgctggccggcggcgtctacttcggcatggaggcctccgcgaagtcggatgacttcaagcgcgcggcgcagaacagcagccgcgcccaggacctcaagagcacgggcaagtcgtacgcgctggtggccgacgtcggcatcctcctgggcctcgcgtcggcgggcgcgggcggctacctggccttcgccaacggcggcggcggtggttcgaagtcgacctcccgcgcgagccgccccgcgccgtcgcccgtccccgcggccgcgccgcaggacacgcctcccgcaccgaaggaggcccccgccgcggagaaggagccgttgcccatgcctccgccccccgcgcagacggcgcttgcctcgaagcagaaggagcccagcacgtccaacaagcgcgcgcaggaggacgaggcgcgccagcgcgaggaagagctccgcaagcgccgtgaagaggtggagcgccagcgcaaggagctggaggagcggcgcaagcaggaggaggccgcggcgcagcgcgagcaggaagagcggcgtcggcaggaggagcggcggcgagaggaagagaagaagaagcggcccgcactcgacgatgacgatctccggaactactagccatgcgccgtcccttgcgaaacctcgttgctttcatggccctgagcaccgggctgtccgcgtgcagcctcctcgtcgacttcgacgaggaagggcagccctgcgatgagctcaaccagtgtctggagggctacacctgcgtcgacaacgcgtgtgcccccgacgacggcgcgccgtccgatggcggctccgatgcgggcaccgatggtggcctgaacaccgacggtggcctgaccacggattcgggaacccttgacccggacgcgggctcggaagagctggacgccgggctcccggacgacgcgggcaccaccgaaccggggcccgtcctggagccggagttcccggccagctgacctgcctcacccgaggtccgcggctcgcggcgtggagacggagcggcgcctgacgcgggccgcccgctccgtggcgccccggccacgccgcggcccggaggacacgcctgctcttcgcgcacggcgtggctgaagtccctcacccgaggcggtttccgagggagaccgtcccgctccgcccaccgccgcgtggctggcatcatccatgctctgtgctccgcccaggaggcaacatcgacatgggcaagcgcgtgggagtgctgatgggcgggtggggcgaggagcgggagatttcgctcaagacgggagaggccgtggtggcggcgctcgagtcccggggccatcaggtgacccgcatcttcgcggggccgggcctggaccgggcacttcgcgccggccgaactggacg

SEQ ID NO: 1122 - DNA, 17173 bp, Myxococcus xanthus
tgttcatcgtgaaaggtgactccgcaggcggctccgccaagcagggccgggacaggcgcacccaggccatcctcccgctgcgcggcaaggtgctcaacgcggagcaggcgtccaccgacaaggtgacgacgaacaaggagctccaggacatcgtgtccgcgctgggctgcggcatcggctccgacttcgacatcagcaagctgcgctacggccgcgtcttcctgctgatggacgccgacagcgacggccaccacatcgccacgctgctgctcaccttcttctaccggcacctgcgcccgctgattgagagcggcgccatccacatcgcccagccgccgctgtaccgcgtggacatcggcaaggagacgtactgggcgctggatgagccggaccgcgaccgcatcatcaaggagaagacgaagggcaacgccaagcccaacatcatgcgcttcaagggactgggcgagatgacgcccgacgagctgaaggagacgacgctcgacccgaagcaccgcatgagcctgcgcgtcaccatcgacaagcccctggagacggaccggctcatcaacgacttgatgggcaaggacgtcagcgcccgcttcaggttcatcatggagcgcgccagcgaggtccaggacctggacgtctagtcaggacggaatcaccgtcgcgggtccctcccaccccggaggggcccgcgcgcagcagggcttttgagacggagccccggctcggctagcattcgcgccgtgactacgttccgccgaacctccctgctcctcgcgttcatgctggccacctctcccgcctatgggcagtccacgcggaagaagaagtccagcaagaagccccccgccaccactcagccggtgaagacgaccaaggcgcccgcggcggacgacgcggatggcgatgaatccgtcgagccccaggctttcggttctccgaacggggacgaggagacggccgtcacgccgctggtgtcgccggacgctccgaccgtggccaaacccgcggcggcgccaggtgcctcgggtgagccggcggtggccagcgcggcggtgacggcctccgggccggtggcgctcttcgcggtggctcggacgtccgcggaggaggatgccgcggtgaagctggaggacgagctgctgagccggctcaaggcgagcggcgtggcgctggtggacctgggcgcggccttcccgccgtccccgccggtctcgctgacgcgcgcggacacgctcttcgagcagggtcgcaccgactacgacaacctggaccccgagtccgccgaggcgaagttcctggcggcggcggaggcctacacgaagcacccggcggagctgagcccggagcggctggccaaggcctacctgttcctgggcgcctcgcggatgctcaacggcgactccaccggagccctggacgcgttcaagcgcgcggtggtggcggagccgtccacgtcccccgacgccgccctcttcgggcaggacgtgctgaagaccttcgaccaggcccgcgccgacgtgaaggcgcgcccggccggcacgctggtggtggagtcgaagccggcgggcgccagcgtcctcgtgcgaggccaggagctgggcgtcacgcccctcaagggcgtggagatgccggcgggccagcacccggtggtggtgtccctgcccggctactcggccttctcccagtacacagaggtggcgtccgccaagagcaccgaggtgaaggcgacgctggagcccaccccgggcctgtccgccgtgcgtgacgcggcggtccacgccagcacggaacaggccttcgagcgggacacgccgccgcccgaggcacgcgccattggggagcggctcaacgcccgttacgtggtgctggcggcggtggctcgcggggacaagggccacctccaggccgagctccaggcgtgggacctgcgctccaacgcgcggctgcgcggcgtggagattgccctggcgccgggcgcgaagaagaacggcccggacgcggcggcggaccaggtgcgcgccttcgtcaacggcgtcgcggcgccccgcgtggcggagagcaattcgttctccaccctcatcaagcgcccgtggttctgggcggtggtcggcggcgcggcggcggtgacggccggggccgtctacgtggcgacgtctcaggacaagggccgcccgttcaaccccgtttctggtggagtcgggttctgaggcagcgccgcgtgttgaatgcccggaccgccacccgcgtcgcctgtttcaaaggtcaccccatgaaatccgccctcgccctcctcctcctccccgcgctgaccctcgcggccccgccccaggcgcgccgcgtcagcaccctcctggtgcccatggacccggcctccgaggcgtccagcgtgcagatggagggttacatgaacgacgccctctccaacttcgccggcatgacggtccgcaagtcggaggagctgttcggcatgccggaggacccggaggccaaggcctccctggagcgcgggcgcaaggggtactcggagagcctctccgccttcgacaagaaggaatacgaggaggcggagcgcaaggtgcgcgccaccctgaaggagcttcagggggccgcgggcgccatgcgcgggtgctcgccgctgtgtgacgcgctggcgctgtacgccgccgtgctgcacctgcgcggcgaggtggaggaggcgaagctggcgctcatcgacctcatcgcgctgtcccctacccatgagctgtcccccaagcgcttctcgcgcgagttcctcgccctgcgcgtgcaggtggccaccagccgcacgtcccagctacgcggctccgccacggtgaactcgcggccctcgggcgcgcgcgtgtacgtggacggcgaagtcgtgggctacacgccagtgacgctgcccgcgctgcccattggcaagcacctgctgcgcgtggagcgcccgggcttccggcagtacggacagttcatggaggtggccaccgacgacgccgaggtcaccgccaagctggtgcctacctctgcgtacaaggccttcgacgtgcagttggaccgggtggcgggcgaggtgaaccgcgccggtgagaaggcgtctggcgtggcggccatggcgcagtcgctggggctggaccgggtcatggtgggcacccttcgcgccaatggcgagggcaccgacctgacgctgggctactacgacgcgcgcaccggtcagcggctggcggggcggcgcatggccgtccagggcgatgagttcggccagttgaagcaggagatggagcgggtggtgaaccacctggtgaacaacatcggcgagaaggtgaccaagagccgggacccgctggacaaccgcgggggcatggaagactggtcgtccgaggaccggggcggccgtggcaaggcgcaggacaagaagagcaagcccggcgacgacccgctcgacggtgtgtccggaaccgaggactggtaacgctgagcgcttgtcccgggacggctgatgcctagagtcccggggcgtatgcgcctgctcgccctcctgctcctccccagcctcgcgctcgcccagacgagtgtcgtcagccagcccgccctgccctcccgggggctggcgctgccgcccacgggcgccgcgctggtggatgaagccaccgccctgtcgctgcaaccccgcgggcctgggcttcgtcaacggcagtcagctcttctacctgcacgagcgcaacctcgtgcatgacggactgggagacggcgtcttcctggccacgcgcctgctcggcctgggcctgggcggcgccatggagtggattcgcggacgggcggagccggactaccgccgcacgtccctgggtctctccctgggcacgcgcacgctgcagctcggcggttcgtggcacgcctacggttcatcccaccgggacatcgacgcgctggacaccttcgacgtgggcctcacggcgcgccccatgcgggcgctgtcgctgggcgcggtggtgcgcgacatcaacgcccccaccgagggcacgctggcactgaagcggcagtacaacctgggcgtgggcgtgcgcccgctggatgagcgctacacgctgggcgtggactggctcttctccgagggcgccttccgccagggccaggcgacgtacaccgtcaacgcggaggtgattccgggcctccgcctgggcgcgggcgtgtcgcacggcttcacctccggggtgcccatcgcgctccaggtggcggccacggtggacacctcgcacctgggcctcacctacgcggcgggcgggacgaatgcggggctggaccacctggtggcggtgcgcctgtcgtcggagacctaccgctccatcgcgccgcgcggcggcgtggtgacgctgctggacttgaatgacgcattgagcggcggcaccagccccgtcctctcatggttgggcgtcaccgaggcggacccgtacctgcggctgacgcggtggctggacctggccacccaggacgaccggctggccggcgtggtggtgaagatggagagcctgcccggggtgagctggggcaaggcggaggagctgcgtcaggcgctgctgcggctgcgcgcgtccggcaagcgggtgatggcggtggtgctgtccacggacgacctgggctacttcgttgcctcggcggcggaccgcatctacgcgctgcaggagtcgattctctacatcaacggcctggccgtgcacctccagacgtacggcgggacgatggagaagctgggcgtgcactgggacgtggcgcgcgtgggccgcttcaagacggccccggagcagctttcccgcaccgagcccagcgacgcgtccttggagtccacgaacgcctacctggacacggaggtggccgtctacgagaaagccgtgcaggagggccgcaaggtgcccgtggagcggctgcacgcgctgtgggcactgggcctgccccatccgaagcgcgcggtggagctggggttgatggacggcatcatctcctcgacggagctggacaagaaggtggcggagctggtgccgggtggacgcttcagcaccacgtacgcgccgcgcgacgagcgcgacggccgctgggcccgccggcgccgcatcgccgtggtgccggtgctgggcgacatcatcggcggccgcagccgcgaggacccgctgggcttcagccgcctcgcgggcgcggagacagtcattcgcgcgctggagcaggcgcagtcggacccgagcgtggcggccatcgtcgtgcgcgtggactcgggcggcggcgaggtgctggcgtcccacctgatgtacgaagccgtgatggaggcggccaaacacaagcccgtcgtcgcctccatgggagacatggccgcgtccggtggctactacgccgccattggcgcgcacgaggtgttcgccctgcccaccacgctgacgggcagcatcggcgtcttctacatcaagcccgccgtcgagggcctgctgagcgggctgttgggcgtgcaccaggagagcctgacccgcgcgccgctggcggacatcctggacgtgtggcgcccctggacgccggaggagcaggaggcggcccaggcgtgggcggacgcctcctacgacagcttcatcaccgaggtggcgctgcggcggaggatggacaaggcgaaggtggacgaggtcgcccggggccgggtgtggagcggccaggacgcgctcgcccgcggactggtggacaagctgggtggcctgctggaagcggtggactccgcgcggatgcgggccggaatccctccggacgaggagctggacctggtggtgatgggcgaggcgcggggcttcttctccgcgctgggcggtgagcccggggtgcgcgccgcgctgtccctgctgcccgcacaagagcccgccctgcctgagtccctgcgggcgctggcccgctcggccggcctgaatctgatgttgctccagccgggcgtgaaggcgatgttgcccttccagataaccgtccgctgaggtcctggcggcggccctgaatcaacaggtggggggtcggccggacgacaccgcgcgaaaaaagcggcggcgccgtccccggcctctgttactgttacccctgcactccggacggctttgggccgccagggtgctccaggaaacgacggttcggcctgctcgtcaccagggcccctattccgcttcctgtcccacggcatgagtcaccttgcgtccccgccctcctagtggagcggccgcccggggcgcacacagtctggaacgttcatgagcgaaaaccccgataaccgcgacccacgtgatgccccccccgttcccgccgcccgcgccgtggcgccgcccgagccggacgatgacggtggccacgagggcgacgacgaggggcccgacgacggtgattccggcgggggcgcacagggtggcgcccccgggcagcctggccaggccaccggccgccgccgccgccgtcggcgccgtcgccgtggcgcgcaggtcctcttcaccccggacggccaggcctaccggatgcagcctggagcggacggccagcaggtccaggtgttcctcacgccgcaggagctggagcagtaccgccagcgacaggcgcagcaacaacagcaacagcagcaaccaccgcagccggcgcacggcggcgggggccagcagcacgcccgccacgcgcagcacgggggcggcggccagcaggcctcgcagcaggcgaacctgtcgccggtggagggcgtgctggacacggaggccaagggccccaacgccttcctgcgccagctcaagcgcaacctgctggcggcgccggatgacccggagctgccgaagaatctggtccagaagctgcgcctgcggcagggccagtacatcaccgctttcgcgcagatgcggggccacaagggcgtcatccagaaggtggacacggtggacggccggccgctcgagggcgcgccgcggctgccgcacttcgcggacctgacgtcggtggaccccaccgagcggctcaagctggagaacggtcacaaggagatggtgacccgggtgctggacctcatctcgcccattggcaagggccagcgcgcgctcatcgtcgccccgcccaagacgggcaagacgatcatgctccagcgcatcgcccaggccatcctctccaaccacccagagtgccacgtcatggtggtgctcatcgacgagcgtccagaagaagtgacggacatgcggcggggcatcaaggcggaggtcctggcctccagctccgacccgccccaccgcggaccacctcaaggtggcggagctggccctggagcgcgcgcgccggctggtggagtccggcaaggacgtggtcgtcctcctggactcgattaagcgtctggcccgcgccttcaacaaggaggtcgacaactccggccgcaccatgaccggcggcgtggacagccgcgccctggagcgccccaagcgcctcttcggcgccgcccgcgcgacggaggaggccggcacgctgaccatcatcggcacggcgctcatcgacaccggcagccgcatggacgaggtcatcttcgaggagttcaagggaacgggtaactccgaggtcaccctggaccggctcctggcggagaagcgcgtcttcccggccgtcaacatcgcccagtccggcacgcgcaaggaggagaagctcttcaccctgcgcgagtacgagaaggtgaagaagctgcggcagatgctcttctccgtgaagccggtggaggccatggaggcgctcgtgaagcggctgtcccgctacacgtacaacgacgagttcctcgacgagctgtagtcccccgcttcgggagtggtacggcgggcccgggtgtgcgttaaggtggcggcatgattcaaggctcgggccgctgccactaccacccggagcgcgccggcctcggcgtctgcgtggagtgccggcgtgtcatctgccgggaatgcaccacgcagttcgagggcatcaaccgctgcgccagttgcctggaccagcgcctcaaggcgctggagggcccgggtgagcgccgcgagtggtcggcgggcaacgtggtgctggcgctgatgagcctggcgctcgtctttggcggcatcctcctgctggcccaagtggcggcgagctagcccatggccgtctccgcgctcgaactccgcccgcgcaacgcggtggccttgatggacgccgcgctgcgcctgtgtacccgcaacgcgggcgtctgggccctcaccctgcccggcggcgcggccgtggtagccgccatgttgtacctggcggagtcggtgcgcatgggctggccgctcgtggtgccttcgctgctgctgacgctggcgtggttcctccggggcctgggccagggcgcgacgtgccattacgtgcaggagctgctgctgggcacccagggcgagccttccgcgtgggcttcgctcaaggccgcgctggcccggatgcccgcgctcttcatcgccgtggcgtacctgctgggcctcaacaccctggtggtgatggtgacgggaggcttcggctacatcctgctgcagtcccacggggtgggctacgcggcggtgatgcaggggcgaggcagcccgctgaagctctacggcacgtgctcacggctgctgggacccgcgcgcggcaccgcgctgtgggtccgcgccctcatgtccgtgcaggtgctggccttcttcaaccttcacatcgccttcaacttcctgctgttcctgggccgcaagctggtgggcgtggacctgacgttcgcggagcgcttcgcctcgctggacaacggccagtggctgatcttcctcgcggtgacgacgttcgccctcttcgagccggtgcgcgccgcgacggccacgctgctgctggtggacgggcgcgtgcgtcaggaagggctcgacctgctggccagcgtccagcagcttccgtcccgggatttggggcgccccctgcctccgccgggagcggcgcgtggcgcggcgatgctggcggtggtgttgggcctgggcctgctgacggcggcgccggcccatgcccaggacaccgaggacgcgaagcccctggccccctccgaggcgctgcggcggctgggcgaggtcgcggaggcgtgtgaggcctcggcggatgaggacgccgcggacctgtacgcgcccctggagtccctggggcccggcgaagccgtgaagctggaccgcttcgtccgccgcgtggagcggcaggccttcgacgaggaggactgcgacaaggcccgcgccacgctgacgcaggggctcaccacgatgggcgccaccgtggacgcccaggcccgggcggatgcacgtgccgccaccgcgcgggcgaaggacatcctggcccggcccgagttcgcggaagccgcgcccaaggcggagaaggacgcccccgagcccgcggccccacccgagacgccaggctggtggcagcgcttcatcgactggctgggggagcagctgaagaaactgttcgagcgggagccggcggagtccagacagcagactgcgcagcccatcctaagcggcatgaatgtggccaacgtgctggtggtggtgctggtgacactcaccctcgcggtgctgggcatggtgctgctgcgggcgctgaaccgcgacaagcgccgcacggatgccgcgggagtgcaggtgtccacggtggacgcgtccacgctggcgggggatgcccaccacgcgctgtcacgccctcccgagggctgggcccacctggcggacgaactggcggcgcggggggcctaccgcgaagcggtgcgcagcctctacctggcgctgctgtcccggctccaccgcgacggcgccatcctctatgacgagacgctgagcaactgggactacctatctcaattccggggccgcgcggaatggaaggcccccttccgagagctgacgcggcgcttcgacttcgcctggtacggcaacctgccggtgggcgtggacggctaccgcgagttccgcgcactcaccgagcccctgctggccgcgccgtcacgcccggaggtggccggtgcgtgaccgtttcccgctgctggtggtggggggcctgctgctcaccgcggtgctgaccaccttcctggtccgaggcgcccggcgcaacacgttcgcggacacgctgtccacgtaccgcgcgcaggaggacggcgcgcgggccctgttcctgctggcccaggagagcggcttgccggtgacgcgccgcatggcggacctgcgcatcgtgtccggactgggcacgccggtgctgctggcggtggaggtgtccggcgcctacgaggacgacccggaccagacggcgctggccgccgagcccgacgcgggcctggccgacgaacatgtcccccgcaccggcttcaacgccttccgcgcggccgcgctggacgacgatgaaaccgagcaactgctgaagcacgtgcgcgagggcggaagcgccatctacgtgccgtggggctcacgcgagaacccggtgctgcaagccttgaacgtgaagctcttcaaggcggacaccacccttcccatgcgcacgctggtgccgccccagcccacgccgtacacgctgggcgtggagcgcgtggaggcgaaggtccaggcctacctggagctgccccagatggccgtccccgtcctggaggatgagcggctgggcatgttcgtggcggcggtggtgccgtacgggcagggccgcgtgctggtggtgggcgccccggagctggcgatgaaccaggccctggcgcgcgcggacaacgcgcagttctggctcagcgccctggcgtcaatcggccccggccccatcgaattcgatgagttccaccacggcttcaccaacgagcgctcggtggtggacttcgcgcgccgctacggcctgcacttcgcggtgttgcagttcctgctcggcgtggccctgtggtcggtatcgctcaagcgcttcggccgtccgcggcccccgcccgagtcctcgcgcgtgggcgccaccgacgcgctcttcgccatgggccggctctatcgcgagggccggcaccacggattctccgcccagctcatcctccggggcctcacccaggacctggccctgcatgcgggcctgcccgcgcatgcgtccgcggacgcggtgacccacggcctgcgcgagcgtggccgcgcggacctggcccaggggctcgaggagctcaccacggacagccgcgcggtgacgcgcgacacggacctccagcagctcgcagagcgcgcggcgcggctgcgacaacgccttcattccgccggcgccgcccggcccagccctcccgaaacgacatgaacgacaccctgtccgccccctcccccgccccggctggcaacgccgtgcaggccgctcacgccatccgcgaggccgtgctgtccgaggtgcgcaaggccgtggtcggccaggacgaggccctggagctgatgctctgtggcctcatcgccggcggccacatcctgctggaaggcgtgcccggcgtggccaagacgttgatggccaaggccctgtcgcgcagcatcggcgcggagttcaagcgcatccagttcaccccggacctgatgcccgcggacatcctgggcaccagcgtgttcgacctgaagacgcagggcttcacgctggtacgcggccccatcttcacggacctgctgctggcggacgaaatcaaccgcgccccggcgaagacgcagtccgcgctgctggaggccatgcaagagcgctcggtgtccatggagggccgcgtgctgccgctctccccgctcttcaccgtgttcgccacgcagaaccccgtggagtccgaaggcacctatccgctgcccgaggcgcagctcgaccgcttcctgctgaaaatcgaggtgggctaccccgcgccggaggaggaggacgcgattctggcctccgtgcaccggggcttcgactcgggggacctgcaacgcgcgggcgtcaatgccgcggtgacgaaggacgggctgctggccgcgcgcggcgcgctgaatgaagtgacggtggagccgccggtgctggcatacgtccgcaagctggtggcggccacgcgcgcctccagccgcattcgactgggagccgggcctcgcgcgggcgtgcacctgctgctggcggccaaggccctggcggcgctgcgcgggcgcggcttcgtcaccccggacgacgtgcgcttcctggcggcgcccgtgctgaagcaccgcctgctgctgtcgccggacgcggagctggacggggccacgccgacggacgtgctgcgcgaagtggtgcgcggcgtcgaggtcccccggtgattcccaccccgcgcctctgggtgctgctggcgctgctcgcgctgccgatgatgctggcgggcttcagccccggcattggcggcgccgtgctcgcgctggacgcgctggtgctggcgctggcggtgttcgacgtgctcaccgctcggagggcccggctggaggtccaccgggtgctgccggcgcggctcaacgtgggtgtggccaacaaggtggtggtgcggctgattcaccggagcggcggcgccgtccaggtgcgcgtccgggacgacgtgccggatggcttcgccgccacgccggacgaggccccgctgcacctgcccgcgcggagcgagtcacgctgggtgtaccgggtgacgcccgtgaagcgcggccgcttccagtttggagacgtgcacgtccgcgtgcgcgggccgctggggctggtgtcccacgagcgcgtgttccccgcggcgcaggacatcgccgtgtacccggaccttcgcggcgccaaccggctgctgctgtcgggcgcggcgctggacctggtcaacctgggcctgcggcagctccggcgcgacgggcgtggcagcgaattcgcccgcctgcgcgactacgcccagggcgacagcgtgcgggacgtggactggaaggccaccgcgcggcgtgggcggccggtgacgcgcgtgctggagtcggagcgctcgcagtccatcctcatctgcgtggacgcgggccgctccatggccgcgcaggtggacggcctcaccaagttggaccacgcggtgaacgcggccctcttcctggccttcgtggccgtgcgcaacggcgaccgcgtggggctggccgtcttcgcggatggcgtgaaggcctacctgccgcccgcggccggacgcacgcagtaccggaagattgtcgacacgctctacggcaccacgcccagcctcacgtacgtggactacctggcgctcttcaaggagctgaacctccgcctcacgcgccgcagcctgctgtgtgtcttcaccgacttcctggacgaggagcaggcctccaccatggtggccccgctgcaccgcctggctcggcgccacgtccctctgtgcctgtcggtgaaggacaccgcgctccagaagctgctgcgcacaccgccccccagcccggaagaggccttccagcacgcggtggcctccgagctgctcaccgaccgcgaagtgctcaaggcgcgggtgagccagggcggcgtgcagatgctcgacgtgcagccggatgagctgagcctggccgccgtcaaccgctatctggacatcaaggcgcgcggcgtgctgtagcctccggggccgcgtccggcgccgggacgggcagcggcagccaccccatgaagcgggtatccgggacgttgcctcgcacgcggtgcaacacctgcttgaagagggcgtagacgcggaagaagcgctccaggcccgcgcgctcggcggccgtcaggggcgcggcggcgcacaccaccttcgggtccccccgccccgcgtcgacgaagccgatgacgcccaccaccggcacacgcagccgctgccccagcgccagccggggccccatcacgacggcgtccagcgggtcgccttcatccgacgcaaggcccgggatgctgccgtagttgtacgggcacggcagcggcgacacgaagtccaccgccccgtccgcgcggcgcttcacgaaggagaagcgtgggcactcgatgaggacctccggctcactcggaagcggaggcagccacaagcgctcatccatgggcggacccagcgccgccgtctggcgccgcgcgccccccacgcagccagtccgacagcaggtacgcgtacacgcccgcgcccaccgtcaacgcgaaggacaccttgaacgccaccgacagcttgggcggatgaatctgggacaccgtgccctcgatgaagcccgcgagcacgaacaggacgagcgtgccgaacagcagccgcaccgccgtcaccgcctcctgtcgcaccgcctgtccacggggcagtcctcgcggggccaccatgcctcgcgcaatcaccaatcccgcggcgcccgcgatgcagatggcggtgatttccggaatgccgtgcggaagaatccacgcccagaaccagcccgccattcccttggctgcatagacttgtgcgagcgcgcccaggaacaggccgttgacgaacagcatgatggccgtgcccaggcccacggtgattcccagcgcgaacgccaggaaggccacctggatgttgtgggtgaagaggtaggtggtgaactgggcctggtctcctaccgacatcccgtcacccgcggcctcgtctgccgcgcgttcgacggggtccaggttcaggtgctcggcggggaccagatagtgcgccgcgtcggggtccaccatcatccccacgtagccgaagcccatgcccgccagcagcagcagcagcgacgccacgtacatccgccactcgcgccgcatcagcgcggggaagccccgcgccacgaagccccacacgtccgccaggcgcgggcgccggcccgggtacgtcagcgcgtacgcccgccccaccaaatcgttgaggtaggcattcacgtccgccgagccactgcgcgcgcgaacccacagcaaatcactggagacggcacgatacagccggcccagcgtcctggcgtcctccaggctcagctcgcgcaggccgtgggattcggaccggtccagcagcgactccagttgctcccagcgcggcttgcgggactcgatgaactccgccatctccatgggccggcactctaccccagtgacgtggcggcccaccctgccctccgacgaagctttgtgggaaaacgcaggaccatgacgtgtcggatggcgttcctgggatggctgctcgccctgctgtcgggatgcacgagcatgcgcgccctgtgtcccctggagggaggccgcccctgggtggaggtgcgcagtccccacttcaccgtccgcaccaacctggacacggagacggccgaggaagcggcccaggagctggagctgctccgcgaagggctgctgcaagcgtggggcggcagcttcgacccgccgggcacggtggacatcatcgtcctccacaaccgcagcgcgctggaggagttcaccaacatccgcatcgaagacttgtcccccatccccgaggatggcccgctactggtcctggccgggcacgcgtacgaggtcagcgaagccacctcggacatcaccacccaggcccacgagctgacgcactacctctccgagctcgcgctcgtccgccaaccacgctggctatccgaaggactggccagctacctggagaccatcgcgctcaggccggaacggcgcgaggtcatcctcgggcgcatccacggggccttctacaaccaggtgcagcggcatggctggcgcacgctcgacgagctctgggaatgggacagcaaggggctgctcggcaccgccgagtcgcggcagtactacgcgtcctcctggctgtgggtgcacttcttcatcagccggcacggcgtgcgcttcgaggacttccagaagcgcctcatgcagggcgaggaaccccggcaagccttcgaggccgccttccgcggcgaggaggacctggctggcgagctgaatggctacgtgcgccgccctgggcacatgaactaccgcaccatcaccgcgccgttggcgcccgtgacgagcccgctgcaaacgcgccccatgcgcgcggccgaggtccacgccatccgcgcccagttgttcctgatgacaccgggcgcgtcccccatggaggaacggctgccccacatcgaacgggagatggcggaggccacgcgcgaggagcccggcaacgtggacgccatgctgctgcgcatccgctccacggaggatccgttccgcaggctcgccgtggcgcgagagctggtggagcaccaccccgccagcggccacgcgtggaacgccatggcccaggcgctggacgccgcgggaaatacgtccgaggagcaagaggccgcgaggctccgcgcggtggcgctgctgcccggcagcgtgagcgcgcagaacggactggccggctactacgcgcgcacggcccagccggagaagggcctgacggcggcgcagcgggccctgtcgctggcgccggggaacgcgtcagtgctggacacgtggtccaccctcctgttccagctcggtcgatgcccggaggcgctggatgcccagcagctcgcggtggacatgctccacgaaggcacgccgcagcggctgcggcggaccgtgcacgacacgctggcccgctatgaggccgtgtgcgggcccgatgcccctcccgccgcggtgaccccgcccacggcggcgcctgccgtggaaacgccgtgagcccctggccccgctgaaacgacgaagcgccggaagggcccaggtggcctcctccggcgcttcaggggtccgacagaagcaggacggcgaggactacttcagcagcttctccagcggcttcttgtcgctgctcgcctggtccttggtccagtccaccaccggcgtctgccacgccatgcccgtctcggtgggctcgggggccagcttctcgaactcgaagccgtcaccgccgaagtagaggtactccaccgtggcgaccgtgtactccttgttcgggtccagggccttgcccttggcgtccttgaacttgcccttgcccgcggccgtgaagccggaaacgagcgcgttcgggttggccaactgccgggccaggtcctcgcccttcagcttcacgacgaggagcgagttctcgaacggcatcaccgagtagatgctgccgcgagtcaccggaccggcgggcagg

SEQ ID NO: 1123 - DNA, 19068 bp, Myxococcus xanthus
attcctcccatcccgcccatccctccgattcccgacctcccgaacgcgttctccgaggagacgcggaacgagatgaagcgcgcccgggacgagatgaagcgggcccgcgacgaggtgcggcgcaacatgcgtcgcaacggcagccgcaacgtggtggcgcgcggacagaacctggaggtgaaagacggccagacggtggagagcgccgtggtgtacggcggcaacctggtggtccacggccacgtgaaggatgacgcggtcgccttcggcggcaacctagaggtccacggccgcgtggacggggacgcgcatgccttcggcggcaacgtcatcctggggccggacgcacacgtggagggcgacgtgtctgcctttggcggctcggtggagcgcgacgacgacgcccaggtggaaggcagcatcgagtccttcggcggcgcgggcattggccgcatggtggccagtgaaatcaagaagggcgtgaaggaagccaaggacccctccgagagccggagggaccgcgacgatgacggcgtgggcctggcgggcttcatcctcaccttcgcgatgctcttcgggctcggcttcctgggacagatgttcttccccgcgcgcatgaagcagttgggcgaggaagtgcgccgcaagccggtgcaggcggggctcaccggcttcgtgggactgctggcgatgattcccctcacggtggtgctgtgcatcaccatcatcggcatcccggtggcgctggtgctgtggatggcggcccccgtcgcggcggcgctcggctacgcggcggtggcgagcgagctgggcacgcggttgcccatcttccgcggccggaagacgcaggcggtggtgctggccctggggctgctggtgctgatggtggtgggctcgctccccatcgtcggccccctcatcaccacgctggtcggtttgatggccctgggtgcggtggtccgcacccgcttcgggcagcggccacagggcatgcccgagcccgtcattccctcgagcgagcagcctgtctgacagggattgccgggtgctttgcccggcgcgtcatgcacggacgtaagtcttcagggggactgtcccgggcgcaacacggcccgagacggtcccctctcgttttacggtgtgcgccttagccaaggtcgggcgcgccatcaccgcgcctatcagccaggcgtgttgggcatggcgcgtcatgccgtcagaggctttgaccgcccggtccgcgtgggccattttggcacaccctatgcgacgccttcccgacgtaccgccgcgcggccgggccatcaccgtggacctcgagggcgagagcctccccgccatcgaaggtgagccggtggcgtgctcgctgattgccgcgggtgagcccatgctcgcccgctccatcaagtaccaccggccgcgaggcccctactgcttcgccggggccctgctcgcattgcctgatgcgggtggacggcgtgcccaatgtctacgcgtgccgcacgcccgcgcgggacggcatgaagctggagcggcagaacgcctatccctccgcgaaggtggacatcttcgacagcatcgactggttcttccccaagggcatggaccaccacgagatgttagccggcgtcccggtggctgagcaggtcatggccaaggtggcgcgtcagctcgcggggctgggcctgctgcccaagacgcccgcacccgcgacggcgcccgcgcgcacggtgcgcacccgcgtggccgtggtggacggcggcgcggcaggactggcgacggcgcgcgtgttgaccgagcggaacgtgggcttcctcctcatcgagcgggacgacgcgctcggcggccggctcgcgaacggcgcgccggaagccggcggccccagcctggacgacatccaccgcatctcccccagcagcgtgctcacgcgggccaccgcgctgggcctgtatgacgacgaggcggggcgcttcctcgcggtgggcacctgggaggcggacgcgccacgtctggtgaaggtgtactcggagcgcttcctgctcacgcccggcggccatccgcccacgctccccttcgagaacaatgacttgcccggcgtctacgcgggacgcgcggccagcctgctgctgcgccgctacgacgtggcgccggagacagcggcgctggtgggctggggcgcggagttgcacgcgctggcgaacctgctccaggagcgcggcacgaaggtggtggcggtggtggacctgcgggacacgccgccggcgggcacccatgccacggcggtgcgaggcagcgagcccaaggcccatggcctgcgcggcgtgagcgccttcagctacacgcgcgagggcggcggacgcgaaaaggtgtcgtgtgacgcggtgctggtgtccgtccccgtcagccccagcttcgagctggcgcggcagggcggcgcgaaggtgccgttcgacgagaagcgcgggctcttcgtggtggagacggacgcggacgggcgcacccaggcgccggacgtgtacgccgcgggtgacgtcacgggcggaggcaccgcgaaggacgcggcggcggccggacggcgcgcggcccaggcgctggtgggagggctgtcatgagcaaggcgatgatctgctcctgtgaggacgtcaccgtcgacgacatccgtcacgcggtgtcccggggcttctgcgacgtggagtcggtgaagcgctacaccggcttcggcaccggcatctgccagggcaagagctgcacggcggcggtggccgcgctgctggagaaggagaaggcgctcaagcccgcggccgtggtgcccttcacgccgcgcccgccgctctaccccaccgagctgcggatgatggcctccgcgcccgtggacgagtcccagccgcctgtgggcgggctgccgcaggaagtggacgccttccccgccgcgctgcgcccggagggcccggtgcccgcgaaggcgaaggtggtcatcatcggcggcggcatcatgggcctggcgctggcgtacaacctggcgcgcgccggtgagacggacgtggtggtgctggagcgcggctacctgtgcgcgggcgcgtccggccgcaacggcggcggcgtgcgcatgcagtggggcacgccctcgctggtggagctggccaagcgctccatcgagctgatgaagggcttcgcgcgcgagctgggcatcaacgtctggctgcgccagggaggctacatcttcctggcgaagacagcgccggtggcccagcggctggagcgcaacgtctcgctgcacaaccgcttcggcgtccctacccggctcatcacccccgacgaggcacgcggcatcgtccccgggctcacgatgaaggactgcctcatcgcgtcctacaatcccgaggacggcgtcatcttcccctggcccttcctgtggggctacgcgcagggctgccagaagcgcggcgtccgcgtggagacgtacacggacgtcaccggcttcgagaccagcggcggccaggtgcgcaaggtgaagacgacgcgcggggacatcgcctgcgacaccgtggtgctggccgccggcgcctggagtccgcaggtggcgaagctggcggacgtgaagctgcccaacgagccgcaccgccacgaaatcctcagcaccgagccgctgaagcccttcctggggccgctggtgtccgtgctcgacagcgggctgtacttcagccagtccatgcgcggcgaaatcgtgggcggcatgggcgacgccaaggagcccgcgggcctcaacatgggcagcaccctgcgcttcgtgtcgcgcttcgcgcaggcgctgatggagcagttgcccgaggtgggccatgtgaaggtgctgcgtcagtgggccggctgctacgacgtgacgccggacaacaacccgattctgggacgcaccccgggactggacaacctgctccagatgtccggcttcgtgggccacggcttcatgatggcccccgccgtcgcggagcggatggcgaaatggatggccaccggcgagtccgacgagctcttcacccgcttcaacctccgacgctactctgacgcggcgggccattcgcgtgacttcggcaccggaacgctggagcgcgaggacatggtcatcggctgagcccctggccacgccgttcccgggccgcgcctggaccccgcctccaccgggtccggacgcggcccttgtatttttccggagcctgtcctggccggagacaacggctggggagcgaattgacccggaacacaccagctccggacagtctcgcaaatcacgaaaaccactggcgacccccagcaggactgtgaagcgcctttacatcaacaactgggttacctggacagggacgcaccagtcgcgtgtgccggcgcggcgcccactccgaggagagacgctcggagtggagacatggcacggcgcgtgccttggcgcctcgccgcgcaatccagcgcgaggaggtgttccgatgttcccgaagagcgttcgtgcgctgttcctggtgggagccctgtctgcctgcggcaccgaagcacctcccgacgttcccaacgcggacggccaggagccgctgcagtcgcaggagtccaacgtcatcgtgggctcggtgaactgggtgagcgccacgacgctgtccggcacgcagcgcacgcgctcgcgcgcggtgggatacctgtccattccggcggtgggctcgcgctgcacggcgtggctggtgtcgcgggatgtgatcatcaccaacaaccactgcgtcggcagcagctccgaggcctccggtgcgcgtgtgtccttcaactatgaggacggcgtcagctccaccgctcgcgtctggtacaactgcggcacgctgatccgcacctgggccggcgacgacatgacggcgctgcgctgcacggccaccaacggccagctcccgggtgacgtgtacggctggctgacggtggccagcgccaacgccgccaccaacgccagcatctacgtgctccaccagaactgcgactactacacgacgagcggctgcacgccgacgaagaagtcctcgccgggcgtggtgcgcaatgccaactacagcaccacggacctgtcctacgacgcggacacgctgggcggctcgtccggctcgcccgtgctgtcctcgtcctcgcaccaggtggtgggcctgcaccacatcggtctgggcggcaactcgcagggccgcggcacggccaacaccggcgtgaaggccacgcgcgtgaaggcgcgcctggccgagattggcctctagagccgagcccccgcgtcacgcgggtgatggctcgcccgaaagtggcagcgcctggggggcctgccgtggtgggagcagcaactcctcccgccgcaggccccgcagcgccatccgccccaggctccgcttgagcccgcgtggcagcagtggcagcagccgcatcacccaccggtgccccaagcccgggtacaccagggccgcgccgcgctcgaagccggcgagcgcctcgcgggcacagcgctccagtgacagatggaagaaaggcgccagtgactccgcgccctccacacccgcttcccacagcggccccggagctacgcgcgtcaccgtgacgccctgcccctccacctccaggcgcagcgcctccgtgaagccgtccaggaagcgctgggtggcggagaaggtggccgagcccggcaggatgagctgcgccgcgccggagccgatgttgaggatgccgccccgtccacgctccaacatgggcttgagcagccggtgcgtcagcagcgcgggcacccagacgttggcgcgcaacatggcttccacacgcccccagccctcctgggcatacagcgcctggtcgccttccgcggcgttgttcaccaacacgtccacgcggacgaactgcgactccagcgaagcgagcagcgcgtccacctgctggggatcgcacacgtcgcaggattcgacgagcacgcccagcgtcgggtagttcagcaggagttcctcgcgcaggggctccaggacctgggcctgatggtccacgagcaccagggtccgaacgcgacgtgcaagcagccgggcaagctcccggccaatcccccgggccgcgccgatgatcagcacggttccttggtcgatggggagaggacgcatgacaaaatcctccgttcgttgaggtgcccatcgtgcgcatgccttgcgcggtctgccgctccccccgcagggtttgcacgcctggacagcagacgaccggcgcggcgctggcacggctcttccatctggggcgtgccatgcccagaaaagaagacatggcgactgtttcccgaatcctcgttcccgtggacctgtcggacggctcccgggaggtcatcgactacgcggtgaagctcgctcggcctttcaaggcatcggtcgaggtggtccacgcctgggagccaccccagtacgtggcgcccgacctgctggtggccgcgccggggtggaactcccaatccctggagcacgtcgccgtggaggccgcgacgaaggagctgacggcccagatgaaccagggggagcccccgggcgtcccggtgagccagaaaatcgtcgtgggtgaggcggcgtccaccatcctcgacctcgccgagcaggacaaatgcgacctcatcgtcatgggcacccacggccggcgcggccttccccgcctgctcctgggaagcgtggcgcagaaggtcgtcgcccgcgcgtcctgcccggtgctcaccatccacctgtccgagcggaagtagcgcggacgcgcctcacggccccggggagggagccaccgggggtgcggccggctcccccgccttccgccgcgcggccagcaccgtgggcacggccagcaccgccatggcggcgacgacgagcgcggcgcccaccaactccaaggcccccgcgcccggctggcccagcgtgacggacatcaccacggtcgcgaccactccggcgagcacgctggacgcgcgattcaccggcacgcagaaggcattctcccgcccgtccaggaggatgaggccgccgaagatgccggtggcctgcgacagcagtcccacggcgagctcggaggccaggtggcctcgcgacaaggccccggtgaagccgtcgcggatgtcaccgagcacgccatcgccgccgataagggccagcaccgccagggtgcccaccagcacgggcgtggccaccatctgctcctccacgaagtagcggatggagacctcacgctcgccggacttggccagttggctcattgcgcgcagccggaagaaataggccgccaggtacacgcccacgtccaccgtggccaggagcgtcagcgtggggctgaccgacgagcccgcggccaccgccaccgccgagaagctcaagcccaaggccacccatgagggccagcgcacccgccgtccactgaggacgtccaccagcggcgccaggacgagcacgccgccgcgcatcaacagcatcatgaagacgatggacgcccccggcagggtgtacgccagcgtcgtggtgccgatgatggccgccgagcagagccccgacagcagcgtccaccgccctggcgctggcacctggaagccccacacctggcggtgccccgcgtaacgccaccagcgcatccacgtgaggaagacgaacattcccaccagcgaggccgaggtgctcaccggcaggagcgtgaagccggagataccctcccgcatgccgggcaaggcgcctccggacagcgccttcgtcagcgcgctgtagggggcataggccacgaagtagcccagggcgtacccccagatgctcaggtcacggacgtcatcatttcgaaggggcgtggcggacaggacgtgttcccggttgggggtggagacagggttgtgcaagccacacgccgggcaggtgacggatgtgggcacgcaatcgtttccgtgcgggcgcgtatcccgcggtgtcacggcttttacaggagcctcgcatgcgctcgtcccccattgccactttggccctcgggctcgccctcgccacccctgccttcgccgaggacgacgcgaagccgccccagaagtggaaggtggtgtgcgccacgcagtcgaaggacggaagccgcgccgtccagggcacggacctcatcatcgaggccggtgagaaggtgaaggacggcgtcgccgtggagggcaacgtcatcattcgcaagggcgcggtggtggaggacgtcgtcgccatccggggccgcgtcatcgtcgaatccggtgcccgggtgacgggcagcgcggtgtccctgggcggagaggtccgcgtccacaagggcgccgctgtcgacggggacgccatcgccctgggaggaaagctgaaggtggatcaggacgaagcggtgaagggcgacaaggtcagcctgtccttcgagattggcggccgggacatcgtgcgcggcttcattgaagacgcgctcgacgaggagactggctgccacatcgtcgacgagagcgacaaggacgtctgagtcacgcggcgctggccggccccggcggcacggccggctcggtgcgcgtcagcggcatcagcgaagcccgcagtgacaggatctgctcgcgggccaggttcttcagcgtctccacgtccgccagcgtcatccccttggtggagatgggcgtgcccaccgtcaccaaaccgcgcgaggtggcgaagcgccaggagtgcttcggcagcgcccgccgcgtcccgctcaccgccaggggcagcacgtccgcctgcgcctcgatggccagccggaacgcgccgtccttgaagggcagcaggtcatccgtcttcgagcgcgtcccttccgggaagatcatcaccggcatgcccttggccagccactggcggcacttcgccatggcgcccgtcgccgagtcgcggtcgccgcggtgcacggggacgtcccccgccatccacatgctccagcccaccacgggaatcttgaagaggctggccttgcccagccacttcatctcccacggcaggtgcgagatgaggaacgggtccgcgttggactcgtggttgcttacgaccaccgtgttcggcgcgaccttgtccggcacctggccgtgcacgccgaagcgccagaacggcgtcagcttcgccgcggtgacgccgatgagccggaagcagcgtcccgtcacgtggcgcttgtggtcgaaggcccaggtcaggatggccagcgacagctgcacacagaagccgaccagcgccaccaggccaatctcgatccacgtccagatggagagcagtgcgttcatgagagcctcgaacaagcgtcagcgaaccgcggggtccaggtccacgctcaccggacagtggtccgagccgagcacgtccgggtggatgccagccttgcgcacgtaggccatggccgctggcgaggccaggacatagtcgattctccagccgatattcttctcccgaacgccggcccgctgactccaccacgaatagttccccccacccttgttgaagtggcggaaggtgtccacccagccggcacgaatccaccggtcgaactcctcgcgctcctcgggccggaagccgctcgtctcccggttctccttgggccgcgccaggtcgatttcttgatgcgctgtgttgaagtcccccatcaccagcacccggccaccatcgcgcaggggcttctccagccgctcgaagaggcgccggtagaaggtcagcttgtaggggatgcggctcaggtcccggtccttcccgttgccgttgggaaagtagccgttcaccacggtgagcttgccgaagcgggcaatctgcaggcgcccttcgacgtccagctcccccacgccgagcaccgtcacgacttcatcgggctccaggcggctgtacagtccgacgccgctgtagcccggccgctccgccgccacgaagtgcgtcttccaccgggacggtgagcgcacatcgtcgggaagctggtcggcgcgcgcgcggacctcctgcagaccaacgacttgcgcccggcaccccgcgagccagggcaggaagcccttgcggtgcaccgagcgaagtccgttcacgttccacgaaacgactcgcacggggaaggcttatggcccgccccgtgcggcattaccagcccctaccgcacacacaggcggtaggggcgaacaggcagctggctacggctccgtggcgctcgcgcggttctgcggctggcgcgtcggacggaggatgaagtccgccgagttgtcgttcgagtcgtggccgttgcccagcagcgcgtgcgcgccgtcgaccatggacgccgcggtcgacacggccgaggccttgcgctcgaagctgccggcggtgggcgggtacgccggcaaggggctgccctcagcggcgttcgcgttgaggtagcccaccgtatccaccaccagcggcgaggagatgccgtcggtcagcgccagctccggatagccgacgcgcacatggccaccattgctgttggcgcccaggttcagggccgttccccagttcgcgtcacccgacacggtgttgccgctcgtcgaggcataaccactggcgaccaccaggaagtagccacggggctggatgaccgagttcgcgggcagcgtgaacgagttgttgtagttcgtgctgctgtaggccttgtactggaccttccagccggagatgtccaccgcgctcgaggtcgggttgtagagctcgatgaactcgtcgctggcgccaccggggcccgcgaccgcgaactcgctgatgacgacgtggcccgtgctgctgcccgcggtcacctgcaccgccgccgcgatggactgaccgttcagcgcggccaccagctgaccctcaccgcccgtgctgcccgcggtgaagtcgaacttggcggacaggctgttggccggcaccgtcaccgtcaccggcaccgtgccgagcgacgcgggctccagcgcgagctggatgaccgtgtcctgcgccgggggaacgtccagctccaccgtgtagccctgcgtctggccagcgctcaccgagatgacctcgggcgacagcgtggccagctcagcggcctgattcgccgccagcacccggaccgtggccgcacgcgtgtcgttgcccagcgtggccgtcagcgtcgccttgtccgtctccggatccgcggccaggttcgccgtcacctgcaccgtggcggagcgctcacccggggcgatgcgcaccagaccaccctgcacgttcagcacggcgctggacgaagtaacctccacccagacctccgccggagcttcctcacgcagacgcaccgtcagcgcctcggggaacgtcgcccccgtggtgccagtgcgcgcgaaggtgcccgtcggaccgaagctgtccagcgagacctggaccgtgcccgcgtcggtgccggcgtcgtcctcgcccgtgcccgcgtcggtgccggaatccggctcacccgaaccaccgtcttcatccgaacccgcgtcctgctcgcctgaaccaccatcctcggtggtgccagcgtcgtcctcaccggtgcccgcgtcctcggtggtgccagcgtcgtcctcaccggtgccagcgtcctcggtggtgccggcgtcgtcctcaccggtgcccgcatcctcttcaccggtgccagcgtccacttcaccggtgccggcgtcgtcctcggtgccggcatcctcctcggtgcccgcgtccggcgtgggacgacggcagctgttgtcacagctgtcgttgttgtttcggttgccgtcgtcgcacgtctcgccagcctcgacgatgccatttccgcaaacgggcctgacttcagggtcgtcgccacatgcggacatgaaaaggagcagtgcggacagcggcgccagcatctgccggaaggaccagggcatgggtaaagagtctccgttgaaacttgaagagccccctgcatcccatatctgtcacccacgacgcaatccgggcggcagtttccgatttcactggactcaagcccgggttttgatcctcccggcctcccctctcaggacggaggcactggagcgtgctccccgacctcatggggcggctccaagccgtggtccacgaggaagacacgcacggcctcggcgatctccgacccggcctccagcaggccggcgtgccccgcgtcatccacccgcatccaatgtgcgtgcggcattgcgtcacgcattcgctccatctcccccagcggaacgagcagatcgttgctggcggcgacgatgagcgtgggcacctgcaccgtcctggccacgtcccaggcatggccctccaccatgccccggagggtgtaccagtaggccctggggctcatccggcgcagggcgagcatgaactcgtcgatgtccgcccgaggcgcccgggcccggagcgcccccaccatccgcgccaggggataggcgaagcggctggccatcaccgcgtgcgccacgggcgccgccagcggcagcgtgggcgtggccagcttgagcatgccccgggtggcggacaggaacgcgcgggcccccgccgagtccacccccgagccgaacgcccccggcgccccggcgatgagcgtcatggacggaaccaggtccggccgccgccggtacaggtccagcaggacgcgcacgcccatggagaacgccacatggtgcggcggccgcccatccccccgggccatcaccgccgcggtgatgcgctccaggtcatccacgtgcacgcgaatctggtacccatcccccagggattcatcgctgctgccgtggccccggtagttccagtgcaccacccggtggtcctgctccaggtttcccaccaggtagcgccagaagttctccgaggagccaatcccgttcgtcagcagcaccgtggggcgggccgccagctctgcgtcggcggaggcctcccggaggttgccgaagtgggtatgccaggcgacccgggtaccatccggggctgtcacaaagcgcgtggtgcgacggtagggcatgccacctcccacgatgaggcgcccgggccgggggcgcaagcatcaacctgccccgacgggcacgtcccggggtatgagggggcgccatgctttgcgtcgacgtggaacggttcgatatccgccctgccctggcccactacgccgagcacggctacgcgaagctgggccgtgtgctgggtgacgagggcctggacgcgctccgcgagcgggccgacgacctgatgctgggccgggtcgtccacccgggcctcttcttccaaccggacgccaccaccggtcgctacgaggacgcccccctgggactgggctggcagggcccctccctggactaccgcaagctggagaagctggagaaggacccgcgcttcctggcgtggatggagaacccgctgttcgaacgcatcgcccgggcgctcatccccggcgacatcgtcctctaccgcgccatcctcttccacaaggggaaggccggcggcagcaacctgccctggcaccaggatggcggccggctgtggggactcacccacgaaccggagctgcagatctggaccgcgctggatgacgcccccgaggacggcggctgtctggaagtcgtcccgggcagccaccgcggcggcctggtgacgcctctgggcggggtgattcctccggacgcggtggcggcggccgacgctgaatcccgcgtcctgtccctgccggcgcgcgccggcgaggccatcctggtccacaaccacctctggcaccgctccggacgcgggcgccccggcttgcgccgccgcgccttctccgcctgctacatggacgcggtcgtgcgctgcctgcgcaagaagaaggccccccgcgtcttcccgcccatgttccgccggtgacctcagcccaccaggggcatgcgcagcggcggatccaccggctccttcgcgcgccgtgccaccggcagggagacgcggaaggtgctgccccgtccttcctcgctctccacggagatgtctccaccgaagccggtgacgatgccgtggcagatggacaggcccagccccgtgccctcgcccaccggcttggtggtgaagaaggggtcgaagatgcgggcgcgcacctccggaggcatgcccacgcccgtgtcgcgcacctcgatgatgacgcggtcccctgcgcttcgcaggctcagccggacctcgtgctgctccgtctggcccatcggaatggcctgcgcggcgttgatgagcaggttgaggaacacctgtccgaagcggccctcgttgccctccaccagcggcacctcgcagtagtcgcggaccaactgcgcgcgcagcttcagctcgctgcgcgccagggtgatggccgactcgagcaccgcctgcacgttgacggcggtggccacctcgtcgtcgccccgggagaaggtcctcaagtcccggacgatctgccgcacgcggtgcgcgccgtcggtggcctcgcgcagcacctcctccagctccgccatgcggcccgacggcaactccggcgccagggcgtgcagttcgcccgcgaggaacgacaggttggagaggacgaaggccagcgggttgttgatttcgtgtgccacgcccgccgccagcgtccccaccgccgccagccggtccgacaccacgagctgcgcctgcatggccttgcggtcggtgatgtccaccgccacgcccgccagcagccgccgccccgagcgctcccgcacgatgaagcggtaggtgagccagtggcgctcggtgccgtcgcgcgcgggaaccatcatctcggtgatgctctgcttgccggaggtcagcaccgcgtcgtcatcccggcgcgactgctcggcggaggccgcgggcatcaaatccacgtcggacacgttggacatgtccgcgcccaccgggaagccgaagaaccggctgtagcgcgcgttcacccagatgcggcggccccgctcgtccttcatgaaggccaccgcggggatgttgtccatgaaggacgcgaacagctcctgcgactcctccagcgcgcccatcgccagcgtgttctgcaccatcaactcctgacgcgcctgggcctcggccgcgttgcccatggccgcgccgagcagacccgccatcagctccagcgtgcgcacgtcccggtcctcgaacgtgttcggccgccggctggtgacgttgagcacgcccaccgggcggccctcgcgccacagcggcacgcaaatcatcgaccgcgcgcccacctggcgcagcgccgtcacgttgacccggacgtccgtctccgagtcatccgtgcgcatcacctcgccctgcagcaggctggcgcccgtgagactgccctccaccttcagccggaagccgatgaagggcatcaggctgccgctggccaccaggtaggtcacctcctcgtcggtgtccgcccccagcagcgccaccgccgcgccgtccgcgccgcacaacacccgcgagcgctcgcacagcaaccgcatcagctcgtcgagcccgtagcccgccatcgccacgtccgactgcatctggatgatggaggacagccgcgccacctcgccccgcgcctccgcctcggacgtccgccgctggcgccgcgccgccacccgccgctccagcaacaaccgccgtgagcgcacctgcaccggggtgaagggctccaccaggaactcgtccacgcccgcggccagcagcggctcgagcgccgcgtcggtgccttcccgcgccaaccccagcaccagcggctcctcgggacgggcccgcgtccgcagcgcgtccagccagcgcgcgtcctccaccaggtccgccgcgtccaccaccagcacgtccacgggcccgtgccccagcgccgcgccggcttccaccacgtcggcggtgatgaacacggcctggccctggcgccgcagctcctccgccacgggatgccggtcatcagaggtgagacacaggaacttcatccagtcgctctgctccgtggccccaaacacacggggtgaaaaatactatgattctgtagcacggcatttccagccaggagcgtcctgactggcgggggtcaggcgcaccccatgcccggtggaaacataccggccggagggtaaacgggtggccaccgggtggcgccaggacgctatcctccgcgcgtgccgggcatccctggagtcgtggtcgccgagcagccgcactacctgccgtgggtggatttccacgagcagttggcccgcgcggggaccttcgtcgtgctggacaacgtgcagtggctgcggcgcggctggcagcggcgcacccgggtggccctgccccacaacgtcccccagcccccgcccacggagcccgggttccagtggatgtccatccccctggagaacccgcaccgggacaccctcatcaaggacctggcggtggatgcccgtcagccctgggcccgcgagcacctgcgtatgctggtgtcgctgtacgcaaagcggccctacttcgcttcgcaggtactgccccggctggagcccttctatgacgcggcggcgcgcgagtcgggccccgggtcgctgctgcgggtgctgctggcgagcatggcgctcttcaacgagccgctgggcctgacgccgaacctggtcctggcctccaccttggacaagcagggcgaggacaagtcggcccggttggtggcgtactgccggcagttgggcgcgcacacgtactactcggggttgggctcgtccctgtacctccaggtgggcctgttccgagacgtggacgtgcgcgtgctgtggcagcgcttccgccaccccgaatacgcacagggccgcccgggccgcttcgtccacggcatgtcgttggtggacgtgctggccaacgtgcagttggacgaggtgcgccaatggctggagccttcgccctggggaccgttcgcgccccggcccccgggcgaatgacggtgcctcagcgcgcggaggccgacgtccccgccggcttgtccttgtcgaagcgcacgaagtagccgcgcacggcggagtccaggagttcggtcgtcaggcgcggctcctggccctggtagtgggccatgtcgatgacctgatccaacaagtcacgcggctgacaggcggcgaacggacggcccacggggcggtagtgcgcgtcgatgaggtagtccaccgccgccgcgttgtagggcacgccgcgcttgcggcacatgacctggaagatgtcgtggaactgctcctcgtccgggcgctgcacctccagcttgtagcggacgcggcgcaggaaggcgtcatccacgaggtcgctggggtccaggttggtggagaaggcggcgaacacgtcgaagggcacctgcagcttcttgccggtgtgcagggtgagcatgtcgatgtcgctctccagcgggacgatccaccggttgagcaggtccttgggggacaccttctgccggccgaagtcgtcgatgaggagcatgccgttgctcgccttcatctggaacggcgcctcgtagtacttcacctccggcgagtacacgaggtccagcatctccagcgtcagctcaccgcccacgacgacgagcgggcgccggcagcgcacccagcgccggtcatacggcgaagtgccgggctcgtcctccaccaccttgtggaggttggcgtcgaagatgcgcaccacgaagtcgtcaatgaggatggcgtgggggatgaagatgtccccgtcgaagcagttcaccatgccctggcagatggccgtcttgccgttgcccgggggcccgtagaagaagatggcgcggccggagttcatcgccggaccgatgccgtcgaagatgtagtccttgatgatgaggtcgccgaacttgtcctgcatgcgcgcgcgagtgatgcggttgccgcgcacggtctgcttcttcacggcggccgcccactccaggaagggcacgggcgcggggccgttgtagcggttgcggtcgagcacctgccgcagcacgtccgtcacgaacgtggtgagctggtagatcatcgtcgacttgcccacgcccgatccgccaccgccgcggatgtcgatgtacttctggcggcgcagtccttcgatgacgtcgtccaccagcgcggtgggcagttgaaggcgcgcggcgatgtccatgccgcgcatctcaccggcgaagaagagcgccttgagaaccagctcttccacgaaggtggtgttgaggcccgtctcgcccagggtgcgcggctgggagggccagaaacggtcgcccgggccggcgccgccctcctctcccgaccgccggggcgtccggcgctccgggccgctgtactgcggactggcggcgccgcctcgtcggtccgggcccgagtactgggacggcccgggcccacgacggtcaggcggggcgacgatgacggacggcagcgtggccggtgccggcggcggagcacggcggtccggcggcgaggacgagccgcgacgctcggtgggaaagtcgggctcgtccggctccgggggcagcgcgggacgtgagccagtgacggcgcccggggggcgcggcgggagcgcggcggtcatccccgtgacaccgacgcgcgggcgcggaggccccgacagcaccggcgtgggcgccgcgggcggcgccacggccgtttccacgggggtgacgctgcggctggactcgtcgctcgacgagccggagtccggggatggcggtcgcctgaacagggacatgcggtgctcgctccagggtgttcgcgccggagcctaccgcatcggtccggtttggacgaaacggagttgcagaacaaacagaaaagcactgaacccaagtgttcccgccagcctcctcgtcgatagtgcgcgcgcctccgcccgcatgcgcggcgcgcgaagcccacccccatcattcgcattggagctcttcgtgaagcgacttctgtccgtcctcgccctgcccctgctgctgctcggaacctccgcggcggcgcagacgacgcccaccctcacgttccacggcaactggaccatccaccagtcggaggtactgaccgaaggaggccaggtacaggtcgtctacagcaccgcgcgcctgccgcagtgccgcgtcaacaacccttagagcgcatgagagtagtgt

SEQ ID NO: 1124 - DNA, 13706 bp, Myxococcus xanthus
cctatccgagtcctggatttctcagcagagcgtattctccgctgctacgcagagaagacgatccatccagaaccgcggtttctgctcattggatatgagtctgatgagatgatgccactgcatctcttctacgattttgacgcaccggtacgggacgatgcgctggtgacggagcggtacgccaatggcggcgagcttcatgacaggttcgaaactctgggtgaaatgttggcttggggggcgctcctgaagttcagggtcaacacgatgcctcagcgatgtgaaggaatgctctcttgtgacgatccagacctcctctctcaactcgatccagtgatgttcagtctggggttcaccaagccgattacaaccggtcctcgctgtggactgtatgaacggaacgatgcggtcttgatatgcgagcgcacgccccgagaagaactcctggggaaccaggccttcactctgggcggccgtgatgccggagtacttagaaggctcctgggaaggctcaccaccgagtcctcgttggaggtcgaagtcgacgaatggaccccagcgcttggatgactcgcagtcctccggacgattacggaattccagcagactccatgtcaacacacgaggaagtagagctcgagatggagcgcctgctgttgcggactgtccctgggctcgaggagcagtggcggggcgcagtgcctgtcacgattgagaagatcgagcggattgtcggccgccccctgccgccgttctatcgctggttcctgagtcgcatgggccagagcatggggcccctggcctatcccaccctggatttctccgccgagcgcgtgctggcgtgctacgcccagaagttggtcaagcccgaacctcgctttctgctcatcgcctatgagtccgatgcgatgatgccgctgcacctcttctacgacttcaatgcgccctcgcgaaacgatgccatggtcacttcccgcgaagcgcgcggcaaggaattgaccgacgccttcgagacgttgagggagatgctggcgtggggagcgctctccctcttccgcattgacagggcgccgcacacctgcagcggcagtctcaagggcgacaccaccgacttcctggtggacctcgacccagtgatgagcagtcttggattcatccagcccatccccactggcccgctctgcagattgtatgagcgaccggatgcagtcatggtgtgcacgggcacgccaagagcgggaaccgggaatcggagggcttttgacctcggcggcaatagtgtcggaaggctgcggagaattctgggagagatctcatccgcgcgcgtcgcggaactccaggtgaagaagtaggctgcacacccagtgagttcagggcaggaggataccgacggcgtgcagggggcgcgcgggctggagcggaggcgctctcgccgggctcgtcaaaactcaccgcgctgccgagcatgaccggacggaaggcccataggatgctctccaggcgggcggagagtagggggccgtcgccgaggccgagggacacgggccgtgccccaaaggcgctggccactgcggtctgcgccagcgcccaaagggcgtggacggcgaagaagcgcccccagaaccagaagtgctgggacaggcggtccggctcatgcggtgcgtccctgtctaccatggcccggggtggtatccgtgagcggcggggcaccaatcaccctggagcatggcgccgcgtctctggtaggcatccgggttgaggagctcatggcttacggcatcgcgaatcacctctggattcatgggagcccggaccggtccagggttcgtcagtggatggacgccgcactggggacgtcgttcggggagcagcctcggagcgacatcgtcgtcgcggacgtcttccagttcaggccggcgctgacgctcatcgacgtgcaggtgctcggtgcgccgcgcgtcgaaggcgaggcggaggcggcggagcaggacggcttcctgacgcgcgtggccagcctggcgaaggaagcgggcttcaagagcacgcgggtgtggatgggcgaggtgggcaccatggcgtgggaactggagtcccaggacgaagagggcgtgcccgttggtgcgaagcgggaggacgaggcgctgcgcacgctgggggcagacgggtggaccgtggacccgctggcgcccgtggtggcgcgcgaggtcatccggagcatcgtcaagctgccgctggaggaggtccaccactacatcgactgggcggtgagctgccgcagctcgatggcggcggggacgccggtggagggcttcaacctgacgcgagcctcgcggctgatggccacgcactacctggtgtggaaggggacggtgctgcccaagccgacgccggtgagcgagatggcgccgaagctcgggagggcccggaggatgcgcagggcggcgactttggtccctgctgcgcgcgtctggggactggtgctgctggtggccttcgtggtgcccgcggtgctttaccacttcatcttcgccccgccggtggagagcccggtaaagggcttcgtgctcagtggcgtgatgacgctggtctgggccctgttcgccctggtgcgctttgacgacttccaggggcggccggtgcgcctaccatggaggctggcgctgttcgtcggtggccagctcgtggtgggggcgttgatgtggtggcttcatgggatgccaagcagatgaggcatcccgtcagtcaatacgacaaatcgcagctagagagtgtccgccaataagggacggccttcttcgccttccacatggccaactggacgcgttttcgcagcaccaatggcctggagcgcctccatggcgaggtgaatcgccgcacccgcggcatcggtgcctttccggaccgcgccagcgccctgcgcttcatcaccgccgtcgcacttgaagtcaccggcgtctgggttggccgtcgctatctcgacatgtctctactgaaatcaacccctgacacttccgctgcatgatgcagccaaggatccttcctcccccgaaccccctccgaaccaactacacaggattcgggacttgaccgtctgttttcctgcctacgcttgggggcgcagactgcctgagaatctgggtacaatcgcgagccatgaatgtgctcgccgccactcaccaacttccgcctgcggccattctcccagtgctcgtggggatgttcgtccttaccaccttcatctttgccgctgtgagcggctggcggcagctcgcgcagaactatcccgctgggggggccgtgccgagcccactgaagtacttcgtctgggggcaggtgggccggatctactaccggaaatgtctcaacgtggggggcgacgagcgaggcctctatctcgttccgttcttcgtcttccgaccgttccatcccccgctcttcattccctggtctgaaatccaggcgaggacgcaggagcggttcttgttcatgagggtcgacacgcttgatctgggaagaggcttctccaagattcgcattcagtcctcgggcgctggagccctttcaggcgaacctgccttccgtttgacggacgctcggcgtcacacttggcgccgtcacgcgcgccggtaagggctcgaacaggagttacctagccaaataggaagtagacaggcgaccgagcacattggtcggatgtgggcgcggaaaaggccatgacggagcgctaccaggcgcatcgagacgtcatggacgagcgggtgacgcgccgttgagcagacgccgacgcacttgcgctggggtgaggtggtgttaccgcagtcgcacgtgcgatgggcttgtcgcgcatggcggtgcacgcggggcgtgacgtggcgagtgggcaatgcctccagaggaggtggtgaggatgcggcgcaagggcgggggggcccccctggtggaagtggcccagccgaggctgatggcaacctgagagtcactgatggccccccgtgacctcaacgggggcgcgtaaaccgcgccccgggacacagcgcacagccgctcagaacgccgcgtcgagcacgacgtccgtggccgcgccaacacccacggccacctggtacgacgacacgcggcgctcgaagaagttcgtgagctcctgcacgtcctgcaggtccatgaagtgcagcgggttcttcgtgccgaacaccggcgtcatgcccagcatctggagccgctggtccgccacgtactccaggtagccgcgcatgtcctgtacggacaggcccatgacaccgccgctcagcaggtcctgggcgaactgcgtctcgcactccacggcctcgcggagcatggccaccacgtcgcgctccatctgtgcgtcgaagaggtccggctcttccttgcgtgccacctggatggattcgaacgcgaacgccatgtgggcgctctcgtcccggaacacccagttggtacccgccgccaggccgttcaacaggcccttgctgcgcaggaagtacacgtaggcgaaggctgcgaagaagaagaggccctcaatgcagcccgcgaagcagatgaggttcagcaggaactgccgccggtgcgccttcgtctgcagcgtgtccagcccctggatgctgtccatccacttcatgcagaactgcgccttgcgctggatggaggggatgttgtcgacggccgcgaaggccatcgcccgctccgccgggtccggcacgtaggtgtccagcagcgtcaggtagaactggacgtgcagcgcctcctcgtagagctggcgcgacaggtacatccgcgcctcaggggcgttcaggtgcttgtagaggttcagcaccaggttgttgccgacgatgctgtcacccgtcgcgaagaacgccaccagccggtggatgaggtggcgctccgcgtccgtcatcttcgagcgcaggtccaccaggtccgtggagaagtccacctcctccacggtccaggtgttcttgatggcgttccggtacatctcgaagaactgcggatacgccatcgggcgcagcgtgagattcaggccagggttcaacagcattgcttccgtgctcctcgcgctgcggcgcggtgtctccaacgttcttccaactgcgaaaccgtcaacgtcccatgcctactggcaggcctcgcacgcctccgggttctccagcgagcaggccaccgcctcggcctcggtcgccttcgccaccggagcaggggccgcctgcgccacgctggcgccaccacccgcgcccaccgtggccttggcaatccgcgtcgccggacgcgagcgcaggtagtacgtggtcttcaggcccttctgccacgcgtagaagtacatcgaggacagcttcccgatgttcggcgtctcgacgaagaggttgagcgactggctctggtcgatgaacgccccgcggtccgcgcccatgtccagcagcgagcgcatcggcagctcccacgccgtgcggtacaccgcgcgcaggttctccggcagctccgtaatgtcctgaacgctgccttccgccatcttgatgcggttgcggatgttctcgttccacagcccgagcgcctggaggtcgcgcaccaggtagcggttcacctggaggaagtcacccgacagcgtctcgcgcttgaacaggttggacacctgcggctcgatgcactcgtagcagcccacgatggacgcaatcgtcgccgtgggggcaatggcaatcatcagcgagttgcgcaggccgtgcttcatgatgcgctggcgcagcgcgtcccagcgcgccgtgtcctcgggcaccacgccccagtggtcgaactggagctcgcccttggccgcccgcgtctccgcgaaggactcgtgggcgccgtactgctcggccagctcgcaggacgtggtcagcgccgcgaagtagatctcctccgaaatcttcttggagagcgcacgcgcctccgccgagtcgaaggccagcttgagctggaagaagacgtcctggagccccatcaggcccaggcccaccgggcgccagcgcttgttggacgaagccgccgtggggatggggtagtagttcaggtcgatgacgcggtcgagctgccgcatcgcgagctgggcgttggcgcgcagccgctcgaagtcgaacttcccgtccaccagcatccggctcaggttcagcgagcccagattgcacaccgccgtctcaccctggctcgtcacctccaggatttcggtgcacaggttggacaggtggatgacgttgcccgccttgcccgtctggttgctcttgcggttgctgatgtccttgaaggtcatccagccgttacccgtctgcgccaggctcttcatcatccgggcgtagaggtcacgcgccttcaccttgcgcatggccaggccgtcggcctcggccttcgcgtaggcctgctcgaaggcgtcgccgtacaggtccgtgaagtgggggacggacttcgggtcgaacaggctccagtcgccgtccgcctccacgcgcttcatgaagaggtccggcacccagttggccaggttcaggttgtgcgtgcggcgcgcgtcgtcgccggtgttctcacgcagctcgaggaagtcctcgatgtccgcgtgccacgtctccaggtacacgcagcacgcgcccttgcgcttgccgccctggttcaccgccgccacggaggcgtccagcgtcttcagccaggggacgatgccgttggagtgcccgttggtggacttgatgagcgagccgcgtgcgcgcacccggtggtacgccacgccgatgccgccggagaacttcgacagcatcgcgatgtccgaatacttcttgtagatggcgtccagctcgtccgcgggcgagtccagcaggaagcagctcgaaagctgctcgtggcgcgtgcccgagttgaacagggtgggggagctgggcaggtactccagcgagctgaacagccggtacagctcgatggcctcattcacattgtcgccgctgagcgcgctggccacgcggaggaagaactcctgcggcgtctccagcacctcacgcgtctgcgggttcttcagcaggtaccggtcgtagacggtgcgcaggccgaagtactcgaagaggtcgttgcgcgacgggtcgatggccgcgttgagcttgcgcgcgttggcctggacgaactggagcagccggtccgcgatgagcccgtgcttgtggcccgcggccaccgactggctgaaggagtggatgtcctggttgctgacttccttctggatgaaggtggccagcaggcgcgcggagaggcggccgtactcgggctcttcgacgatgagggcggcggccgtctggatggagaggctgtccagctcgcgcgtcgtcgcgccgtcatacaggccggagatcgtcttggtggccacgcgcatcgcgtccacgcggggcaggcccacgcaggagcggcccacggcgcgcacaatcttgttgaggtccaccgtctccgtgccgccgttgcgcttacgcacccgcatggaggtggcgctgaagtcgcccgccgtgggctcggaagcaaccgcgcccgaggcagcggcgcccgtcggcgctgtcgtcgtcgccggcgtggacggaccggaggcgacgggcgggacagacatgttggcggacggcttcacgggcgtatcgaagttcacgagcggctcactccagacaaaagcagggcgctttgggcagacacgaggcctgtccagggaagcggacttccccaccacgttactggaaaattgttcaggtaagtcccgtttcggcgggacgggactagcggctggaatcgatggtgtgtctggggggatttatgggccagaccgatgttgtaagcaagaaacccacagtccctcctcttccccgctccctgccacatcggctggtggggcgccatcgaccagccacaagctatgggggggtacccgacctgtcaacgcgagatctagtgctcggcccggcatggcccgtgcaatctatgatcgatctccgagacgatctcgcagtcattccgtgaacactcggtgaccccactcaggaacgtggagtgtgggccacctggaatccaccgtggacggtcagaaagggccctacggaggggttggaaccacaccgcccgcatccgtcccggtgggggcctggggggctccgtccagggcctccccggtggtctccggctgcggcgtgggggccggggacggcgcggtgggggcgggctgcggcgcgggctgggacggcgcctggggggccgcctgggggccgctgagggtgtgcacggcgcgccgcagcgactcctccaaatcgcgggccggcggggccacggcggagagcatctggttggcgctgcgcgcgtggcggctctgactctccgcggccagcttgagctgggtgagggcctcgctgaccagccggcgggcgtcctccagcttctgccgggcctggtagtaggccacgtccaccatgtgcttctggagcgacaggcgctgctcctcggtgatgccggagagcttctccgcgcgccggaggtagtagaggccctggtcgacccgggccggctcgtccgacgcgatgcgcggccgggccaggccctccaggacggggaacagggcctggtccagctcgtcccggtcggtgaacttgcgcgtcaggagggccgagacgtcctggccttcgatggcgacgggcgcataggcgtccgccagccgcgggtccccggtccggtaggggaccgcgcccatgggggcgttgcgacccttcatcaccaccaactgtccgtcctggagggccagggtgaaggtgcgcgcgttgagctgggagaggaggaagacgaccacgccgcccaggcccaggatgagagtgaagacgaggagccgcgtgaaggtacgccgcgcccgatagccgaatccctgttgtgccgttccgttcatgtcgcctgccctcctgacgtacgagcgcgaggcccatttccagccccggcgcttaacttggggcgcgcctgcccgggggtatactcccactcccgaacacaccgatgcaccacacattccgccgcttggggcccagcgagctgctgccccgctacattttcgcggagagcctcttcgcccgtcgacgggtcctggaagtcgatgcggtcgcctccaccgggggcgagagcgcacgcttcctcgtggagagaggcgcgcgcgcggtcgtgtcgtgcgacagggatgtagcggcggtcgaggccgcgcaaaaggcgcacggcggtcccgccttgcgcttcagggccaacgtctacgacgacttcgagtcgggcagcttcgatgtggtgctggtcgcggacctggcgccgtacgtgaaggcgccggagctgctggcggagctggcgcggctggtgacgaagcagggcttcctcgtgggcggcctgcgcaacgtcgcggggctcgcgttgccccagttgctggaggccgaggagggcgtgccgcccacctatggtcaactgctggacgccctgtcggtccacttcgcctctgtggaggtggccacgcagtccccggtgctgggctaccagctcgccttcgagcggggcgaagggctccaggtggacggcaccctggtgaatcacagcgaggccgcctacttcctggtggtggcggggcaggacccggcgcgcgtggtggacccgacctgggtgcaactgcctcccgagccgctggccttcacgcggggcaagctcgatgaagtggtggcgcgcgcgaagtcctgggaggagcgcagcggccggctgaaggagtcgctgacgaagctccgcgcggagctgacggaccgcgaggcggaggcggcgtcgctgcggccctccttggagacggctcgtgatgaggtggcccggctcaccgcgcagttggatcaggcgcgggggagccaggaagcacagcgcgagcgggacgacctgtccgggaagctgcggcgccgcgagctggagctccaggtggcgcaggagcggctggccgacgcggaccggcggctggcggcgcagcggctggaggtggaggccgcgcagcgtgctcaggcggacgcgggcgtgcaggtgttggcggcccaggagtcgctgcggctggagcgtgctcgtcgtgaggagacggctgcttctctagaggaggcccgcgagcggctgacgcaggcgtatacgcaggtgcgggacctccaggaggagcaggccacgctgcgcatcgagcgcgagcgggaccggctggcggccgagcgcgccgtggagcagtccgaggaccgtcggcgtgccgcggaggccgcgcgcgagcgggagctgcgcatcgcggagcagtactcggcggcactggcggccgtggagcacctgaaggccgaggcggctcaggcggcggagacgtcccgggacgcgggcgccgccgtctccgtgaaggatgcggagctggcgcgcacggctcgggagctggtggacgcgcggcagcggacggcctcggcggagggagctcagaaggacgcggagtcgcggctggagtcgctccaggcggaggtccggggcctggagacggagctgaccgccgctcgcgagtcgcagtcccgcctgggccaggaggtggaggccctgacgcacgcggaggcttccgcgcgggccacggcgcagaagtgggaggagtcgcttcatcacgcctcgcagcggttggaggcgctggaggcggagcgcgctcggaccgaggagcgcctggggcaggcgctggagacggagcgggacgcgctccagtcccggctgacgtcgctggagcgcgagctggaggacgagcgggctcgggcgacggcgctggagcagcaggtccttgatgaggtctccgcgaagggagaggtcgaagcccggcggcaggagctggcggaggagcgcgcggccctggtccggcgcgtggtggagctggaggccgaggcttcctcgcacgctcgtacggggcggcagtcctcggagcgcgcggaggagctggagtccgcgctgcggaccgcccgagaggagctggagtccgcgcacctggagtggcaggcgtcggaggagcagctcgggcgcgttcgcggggaactggactcggagcgggaggcccgggccgcggtggaagaggcgctgcggctggcgcgtgggaagctggagggcgcggcgcagcggctgacggacgccgaggccacgctctcgcggacccgtgaggcgttggacgcggaggttgctcggcgcacggcgctggagaactccctggcggaggtccgggactcgctggactccgaacaggaggggcgggcccttgcgttggaggcgctgcgtgcgcagctcgaggccgagcaggcgcggcgcagcgatgccgaggcgacgctcgctgagactcgggctggactggatgaggctcgccagtcgctgacccaggttcgggacgcgcttgcttccgaggaggagcggcgcgctcggtgggaagcggcgctcggggatgcgcaggcgctgctccaagtggagggacaagagcgcgcgcggttggaggtggcgctcaccgcggaggcggagcgacgggctcaggcggaggactcgcttgtaggggttcaggctcgcctggatgaggcgctggcgttgcgcgcgcggaccgaggcggagctggtctcggcccaggaggcgctggtccggcacgaggctcggggccagacggcgctcgcttccgaacgtgaggagcgtgaacggctggccgcggagctcgccgcgatgcgggagcgtgccttcggcgcggacgaggtcgtcacccggctccagaccgaggcggcttccgagcgcgaggcgcgtgctcgggccgaggaggcgctcgcagcggagcgtgaggcgctcgcccaggttcgtgtggacctggacgtcgaacgccaggggcgcggcgatggcgaggccgagctggctcgcgtgcagggggtgctcgggggggagcagcaggctcgctcgggggcggaggccgcgctggctcagctccgtgcgacgctcggggcggaacagcagtcgctggccgatgccgaagcttccctggccgaggcacgtgctgcgctgactgcggaacagcagacgcgcgccgagaccgaggccgtactggcgcagtcgcgcgatgcgttcgcggcggagcaagaggctcgcgccgagaccgaggccgtgctggcgcagtctcgcgaggcgttcgcgtcggagcaacaggctcgcgccgagaccgaggccgtgctggcgcagtctcgcgaggcgttcgctgcggaacagcaggctcgctcagagaccgagtccgttctcgcacaggctcgcgcggcactcgaggcggagcagcaggctcgtgccgagcttgagacagccctgtcgcagtcgcgtgagtcgctgacggcggaacagcagacgcttatcgagcttgagaccgcactgtcgcggtctcgagagacgctcacggcggagcagcaggctcgcgcggccatcgaggctgccctgtcccaggcccgtgaggcacttgccgcggagcagcaggctcgcgcacaggctgagtctgcactggcgcagtcgcgtgcgacgctcgaagcggagcagcagactcgcgccgataccggtgccgcgcttggacagactcgctcggcactggagtccgagcagcagggccgcgccgaggccgaagccgcgttggcgcaggtccgcgcggtgctcgaagcggagcaacgcacgcgaaccgatgcggagtccgcgctgcaaacgctgcgcacggagacgtccgagcgcgaccaggcccggcaggagcggctggctgccgccgaacgtgtcatggctgagcaggagcgcgcgctcgaagcgcagcgcctggcggccgaggctcgcgagcaggagctgcgcgataccgtgacgcgcctggagtcggagcgggcgtgggcggaggacacggcgaaggaacagcgctcggcgttggagtcgcggctctcggaggcgcgcgcggcgcaggagtcggacgcggcgcgtgcggtcgcgttggctcagtccctggcggaccttgagtcggcccgaagcgcggcggatgcccagctcgccgagcgtgcgggaaccatcgaggcgctggagacgcaggtcgcccaactgcgtgagcaggtcgcggagcgtgaggcggaggcgggccgtgtcggtgaggccgccaccgaggctcgcgaggcgctgacccggcaggaagccgccgcgcaggagcgactctccgcggtcgagcgtgcgctggacgatgcgcttgctcgggcggagcggcagcagggcgaaatcgaagcgctggcggcggagcgagaccgcgaacggacggccttggccgcggcgcagcaggaactggcgcatttgggcgccgcgcggcaggagagcatgcgtctgggggcacagctccagcacgccatggcgaccctgcacgagcggggcatgcacatcgctcggctcgatgcagagttggtggatgcgcaggaccggctcgcggcgcagcgggagaacgccgagttgctcatggtgcagctcgagacggcgcggcgcttcgcgggcaaggccaccgcgatggagaactcgctcgaagccgagcgcgccgcgctggagacgctgcgggccgagctggcccgcgcgaccgaggccaccgccacggagcaggcgcgggcgaacgcgctggaggcccagctcatggactccgccggggg

SEQ ID NO: 1125 - DNA, 17622 bp, Myxococcus xanthus
  unsure (1)..(17622): unsure at all n locations
cggggtgccctcttccaggattcgcccctgtgcgatgatgtacgcacgatcacagatacacagggtgtcctgtacgttgtggtcggtgatgaggacgcccaacccgcgttcgcggaggaggaagatctgccgctggaggtcgcccacgttgatggggtccacgccggcgaagggctcgtcgaagaggatgaatcggggctgcgggatgaggctgcgggcaatctcggcacgccggcgctcgccgcccgaaaggtctccccccagggactccccaacgtgcgtgaggccgaactcgtccaggagggtgtcggcgcgctgctcgcgggccttggcgtccaggtccttctggagctccagcacggccaggaagttgtcgcgcaccgtgagcttgcggaagacggaggcttcctggggcaggtagcccacgccccggcgagcgcggcgatgcatgggcaggtgcgtgaggtcctcgtcgccaatgcgcacgcgtcccgcatccggagacaccaatcccaccaccatgttgaagctggtcgtcttccccgcgccgttgggccccagcaggcccaccacttccccggcggccacgctgaaggacacgccggccaccaccttcttgcggccgcggaaactcttctccaggccctcggcgatcagcctcgcgctcatcgagccgtgcctccctgcgcggagggggccgtcccggaggacggggccggacggggcgcggactgccgccccttgcgcctggccggggtggggttggagggcagcgattcgaagacgatgacggcgttctccacctccagccgctcgttgcccagcgtcagccggaccttcgtcccgcgcatgtgcgtggtgccctggcgggcctcgggcgagcccgtcaccaccagcacgccgctgggcacgtcgtattcagcgcgctcgcccttggccatgcggtcgccgtccacggcatgcaccccgcccgtgcacaccacacgcgtcacctcgcgttgaggggtgtagttggccgtcatccggtcacacttcaggtcgagcgtgcggtgcttcaccttcacgttgccggtgagggtggcctgggacttctggaaggtgacgttgtcgccgttgatttgaacgggctccgtcagctccttgccgcccagggggcccggggcgcgggtccccgtcccagcggagggggcagagccccccacggcggcgggaggcgtgccctgcgcgggggtggcggcgaccgcgggcgcgggctgcgcgacgaagaaggccatcacgaggaactcaatcactctggcgctcccagcacggactccaccgagcccgcgaagttgaacgtctcgtccgggaagaacagctcgaagcggtccgccctcagccgatagtcaggtcccttcaccgtcacgccctcgtttccatgcgcccgctccgtggtggcgtcgtacgtcaaccggggagtgcgggcctccatgcccttcccggtgcggatgatgacaccgcccgaggccaccacctgcttggacgcgaggctcccctccatattcggggcgctcacctccacgcctccctccgtcccggggggcgcgccctgggaagaggaacccggcggaatccggatggtggcgtcggtggcccacacctcgccggtggtgcgctggtaggacacctgccgggccgtgccggagcggatgagccggtcgccctcgaaggactccaggcgcgcgccgtgcagcaccacctccgggggaggctggccgccagacgcaccctcgccggagcccggcttgcaaccgggggcgaacaccaggatgagaaggctggcagcgagcaggcgagacacagggcttctcttatcacccggcggatgcgggcgccgcctccggaagtgggacgtcctcgctcaccggcggacgcgtcttccagcgctggtgcatccacacccactgttccggcgtcgtccggatggcggcttcgattcggctggacagggcggccgtgagggccagggcggccgcctcgcggtccgtgtcctggggcaccgggacctcttccatggacaggcggtaccccgccccttcgcggtgacagaagcccgtcaccaccgccgcgcccgtgcggatggccaggtcagcggcggcgcgtggtgtggcggccagttgcccgaagaagggcacgaagagggactgcaccttcgtgtcctggtcgatgaggatgccgaggatttcgccgttgcgcagggcgcgcagcatggcccgggcagcgccttcctggccgcgccagatgctccgcaccccgccccgggcccggaactgacccaccagctccgtcagccgggggtcggtggtctccttcgcgatgctctggctggggtagccggcgcgagccacgcggcgggcgagcagctcccagttccccacgtgcccggacacgaagacgacgccgcgcccccgggccagggccgtctccagcacctgccggtcggcgtccggccaggcgaccaggcgctccagggcctcgtcgagggcgcccgtgcaggccacctccagcgcggcggcggccaggtggcggaaggcgtcgcgggccagcgcctgccggtccgcatccgacttttccgggaaggccacggaaagggacttgagggccttgcggcgttcccctccggccagggtgtaggccagggcgcccagacgcgcacccaggctccgggcgacgcccaggggaagaggttgaaggagcaacaggacgccacggatgagcacgtagcggaggaaacgcttgaggcgctttgctaagggtggacgctccacgaggcgttcaatatcccatgcgcgaatacaacttcgacgggctcgttgggcccacccacaattacggcggcctctcgcccggcaacctggcatcgcagagccatgtcggtgagcccagccacccccgggacgcggccctccaggggctggaaaagatgcgctttgtgtccgccctgggggtgggacaggcggtcctgccgccccagccgcgcccgtccctgcacgcgctgagggcgctgggcttcacgggctcggacgaggaggtcatcacccgggccgcgcgcgaggccgaacacctgttgcgcctgacgtccagcgcgtcctccatgtggacggccaacgcggccacggtggcgcccagcgcggacacggcggatggccgggtgcacctgacaccggccaacctgtcgcagatgtaccaccgggccatcgaggcggagacgacgcactcggtgctgcgcgccatcttctccaatgagaagtacttcgcggtgcacgcgccgctgccgggcagcgggcacttcgcggacgagggcgcggccaaccacacgcggctcgccacgcccgggcacgcgggcgtccatctgctcgcctggggccgcagcgcgtggcaggacgtgcaggggcccagccgcttccccgcgcggcagacgctggaggccagccaggcgctggcgcggctccaccagttggacgcgaagtcggtgctcttcccgcagcaacaccccgagggcatcgacgcgggggccttccacacggacgtgctggcggtgggcaacgagcggttcctgatgctgcatgagctggccttcgtggaccacgcggggctcctggcggtgctgcgcgagaagctgggccaggacttccgcgcggtggtggccacgaaggcggagctgccggcgaaggacgcggtgaaggcgtacccgttcaactcgcaggtgctgacgctgccggacggcaccatggcgattgtggcgccgatagagagccgggagacgcccgcggcgcggcagttcctggagcgcgtggtggccgaggacacgccggtgaaggccgtgcactacctggacgtgcgccagtcgatgaacaacggcggcggaccggcctgcctgcgccagcgggtgtggctcacggacgaggagcgcggggccatcaaggcagacgtcttctacacgcccgcgctgcatgactcgctggccggctgggtgcggcggcactaccgcgaggtgctgcggcccaaggacctgcaggacccgcagctggcgcgggagacgatgacggcgctggatgagctgacccggattctcaacctgggcagcgtctacgacttccaacgctgaggcgtacaacggccgctgagcttccggctcagcgcgcgtccaggggctggaaggtgacgccctccagcttcagccggtctgccgcgaccaccatgcgttcggtcgcgatgacgagggcggggtaatccctcagccggaacaggtccacctcgacgggcagcgtctcccgagcgagccagtatgtatctggcaggcgctcactggcctcgcttccgcacttcgcgcaggtgggcgcacggggatgcacgaagcagtcgggatgcagccggccatgaagcgccagttgtaactcacggagcaccggagggttcttccctcggaaggtcacgtcgagacgacacccggtgagtccccggacgccttcgccctgcaacacctccagcgcttcgtcgcgaatgacgagcgtccagtcctgcaatgcgaggtgcccgaatgcccctgtcgccacgcctgacagggggccgagccgggttccgggctccaggaccgcgccttcgggcgccaggggcctgacgcgctcgcgcagccgcgcgaagacctcgaagggaacgggccaggggtcggagaacggcttcagctcagccttcgagaagctcgacaggtcgacacacggatactgcaagcccgcccagccgccgcccaccccacactccgtgcagggctccacgcctgggaggccccacttgtgcgcggcgcgactcaggttgcccgtgaagcgcgacgtcgtgctcgcttcgactcggtagaacctcacgccctcgcactccttctcctgagaaccgccgtcataaggcttctatccgaggcccacgcattccgggggcaatgggcatgttgtagggcacgaccgggccggacagctcgaaacgaaaggcgagttcgaccgcgtgccgcatgatgacgtcccgcgatgggggccggggattggccaccacgaactgccgccatgcgttgttccacgcccctcccggccccatgcccttcccgctgtgaatcttccggtggacgtgctcggggacgaccagggtgaattggtggatgtcgatgcccgccgcccgaaaccacgccgcgagccggggttcctgcggaaagaggtgatgtttgatgagcttgccgtgcggccgggggatcgcggggatgaagacgggagagcgccgcgccagcggagccgtcgcgagaggccgtgcgtccgctcgaacccctgtacggcgctgccaccagtttcggtaggtgcccgtcccacggaaagcggggctgcccgtcgccttctcgaccgtccctgccatcggcgcatgcgctacgacgtcgtccgccacgtcctcgcaccggttgccacttcgcggcttcccactcacgcatcacgggggaggacgccgtactgcacgcgagcgcgcccagaagaaggcagcagagcgtcaggagccgtagcgacccgttcatggcggcacagcctatccgagcgcccggccgccctacgcacgggcggacgggcgctccgtggccggctgcaagcccgagtgtggcaggcgcccgtagtcggacgcgctggcggtcatcaccttctttctagaggaggtgagattccccatgattcccgaagcgatacagcactatctgcgccgcaacggggtgcgtttcgagcggtactggcacccgcgtgccgtcagcgctcaagaagtggccgagtcgctgcacgtctccggctggcgcgtggccaagtccgtcatcgtgatggcggaccggcagccatggattgtcgtcgtccccgcggcgggcaccgtcgatttggaccaggtccgagacatgctgggtgcccggcacgtccggctcgcgaccgagccggaattctccggccactttcccgactgcgaggtgggcgcggaacctccctttggtgagctctacggcctgcctgtcgccgtggatgaatccctcagcctggcggaacggctgctcttccgcgcgggctcccacgaggagtcgctcgagctgcgcttccaggacttcgccatcttggagtggcccctggtggcctccttcatcgaggaggagcagcaactccaagccatccacaacaccggcgcgcccagccgcccccgtgaggaggcacacgcccacgtctgaaccggagcgaggcccgggcgactaatgcgcgtcccgagcctcgccatccacatccgggccacgcagcaggtactccagctccgcctcgcgcgggtcctccgacaacgtcttgcgccgcgaatccacgcgctcgcgctccgcgccttccagccgcgccacccaggcccgcgcctcggcccgcgcgcccgcggggagatgccgcatgccctcgtggaccgaacgcgccgccgcgtcatagcgacgcagcgcctcctgggtccgcgccaccgcgaagaacgcatccgcgccaggcacgagccgggccgccgtctgccgccgctccagcgcgtgggagagcagcccctcgcgctccaggcacgccgcttccatggccagcaaccgcgcgcgctgggcgtagtccgtgatgaagggcgccagcgcctggagcgtgtccttcgcccgccgagtcaaccccgcatccagttgctgcgccgccaactggaaggacagcgccacgttgcccgggaagcgcgccaacatttgctccaacacacgcagggcctcctcccgcttcccctgcgcccgcaacacttccgcgcgcaacaggtgcgtgtccagcgcgtccggcgccaggcgctccacctgcgcccgcgcggcctccgccgtctccaggtcccctcgcaggattcgcaaccgggcctcgcgcgcccacagcgccgcggcttccggctgacccgcgaagtgctcccgcgcccagcccgagtagtccagcgccagcgccaaccgccccggcgtgttggccagcgcgtccagcaaccgcaccgcggtcgccggcgaccgcggcgtcagcaccgtgagcgaggccagggtctccgcctgcggcagggcctcgcccagcagcacggtggcatccccagcctcgtgcgccagccggtactccaggaagccctgggcgctccggcccaacgccagcaacgcccgcgccgccacccggtgggagctggcatccagcggtgccaggtacagcgcccggttgaccagggccagcgcctcccctgccccctcacgccctcgcgccgcgtgcgccgacgccaccagccggtacaacaggtagtccgaggggtgccggtccaccagcgccagtccccgcgcgtggacctcccgcgcggatgcccccgacgtgacgagccgcgccagctccgcctccgcgtcgcccaggcgatgacggccgggcaccagcgccaccagcgccaccgccgtgagcgccaaccccgtccccagcaccgcgcccgagggccgcgcgcaccacgccttctcctcgacggcccgctcccggggacgcgccaccgcgcccagcgccaccaacgccgccaccgggcacgcgggcaattccaagctgaaatcgaagaggtcgtgcagcgccagcgccgccacgcccgcgagcgccgccaggtccactgtctccaacccctctcggcgcagcagccgcaagaagccccagacggccaccgccagcaacaccagccccagcgcgcccagctccgccgcgacctgcaacaccgcgttctccgggtgcgtgaaggtgttgggattgggctccgactggtagcgcggaaacgccgcctcgaaggcgccgcgccccatgcccagcacgggaaacgcccgcgcggcgtccgccagcatcggccatagtgccaccttggactggcgcagcttctccacgctgtccgcggtgcgcgcctccgcccacaggccgtccgccgccgtgtacgcacccaccatcagcacgcccagcagccccagcagcgccgcggcgctccgggcccataccgggggcgccccttcaccggacgcgcggcgattgcgaagcaggaacagcgccagcagcgcctgtccgaaggcgaagaaggcaatgcccccgcgcgacagcgacagcaccacgcccagccccgacacgcccgccgccagcgcgtatggcaacgcccgcgactgatgtccgcgcgtcagcgccagccccacgcccagcgtggacgccagcgcgaggaagccggccaggtggttcgggttgccaaagggcgtcaccagcgtgggccgcgcgtgcatccagtgcatcagcccgaagagggacttcacgcccagcaacgcatggcccagccccaccaccgtgaggcccgcgccagtgaagaccaccgccgccagcaaccgctcccggctgccccgcgagcgactcacctgcaccgtcgcgaggaaggccagcaggtaggccaggtgcttcgccagctcgcgccaggtggcggacgggtccagcgacaccggccgcgcccgcttcagccccagcggcaccagcgcgaactcccgcagcgcggccgcctccggactcagcaggcgcaggacaccgtccggcagaggcaccagttgcaccgcgcacaggcccgcccccagggccaggggcactgccagcagcggaacgcgcagcgactggccctgccgattggcccctatcgccgccagcaccgccgcggcgccggacaacagcaccagcggacccagcagccaccccgcggcgccgcccaacgccagcggacacaccacgacgagcgccgccagcgccgcctcggcgaacagggtgaatcgagaggcactgcgggaagcgcgaggcatgcggggattggctgggtgagtatcacagcacccgcgcccctcgcccgccaccccgccaccaggacgagccgccagaagaccggacgtgcgcgaaaggtgacatcagaaggcgaaggcgaccagcgggatgccagcgcgcggcgtccactgccgcgtctgcatggcccctcgcgcgtcccggcgggccttcacgtcgcgcaactcatcctccaggcggatgcgctcgcgaaccaggctttcccggtgggcccggttgatacccgcttgcttggaacccgtgacgatgcccgcgatgagcagccccacccccgcgactccgcccagcgtcgtgcccacccccagggccagcaaggtgccggcgtcgtcgtcattcgacgagctcatgccgacgatgatgaggggaatgcccaatagcagcaacggggacagcacgtagcccgagtacgccatcaccaacgaccccgcgggccagttcgtgtcaacggagcgaatctcgctctggagcatcgcgatctgctgcgtcagctcgcgagcgcgggcgtccaggtcctccggcaggggcggcggcgtggacgtcccagagacgtccggcgcctccgccggggcctgggccacgaggagccgggtggacacgggccgctcggacacgggcgtcagaagtgagtgggacgtcgatgtggacgcggtggccagcaacgcagcggcgacgattgacaacatgtgtggcgtttcccccaggtgtggagcaggcgggcgaccctagcatccgcccaggcacgaagggctcgaagccagcttgcatccaggggaccttctggcatgttcgccgcagccatgcgccgcttcatcgtcaccgccgccctcctctgttccgccctgtccggcctcaccggctgcaagggcgcctgccgcgagctgtccgagaagctgtgcgactgctccatcaactcggtggagaaggagctgtgccttcgccgcgcctctcaggaggaaaaccgcgtggagcccaccgccgaggatgaggccgtgtgcgaggagcgactggccggctgcgactgccgcgccatcgagaccgacgaaggcaagcgcgcctgcggcctctcccgctgaggcggcccacctgaccggaggctccgggtgcctgtgccccggacgccgcccgtctcgcttgacggcgcccgcacgccgctcaggtccccgacaccaccggcttcacgggctcgcgcgacgccccctccccccagggcgtcagcgcggcgcggatgcgtgagcgcagcggtgtctccacggcgcggtgcacccacagcgacgcgggcacgcccagcaacaacacggtggccagcagtccttcgggcgtgcgcagctccacccagggcgacacccaagcccccaggcccttggccgcctccgacaccgggtactggagcaggtagagcgcgtagctggcgcctcccagcttcaccagcgtgggccgtgacagcagccagcccagggcgcctccgccccgcgccagcccgtacaccagcagccccgacgcgggcgccagcagggcgttgtgcatcagcgggtacggcaccctcgagcccgccgcgcccgccgccaccagcagtgccgtccccagcgccgccagcaccgcgccggagcccttcgcccctcccgccgcgcgctcgcgcacgaagcaccagcccagcaggacgccgaagaggaactccggcagccgcgccagcgggttgaacttgagcgccatcagccagggccccgacgcatgcacgttcacggggcccgggccgtccggcaggagcgccaggtacagcagcggcggcaggaaccccagcacnccacgcgccgccagggccacggggagccacgcgggcttgagccggggcagccccttcgccagccggggaaagaggccgtaaaagcaggcctccaccgccacggaccagcccggcggattccagtacagcgcgagccggggaacccaggcctggagcagcgccagcgtcgccaccccgcccaccgcgagcttcgcggcggccaccttccagccgttatccgccacggacgcggcgatggtggtgggcgcggacaggaggaacgtcagcacgtagacggggtacacgcgggcgacgcgcgcggcccagaaggccctgggcgacgtctccatgcgcccgtccgcgtccaggtagttccaggcgagcacgaagccggacaggacgaagaagacgcccaccgcggcataacccgcgcccacccagctccgcagcgcttctggcgccgtgcccagacacggcgccgcgaagtggaacaacacgacgtgcagggccgcgacgaagcgcagccccgtcagcgcgtcgagggccctgctcccgctcaccgctaccgccggccgatgccgtagtacgtgaagcccagctcacgcatgcgcgccgggtcgtacacgttgcggccgtcgaacacgacgggcgacttcatcagcgtcttcatgcgctcgaagtccgggtggcggaactcgttccactccgtcaccacgaagaggccgtccacgccctccagcgcctcgtagggcacggaggcgtagcggatgcgatcaccgaagacgcgcttggccgtgtgcggagacaccgggtcgtgcgcaatcacctgggcgcccttgccgatgaggccctcgatgacctcgatggacggcgcctcgcgcatgtcgtccgtcttcggcttgaaggccagaccccacacgccgaacttgcggccctccagcgagccgtagtgcttggccgccttggtcaccagcagcttcttctggcgctcgttggtgcgctccaccgcgcgcagcaggtccagctccaggccgtagtcacgcgcggtggccaccagcgccttcacgtccttggggaagcaggagccgccgtagcccacgcccgggaagaggaacggatagccgatgcgcttgtccgaccccaggcccttgcgcacgaagtccacgtccgcacccaccttctcgcagagcgcggcgatgtcgttcatgaaggagatgcgcgtggccagcatcgcgttggccgcgtacttcgtcagctccgccgagcgcgtgtccatgaacaacaccgggttctcggtgcgcacaaagggcgagtacaggtccgccatcaccttgcgggcgcgctcggagtccacgccaatgacgacgcggtcgggcttgaggaagtcgtccagcgcggcgccttccttgaggaactccgggttggagacgacgtcgaactcgatgtccgtcaccttgcggatggcctcgcgcaccttgtccgcggtgcccaccggcacggtgctcttgtccaccaccaccgtgtactgcttcatcgccttgccaatctgctcggcggcggccagcacgtactggaggtcggtgtcgccgctctcaccttccggcgtgcccacggcgatgaagacgacctgggcgttggtgacggcctccgtcaggtcccgggtgaagaacaggcgcttctcgcgcacgttcttcttgatgagctcctccaggccgggctcgtagatgggcacctcgcccgcctggagcatgcggatcttccgctcgtcgatgtccacgcacgtgacgtcgttacccgagtccgcgaaacaggtgcccgcgaccagtccgacgtagccggttccgatgatggcaatacgcattgagggagccccagtgaatgtctcttgcaggactcatacgccgggagggagtccgaaagaaagcccatccccgtcactggggctcctctgtgagcagccgggcttactggcccgtgagcaggcggcgaacccgctccatccccttgagggccgaggtccggccgggggtgcatacaggacccaccaccgtccgctccaacagctcccgcgtcgcccggcgcagcggcggcagcgcggcggtggcgtccgcggcggcgtccgggaacaagcgcgcgacaatcgacagggacgtgtagagggcccgctccaggcgccactccgcggcccgggccagcagcaccggcacatccaacggacgcgagtacacgccgcccatccacttcgcgccggtgacgagctcgcgcaggtcgatgaaggacaaccacggcaccgcgtatccatggcgcgcatgctccagcgccaccagcagcaccgcgtcctccagctccgggcggtagagggaggggccatacacgcgcatgggcttcgcccgctcgaggatgcccgccgtctgttcgcggcgctgggggcccagcacgtccgaatagagcaggatgaccgtgcgcccgtcggacaccaccttcgtggcgccgctgttctccgtgtcgggctctggggcgaactcgtggtgggacaggaagcccgagaagccgtccacgtgcaggcgcttcatcaggatttgcagctccggcacgggccggaagcccacgtgcggatagagcgagtccgcgaaggacgcggcccccatcagcaccagcttgcgtgcctccagcgcgcccacgatgcgcttgaagttcacgagcttcatcacgttgtcgttgacggagccctgatagatgctgagcagtttgtcccgagcccactccggcgcgttgcccgcgcccagccggtactccaggttgtaggccgccaggggcgccaggccctgcatgatggcccagtccacatactcttcccagggcgccccccgaagcgcgccacgcggcgggtcgaacgaagagagaactcggaaggtatcgagaagaccggcggacatgggcccccctttaacggtccggacgcatggcctgcaacgtccggatggcgtcacgcccgagcgccaagggtgaacagccgacactgggcggcctttcagggtgggtccccaaaccggtccgagtgaatacctgggccgcccggtacgtcgcgggccgggcaggctttcttggaggcggcatgtcgcagcagggatggtcggacgggcgtccgggccgttggctcacgctcggagcgctcggatgggtggcgtgcacaggcacgacacccgcggaacctccggcattcgacaacaccacggcggtggagtcggaggcccggtgcgagatgcggccgcccttcgagccccacttcgagcccgaggtggagtgggcgtggacggccagtcccctcatgcccacgcataccaacgcgcaggccacgcccgtggtggtggacgtcaacgcggatggcgtccccgacgtggtgttcaacagcttcgagggctggaacttcaagacgaacggcgtgctgcgcgccatcagcggcgcggacggctcggacctgtgggcggtgacggacccggcgtaccgcacccggggctccgccagcgtcgccgcgggcgacatcgacggcgacggcaaggtggagctgtgcaccgtgccggagagcgcccagggcatcatctgtttcgagcacaccggcgccttcaagttccgcgcggacggccccccgctcgactggggcggcgtgtccctggccgacctggacggggacgggtcggtggaaatcatcgccggcaaccacgtctacgacagcagcgggacgctccggtgggtggggagcgacggcgtgggcagcccggccaacgacaccggaccgctggcgttcgccgtggacctggacggggacgggctccaggaggtggtgaatggccgcgccatctaccggcatgacggcacgctcaagtgcaaggcggcggagctgggccacgggctcgcgggcgtgggcaacttcgacgcgggccccgagggcgaaatcgtcgtggtgtggggcggccacgtgtccttgatggacgcgaactgcaaggtgaagtggaccgtgcagcacctgggcggcggcgtgggtggacctccgaacatcgcggacttcgacggggacgggcagccggagattggcgtggcgggtgcgtcccactacgccgtgttcgagtcgaacggcacggtgaagtggctgagccccacgcaggaccacagctccaaccgcaccggttcctccaccttcgacttcgagggcgatggccgcgccgaggtcgtctacgcggacgagacggcgctgcgcatctacgacggcgtgacaggtcaggtccgcttcgaggcgccgcacagctcgtgcaccgcgtatgagaatccggtggtcgcggacgtggacggtgatggcaacgccgaaatcatcgtcgcgcagaacacggcctgcggctacggcgacttccagggcatccgcgtgtaccgggaccgcaaggacggctgggtgaacacgcggcgcatctggaaccagcacgcctactccgtcaccaacgtgaatgacgacggcaccctgcccgcgcgccccgtgagcaactggctggcgccggggctcaacaccttccgcaccaacagccagggcacgggcaccgtgcggcccttcgcggcgccggacctcgccatcgggcaggtgacggccacgtgcacgggcgagggcgcggtgatgctcggcgcgcgggtgcgcaaccagggggactcggcggcctcggcgggggtccaggtggccttctaccaggacgcggtgggcgaaggcggcacgctcctgggcgtggccaccgtgccccacaagctgaaagcgggcgaagagacgtccgtggagctggcgctcgacaccccggagagtggctgggtgctggtctacgcggtggtggatgacgacggcaccggcaccggacgcgagctggagtgccgcgaggacaacaacgccgcgtcggcgcaactgaagctggcgtgcgcaccaaacgagcctccagtggcgttgtgccgggacgtcgtcgtggaggcggacgcgcagtgccgggcctcggccaacgtggaccacggcagccatgacccggacggacagccgggccccttcacgctgacacagacggcgcccgggcccttcggcctggggcgacatgccgtgacgctgacagcccacgacggcgaagacagcgcggtgtgccaggccacggtgaaggtggtggacacgacgctgccgtccatcctctgtccggcgccgcaggtgctggagtgcgtggcgggcggcgcggaggcgacctacaccgctcgggcggaggacaactgcgggccggtgtcggtgacgtgcacgccgccggatggctcccggttcccgctggggcgctcggtggtggactgcaacgcggtggatggctccggcaacgcgtgcggctgcgccttctccgtgacggtgcgggacacgcgggcgcccgtgcccggcgcgtccctgggcaagcggctgtggccggcggaccaccagtaccgcacggtgacgctggccgagtgcgcggcgcccgcgaaggacgcatgcatgggagacctgtcgttggagcggtacggccgcatcgtccgggtgacgtcggatgagtccgaggacgtcgcgggcatctgcgacggcaccacttgcgacgacatcgacgtgcgggtgaatgccacctccgtccaactgcgcgcagagcgcgacgacaccggggatggccgcgtctacacggtgcactacgtggtggaggacccgtccggaaaccgggccgacgggcgctgcaccgtggaggtgccgcgggattcggccggccagcaggtgcacgacagcggtccgaagtactgcgtgggccagggctgcgcgccgggcctgggcggcagcccgctgtgtccgtgaggtgagcaaggcaggggcgtggagcggngtcgctccaccgccccgcttccgccccgcgcatcaggcgccgcgacgcgggtcccgcacggcgggaagtgtggcgtctccttcatgaggcaggttcgcatgaagacgctgcctggcgtgctggcggtgggagggcctggctggctgcggcggaggcatgccgcgcacccagctcagcctggacggcgcagcctcgcccgcacggcgttccgtgctcgccggacgccatatcgcgccacggagcccatccgtggcgccagcagcagcttcgccgccatccacccggtccggccatccagcagcgacgcccccagcagccgcgcgtcggagaaaaaacgccgtgcgagcacttgctgccagcgaggcggagccagcggcgccagcgcctcgtccggcaccggcgccgccaggagccgccgcgccacggcccacgcataccaggccgcatgtgggaaggccgtgccgcgtgcccgctccaccaccatccgccagtccagccgcgtatccgccagcgccagcagcttcaagtcgaagagccacgccaaccgctgcaacgcgtggttgctcgcgtgcaacgccaggtagacggcctcgtcctcgggccgtagccaccgcaccgcccggccatccaccgcgcccgtctccgcccgcgccagcagcgcgtcgccctccagcgcctcgccccatcccgcgagcgcgcggtagtgcagctccaccagccccgccggcccggccagctccaagtggtgagagtcctcttccccgtgccgggcgccgtcgtcccgccgcaccgagagccccacgcgggccagcgcctggaccgcggcgcccacatgcgcgcgtgccaccagcaggtccacgtacgtggtggctcgctgctacgggtccggatacaggcgcagcgccagaccatacccctttgagcagcaccggtacctgccccaccgtcgccagtgcgttcaggcttcgcagcagcagcatcttcacgcgca

SEQ ID NO: 1126 - DNA, 16265 bp, Myxococcus xanthus
gggcgtcctcgccatgggactgtggcccacgcgcggcctgcagatggtggccctggaggacctcgcggcattctccgtccgcatcatggaggagccggagcgcttcgaggaacaacgcatcgaggtggcctccgacgaggtgacgggccagcaggccgccgggctgctgtccatggtgagcggccaccgcatccactacgagcaacttcccctggactacatccgcgagcgcagcgaggacctggccgccatgtacgagtggctggaccgcaagggctaccaggcggacgtcctcacgctgcggcaccgcttcccggaggtccgctggcacaccttcgaggactgggcgcgtggacaggactggagcgccctgacttctcccgcgtggccccatgccgccgcggagcccgtatccccatgagcccccaaggccggcaccgcgggcctttgctcagtgaagcgtcggcgagacgtcccgcatggacgcgcgagggaagccctccaacaacgacgcctcgtcggacacacccaactcgcgccgcagcgtcgggccgtccatgggcagaccgaagagcgccgccatgggcacccagtccagggccgcagccaccaggggccccaggcccacgagcgccaccgccgcgcctcgcgacgtccccgacgccagtccgcccaccaccatcccagcgcccgtcacgatgcggagccaccgccccggccgcgacgccaagaaaccaacgaccatatgcacctcccaggggcgaagatggacacgtcctggcgggcggccacccaggccagagccccgcacgggtggaacgccgggcaaccaggcagccgcccacgggcgccctgaccgagcgcctgctcgccgtgcgtctcacgcgggcttcaccggtgcggcgccccgcctgtccgctgccagcttgcggggtgaaagccagctttcgcgcacggggctccacggaccgccctgggggaggcaaccatgttcagtcgttcggaaatccacaaggggatgaaggtgcgcggcaacgacgggcacgttctcggacgcatcatcaagatgacgggggatgaactcatcgtggagaagggcctcatccgccggcatgacttcgcggtgtccctggcggacgtgcgtgaagtcgtgggcggagaagtcctgctcaaccacggacgggacagcctcttctccgcgccccgggaagtcccgcccacgaagcactgacggctcagacgccgcggctcgcgtccggcgcgccctccggggcagcggtggcctccggtgcaccgtcgccgcgccatccggcacgcgcctccgcctcacgggccgcgcgtcgccccgcggccacgtccacccgggacagcaccgccgcgcccgacacgaaaaagaagagcagggacagcaccgcctgccggctggagcccgtcagctccaccgtggccgcgaacaccagcgggcccgccaccgcggtgaccttttcgaagacgctgaagaggccaaagaactccgccgccctgtcccggggcaccatctgcgcgaagagtgaacggctcaaggcctgactgccgccctgcaccatgcccaccagcaacgcgagcgcgaagaagtgcaccggcgtgcgcatgaagtagcccaggaacgtcacccccacgtacaccgacagggcgaacatcagcgcgcgcttcacccccacccgccccgcggcccggccgaacaacaccgcgcacggcacgcccaccacctgcgtcagcagcaacgcaccaatcagcgcgccccggccaatgcccagctccgtcccgtacagcgtggacaagcggatgatggtgccgatgccgtcgctgtagagcagataggccaccagcaacaggaaggcctgacggtgctggcgcagcccgcccagcgtgcccgccaactgcgtgaagatgccgcgcagggacagcgggggacgttggatggacacgtccggtttcggctcggggatgcgccggaagaggggcaccgagaagagggcccaccacaccgccacggaggcgaaggccacgcgcgaggcggcccccgcgtccgccagtccgaaccactggggcttcatcagcagcaccaactgcgcggccagcagcagaccgccgcccaggtagcccagcgcgtagcccgcagtggacacacgatccaattcgtcgtccctggcgatgtgccgcaagagcgcgtccgagaacacgatgctgcccgtcacgcccacgttgcccagaccgaagagcagcaggccccatgcccaatcacccggccccaccgtggccagcgccagcgtggacaccatgcccaggcccgcgaagatacccagcatgtgcttgatgcgtccggcccggtcgctcagcgcgcccaggaccggtgacaacaccgctaccacgctcagcgccaccgcagtggcggtggcgaagcggctggtggccacctcgcgcggaagcccctccgccgccacggaggcgtagtagagcgggaacaccaccgtgacgacggtggtgatgaaggccgagttcgcccagtcgtacatcgcccacgcgcgcagcgcgggccgcgtcaggccgatgcgcgacaggagcccccgcaccctgtgcctcatgcgtcgaagtccaccccactcacggcatcgtcgccctgggccgactggtagacgtgccaggccgccgccaggtcctggaagggcagccccaccgccgcgaagacggtgacgtcctcctcggacgtgcgcccggacttcagtccggccagcacctcgcccagctccgcgtggatggactcctcacccagacccaccgcgcccgcggcgccggtggacaccgccaggccccggtggtcgacgacgaaccgggactgacggagcagctccgcggacagctcggccttgcccggctcgtccgcgcccagcgcgatgatgtgcgtgcccggccgcaccatgccggggtgcaggaaggggtgacggctccacgtcgccgtcacgatgatgtccgcgtcggagacggcctcctccagggactccgccatccgcaccggcaggttcaactcctggtacatgcgcgtggcgaaggcgagcgagcgctccggcgccgtgtcgaacacccgcacgtgcgtcagcgagcgcaccagccgcaacgacttgagctgcagcaccgcctgccggcccgcgccgatgagcgccacccggctcgcgtccggccgcgccagcacgtccgccgacagcgcgcccaccacgcccgtgcgcaccgccgtcaggtggccggcgtccatcaccgccatcacctcgccggtagcgacgtcgtgcaggtgcaccacgcctcgaatcgccggcgactggccagggaacttcgcgtgcaccttcacggagtaggcggggatggagggcaggctgccagggaacagcaccagggcggtgccctcggcatggaggggggcccgggcgcgctgcggtgccacggtgcgtgccagggcgtcggtgcggaaggcctctcgcatgtcctccagcaagagaggagcctgcaggttgcgggagacgtcggagcgggtcagcaggagcgtgcgcatcttgcagacaccctaaccgagcccgtgcgggcccacagctccccagcacacggacacggtggcaagcgcccgaagttggacgtccgagcggacagtgcgccgccgtgccgcccggggtggcatccaccgggcccgcatccagcgacggtgggacgaggcacgcaggcgccatcgtccccagaatggaagtgaacggcggggtgggcggccccagggcctcgggaggccggtgatgctggagacagagccacgcacagcgggcgacaaggaggcctccggggctcggacgctcaagacggcggcgttcctgcgcgcccaccaggaggaggtgctggaggactggcagcgggccatgcggacgcttcacgtgggacacgcggcgcagccttcgtggctgctggaccacatgccccagttgctcgacatgctcgcggacctcatcgaccacggcccggacgaaatcctcaccacggtgccggacgagcacgcgatgtcccggctggacgccggcttcgacctgggccaggtggcgtccgagtacgcgctcctgcgcaagtgcatcctccgcaggatggacgccgaagcggcctaccccgcgccgggcgagttggagcggatggaggacgcgctggaccggattgtcacccggacggtgacgtccttctcccagggacggcagcgcatcctccaggccctggaccggatgacgcaggccacgctggacagcccttccatggccagcctcccctcgcggctgctcaccgtcctggcggagtccgcgctctcggtcgactcggcggcgttcgtgctggtggaaggcgacgcgctggtggtgcgcgccgcggtgggcctgggcgcggacgaggcgctcggcgtgtcgctggagcgtgggcaaggcttcgtgggcgaggtgctccgccagcgtcagcccctgacgctgcgctcagcgtccacggaccctcgcgtggcgctgcccacgctgaagcaggaaggactgcgcgccgtgtacggcgtgcccctgctggatggcgaccaactcctgggcgtggcgtacatgtgctcgcgcaccgccttcgtcttctccgagccggacgccctcttgttccggaccatggcgcagcgagccaccgcgcacctggtgcaggcccggctccgggcccgcgagcgccaggcccacgcggacgcccagcgctcgctggcgcaactggacgcgctgctggcctccacacctctgggcatcgcccaactggaccgggagttgcgcttcgtgcgcatcaaccaggccttggcggacatcgatggccactcgccggaagcccacctgggccgccgcttccgggagatggcccccgtgacggccgtgggcacgttcgagcccatgttccgccgcacgattgagacaggtgaacccgtggacgccgtcgagttcaccatccctggagatgcccggaccttccaggccagcttccacccgatccgcacgcccgaccaaggggtgctgggcttgagctgcacggtggtggatgtctcccaccacaagcaggccgaggccgtgctccagcgggcggtggacttccgggaacaactcatggcggtgttgggacacgacctgcgcaacccgctcaacgccatcaacgcctcggccttccaactgacgcggtccgaggacctgacaccccccgagcgtcgcgccgtggaccgcatccgcaaggccaccgcgcgcatggggcgcatgattacggacatcctcgacttcgcccgcacccgcctgggcggggggcttcccgtggcccgccagcccatggacttcgtggaggtatgccaggcgacgctggaggagctccgggtcagcgccccggagcgctcgctggtgttcgaggcgagcggagacacccgagggaactgggacccggaccgcgtgtcacaggtgctgggcaacctggtggccaacgccatccagcatggccaggaagacagaccggtgtgtgtcacggtgcgcggagaggcggatgaggtggtgctgaaggtccacaacaccggcgagccgattgcggccgagctgatgccgcgcctgttcgacccgttcaagaacatgcccgcagccgcgccaccgcaggacgtcgcgaggaagaaacgcagcctgggcctgggcctctacatcgtcagccagattgtcggcgcacacggggggcacgtggaggtccgctccaaccgggaccagggcaccaccttcaccgtccactggccccgcaccctcacgacgctcggggacgcatgaagcagcgcggcaggcgggacggcctgccaccctctgcccgcacgcctgccctttctgggggtgaatcgcgcacgccaggccgctatgcgtagggcatgttcttcaatccgaccaagaagctgaggattccgaccccggaggaagcactgccgggccgctcggatgtgatgcccgtcccggagaagcacgaggtgctgggcacgcccatcaagggccccgtgccggaaggcctggaggaggtctacttcggcctgggatgcttctggggcgcggagcggaagttctaccagacgcctggcgtgtacagcacggcggtgggatacgccggaggcccgacgcccaaccccacctaccgcgaggtgtgcagcggtctcaccgggcacaacgaggtcgtccgcgtcgtcttcgacccgaagaaggtgtccttcgagcagctcctgcgcgtcttctgggagagccatgacccgacgcagggcatgcgccagggcaacgacgtgggcacgcagtaccgctccggcatctacttcaccagcgaggcccagcagcgcgccgccgtggcgagccgtgacgcgtaccagaaggcgctggcggcccggggcttcgacgccatcaccaccgagctgctccctgctccgcccttctatttcgccgaggactaccaccagcagtacctggagaagaacccgggtggttactgcggactgggcggcaccggcgtgagctgcccggtgggtgtgggcgtcaacgcctgaagccagacgccgacgtgcgcgggcgcgtgtcgggactccatgcgcccgccttccggctcaccaggtagtcagaggacaccccggaggcccccatgacacgggcggtggccacccagccctgcggggcatcgcccaagagtcctagcagccaatccatacacagtccgcgtcctacccaacgcgtctgcgtctgcgctggacgcaaacaaagacaaacacatcaaccccgcaagcacctcacagaggaggaagtccctctcacgacgaatggcacgccatctgcttcgcggctgcgcggagccgccgacccccgtccaggctccagcccgcagttgcgtcagtccaacctcgactcaaaggacgtcacgaatggctgcgtatctcgttcagaatcagtggggtggttcgcaagcgacctggaacccgggtgggctctggctcatcggtgcccgggacaagcagaacgtggtggccctcgacatcaagtccgacgacggcggtaagaccctgaagggcaccatgacgtacaacggcgaaggccccattggcttccgcggcacgctgtccagtgccaacaactacacggtggagaaccagtggggtggcacctccgcgccctggcagcccggcggcgtgtgggtgctcggcgcccgggacaagcagaacatcgtggccgtcagcatcaagtccaacgacggaggcaagacactcaccggcaccacgacctacaacggagagggccccatcggattcaagagcgaggtgactgatggcgacacctactcggtggagaaccagtggggcggcagcgccgcgccctggcattctggcggggtctgggtgctgggcactcgcggcaaacagaacgtcatcaacgtcgacgcaaagtccaacgacggaggcaagacgctctcgggcaccatgacgtacaacggcgagggccccattggcttccggggcacgttgacctcgccggacacctacaccgtggagaaccagtggggcggcagcaccgcgccctggaacccgggtggcttctggatgattggcgcccgcaacggccagaacgtcgtcgccctcaacgtcgcgtccagcgacggcggcaagacgctggctggcaccatgatctacaacggcgagggccccatcggcttccgcgccagactcggctgacgctcgccggctggaccggccctgattcgagggccggcccggccacctgccttacgccaggttgtggaacacgcgctggacgtcgtcgtcctgctccagcgcgtccacgagctccagcacctcggtggccttgtcctcgggcagctcgatggggttcagcgccacgtattcggagtccgccgagacgggcaccaggcccttggcctcgatggcggcctgcagctggccgaagtcggcgaaggcggagcggatgatgatctgcttctcgcccttctctcccacgccctcacccatctcctggaggccgtggtcgatgagctccagctccagcgagtccaggtccaagccctccgggttcaaccggaacacgcccatccgctggaacatgaaggccacgctgcccgcggtgcccaggttcccgctgtgcttgttgaagtgcatgcgcacgttggccacggtgcgcacgacgttgtccgtcgccgtctccaccagcagcgcgatgccatggggcgcgtagccttcgtagagtacgatttcgtagtcggtcgcagactggccgctcgcgcgcttgatggccgcgtcgaccttgtccttcggcatgttcgcggcgcgggcgttctggagcacccggcgcagcgtggagttcgaatcgggattgggcccacccgccttcaccgcgatggcgatgtccttgctgatccgcgtgaacaccttcgccatcttgttccagcgggccatcatcgtggccttgcgtgtctcgaaaatgcgtcccatggctgggatgtataggtcggccacgttccgcgtggctactccctgtagcccccggagcgcggatgttgaccaggacaggccgcacggtcgccgggggcaacccccagcgccccgcacgtcacaccttcgcgggcttctccagcaccagcccgaagtgcgtgtagcaggtcgggtgcaggtccatgatgttctcgaagtggaagacgcgagactgaagtcccgccgtcgaacgaggcccatgtcgaccacaagctcgccaagtcgaagggcggcgcaggcgatgtggacaatggacagcttctctgccggaagcgcaacctcaagaagggcaacaagcactcttgcgacgggaaatcgaaatgagcaccgcgaagcgtgatgaccgggtcaaggtcatcttcgagttggagaaggacgaggacgactcccccccgcggactccgagggactctgggcgcttcccctggggaaggggttgttccaactcgacaacgtccccttcttcgcgaagggcgttgcctgcgaagacgtcgtctcggccaaggacgtggatggagagcttcggttccagaaggtcgtccgtccttcgggccatgccaccctgcgcctcatcgtccacgacgaggaggatgtgccctccgtcaaggagctcctggagaagcacggctgcgctgtcgagcggagccatgtccccgggctcatctccgtggacgtgccgcccacggtcccactcgactccttgaagccgctcctcgacgaaggtgaagacgaggagcgttggggctacgaggaggcgtgtctgccctagcggacctgctgcgtcgcgggcaccgcgcgggccacttcacccgagcccacgccgcccgcccgggcacgctccaggtgcggagccagccgcccaatggccatcagccccgccatgcggaaatcggagatgaacgaccagaacgggtacttgaacgacgccggcttgttccgctcgatgacgaagtggctgaaccacgcgaagccgtaggcggcgacgagcgcggccggcaccagcgcgccgcggcccgtggcgacggccgtcacgcccagccccagtcccagggaggtgcccgtgaagtgaagccagcgcgtggacggcagcgcgtgctcccgcaggtagaacggccagaactcggcataggtctcgatgcggtcggacatggtgggaagttagggcccctgggcgccctcccgtcaacccggctcgacgcagagcgtgtaggcatggacaggcaagggtaccccccgcacgcctaccagccgggcaggccgtccagcatccgtcatgttttccagcccggtgccacctcctcggcgcgggcctgccggacgcctccaggtcatgaaagactctggagccatgacggagtggatgcccaagccgaaccccgcggtcgacctgcggacgctggccctcagcccagaggagggcttcgtgctctcccgcctggacggcgccacctcggcccggaacctgcccgcgctgacgggcctgccccccgagcggctgcggaccatcctctcccggctcatcacccagggcgcgctgctgcccacgcccaccgcgagcccggcggcacctgtcgccgctccgccagtggccttcgagccccagcgacggacgtcccccgcggcccccgagcccgaagcagacctccccgtgctcgacctgacgccgctggacgccgcgcccgaagcagacctccccgtgctcgacctgacaccgctggaggccgcgcccgcccccgacaccgcgcaggacgccgagccgtcctccgaagacgagcccgaagccgccctgggcaactaccgccagctcttcgaactgcggctgcacccgctccccgaggaccagcgcatcgcccatgcccacgcggcggaggaccccatcctctccgcgctatgcttcgacccggtgcccgccgtcatcaaggccgtgctggagaacgcgcgcacgggtctgccccatgcgcggctcgtggcgcgctaccaccgcaaccccgtcggcctggaggcactgtgcgcccgggcggccttcgcggtggacacaggggtgcggcgctggctcgtgcgcaacccgcagctccccgccagcctcttccggcggctgtggagcgcacgccggctcatggagctgcacaaggtgggcaatgaccgcgacgtgccggaatccacgcggcgcgcggcgcgcgaggtgctccgccagcgcttcgccagcggccccgcggaggagaaggtggagctcatcctcaacacggaaggccgtgccctggcggcgctcatcggcctgccggtggatgggaagacagcgtcgctgctgtgcggacgcacctaccgttcgcccatgctcatccagaacatcgcccgctggagcgcggccccgccggccctcatcgcgcacttgctgaagcaggaagcggtgcggcgtcagccccaactgcgcatgctgctggcccgccaccccaacgccccagcggacgcgaagcgcggcggcgcctgaacctcacgcggacttgcgcttgcgagcggcggagggcttcatgtccacccagcgctccgcccaccgcgccagctcatccacgaccttccacagcgcctgtcccttctccgtgagctggtacgccacgcggatgggaggccccgcgtccacgtgacgcgacaccacgccctccgcctccagttccttgagccgctccgacaggacgcgctcgctgatgctgccaatcgcgtccgtcagctcgccgaagcgccggggccccgcgagaaggatgcgcaggatgaggcccgtccagcgcttccccatcagctcactggccttctcgaaccgcgcacaccgtgtcagcggatgctccattggcgcctcctccctcgaatatagcgagccgccccgccaccggcacggaagtcccaagctacttactttttggaagtcacttgcagattaaaagcgagcccattacctgaagaaccgtggcggtggcccatgaagctcacgcgccgaatcactccaggaagggactcgcccatggcaacgcagcaggcaggcctcgacgccaacgccctcaaccagctctttctcgacgcccgcacccacaacgcgtggctcgacaagccggtggcggacgacgtcctccagcagctctacgcgctcacccggatggcgcccacggcggccaactcgcagccggtgcgcatcgtcttcgtgaagagccgcgaggcgaaggagcggctcaagcccaccctgtcccctggcaacgtggacaagacgatgaacgcgccggtgacggccatcatcgcgtacgacaccgcgttctacgaaaagtttccccagctcttccccttgcgcgacatgaaggcgggcttcctcgccatgcccgcggaggcccgcgagaagacggcctacatgaacagctcgctgcaggggggctacttcatcctcgccgcgcgggcgctgggcctggactgcggccccatggcgggcttcgacaacgcgaaggtggacgcggcgttcttcccggaggggaagtggaagtccaacttcctcatcaacctcggctacggcgacgcggagaagctcttcccgcgcaacccgcgcctggacttcagcgaggcgtgccgcatcgagtaggggcccgccctcacccgaaactcaggcccgccgcgccgtgaggatgggctgatggaagcccgtctcctccggcgtgtgccagcgcgtatccatcagccccgcgcgcgtgagcgcccgctccaggtccacgcgctgaagcgcgcggtacacgcccgtgtgctcggtggtgtgccagcccttgccctcggggcggaggatgaactggtgcaccgtgtacgtccgtccgtccgcggcccagtcccagatttgaaagaggatgcggcggccctcgggcgcatccaagagccgctccgaggtgaagcggggctggctctgcaccagcgcgtcggcgtcgcgcacgctcagcgccaccagcccaccggaagccagcttcgacgccatggcgcgcgccgccgcgtccaggtcctcgtccgtcagcagatgcgtcaccgcgttgtccagcgccagcaccaccgggaaggtgccctccacctgcgcgtccagcgtgcgcatgtccgccacgcccgtggtgaggtgcacgttcatcgcgcgagcctcgcgctcggcacgtgccacggcggccgggctcaaatcggtggcatggacggtgtagccacgacccgccagtcccagcgcctgggtgccgatgccacacgcgcagtccagcacacgccggggcggcggcgcctcgcagcggcgcagcagcgcgtccagcatggcgccctgccgctccaccacctgcggccaattggcgaagagcaggtggtattcctccgccatgccctcgtagaaccccagcgccaggtcgctcatggacggcgcgccgtgcgaaaaccgccgttcactcacgagctgaaggagcgcccctcgagcgcctcaatcgccgcgcggagctccgccggcacggggaccttctcgtgggtggcgtagcgcagggtgacgatgacgcagctaccccgggtgtagaggacgccgtcgtcctctccggccaccgcgtgctccagggtgaaggacgacgttccgatgcgggtggcgcggcaacccgccaccaggcgcgtggggaagaggatgggacgcaggtactccgcgttggtggccttcaggatgggccccacgccgtcgcggttcgtccgctcgtcccccgcgccggacggccctgtcagaccgatgcgcgcgaagtagtggatgcgggcggtctcgaaccaggtgaacgtgcgcgtgttgttggcgtggccgaaggcgtccatctccccccagtggagggggaaggagacgaccaccgggaaatccttgagcggcgagtccggcatgtcctcagggtgccccacccggcggccccagggaaccgcgaaccgcgcccgcctggcctccaggcgagggccacggccgtggtaatccaggactgccatgcgttcacgattccacacgtcctcgcccgcggcccccgggctcggcttcaccgtcctttccggcctcttcctggagcagcccgctcatggccgctgagcgtgagccgctggagccgctgaagccgccacgagaggacacccccgccgaggacctgcgtccctacgctttgtccccgcgcgagggcctgccggtgtcggaccagagcatggcggcgcatccccggaagcaggcggacatggtgcgctggcttcatcccgcgcagttgctgcgcacgggcctggacgcggtggttgcggccgtcttcggcgcgcgcgcggaccaacggctcatcgaagcggtggtgcggccgcaggtgccctacttcgactactcgcaggagccgatgccggagggcggcttctggctggactatgtgtcggacaccggcgacggctggaactccacctacgcggtggcgcggctgctggcgctgccggagctgacgctgtccgtgcagggccagccccacgcggactcccacgccacacagcgaggacggctgctcgtccatggcggtgacggcgtgtaccccggcgccagccgcgaggtgtacgacgagcggctcgtccagccctatgaggcggccatgcggcgctcgcatgcgcccagcccggacctgttcgtcattccgggcaaccatgactggtacgacgggctcggcgccttcctgcggctgttctgcgcgaaccggtggattgctggccggcgcacgcggcagagccgcagctacttcgcgctgaagctgccccagcgctggtggctcatcggcacggacgtgcagctcaacagcgacatcgacgtgccgcaggtggagtacttccgcgaagtggccagccacatgggccccgacgaccgcatcatcctctgcaacgcggagcccgcgtggattctggccgccaccgagcggcgcaagggcagctacctggagaacaacctggagtacctccaggagaaggtgttcggccggcgcatcaacgtcttcctcgccggggacctgcaccactaccggcggcacgaggacgccggcgggcggcagaaaatcaccgcgggcggtggcggggccttcctccaccccacgcacgcgccctccgcccacgtcctgcgggacggctacacattgcagaagagcttcccggacgaacggacgtcccggaagctggcccggcagaacctgctcctcattcgccacagtcctctgttcggattgatgaccggcatgctgtacctgctgctggcactggcggcctacgcggaggtgggctcgttcggaatatcgcagctttcagacgtcatcctggcggtggccaacagcatggtggcccggccgtggacgctggtgctgggcatggccaccatcggcgggctcatcgggctggcggactcggccttcggcaagtggcgcacgctcgcgggcacgctccatgggctcggacacatcgccgcggccttcttcgtggcctggggcgccacctacttcacggtgagcggcctgggtgtgtgccccgagctcgccgcggacggcatccactgcgaggcgggctggtggcacctggcgggcaagttcctgctgtcctcgggcttcaccttcctgggcggcttcctggtggggcccttcgtcatgggcctgtacctgtggctgagcgtaaatcgcttcggcgcgcactccaacgaggccttcatctcgctggcgcttccggactggaagaacttcctccgcatgcgcattggtgaagacggacggctcaccgtcttcccggtgggcatcgagcgagtgccccgcaagtggaaggagacccacgccggtccctacgcgcccgcgttcgacccgaatgacccgaaggccaccgcgcccgtactcatcgaaccccccatccgcgtgtgaggcgtgccaccgccggacaccgccgtcccaacaggacggatagaagcaaagcaggccccactggcccctctccgagaacggattgcgctgtgctccgatgtaatggggtggctcatcggagtagacagggctcatgagcgcccctgtcttcatctacctgaccccgcccgacggactcgtccccctgctgacgccggcgcggctcgcggccttccgcgactggctctggcgggagaacacagagcacctgaacgcggaggacctggccgacattgagtcggacgaggagctgatggccctcctcggcctcgtggaccacctgctccagcagggcgccgagtccctgagcaagccccccacccgccacgcggacgcgatgctggacctgctcgatgagctgtccgactacttcacccgcgaggaactgggcattccagagggcatggagctggcgacggacctcaagcctaccgacaagcaagtccgcgcctcggacgtcgtcatcggagagaactgtcccaagcggacgttcgagctgtggcgtcacctcgtctggggccgggcgccggaccggaccgtggcggagggcattggcctgcgacgcaacttcccctccatgggctactggacggccgcggaggtccggcacgtgcgcgacgacctgcgccagcacctgagcggggcccctgactacatgcccatgaacaactgggcccgcttcatgacgtcgctccgcctaa

SEQ ID NO: 1127 - DNA, 14861 bp, Myxococcus xanthus
acttgcgcaccgccagcctatcttggtccatctccacctcctagaaggaggtggaggggagaccctgctgcccagtgccgtcaacgctccgtaccgttcccgggtgtgctcaccatgtccggaacgggtgctcaccatgcccggaacggggtgctcacctcgggccggaatcggtgctcaccatgcccggaacgggtgctcaccatgcccggaacgggtgctcacctcgggccggaatcggtgctcaccatggtccggtacacgcagttcacgtcgcgggtgacgatacccagagagattcccgcgtcgtccgtgcgctggtgcgcataggccagcgtcgccgcgacttccgcgcccatgtagagggtgaacgcctcggagaagtagcaaccgcgcgcccgggcgacggtcagcaacgtattgacgggtttaccagacgtggcctcagagagcaccacccgccgccgcttcatctccagcccacggagggcctcctggggctgtgccacagccgttaggcccaccagtagcacgagcggcagggcaagccgagcaagtgacgagaacacgcgcgggcgacctccaaggggcatagcgggagcgaaccaggatgcgcacaattgcaagcccttctccggttgtcctggcgctgggggattcggcaaaccacaagaacccagatcacttgccgggtcgcgccgcttcactggcttccgtgcccccgaacttctggcgccaccggtagagcgcctgctcggtaatgccgtgcttccggaccacctccgccacgctggccccaggcgcctccgcctcccgcagattgcggaccatttgctcctcgggaaacctgcgcttcctcaagaccgacgtacccccctggccgcgaggactctctcacgcttcaactggtccgaaaatcgggggggcaggccacaagagcaaccgtgcagcaattcataaaaccctcatgcagccctgactcagccgccagcacatggccagacaatagacaccagagcaatccattcagacaacctcaagaatccaatagagaacataagaccctagaggtctacactactacctgaccagctccatcgcgcagtacgactcacttccatatgccctgtccgaaagtccctacgtgcgcccaccatggcagtccgacaaccattgaactagcgtccccgcgttgagcaaatgtggagctttccagccgcaacaaagcccatcgacgggcggcaggggacagaccgagcgcagccagacgtcggaagccattgcgcagcgcccggcgagggcagtcgagggccccacgcaaacggctgctcattcgctcaatcgatgcaaggcgcgagaacaaggagcagcgacaacatcgacaagcactaagcattcaatagacacacatgggtcatctgcgaccacgcccatgtggccccttccaccacacccagcagctctcaacaaaacctcttcacagataggcaaagggcttgtgatcacattcacattcaactacctacgcgctctcacttacaggagatttagatggcgaccccaacccgcttcgcatttacccagccgagctcgccgggcaccgagttcatcatcgagctgacggacgaaaacacgattgcccatgcgcgaaggattctctcaggcgaagagaagaacgagattcacgtgcatggacgaatcatcaagaggacccagccatacaacccgaggttctcattccatttggacccggccaccatccggttcttcgagattgccatcgaggtctgcgacgcgaacatggtgtacgtagaggaccatctggatgaggcgggcggcgcgttcctgccggggggccactggtgcccgtgggactccaagctgacgcgtgaggtgacttgaggtaagaaggcggccgagtggctgcagtgtgtgtgtgcaattcacggcgtcgcgaggtcccaaaccaaccgcgcagattccgcagccgcccaccctccgttcgcaagcttcgcaacggagaccccggccccctgtgtcagggaggttgtcgcctcggctgacctgcctcacacgcgcctcgctcactcgccttgacgcactgccgaatgtggccttgctgcaagcgtgcgcgccgtctggatgaaggcgctggcatcgcgccttctcgtaggcgcgagtgacgccaggccgttcacgcaggtattcgcggaacgcgaggtgccgagaaatctcccgagagccgtcggcatcgcaatgaaggtggacgagacgctctcgcgttctcggctcgtccttggtgcagcaacgccggcccggtaggccgagctctcgccaccacgcatggctgagcgcctcaagcatgcccaacgtggggatgagcgcatcgtgcagatcgacccgggagcgctccgcgatgggcccgcgcgcgaacctccgtcgaggcgcgtcgatgcgctcgattcgcatcccaggctcgattcccacacgggcggcgacactcctccgcttgattcgcgtcaccatctccttcactccgtccgaccggacggtgaagccgaggggctccacggtgacgcacacaggggctgttgtgagcagccatgcgcaagtacaggggcctgacagggcgcctggcaggtcgcatcaagcctgctagggttgagtcattcttcaaggaggtggcaccgatgtcgatctacgaaatgaccgttccctgcttcgcgcaaatgctgcgcgcgttacaaggtttcctgaagaagggggaggcgcatgctcgcgagctcggctgcgactcgaagaacctgcttcagtcgcgactggcacctgacatgcacaatctggccagccaggtgcagttcacctgtacccaggcgcaggaagcagtgctgcggcttggccagcagccgctgtcggcgctagacgcgccggacgacatggaacaggcgaacgccttgattgagcgaacgctacaactgctgtcgagcgctgacagggcgcggatagaggaaggcgcacaacgccaactgtccatcgagctgcccaatggcatggccttcgacatgaccggcagcgaatacgcgcggaactgggtgacaccgcagttctactttcacctcgtcacggcctacagcattctgcggaacaacggtgtgcagcttggcaaggccgactacgtcccgcacatgttcgcctacctgcgccagccagcggcctgagccgagggcgtcggcgttcaatgactgaggaggacttggagtccaacgtcatgatccctggtcccgacgcagtccttggctgtccgcgctgtggcgccctccatcggtgcgggaccctggcctccggaaatacgttcggcgccgtgctctggagtgatggctggttcgaagcccctatgcggccgctgccccccttggttgcgcgctgcatgggctgccatgcgttcttctgggtcgcgcgcgccgtcgagctggggcatgtggaccacgtcacctcccagtgcgatgagacgctcaccaccctcaccctgatgagacgctcaccaccctcaccctggagagcacgggggcgtgtcgcatcgaggtcatgcagcgcctgcggagcgacctggggatgggagtccaggaggtgaagcgcttcgtcgcccagccctcctggacctgccgccgctcccggggctcgggccaggcctggagactcttcgtgacgcggcgcggagggccgactcacggctcctccggcttccgccagggtcggcggagtagataggctgcgatgctgcggcgtccagcccaacaccacgcatccatcaggtagcgctcatgaagctcgacaagcccgagaacctgttcgctgccatcgagcagtgcgatgtcttcgcggtggaggacctgctggccaaaggggccgaccccgatgaagtcgacctcgacggctaccaggccacgccgttggcgtatgcctgcagtcacggtgacgaggctgccgtgcgcgcgctgctggacgcgaaggccgccccggatgcagcggccttccagccgccgctggtcgcggccactgcgcatggctttgccgctcttgtgagcttgctggtgaaggccggcgcggatgtgaacgcgggggacgaaaccggcgccagcgcgctgtggacggccgccgcgaatggctttgccgacatcgcacgatgcctggtggaagccggcgcggatcgcgaacaggcggacaacgacggcaagttgccctccatcgtggcgttggagaatggccatgtcgcgctgtcgaactacctgagcgatccggcgagctacccggccacgcattccttctggcgcggcagcaagaaggctgcgcggcaggcggcggaggcacggcgcgcacaggttgtcgacagggccacgggcaaggacgtccgtggcgctgccgctgccgaacccgaatggacgttctccggcggcattgcccgcagcccgtgggcaacccaggacttcccttcggtggccgctgccggcaacctcgaactggtggggcggatgctggacgccggcctcgaccccgactggacccagttcaagggcaacccgacggcgctgatgctggccgcgcgcagtggcgaactgggtgcggtggacctcctgctcgcacgcagagccaaggtgaaccaccgaacggacaagggactcaccgcgctgcacatggcgctgttcaaaccgtcggcacgcgtgcacggccccatcattcgcagcctcttggccgcgggtgccgatcccaacgtgcccgacgatgaaggacaacgaccgctacagcgcgcgctggcgcatgcgatgccaacgctcgtgcaggcattgatcgaagccggtgccgacccgttcattcgcggccgcgtcgtccgcataacggtggtcatggtgccaggagatggcaagccttcagatgcctccagcgagtttctgtatcgtgcgcacaaggggcggtggtacgacagagggacggcacccatcccctatccacggtggagccaggggataggggatgggccgtctgaagcatgcagcgaaggttgctcaccgcgacagcctggcggaactcacgctgcttcgacgcgcgcgccaacgggacgcgcgtcgccctggccaacgtcattcaaccagcaccatgggcgacgtctgtcgtcgcccatggtgtgcggggctagcgagccgggatgcgcaggagcaggtcgtgcggcggcaggtagagctgctcggcaggcgttgcccgtccttcgttgtcctgcccccacgtcaccacggtgccaccggcgaggaaggcctggctggcgttgctcgtgacggcaatgcctaccacgtccctcacgtcggaggacggggcgatggcgctttcgccccaggccacgacggtgccatccgccttcaacgccaggacgaaggaatcgcctcccgcgatggccacgacctccgtgaggtcggcggggacactcaggtccgagggaaggtcaccgccccacgccaccacggtgccatccgcctggagggcgaaggcggtccttcgcgacgtggccacgctcaccacgtcggtgagccccgccggaatcgggtggatgtcggccagggagggcccaccccagacggagacgtgattggaagcaaggacacccacgccccaatgctccccgtaggcgacggtcttctggggcaccacccacacggaggtggtggtgttccgccgccagggcacacccggcgtcacgacgacgtcgcgctcgcccggagcgacgtggtgcgccacccgcgccaccacctccgtgtcggaccaggagatgaagtcggtgacggcttctcctcccaccgtgacggtgaaggggccgcgctcggcgccgaaaccggagcccgtcaaggtcaggtgtcccccctggaccgccagcttgggcgcggagacctcgagcgcgcccagccgcgacagggccaggctgaccggcaggggctcgccttcgcgcacgtccagcgcggcctccgccttcgcgtagttcgccttgctggccgccagggtgtggcgcccctggggcacgtcttcgaggacaaagtgcccctgagcatccgtcatcgcggtggcgccatggccggagagcgacacggtgacaccctcgtggtggctttcgccttcaagttggatggtgcccgtcaccacgccgggcctgcgccgcagcgtgatgttgaccaccgtggtctcctgattccgcaccaccacgctccgctcttgaatctcatagcccgtccaataggcggacagcgtgtacgtccccacgatgaggccactgaaggagaagcggccctgggcgtccgtcaacacggaggcgttgctctccaccagcgccaccgaaatgcccgaggtcgtgttggcgtcctccagcaggaccacgcccgagatgctcccgcgagcgcgggacagcgtcaggctgacctgggcctgctcgccggcacgaacctccacggtacgttggcccgtggcgaagccgtccttctgggcctccaaggtgtaggagcccgtggggacgcctgtgagggagaactggcccgcggtgttcgtgcgcgcgctgaaggccgtccccgccagggtgacgttgatgtccaccggcgagctcccgccctcgagctggatgacaccggccacgttgccccgctcgcgcgccagcgagagcgagacggtggcctgctggttctcctgcacctggacggactcgcgcgccacggcgtagccgctcaaccgcgcttccaccgtgtacgtgcccgcggccacgctgctgaaggcgaaacggccctggccgttcgtggtcgtggtggcccccgtctccgccagggtgacggtgatgccaccgtggctgctcgcgccctcgagcagggccgtgccctccacgcggccctgggcccgtaccagcgtgaaggcgaccgtggccgcagcgcccgtgcgcaccgtgacggattgctgcaccaccgcgtagccctccttctgggcggtcaggttgtaggtgcccagcggaagcccggtgaaggtgaactggccttgtgcgttcgtcgtcgtgttggcgcccgtctgcgtcacggtgatggtgacgcccgagggggtggctccgtccgacagttggacggtgcccgccacgtccccgcgtaccagcaacaacgtcaggttgacctggctcggctggttcgcgcggacctccacggtctgctgcgcgtccacatagttctcccgccgcactcgcagggtgtacgtgcccgtcatcacgttctggatgttgaactgtccctcggcattcgtggtcgcggtgagggacgcttccaccagggtgacgacggcgccggcgtggttgctcgagccttcgagctggatgacgccggtcacactgctccgctcgcgtgacagggagaggctgaccagggttgagcccgtgccccgcacctccaccgtctgctgcgtcgccaggtagttcgtcttctggagcgccaccgtgtaggtgccctgggccaggtcggagaaggtgaagagccccgtcgcgtccgtggtcgtgttggcgcccgtctccaccagggtgacggtgacgcccgaggaatccaagacgccttccacctggacgttgccgaggattgaaccccgtcctcgcccgaggtcgagcctcacggaggccgttgctcccgtggtgaccgtgacggactgtcgggcctctgagtagccggacattctcgccacaacgatgtgcgtgcccgaggcgacgttctccaagacgaagcggccgtcagtggccgtggtggtgctcagcgaagcgccttccacggagacgctgatgcccgcgtgggacgaggccccctccaggatggcctggccttcgatgcgcccgagctgcgtccctgaatcaggctgagtccccgcgtcggaaggggtcgtggaggtcgaggaacaggcggagagggccagcaggagggcccagagccaggaagggcgtatgaggcgcatggggagtgccactcggaggaaccgggaatgggaaggactgccagggaacggcgaagctcctgacggtacatggattctacggttccgtggaatggagtggccgcggcaggcgtgtggtgggggcgcgtctgccccgcgacggcattccaccctggcgcgctcaggtagccctgggcgccgtggaactcagacacgtcgaagcacaggcgattggcgacggcacggggccccctcttcggcacgccccttccgggccccgcatgcgcacgcccccgcattcctgatatgcgactgtgtcgtccgctcccgccatgccccagcttctggtcctccccgacggccgccgtctccctttggacaagcccgtcgtctccgtgggctccgacgccacctgtgacgccgtgctcgttgcccccggcgtgaagccgagccacgcgctgctgttccgcgacgcgcgaggttggagcgtgtccccggcgggcaagggctgtgacatcaaagtgcgagggcggcgcgtggacctggcgcccctggagcccggggaccgcttccgcgtgggcacggtggaactggagctcatcgaagcggtggagtccgtcgcgagtgatgcggcggaggtggccccccggcgacaggacggccggctggtggcggtgctggcggagctgtcctcgcggctgctggtgcaacgccctcccctggagctgctggaggtggcgatgcgggggctcgccgacgtggtgggcgcggacgtgggcttcctcgtcgccgcggactcgcgggagggacctcggcgcgtgctgtgttccacgggcgccagccccgacgcggcggtggtggacagtctggtggaccgggtgctgacctcgggtgccccggtgcgggtggccgacgtggaggcggacgcggcgctggcccgggcgcccagcatggaagccctgcggctgggctccgcgctggtggtgccgctgcgcgtggagccggtgccgctgtccgtggtgtacctgggacggaggttgggtgctccggccttttcagcggtggcgctggaggaggccatggcgctctccgcgctgacggcgctgctcctgtcgacccggcgcgaattgacggagctgcgcgcgcaggtggagggcctcacccgccgaatcgaagccgcgacgttcgaagggctcatcggcgaatccccttcgatgcgcgccctataccggcaggtggagcgactggggcccacgccgctcaacgtcctcgtcacaggcgagacaggcacgggcaaggagctggtggcgcgggcactccaccggcgcagtggccggcgcggccggctggtggccatcaactgcgcggcgctgccggagagcctcatcgagcgcgaactgttcggccatgcgcgtggcgcgttcaccggcgcgggcacggagcgggcgggactggtggaagcggccgacggtggcaccctcttcctggatgagattggggacatgccgctgtcgctccagacgcgtttgctgcgtgtggtgcaggagcgcgaggtcacccgcctgggcgaacaccagccgcgcaaggtggacgtgcgcgtggtgtccgcgacccatgtggccctggaggaggcggtgcggcggggcaccttccgcgcggacctgcgcttccggctggaagaggtgcgtgtcgacgtgccgccgctgagagcgcgtggtgaggacgtgctgctcatcgcccaccatgtgctggcgcaagaggcgcgcaaggcgcgaggcttcacgcagaaggcctcggaggcgctgcgggggcaccccttccctggcaacgtgcgagagctggcgtcgcgcgtgcgccgcgcggcggtgttggcgacggacgagttgttgcgccccgaggacctggagctgggcggcgacgcagcgcccatgattcccctggaggaggcgcgggaggcgttcgtccagcgctacgtgcgggaggccatcgcccgctgcggcggcagtaagaaggacgcggcggcggcgctgggcatcggtcttcgctcgctgtttcgctacctcggcgaaggggactgacaggccgcctcctctggagggcttgtccgcgtgccagtcctggcacgtttcccccggcatcaggtgctcggagggtcaggggcgtcatgcaaccccgtggaatcagggcgattcgatgtctcgcgaggcttgggcacgcacgttgctcaggtgttgcccatcgcacgcaggcggagaaccgccacggtgcagatgaacctgacggagacgacgatgaagcatgtggtgatgggattgttcctggcgctgacggtcatgggctgcggcagcacgaaggacgatgacggtgaggggcccgacggcaaccccaacgagcagagcgcggggctgtgcagcgcgagcaaggcatgtccctccgggcagttctgcttcaacggcctgtgtgccatcggctgtcagtcgaacggggactgcgcggcggaccagtactgcgacctcgaggacacgggcatggccgtctccttttgcaagaacaagaaggtgccgacctgcagctccaacagccagtgcctgagcaaccaggtctgcatcgagggcctgtgcagcctggcgcctccggccaacccgccctcgtgcaacccgaacaccagcgacttcaaggacggctgcgacacctatgcggtgtgcctggacgcagcggaccagggctcgcagcagccgtactgcgccagcttcgcgccctgccccgaggatggcgtgtgccccacgggcctgggcggcgcggtgtgcaacgacggctacctgcccaacaagggccgcttctgcatgcaggggctctgcagtgacaactcgaactgcccctcggcgtggagctgcgtgaagcccttctccggcgcggtcctcgggttctgcagcccgggtgccttcggcttcccgtgcgcggagaacagccactgcaagagcggccagtgcttcagcgcgccgggcgtcatgggcacctgcatgtagctggcgaagacggccccgtgttcccccgtcggggagcacggggcctctggcgttgttggggggtgctctccgagcctccctccgcctagagtcgcccgggccttggtgatgcgccgactcctcctgctctcgttgttgcccgcgctggtgctgctcgtcgcgccgggctgtccgctcgacatccgaatccgctgtgacgagcccaacggctgtccccaggggcaggtctgcgtgcgaggtgactgcgagcccgtggacacggtgcggattggggatgcctgcggcgagcatgcggactgcgggccggggcgcacctgtggcacgggctttccgggcgggtattgcctgctggcgtgctccgacgcggcgccctgcccggcaggaagcgtgtgcgcaccggggctggggcagtgcctgcgaacctgtggcgaggcctgtgctcggccaggctacggatgtgggcacgtgcccgacgcgtccggccccctgagtgcatgtgtgccggtgacgacgtcgacggatgggggctgcacaggctcgggatgcgaggtgccggatgccggctgtacgggctcgggatgcgggtcgccggacgccggatgcgcgagcgctgtggaggtgggaggagcgtgcacgcggccgtgcgagtgcgcggatgcagcggcggcctgtgtcggcgggacgtgcacgctgacgtgctcgacggacttcacgtgtcgcgacgggcgacggtgctcctccagtgcaacctgtgtcgtgggggctcggattggagagccgtgcagggacacattcgagtgctccgacttcgccggttgccccagggagcgaatgcggtgcgaggagaagtgcaacccggagagcaaccactgcgaggcgggctaccaatgtgctccggacgggctgtgcgtgcaggagtgctcgggtaccccggtctcggtgggagaggactgcgagaactcgctggactgcgcgccctgtagcgtgtgcctgtcatcgggggcggcgctgcggtgccggcagccgtgccggctggaccgggactgcccaggaggggcgacgggcgcctgcgaacaggtggggaacacgaaggcctgtcggctgtcgctgtaatctaccaggttgctcgcgggagcccgctcccggagaatacccgggtgatgacgggtgaagtgcttgcgggccgctaccgactcgagcgggagttggggcgtgggggaatggccacggtcttcctggccacggacgtgcggctgtcgcgcccggtagcgctgaagcggatgcacccaggaggcggcacgggccgcgcggagcgtttccggcgggaggccgagctggccgcctcgctccatcatcccaacgtcctggaggtccacgactacggcgaggatgaggcccatggcccgttcctcgtctgcgagtgggtgcggggcgaagacctccgcgcactggcgggaaggctctcgccggcgccgcccgaggcggtgatggtgttgggctgggagctcgcccgggcgctggcggcggcgcacgcacgcggcatcgtccaccgcgatgtgaagcccgacaacgtgctggtggcggaaggcgggccgctgaagctggcggactttggactcgccgcgctagaggaccaggagcgcctcacgagtaccggggcggtgacgggctcgttgccatacatggcgcccgagcgcatcgacacaggcgcgtactcccctgcctcggatgtgtacgcggtgggtgtcatcctgttcgagctgtgctcgggcaccacgccgcacgcgggcaagggcgcggcgcatctggccgcgtcagtgatgacgaaggatgcgccaccgctgacggaggtggtgccgggcacgcccgcgcccttgtcagcgctggtcgcgcggtgtctggcgaaggatgcacgggatagaccgcgcgacggggccgcgctggcgttggcgctggaggagctgctccaacgagaggtcggcccgcctgccgacgtggcgcgggagttcttgggagacccggtggcccgcgccaatcgatggcgccgggcgcgcttcgagcggttgctggaggaggggcgcggactgctggcgcgcggcgagggggcgcgggccgcgaaggtcctcaacgccgcgctgtcgctggagccgacgtccgccgaggtggtggcgctgttgcgtcagcggccgaggcgttccgcgtggagggctggcgccgtgggcgccgggctcgtgctctgcgcgactgcgggctggtggatgaggccggaccagcgcgtcgaagacgtgacgacaccgcgtggcgcggagccctcgtcagggcaggcctcccccagaacggcatccgttgacggcgcctccacgggtgaacgccttcatgcgcccacgcccccgggccaggagaggcctgcctcggggacggcccccggcatgttggatgcttcgcgggaaccggcgccttcggctgaaagtgacaccacgaatctggccggggcattggtaccgacagaacgcgcggcggacggtgccaaggcgaagccggctcggccatccgtttcgacagggcgttcggggggaatggattcggcgaagcgggccgtatcgcccctgccgacagggcactcggcgggagccgagcccacaggggccgcgcggcccttggtgccggcgccagggccggacgtggaaaccaccctccccgcgcgtcccgccctgttgaaggtgacggcgcgcccatgggcggaggtgttcgtgaacggcgagagccacggctacacacctcgagtgcgtgaactctcgctgtcagcggggacctaccggctgcgcttcgtcaacccgctgtgcgacgaggtcgagcaggaagtgacgctcgcgccgggggagaccgtgacgcgcgacgtggtgttgtcacctcgcaaggcagaggtgctcatccacgctcccgccggcgcgcggctcttcgtggacggccgggaggtgggcatcgcgcccctgcccgctccagtggtggtcgaacatggacgacacacggtgacggcacgccgcgcgggtgaaccgcccttggtgcgagaggtggacgtcgtcgccggccgtcgtctcgaagtggcgctggacgtgacgccatgatgggcgcggccttgatgctgatggtactcgcggcgtccccgctcgacagcgcgcgcggtgcctaccaatccggcgagctgcccaaggcccgcgccgagctggagtccctgctctatccgctgcggctcgacggagaggcgttggaagcggaggcgcacctgctgctcgcagccacctatcacgcacaggaggagctggcccgcgcggaggacgaggtggtgcgagggctggccgttcacggcgactcggcgctggacccgctgctgtatccaccggacttcctcgccttcgtcgagcgcgcgcgtgcccaacaccagacacgcatcggggaactgcgcgccgagcggagtcctcggctgtttccagcgccctcccccatcgtcgcccccatccgcgcagacgaggtgcccacctcgccagcgctgacccgtgcctggtatctggcgcccttgggcgtggggcacttcaagcacgggcgttcagggatgggcacggtgctggcggtgacgcaggggttgggactcgcggcggcgggaatctccctggggacctcgctctcgctgcgcggaccagacggccggtatagcgcgagcgacgcggggacggcgcggacgctcaacgtgacgtacctggtgggagcctatgccttcgcggtggcctatgcatatggtgtcctggatgggttggtgttgacgcccgctccacccgttcgcccggttccgtagag

SEQ ID NO: 1128 - DNA, 15559 bp, Myxococcus xanthus
taacggccgcttccgggacgagtgcctgtcagcggagtggttttccaccaggagggaggccgtcgtcctcatcgaggcgtggcggcgcgactacaacgagaagcgcccgcacagcagtttgggctacaagacacctgcggaggtcggagctcgccgtgcccatgccggccccgtcgcatcatccctcgagcacggcatcagcagcgccgcaggactctcgtaacgcgtggtccgaagaacgggggcagagcacagccgcgctcaccgcgcctggccccaccatccgcttcaccatctccgccttgaatgcatccgtgtacgacacagctacctgcctgcactcgcccccatggggtggtcagctcggccggtcggccgaggcgacaacttccctgccacagggggcgcccctcacctcccgctctgctcccgctcgctacgcccaagagggctcctgtccttcctatgctccagaccaggctatgttcgataaaggaatccggcctcaggcacacgcccaataatggcagacaacccagccaaagaaggcagatgcgcctctgtgtaaccagcctcccgaagcgcacgctcaacaacaaccaacggagccttccactccgacacaaaatccatcttagccatcaaaacaggaccagcatcagaaaggaggcttccaacgccccccacaacgcaatcccaatcagcacttatcgcaattttcgaaccatcccaagacatcttccatgtcgacgaaaacgtattggacggccaggaaacctcccacccccccacgtcttggcggagaatctcctcaagcatatcgacgacatcatcaaccatcagactgaggtcatacttgtacccaacaggtatgaacacacctctccacacaacaaacgcccactccgcgctccttgggaacaccgtctgaaccgcatcagccaacgactcatcttccccatcaaacacacgaagtgtccgcgggagtcccgcctgaatcaaaaaatcaagcgacataaatatatcactccgccaaatatccgtgaaaagtcccgccgccattattccgaacaaagaatcggttcgcccgaacggtcttgccagagggcagatgcactgccgagctatgattcgggggcaaatcccccccctgactgtctcggcgctagtgtcgcagccttcgctcccacataatccaaatatgccttacttccccactgcccctgtgccacccttgaatctaccgccagctgcgatccttctgtccacttgattccatgcttcttcgaaccaacatacttagcttctgggcgtagtggcgctacgaccgcctcttgcgcatcactcgagctagacgaatcatctccacctccggattggttcgccatctgcactgcatttagggccccggtaatattcacgcccccttcagcaccagcagcaacgccctgcacagcaacagcacctccaagcacagctccctcaagcaggggcggagccggggctggaggaggagagccccgcctttaccgcgacggtggaggagccgaggaaggagcgcacaccccgtttggactgggccgggctgctgcgcaggacgttcgccctggatgtgttcgcatgcttgaggagtggaggcaggcggcgggtgttggcgtacgtgaagggagcaggaggggtgagagcgattctggagcacctggggttgcccacggcgggtgcgcacctggccccggcgcgcgggcctccccaggccgcgtggtgttgaagctcaagccgccacagccagccaagagagccaggcccctgcctcgccccgcctgggaaggaggctgggctgggcaggcgtgtgcctgctggagataaagggattctgcgccggctcggcgtgcggctcatgtgccacccgtcagcgtccctcacctcccgctctgctcccgcctgctacccccaatagcgctcctgtccttccttctgtgtagcggccccccgaatcaggcaccttgcctcgtctcacgttcaacagcagacgccttcaaccaatcctttccttccgcccctcgccatcgctgccgcggaggcctactggcaatcacttcctgcgtaccacctgactcccagcccctctccgcgaggttacttcagccttctgttcgcgctcgacttgggcgggcgtgccgccggcgcatggggagattcgacagcgggggcgccctctatgctgcggccctggactgctggccaaggaaggacacgcgctcacccgctcatcgaagcctttgggagaggccgctgcttgtcaagcgactgactggctcacgctcatgccgcagcctccagcactgctggcttcggcgctcggtattccgtcccatcgcgcatcatcgcgaagaggattccggccagccgtctcgccagcgccaccaccgctgtcttcttgcccctcctggcggcaatccgttcggcccattctcgcaaatgggctgtctcgggtttcttcgctcgcaacaggcgcagcgccggattggcgagtggatcgggctggacgccggcgtactcgccgagggccgccgcgcggacctggccatcatcaaccccgagggcctggacgggaagctggatgaaatcgccgaggcgcccatggagaacttcgggggcttcgtccggctggtgcgccgcaatgatgccgcggtgaaggccgtgctcaactccgggcgcgaggcggtacgggagggcgccgtggccccctcgctggggcgcgagcgcggcttcggaaaggtgctccgggctcaatacctctcgggtatgaagttcttccccgcgagcgaagcctcgtcgtcataggcgccccgcttggagcggcggggcagcttcgcctcgggacgcttcaccctcttgtgaggaatcttctccagcaggaagcggatgcagttgagccgcgccttcttcttgttgtcggagcgcaagatgaaccagggcgcatacggcgtatccgtcgcggccaacatcatgtcacgcgcctgagagtaatcgtaccagcgagtccacgggtacatctgggtcttctcccggtccgaggggaccggcagggccaccactcggaatacccgggggctcacccgctccgtgatggcgcgaatcgtaccgcccttgcccgccgcgtccctcccttcgaagaccacgacgacgcgcaccccctcctgcttgacccaatcctgaagcatgcagagctgggcctggagcctgcgaagctccttttcataggccttgcgcttcatgggttccgtatgggtgtctggtgccatgacctcgtgccccggtaggagaagaggggggcttcactccacgggggggccatgcccgggcactggcccggcgtcagcttcccggcggtctcgtggatctccgcgcgcagtcgctctccatccgaggggtccacggctttgtaggcgatggtgacgccctggggagtgtcctccacgcgggcgtaggtcggcacgctcggagcccccgcagaacccgggagcccgctaccgcccatggcctcgtagtcgatgccgggaggctgctcgaggccgcggcgccccgatacgccgtgctccgcctgccgctgcatcatgttgcggccacgctgccggaggttcgccacctggtcctcctcggaggtggtgaagacgagggccacgccgtcgggcgtgtcctccgcccgcgcctgagcgccggggaccgtcatgcaatgcggcctcacgtgcccgcccctccctcgcgttggagcgggcgctccaccccacccctttcaaggagttgggagcatgtcaccttgcgcgagggggcaagagccctggggacagggctcttgcggaccggcctgtcacggtgagcggtcaatctcctcggtgatgcccacgtccgtcacggaacatgcgccgccgctgctctccacgaggaggaaggactccgccgggaagacgttgacgccgtgcaggtacgagcactcgatgagggcgttcatgtcccggctgctgctgtaggtgaagacgcgggcgggcgcgctgaagtcaccgtcaccgcccggcgcggtcgccaccgccgtgttgggcttgaagtcccaggacttcaccttcacctgccagtggtcgcctgggatgcagcagtccgccaccttgacgtcgagctgcttcgtgcccgggcagctcacggcgtagcgctggatctggccgggacgcgacagaaggcaggagaggagaatctgctgcccgccatcggacagctgggtgatttggggctgacgctggcccgtggagcggtagttgagctcgcccgcgcgcggcgccgcctccgcgggctcgccggcggctggcggctccgcggatgcgagcggcgagacgccgagcgcggcgcaatacaggacgagagaagcgagcctccggagcttcatgaaggaagcggtcatgacgtatctttctgttggcgcgagagaaggacctgcgctccaggtagcgccccgcctgagagcagcggggaaataggcatacggagccgggccgggcagtgtttccgaggggcatgcatgcgttcatgtcgtgaaagccagcgtctcctcacgcctgcgactctcccgcggcctccttcaggggctggcacggaagcaccaccgtgaacctcgagcccaggcccggcgtgctgtccacgcgcaccgtgccgcccatggcctccgtgaggctccgaacgatgtagaggccgagcccgaatccgccgtagtgccgggtgggcaccgcgcgctcgaaccgctcgaagatgtggagcaggcgctcgggcgggattccgatgccgtggtcctccaccacgagctcggccgccccctccccgcgtgagagcgaaatctcgatgggcctgccctcgccgaacttgagggcattgccgaggaggttcgccaccacctggtccagcctgctccggtcccacatcccctcgacgggcccttcggcgcgcacgttcacccgcgacccggttcgggcggcggtctcgatgaaccgctccacgacctcgcccacgacggccaggaagtccacgcgctccaggtggagcttgagccgcccggcgtgcagccgcgagacatccagcacgtcgtccaccaggcgcatgaggcgctgcacctgcttctcggccgactcgagggcctgcatgagccgctctgcggaggggcgctcgtttcgtctccgcagcaccgactgaagcacgatgttcatggagatgatgggcgtcttcagctcgtgcgccgcgacaccgaggaactcctcacggacgcggatgccctcctgggcctcctggtagaggtgggcattgtcgatggccatggccgcccggtgggccagttcctccatgagcgccaggtccgatggcccgaaggggcgcttcgggtccgtgcggcccatggagatggcccccagcgtccgtccgcgcgccatgagcggcacggccatgccgctccgggtccccagctcgcggatgagccgggcattctcggcgtcgaggctgtagtcgtgcatatcgggctccgagagctcggagcgcaggaagggcttgccggaccatgacgcggatggccggctggagcgagccccagtggggcggatagcgctcctccagctcgcgcaggaccctctgcttcgcggggtcggagtgaaacccggccagccggcgaatcctgccgtccgcttcggccacatcgacgatgcaccagtcggcgaacgttggcgcgacgaggcgagccaggcgctggagcgtggtcggatagtcgagcgactcggcgagcagcgcgctcgcgtcggacaggaagcgcacggccttctccgcgcgcatgcgctccctcaagcaggtgcgcaggaggcgagcgtggggcttgaggcggcggccagcacggagccgatgaaggagaagacgccgcgagtggactgggccgagttgctcagcaggacgttcgacgtcgacgtgttcgcctgcatgaggtgtggaggcaggcggcgagtgctggcgtacgtgaagggggcggaagggatgctcaccatgtccggaacgggtgctcaccatgtccggaacgggtgctcaccttgggccggaatcggtgctcaccatggtccggtacacgcagaagctgcgcctgtccgggctgctgcagtccctcgagctgcgctgccgcgaggcggccgacgccaacttgccgctgacggaattcctctaccgactgctggccgacgaggtggagcggcgcgacggcaagcagttggacgtgcgcctgcgccgtgccgccttcgaacggcccagcaccctggaggacttcgacttctccttcaacgtctccgtcccgcgcacccaggtgctggagttgggcacctgcacctttgtcgagcggcacgagaacgtgctggtggtgggccctgcgggcgtcggcaagagtcacctcgcccaggcgctgggccagcgagcctgtcgcgccggccacgccgtcctctacgtgagcgcccacgacatgctcacgcagttgcgcgcctcacgcgccgacaacagctacgagcgacgcctcctgcgcttcaccactccagccctgctcatcatcgacgacctcggactgcggccactcacgggtgaggagggcatcgacatgtacgagattgtccgccgtcgctacgagcgcgtggccgacttcaacgcggacgggcggctggatgtcgccgcgacgattgcagcggcgaacaccgtcagtctgtttccgggtctgggggatggctcgctctcggagagggcatgacgtcgtcctggacggaatgccgcgcgggctcgtggccgggaagttcagcatcggcgacaaggtcttgctgatggtgggtcaggaaggcctggactccctctcgctgctgacggcgacctgtctcccctgacgcacgcaggctggttcgtgcgactccgcggagcgcgaggcgtgacaaccgtttccttcaggaacaacgtccttccatcccctcgcgtccagaacactcgctagtgctcgtgcgttccctgcctttccttccttgggtggcggaggcgtcctgcgcgtcgccaacctcactcaggagtgttccatggtccgtctggaagacgcgcgtcccctcatcgccgcagccgagaagaaggctcaggaactggggcagcccatgaacatcgctgtcgcggacgaaggcggcaatctcgtcgcgcacgtgcgcatggatggggcgtggctgggcagcatcgacatctccatcaagaaggcattcacttcgcgtgccttcgatatcaccacgcaggaactggcaaagaacgcccaacccggtgggcagttctacggcatccacgcgtccaacgacggaagggtgatgatcttcgcgggcggcatcccgctgaagaagaatggcaaggtcgtgggggctgtcggcgtcagcgaaggctctggcgaccagaaccatgcggacgccaccgcgggcgcgtccgctttctagctccgagcagaggtgacgcgaacaacaggggatgagctcccgtgaggcgcctcgcctccaccaccgcacgtcggacgtcagatgcgctgttcggcgagcgcgtgcgcacgctcgcgctcaatcacactgccgacaccgatggtcaccatccccaccgacagggcgacggcgacgcccgcggggccgcccagggcgcccgcggcggcggccgtcccgaagtagccagccagggcgccacccgcttgcactgcgccgagggcgacctggtacgtgtcgtctttggagatgccctccgccaccgagaggccaccgctgatgactcccacagccgcgttgagtcgtcccgaccactccgcgaacttgatgggattgacacggccattcagcgggcctggcaggcccgatggggagatggtggtgcccgaccccttggcggcgaagcgcatgagcccgactccctcgaccacgcccaccgcccctcccaggacgtccgcgccggctgtcgcgagctcacgcgcgcccttgaagcttagcaggttctgctcgtcgagcgccttcttgaagtctcccacgccgctcacgatgtcgttgatgccggcggccacctggaagccacccaccattcccaccgagaggcgctcgttccggttcaggttcagcgtgagctcctgcttgaacgcgtcctcgggtttcaagctgaagaacttcgggttgtccgccgggtccggcttgccctgcgcattcgccgcccgggagttggcctccttcgccagtcgagccagcccatactccgacgcatcgcccgcgacgcccatgccctcgctctccggtgcctccggcgtgtccttcagggcctgggtatgcagcgccgacagttgggtgaagtgattgagctcgttctgcaacccgttgaccgcgtaggcccccagggccgcctgcgcgggtggcaagtcctgcttgagctggttggggccatcgaaggacttgccgttcaccatcacgcgctcaggaggaatggacgcctcggcggttccctcgggccccgtgagcttcgactgggcgtggacgacctgcggctccttgggcgtctgcgccgtcgtcagcgactgctcgtaggtgcgcttgggcttgccgcctccttcttccgagcccgtggtgcgctcggtgacctccacctcgcccttggcattgcgcgtttcggtgcgctggaagtccttcacccggcgaatgcccgtgacgtctgtctggtccgagtggctcgcggtgatgaggccctggttgttgtacgtccgggtggtggtgctcttgacgtccaccaactccacgtcttcgcccttctgggcaggcttggggagccgtccctcggtcgtctccgtgacagtgttgccctccagcttcttgcgagtgacgagcgtgacgttgggctgtccctcgaagaaggtctgggtgttcagctcgccatcgccggccttctcaagcacgtaactgcgaggcgcggcgtcgtcagcctgaatggattctttccgaaccttttccaactccttcgcgccagcggggcggtcggccttggcagggcagtccacggccttggtcgacgtgcgcgtcagccgcagccgatctccctgcgagtacgacgacgactcggtcaccgtcgccttcgcgggcttaccctgctcgtccttcgcaccggggggcggaatgacggtggtggtgacgtccatcttgtcagagggcacggtctccatgaactcgccaaacctgccggtaacgtggtctcccttgttgatttgggagaaggtcttcttcgtctccgtcagcgacccatccggcgcgcgttgggtggtggtctgactggcggatggacccacctggaacttcgtctcggcgtacgaggcgcccttgaccttcccctctgccagctcctcgcgcgacggcggcggcgcggcggcatcctgcttccagcgcgcgtcgatggcggtgctcggcccccccggctcctcgctctcgaagatggagcggcgcgcctcgccggacttgtccaccttcgtcgagtcaaccttgaccttgtcgccctggaacgacagctcgagccgctcggtcaccttgccatccttgtccttgcgcacgaggaccgcatggtccttcgtcgcgccgggctcgacgttgaagggcgccttcgacttggggttcttcgcgatgtcgtcgagcgtctggcgggcggtggtccgtgtttcctggtccagcaacttctgacgtgcgttgagcccgtcgcgctcagcggacacggagttcagggccacctctgactggagctcctggtccagcttgctcggcttggactgggtcttgatggccgggtcgaggttggagagcgagtccgcggcctggtagcgcttcgccgcgcgcagctgctggaccatttctccacccagcttcgctaccgctgggtctttcgcgttctccttgagggagcggcccggctcgcccacgccatccagggacttcgacttcgaggccgacaacagctgcgtcgccaactccttgcgagccccttgccccgccatgtccgcgccctgggccagcgacttcatgagctccggcttcttcgagtggtgcagcgacctgtcattcacctgggcattgacgaatgcatcgcgctggggcttcgtctccttccagagggcggcccggtaggccgggtccggattgagcgcgagttgcttgcgcagctcctcggcgcctgcaacagggccctcgttcgagtgcttcgcgttcttcaccgcgtcgtcaatgtggcgcacgtccgcgcgcgccgcctcttccggagtcaccggaacggacgcgccgagcagcttctgctggtccttcttgctcaggctgcccgcgtcgtagacgtcgcggacctcgttggccttcgggaagggctcgggctggcccgcttgcttcgcgctggcattggccgtcttctgcgcgctcagcgcggtgtccgctttctcgagggccactcgccgggaggtctccgcccgctcgaggccgtcccgcgcatcctgggaggtctccgcggcccgggccgtggcccgagagactctgtcctccgcgtccctcacgcgctcgtcagacggtggtagccgcgtgctgtccgcaggacgctgggcctgctcaccctggcggggggagactgattcgcgcgacttgcgaaccttctcgagcgccttctctgcttccgccttttccttctgggcctccttgttcacctgctcggcgtcccgcgccttcttggcgtcccgcagggcctgtgcctgggccttggctgcttccctgcgcgccgtatcggcggtcttcttggcgtccgccgcgggcttcttctgctccaaggcgggtggaggggtaggcggcgcaaccggagtgggcgggatgcgtggcttctgcgtatcgaccttcggaggaggcatgtcgaactccagagagacgcttgtgattgggttgcttcgaaatggacgaagagatcagccgaaggacgcggtgacgggggctacgctctcttgtcggccgcgctgatgatgcggttgaagtttcgcgaccggtcgagcttcctggtggagacatccgtgtgcgcgaccccatcgcccaacgggacttcgcggcgcttgacccggcaggaattcttccgcaaggccacacggcagcgtgccggctccctcgtttcgacaagggacttcttccgctccatgggcaatcctgggttgggctgttcgggccatcggtgcgtaagagggcatgggcgaacctgtgtcccaaaaatctctgggcagcccgcatggtcgcgcggcgccccaaggccgtttgctctggacggtgtcgtgtacgcgacggatgccctggaactcgtccgccgtgtggacgctacgcgtgccaggcgcctgccccgcgcatcgccaaccctgctggagcgatgaccgcgcgctcctcgctcgctcgcgttgacgccctcatgacgcggtgaccgaatcttgggggcggcgcagccattcccttcggtcagctactcaaatccacgggcagctcgaacggcgtgaacgatgtgatggagcttggtgccgtcacgctccagtggaggctgggatctcgtcctttatggcggagatgcccacgcacgacctgggcggcgggatccacgttccacgacaaggagaagccctcgagcggagcgacggcaggaacctccatcgtgccgagtggaaccgaggtgagttgaagagggggcggcattgtcacctcgggagtcgagccgccctccgtgtggaccgttgcgctcgcggaggtgagtccgaactctccctcggagcccacgagcaccatcgtgtgaagctggatgaggtcgaagggcggggtgagcggcatcgcgggaatctggagcggcggagtgtcgatcgcctcgttcctgaagaggaacccggagccgaagtagaaatccatcgtgacgtaggccttcgcgccgtaggctttgaggtttttcacgttgacgcgctgcggctggtcctccgcgtgatccaaaacgatctccacgccgtcgagcgtctgcccggaagtgaaggtgatgtccttcttgattccgaagcgacgtgtcggatgggcttgctccatggcaaggaggtgcaccggcgcggcgacgctgccagaaacgtcaatctcgaacgagccatcctccgcggcactcacagagttgcctctaacccgcttgtcggcggtcgcgacgatgacgcgcagggcgccgttgctcctcccgtgacgcgtcccttcagggtggcttgctttccgtattcggtgtcctgctgtggggatggctggagccagacctctggctgctgggcttgcccacggcctgtgcgaggttggccccggcacgagggccaccccaggccgcggggtgttgaggcgcaagacagctaacaggccggcggcccctgccacgcacctgatgggagcgcggcctgggcaggcgtgtacccccaagggggttcaatcagtctgtccaccggccgggagcatcgctcgggaggccccgtcagcggccctcctcggcccctccgctccagccctcaccctcaactgggcctctatcccgcctatacgttggaggagctggtgcaaggtgcgcctgagctcgtggcactgccccggcatggtcagcacctcatcgccacgctgcacggcgcgttgaaggcgccggacgccgtgcccccgggcaatccgctgctcccgggtgcacgccgcctggccgcgctcctgggctgagcgcggcggcctccacgatggccggcagccgcgccccttacatgcgatggcgcaggcgtcgacgcgccacctgccagccggccaggacgaggacactccaggtgaggctcatgggcccgcccgcatccgcgctactgctgcatcccgtttggggggccggtatcagcgtgggcttcctgactcgcacagagaccaggaaggagcactgggcggcgttccccgctgtatcggtggccgtcaccaccaccggcgtcgtgcccgaggcgaagtggccaccagacgccaggctataggccaccgtcacggaggagactccatcaacagcagaggcaggcgcatagctcaggaccgtgccctcggggtcctgggtctccactgagacgtctgacgggcacatcacctggggcgcagtggtgtcctgcaccgtcaccgcgaaacggcacgaggcctcattacccgcggcatccgacgccgtcacggcgaccgccgtggtgcccagcgggaaacggctcccggaggtctgactgaacgcgatggacgggtcgtgggtcacgaggtcccgaggctggactcctgcgaaggtgaccaccgcgccttgcgtgtcctctgcctcaaggaccacgtcctggggacaccccaactctggaggtgtggtgtcgcgcacagtcactgtgaactggcacgcggcggcgtttccagcggcatccgtggcggtcaccgagacgagtgtcccccctagcgggaagtccgctccagaggcgtggctgtacaccggttgaacctgggacaccacatccacggcctggcccgccggatagctcaccgtcgcgccgccagcacccgtcgcctccacgatgacttcctcagggcacgtcaggactggcgctgccgtgtctcgcacagtcaccaggaattggcacgagcccacatttcccgcgtcgtcggtcgcagtcagcgtcaccggcgtggaacccaacatgaaggtgctgccggagaccgggctcgccgtgacctgaggcgaggccgtcaccgcatccgttgcctggggcagcacgaatcccgccacggccccggcgggccccatggcctccaccacgacttcggccgggcagacgatggtgggcgccgtggtatcccgcacggtcaccgtgaactggcatgtggacgcgttgcctgcgccatccgtgacggtgacggtgacaggcgtcgtccccaccgcgaagggcgtcccggagccctggctgtacgtcacctcgaccgaggagacatcatccgaggcgctcgccgccggatagctcacggtcgcccccgtggcgctcgtggcctcccaaacgacatcgtcggggcatgtcagcagaggtgcctgggagtcttggaccgttaccgtgaactggcatgtcgacgtgttgccagcttcatccgcggccgtcaccgtcacggtcgtctcccccaacgcgaagacgcttccgcttgggatgtcataactcagggccggggagagcgtgatgtcgtccgtcgcctccgccgccgggtagctgacctgcacacccgcggtgctcgtggcctcggcggacacgggtgcggggcacgtcacggacggagggacggtatctgccggggctggaggcgtcagcacccagagttccctgccgtgaatgacgtcgtctccgaggaagtagacgcgcccgcccgagacggtgagcgacgtgggcgaaacagaggcggcgcccgggaggaggtccgtcacccgcaccgtgccggcttctgtcccatcgctcttccaaatctcagcaccggagacgccatcatcagccacgaagtagaggacgccgttcaaggcgacgagccactggggcgcggagccgagcgggccctgacggatgtccttgacccgaacggtgcccgcctccgtcccatcgctcttccacagctcacgtccagaggtcccgtcatccgccgtgaagaacaccaccccctccatcggagtgagggactgcacggtggcgctcgcactccacggccggatgttcttgagcaacaccgtgccgtcagtcgtcccgtcgctcttccacagctcagagccagcggccgaatcggtgcccgggaaatagagggcgccgcccatcttgaccatcccttcgggcaagaggcctgaggagaggcccggcctgatgtccttcacccggaccgtcccctcctccgtcccgtcactcttacacagctcgaggccataactcccgtcatcggccgcgaagaaaccccacccattcaagatcacggcgggatgaatcgaggagctctgcgttccgggcgtgatgtccttcacccggaccgtgcacccctccgtcccgtcactcttccacagctcacggcccgtcacgccatcgtcggccgtgagaaagaacgacccatccattccaatcagggagctgggccgcggatcggacgaccgagtgccggccgcgatgtccttcacgcgaacagtcccctcctccgtgccgtcgctcttccacagctccttgcccgtgagcccatcggtcgcggcgaagtagagcattccccccacgtcgcgtagctcggaggggttggagctgccgattcccggcaagaggtccttcacgcgcaccgtgcccgcctccgttccgtcggacttccacagctccgtcccggtaccggattcgctcccggcgaagaagagcgaggtccattggcaccccctagctccgcagggcaaagggagttgtaga

SEQ ID NO: 1129 - DNA, 15689 bp, Myxococcus xanthus
gggcgccatggtgatgcgcatccccggcatctacggggcccgggcgcgggcattcacacgcgcttgctgtcgggggcgctccggctgcccgaaggcggcggcggacgcatctcccgcatctacgtcgatgacctggtggagtccattcgcgtggtgctgacgcgcggcgagcccggcgccctgtactgcgtcgcggatgaccgctccgcgccctccgaggagccggtggcctggctcagccagcgcctgggcgtgccgatgccgccccgcattcccctggcgcagctcaatgagacactgagaggcgaccgcgacatctccaacgcgcgcctgaagtcgctgggctgggcaccgcgctacccggacttcatctcggggtacacggcgctcctgaaggcggagggccacggcgccggaccgacgcagcttgtcatccgcaggttggtggcggaggacgcggaggcgttcaaggcgctgcggctgcgggggctgcgggacaaccccgagtccttcgcggcctcggtggaggaggattcggcgctgtccctggaggccgtgcgtggctggctggtgggggcgtcccagtgtgtcctgggtgcctttgacggtgggcagctcgtgggcgcgttggggctgaatcgcgagtcccgggcccggctggcgcacaaggcgatggtgtggggcatgtacgtggcgccggaggtccgctcgcggggcgtgggccgacggctgctgacggcgctcatcgacgaggcgcggaagatgggcggcctcaagtgcctgctgctcgcggtctcggtggggaacgcgcccgcgcacgcgctgtaccgctcgctggggttccggacctatggcgtggagcccaacgcgctgaaggtgggggagacgttcctcgacgaggagttgatggtcctcaccctgtgagccgagccgggtgacagattcttgaggggctggtgttccaggagacgcgcgaggccggaggcggcaggacacgggaaccgagggcttttcgccgcgctggagacgcactgcgcatggcacctggcacccctgactggcttctggagcgaatcatcctgcgcgaactgccgccagaggcgctgtccgccgcgcgagcccggctcgagcgtgagcccggtggcgccgcgaggctggcccggctggaagcggactcccgccagacactggcgcgtcatccgcccgccgaagtcgccgccgaggtggcccggcgcgagcacgagtcccaggtccgcacggagacggcacggcgcggcaactcgcaagggtggcatgggctgtcactcagcgtccccgtggccgcctcgctggcgctgctcttcatgtccgcgccggaggagcagccggagccgtccaattcaccggtgccgctcatcgtgatgctggacaccgtgcgcatcaagggtgggccgcgcctgcgggtccaccggcagggcgcgggcgagccggagttgctcggtgaacaggcccgggcgcgccgcggtgacgtcctgcaactcagctacgtgtcgggtggaagccgccatggtgtcgtggtgtcggtggatgggcgcggcgccgtgacgctgcaccatccctcgatgctgtcgggaagcacggagctgggccccggcgaggcggtgccgctggcccatgcctacgaactcgatgacgcgccggacttcgagcgcttcctcttcgtgacgtccgatgcacccctggaggtggcgtcggtcctggaggcggcgcgcgcgcttgcccggcggcccaccgacgcgcgcaccctgccgctgccacttccggataccctgggccagacgtccttcacgttggaaaaggtgcggtgatgacgcggtccctcctgttttcgctcctgctcgtgcccgccctggccgccgcggctccctcggcctcggcgccgcaggcgtcggtgcgccgcttcgcgctgctggtgggcgtcaacgacggtggcgagggacgggcccggctccggtacgccgtcacggatgcgcgctcgttcggcgacgtgctggaggaactcggaggggtgcagccgcaggacaagctgctgctgatggagggcgaccgcgcggcgctggagtccgccctggtccgcttcaaggcgatgctggcggcggcgaccacgccgggcacgcgcatcgaggcgctcgtctactattcgggccactccgacgagcaggggctgctcctccagaaggatcgcttcggctaccgcgagctgcgcaaggcgctggagtcgcttcccgccgacgtgcgcatcgccatcctggactcgtgcgcgtccggcacgctggcccgccagaagggcggcgtgcggcgtccggccttcatggtggatgcgtcctccgcggtgcgaggccatgccatcctcacgtcgtcttccgaggatgaggtgtcccaggagtccgaccgcatcggcggctcgttcttcacccacaacctggtgtccggcctgcgcggcgcggcggacgtctcaggggatggccgggtgacgctgcacgaggcctaccagttcgccttccacgagacgctggcccgcacggaagagacgcgggccggggcgcagcaccccgcgtatgacatcgagctggcgggcacgggcgacctggtgatgacggacctgcgctccaccgccgcggtgctcgtcctgggggacctggtggacgggcggctctacgtccgtgactcccagggacgcctggtggtggagctgaagaagtacgcgggccgcaccaccgagctggggctgcagaagggccgttactcggtgatgcgcaaggtgctggaccagacctcgcaggcggagttcgagctgggggagggcggccggacggtgctggcggcctccgccttccgcgcggtgcagggggagctgacggccatgcgcggcggtgggcccctgccggcgagtctctcgtcgggcgccggtgccggcgtggcggaagtcgccgcggcgggcagcgggcaccgctcgcgcttcttcaacgtgggcctgttccccggcctccagacgaatgacctgatgaacgccggcgagcccgtggacaaccatctctccatgtccatgggcgtgtcccgcatggcgcggctggacggcgtggcaatggccctgggcgcgaacgtggccacggacagggtggacgggttgcagctggccctgggcgccaacgtggtgcggggcgacatgtcgggcacgcagctggccgtgggcggcaactgggcgcacggaaaggcggagggcatccaggccgcggtcgggctcaatgtggcgcggtccagcggctcgctcgggcagctggcggtgggtgccaatgtgtccggcacgtcgctggtgggagcgcaattggccgtgggcggcaactggacggcggggaacgtcgacggtgtgcagggtgcggtggcgttcaaccacacgcgggaccggatggcgggcctccaggtggccgtgggcctgaactgggcggcggaggcccggggcgcgcagctgtccctcgtcaatgtgggcggtgacgtgaagggcgcgcaggtggggattgtcaacgtggcggggcggatgagcggcctccagctcgggctcgtgaacgtgtcgcgggagctggattccggtgtgccggtgggcctggtgagcatcgcgcgcaacggccagttccacgtcgaggccttcggcaatgacttcaactacgccaacaccgccatcaaggtgggcagccgctacctctacacgacgctcgtgttgggcatgggcaccatggagggcgcgcgtggccccagccactggtcgctgggcctggggctcggcgcgcacatcccaatctccgagcgcttcttcctggacgtggacgcggtgacgaacaccctctatggctggaatctgtcctttgaaggcgaccgccgcctgcaccagctccggctggtggcggggttccaggtggcgcggaacctggccatcatcggcgggcccacgctcaacgtgttgcatgactcgaacggcgagcccgtgtcgaacctgagccgtctgtcgaacctggacgcagggggcgtgctcctgtggcccggtgtacaggtgggcctgcgcatctgaagtaaggaccaatggctcccatcagcgggacgaaagcgtgcctgggaatgacgtctttccatggggacttccccggtgagaggctgaccctccggcccagaatcgcggccggtgtcacccttgagctgggggagagatgtccaagttgctgttcgcggccttcaatgacggcgtgagcttgtccatggcgggcaaccatgaggcggccatcctcgctttcgacaaggtgctcgccgtggaccccaagcacgtcccggcgctcaccgcgaagggggcgtcactggccacgctggagcgcttcgaggaggcgctgcgctgcttcgagcgcgccatcgaagtggaccccaccgaggccgaggcccaccgcgacgcggccctctgccagttggagctgggggagccggaggccgccgcgcagctgctccagcgcgccacgcagctcaaccccacgccgggctaccgcgagtccgccgccgttcaaatctacaccctgggcaacgcgctgctgacgcggggctcccgtcgcccggacaaggcccgctaccgccaggcccgccatgtcttcgaactggcgctgacgctgtctcctggttccgccgagtgcgcccgggccctggcagacgtgtgggagcacctgggcgaccccgttcagagagaccactacgcccagctcgccacccggctccgccccgtgccggcctagcagtcggcccgccggggcctggatgggacgcagcccccttccggtttcaagtccggacgcggcaaagcggttcgaagtgttacatctgccgcggcctttttccgcaatagttcacgcaattcgcgtgaagtacgacaacgccgcccgggagaactgaagatgatcgtcatgctcgagccggactcgcctgagtccgtggtgtccgccgtcctccaggttgcttcccagtacaagggagtgacgccgcggacgcacgtcatcggtggctccgagtacacgattacggaggtctacctgctgggttccaccgcgcaggtgcccgtggagcccttcgagcagattcccggcgtgcggcaggtggtgcgcgtgtcgcagaagtaccgcgtcatcgggcggcacaagggccagcggacgtccgccggcttcgagtacaacggcgtcaccttcgacgagcgctccgtgaatgtgttcgctggcctgtgtgccgtggacaacccggagaacgtggacacgatgatggcggcgcttgctcgcttgggcatccgcaccacgcgcatgggcgcctacaagccccgcaccaacccctacgagttccagggcctgggcgccgcctgcctgccctgggtgttcgaatccgcgggcaagcacggcatcaaggtcatcgcgatggaggtgacgcacccgcgtcacatcgacgagattcgcgacgcgctcgagcgctccggcaacgccacgggcgtcatgctccaggtgggcacgcgcaacgcgcagaacttcgagctgctcaagagcattggccagcagcgtgtcttcccggtgctcttcaagcgcggcatgggcatcaccctggaggagtcgctcaacgcgtgtgagtacgtggcgagcgagggcaatccgaaaatcatcttctgcctccgcggcgtgaagacgcacctgggtgacccgcaccgcaacatggtggacttcgcccacgtgcccgtggtgcgccggctgacgcgcctgccggtgtgcgtggacccgtcgcacgccattggccaggccgcgccgccgccggacggactgccggacatcttccacgccattggccaggggctcatcgcgggcgcgtccatggtgctggtggacttccacccgcacccggaggccgccctgtgtgacggcccccaggccctgcgcatggagcagctccccgcactgcagcgctacgtccaactggtgcgctccgcgtacgagacggccgtgcagagcggcgacgggctccaggccaccggcgcctgagcgagcctcacaccacgccgtagcttccgagcacccgcagggtgacgcaggcggcctgggccgcggccaccgcctcgcgtacccgcgggtcctccagcgcgccgtccacgtccaggcaccacacgtactcccaggcgcggcgctgcggccgggactccagccgcgccacgttgaggccgcgcgaggagaaggcgctcatcacgcggaacagcgcgcccggcccgttctccacggtgaaggccagcgccgttttccgccgcgtccacgtccgttcgggcgcggtccccagggcgatgaagcgcgtgaagttgtccggcgagtcctccacgccttcctccagcacggccagcccgtacaggtccgcggacatgcggctggcgatggcggccgtgtgcggaggcttctcctccgccacctttcgcgcggcgatggcggtgttcgcctccggcagcggtgagatgccccgccgtcgcaggtagcccgcgcattgcgccagggcctgcgggtgggagagggcctgctggacgtcgtccagtgacaggcccggtggggccagcaggcagtggcggatgcgcagggacagctcgcccgtcgccggcacgtcatgctccagcagcaggtccaccgtctccgccacgggcccgcccagcgagctctccaccggcaccacgccgccgtgcacgcggccttcggccacggcttcgaagacggcgcggaaggtgaggcaggggacggcctccacgtcggcgccatgcagcgcgcgcagggcctcttctccgtaggcgccaggctcgccctggaaggcgatgcgacgcggcgactcaggcatgaggcgactccgcgcgcgcatacgtccccagcacgcgcagcgacgaggtgagcggacggatgtcgtcgagcgccgccgtcaccgctgcggaggcggcgtggccctccacgtccaggtagaagcggtactgccacggctgccccgggatggggcgcgactccagcttgctcaggttcacgccgcgcagggtgagccgctggagcatctctcccaacgtgccgggcttgtgctccagcaccaccagcagggacgtcttgcacggcacgccgggcgccaggggcgaggcctcacggcccacctccacgaagcgcgtgtagtcgaaggccggctgcaaatcgcccgcgagcacctccaggccgaagcgctgcgccgccgtctcgctggcgatggccgccaccgacgcgtcgttgcgctcgcggaccttctgcgccgcgccgccggtgtccacgtccggcaccgcgcgggcccagggcaccttctcccggaggaacgtctcgcactgcgccagcgcctgcggatgagacagcacctcccgcaggccttccagcttcgcgcccggcaggcccagcaggcggtggtccacctggctgaccagctctgcggtgatgaccacgccgccctcggcgagcaggtcatacgtctcgttcatgctgcccgcggtggtgttctcgatgggcagcagcaccaggtcctgctcgccgcggcggagcgcctccacggcctctcgcgcatggtcgaagccggacagcagcacgccgcccgcgcggtgcccatagcggcggcgcgcggccaggtggctgtaggagccctccacgccggggtaggccacgcgcaggggcgtggtgtccaggcgggtgacgagctcgtgttgccgagccacggacatgtcgatgaagagccgccagatgcgctccacctcgtgcgggtccaggccgtgctccgcggcgcgggtgcggatgcggcgcaggagcaggtcctcgcggcgctggtcccggaagggcgcggcggcggccagcttcgcccgggcgacgtcgtccgccagcgccatccggcggcggagggcatcgaggatctcctcgtcgatgcgctcgatggaggtccggatgaggtcgaggtcggggagggtggtcatcacgaggttccgaggttgcgccacatgaggtggtgcgggccgatgccgggcaggtcgaagggctcgcctcgctgggcgaagccctgcgcacgatagaacccggaggccgtcatccgcgcgttgcaccacacctgagaaccgccctgccgcgccgcatgctccatgcaggccttcaggagggcggcgccatggccgtgcccacgcagggtggcgtccaccgccatgcctcgcaggcgccaggccgtggtggcgcgcagcgcgtccggcggcggctcccgatacagggaggccacgcccaccaggcgaccctccgtatagacgcccaggtggagcgtgtccgcgtcgtcatctccgggatagacggccatctccggaggctggttgggacggaggatggcgtggcggaggccgcgcgtgtcctgagccggaatcttgcggatgtcagtggcactcacggcgccggagtatgccttcgagggtggcgccccaccagtgtcaccgtactacttcggtagtactgtcttccccatcttcaacacctgcttgaagtgcgtggcggtgacgggggccacgctcagccggccgcgggtgacgagcggaaaatccttcagtgcggcggtggccttgatggtggccaggtccaccggctgcgtgaaggggacgacaggccccatgaaggtggcggcccagtcctcatcaggcacggtggagtccggtcccggtggcgtgagcacctgggccacgcccaccacggccttgtcctcgttggagtggtagtagaggcagaggtccccaggcttcatcgcccggatgttgttgcgcgcctcgaagttgcgcacgccggtccactccgtcttcccgtccttctccaactgggcgtaggcgtagacggagggctcgctcttgatgagccagtactgtggcttggccatggcggcgcaccatatgggtccgaaaccgcgcgcgccaaatgaaagaggccggcgccacgcgcgggcgcccggcctctttcgttacatccggactacgcctgcttcgcgacgctggtggccgccgtcgccggcgccttgttcgtgagcagcgcgctgctcgcgtacaacgccaggcccaccacagcgaccaccgcggcctccatctgcgttgcgaaggccacacccatcagggtcatggctcccgtgcccatcgcgaacgacgccgccaccgccccagccgccttcctcatccgaccatcccccgttctcgcgaactcatcacgcgttgtggacttcattgcctcgcgcgaacttcagtccaagacgcgtgccagcctccagccccgggaaatgggaagcgggaggggccgcggagggcaaagtcgttccctgctcagagcaatgcctgaagaaagcaccgggtgcgacgcgggtacgatgccggaaaaatttcctgaaccccatggggtctcccagaagggcacttcgtaacccactgcgatccaagggctttccctccctccagtacgtggcacacgcgctgctaaggcaacgccgccggaagcaacgcccggccgcggtagggccgggagcgcgacacacgattttgagggagggctgacgatgggcaagacgagcgcggggttctggacggtgttgggcgtgatgctcctggggggctgcgcgcaccagtcgcaggtgaaggtggacaactcggagcagccctaccggattggccgcgaggacgtgctggacatcgcggtgtggcgtgacgcggagttgtcccggacgctgccggtccgtccggatggctacatctccatgcccatggtgggcgaggtccacgccgcgggcaagacgcccacggagctggccgactcgctgaaggaagccttccagccgtacgtgcaggagccgcgcgtgacggtgattgtccgcgaggtgaacagcagccgcgtgttcgtcaccggcgaggtggccaacccgggcgcctatccgctgcgcggccgcgtgtcgctgctgcaggccatcgcgctggcgggcggcttcacggacttcgccaactcggacggcatcgtggtcatccgcaccgacagcaagggcggacagattccggtgcgctacagcgacctcatctctccggatggcggacacgaggtcatgctccggccgggtgacaccgtcgtcgttccgtgagggatggtgacgcagtgggcgtcgtggacgtgggcggtggttggcgtgcgggacggagggcgacggtgaagggcaactggaagaagtggctactcgcgggcctcatgttcggtgcgcctgccgcgcaggccgcgacgatatgggaaccccggcttcggctgacggcggaggagcggttcgacgacgacctgcgactgggcggtggcggcaccggccagctgatgacgaaggtgacgccgcggctgggactggaggcgaaggacgcgcggctcacgctggacagcttctacgcggccgacctgctgatgcggcatggctcgggcaggacgacgctggaccaccggggcggtctggaggcccggcaccagatgacgcgtcgcctgcggctggacacggcgctccgggtgttccgggtcacggaccccagctcgctgccgcgtgccggcctggcgcgctccacgctgcccacgttcttcacgcaggcgacgctgggcgtgacgaaccgcgtggcggagcggctggacgtgcgcgcgggctaccgcttcgaggcggtgcgcatcatcgacgtggggcagcgcgcggggtacgcgcatacgccctccatcgaaggctggtaccgcgccacgcgccggctcggcctgggcttggagtaccggtaccagggcttcctctatgagggggcgctgagccagtcacacggcgcggcgctggggttgcggtatcggctgacgcggccaaccaccttcaccgtgcgggcgggccccgtgcggtacctggcgccggtggcccagcagggtggctgggttccgcgagtgaacgtggagctgcagcgcgaaggggagatgttcgacctgggcgtgtcgatgggacacgacctggtgggcgcgaacggcttcaccaacgcgctgtgggcggactacgcgtcggtgatgttggcgcgccgtttcacccagaagttctcgctttttggcgcggccagcttcttccgcaacgggcaggcgccgtcgctggactgggccgtgttcagaggagcgccgcgggtgtcgcagggctacgcggtgagtggtggtgtggagtaccgcattgaccggcgcctgtcggcgcagggggcggtggatcggatcgctcaggttgggctggcggattcggcgagcgcggtggacctgacgcgcaatgtgttcgccgtccgtttggtggtgacgccttggtagctacagcgcgtgggatggaggaggagcggaacatggagcgagggatgacggcagaccagcttctgggagccctgtggcggcgcaaggccctggtcggtgccatcgcagcagtggtcttcgtggtgggcgcagccatcgtgatgacccggccgagcatgtacgaggcttcggtggtggtccgcgtggagccgcagcggccgggtgaggagatggtgcagcgcacggtgagcgaaatcatcgagcagcggctgctcaccgttcgccaggagctgctggcgcgtccggtgcttcagaaggccatcgaggagatgaacctctatccggacatcgtttcggagaagggcatggagtccgcggtcgcgcagatgcgcaaggacctcacggtgcgcgtggaaggtgagacggccttcgagctcacctacgccaaccgcgacccgcaggtggcggcgcaggtggccaaccgcctgccgaccatcttctccgatgagacgctgaagattcgtcaggcgcaggcggcgcgcgccaccgacctcttcaacgaggagatggttcagctgggcaaggcggtcagcaactgggaggcgaagctctcccagttcaaggtggaccacctgggcgagctgcccgagcagatggagatgaacatgcgcggcctggagcgcgtgtcgcatcagctccagacgaagtcggaggagctgcgtgtcgccgagggccgccgctccgacctggcccgcgctcgcaacgcggtggacagcgaggctggccggctcgaggccgcggagaacgggctcacccgttccctggtcaacgctcgcaccacctggacggaggaccacccggaggtgaagcgccttcagacggagctggacggaatgtcggctcgccgcaaggaggccgaagggcggctgtgggccgagcgcgccgagcgcacccgcgtggccacgctgattggcaacatccagcaggagattcaggacctccagaagcaggccgaggcgtaccagggccggctgaacaacaccccgcgctgggcgcacgagctggcggtgatgaaccgcgactacgaaatcgcgcgcaccaagtaccagagcgtggtgagccgcaaggtggaggcggagatcgcgcaggagctggaggccaagagcgccaagagcctgttcaacgtcatctccccggcgggcgtgccggcgaccccggcccggccggaccgcatggcgggcatgctcatcgtcttcctcctggccctgggcctgggggcgctgacgggagcggtgctggagatgcgtgatgacagcctgcgcgatggcaccgaggttcgccagcgcctcacgctgccggtgctcgcggtggtcccggaaatgcagggcaagacggagcggcggattctgatgccggcttcgggggctcgaaacagcgtgtctaaccccacgtcgttgaactgagtcttgccggaataggacggaggacggacatggatcagacgatggagcgggcgggcaacttcctcccccgagtggatgacaacccgacgggcggcaacgcggtggaccgccgggtggtgacgctgacggcgccggcatcggccgcggcggagcaataccggagtctttactacaggctcgagcggatgcgggacctgcggccgatgaaggtcgtcgcgctcacctcggcgatgcccggggaaggcaagacggtgacgagcgtcaacctggcgctcgccgcggcccgggcgaacccggagcgccgcatcctgctggtggatgcggacctgcgccggggcggcgtggcggccatgctgggcatgcgcaacaagatgggcctggcggagctgctggcgggggactgtgaggtgcgggacgtggtgcggcggttcaactccacgcgcctggccctcatccccgcgggcgtcacgcccgaggacaccgcgcaggtgctggcgagcggtcggatgaagcagttcctcaaggcggtgcgtgagggcttcgacgaggtctacgtcgacctgccgcccgcgctgcccttcgcggacgcggccatcctgggccatcaagcggacggcatgctgatggtcatccgcgccaacgtgacgtcgggcaaggcggtgcacctggcggtggagagcctgggcggcgcgcccatcatcgggtgcgtgctgaatggcgcggaggtccactcggcgccgtatctgaagaactacgagaagaagtagcggtgggtggctttggttccggttcccgcctcctggtgacagggggcggggtcggagatggaagagggtcgggcgggcaggttggaggggcacgtgctccgcgtttttcaccattatttttctgcaaagaaactgacgttcttcctcgccgagagttcggcaatcgcgttggcctgcgtgatgggcgcggcggcctgcgcggcactcttcgcgcccgaagggacgcacacgccgctgtcgcaactgtggcccacgctgctgtggatgggcgcggcgttcgtcatcaccttccagttcacgctgtacctgttggacttgtatgacctccgtgtggccgcggaggaccgggtgaggggataccggttcctcaaggccgcgggtgtcacggcgatggtggcgggcggcgtcatgctcgtcaccccgctggtggtgccgatgcagcttccaccgggcacgctgctgggcggggccatgggcgccctggccgggacgttgatggtgcgggtgtccatccgcgccctggtgggagcgccgcactcggtgctcatcgtcggagaagggcccaaggcgcgcgcggtggccagcgcgattgacgcgggcggggagggcacctaccgcatcgtgggcctgacggacccccgtacctcgggtgaggcgctggaggagacggcggcccggctgaacgcggcctatgtggtgcaggccgcggatgacatgcgcggggccaactgggtggacggcctgctgcgctgccggctccagggccggcgggtgtatgaggccacgggcttctgtgagcgggtgctgcgccggattccggtgcagttcctgcgggcgagcgacttcgccttcgcggacgagctcaccgtgtccccgctgcgccgcacgctgaagcggggcttcgacatcgcggtggcatccctcctgctaatgctgtccgcgcccttcctgttgctggtcgtggtggccatcaagctggattcgaagggccccatcttctaccggcaggaaaggaccgggctgttcgggagcacgtatcacctgtggaagttccgcagcatgcgcacggacgcggagaagcatggaccggtgtgggcgaaggcgaacgatgaccgtgtcacgcgggtgggccgcttcatccgccgtgcgcgcatcgacgagattccccaggtcttcaacatcctgacgggagacatgagtttcgtggggccccgccccgagaggccagtgttcgtcgagcagttgaaggagcagattccgttctacggcctgcgggaggccgtcaagccaggcctgacggggtgggctcagattcgctacccctacggcgcgtcggtggaggatgcgcggaacaagctggagttcgacctgtactacgtgaagaacggttcgctgttcctggatgtgggaatcatcttccacaccgtgaggcatgtgcttctcggtcgtggggcgcggtagggcatttcgctttcccggcctccgctgagggaggccgggaggtgggcccgcctggggaggcgggctggggcgtcgtggatgggggtaagcgtcatggtgggaatggacatggaagcgccgctgcccgcggagtgggcggaggcccgtcgcaggctggagctggagcgccagggcaacgaggtgcttcaggggcgggtggaccggccgacgcgcatcgtcgccatcggcggaggcacggggttgcccatggtgctgcgcggcctggcccggcgcgcgacaccgaaggcccgggagcccggcatcgacatcaccgcggtggtggccatgagcgacgacggcggcagctcgggccgcctgcggcgccaacacggcgcgctgcctccgggcgacatccgcaactgcctggtggcgctggcgggtggaaagaacgcgctcaaggacgtcttccagttccgcttcggcggggcgcgcggcctggcgggccacgcggtgggcaacctgctcatcgccgcgctcgcggagctgaagggtgacttcatggaagcggtgcgcatgtccggggagctgctgggcgccgggccactgctgcgtcacct

SEQ ID NO: 1130 - DNA, 17862 bp, Myxococcus xanthus
gctcaggcagggggcctctctggggctgcacgtaggccttggcgcgggagtactcgtaataggcctcgtagccctggatgacgtcctggtcctcatggagccccaggtggctgaccagcacgatgaggtcggtgacggggcgcagcaggtccacgtaggcgcgcgccacctcgttctgctccagtggcgtcacctggaggctgttgccaccttcgacgatggagttgagcgaggagatgttggccatgccgatgatggccacccggaggcccttcacgttgcggatggtgtacggctccacttccagggccgtctggtggttgccgttcgcccgccagtcgtcccagaagtagttggccgccagcagcgggaacatcgcgtgctgctgcgccatctgggtgaagttgaggaggcccgcgtcgaactcgtggttgcccacgacggccgcgtcgagccgcgcttcggagaggaacttgaactccacctcgccggtgttgaggttgaagatgggcgcgccctggaagcagtcgcccgagtccacgtgcagcacacgctcgccctgggagcgctcgcgcttgagcaacgcccccatgcgcgtggcgccgccgaagggacccgcttccgggatggtccccaggtccacgtccgtcttcaacggcgtgaagtcataggggatgaggcgcgaatggatgtccgaggtatgaaggagcgtcagacgcacctcctgcccctcgaggttgtagtcctggccttccagcaccggcatgcacgaagcagatgccagggcgcagcagaggccgagcaggaggcgacgcatcaagagaattccgtgtttcgggagggagacagcggtaaagcgggcgcaaggtacgggatcaagctttgtcgggcaagcaacgccaccatggcgggccaggttcctgccatcggcgttcctaccccacaggagagcaggcggacatgcggcagcgtcattccagtgtgactgacatcgagatcatcgaggatttctcgtctaccgcgagatgcgacgagggctttctcagggttcggcggctgcgctgccgcaaccggcgcgcggacggttcttcctctcccgtataccgcgtggacgtggtggaccggccccggttggacgcggtggcggtgctcgtctatcgccgcggcgcgtcaggtctggaggtcctgacgcggatgaacctccggcccgcggcgtatttccggaaggacagccgtgacgcgatgaccgttccagaccctgcgtctggctacttgcgcgtggaagaaattgtcgcgggactgctggagccggaggacaagggcgaggacggcctgcgtcgccgcgccgcggcagaggtgcatgaggaggccgggttcaacgtgaagccggaggacatccggctgttgggcggcgccttcttcctggcgccgggcatcctgtccgaaaaggtgtttcccgccgcggtggacgtcaccgacctgtcacccgaggagcccgaaggggatggttcgcctctggaggagggcacgcagttgcactggcgtcccatccaggacgtgttggacgcgtgccggcgcggtgacatcccggatgcgaagacggaagtcgcgttgacgcggctgctcgccctgcagccctgaagggcgtgcattgttttcgcacggccgcgtgccggggtagggtgcgcggcgttccgcaatccaccgcagaggtcgctgcatgtcgtcgctgcccccctggctggcccagttcctgcccatcctcatcctcctgggggccatcggcctcgtcctcacgcgcctgcccaaggtggagctgggacactcggaggcattcaagcgccgccggttcttcaactggttcccgttgggcatgacgtacgcgttcctctacatggggcgctacaacctcaacgtggccaccagcgccatgggggaccgcacctccaacgcggacttcggcaccatcttcgcgtggggcaccgccgtctacggcgtggccttcctcctcaacggcccgctgacggacaagctgggcggccggaagaccatcctgatggcggccgcgggttcggcggtggcgaacgtggccatgggcggcgtggtgtacgcggtgctgacgcacaactgggcgccgccgggcggcctggtggcgacgctgtcgttcctctacgccgtcaacatgtacttccagagcttcggcgcggtctccatcgtcaaggtgaacgcggcctggttccacgtgcgcgagcgcggcctgctgggcggcgtgttcggcatcctcatctcgctgggcatctacttcgcctacgactggagccggctcatcgtgaaggcggcgcccacgtactgggcgttcttcgtgcccgcggccatcctcgccgtgttcctggtggtggactacttcgtcatccgcgacacgcccagccacgcgggccatccggacttcgacaccgcggacgcgtcctccggagagacggggccgcagttgggggtggcgggcgtgctgaagcgcatgctgaccaaccgcgccatcatcatcatcctctgcatcgagttctgcagcggcttcatgcgcaacgccatcatgcagtggtaccccaagttcgcgaaggcgacgggccttggcgaaacgttcgtcgcggccaactggggcatgctgctgtgcgtggcgggcatcaccggcggcatgttcgccggcgtcatcagcgaccgcgtcttcgactcacgccgcggccccgtgtccgccgtgctctacgccggcatgtcggtgggcgccgtcatctccgtgttcgtcctggagagcgtggccctgggctggacggtcatcttcatgtccctgtgtgtcatcggcgtgcacggcatgctgtccggcacggccagcatggacttcggcgggaagaagaacgccggcctcgctgttggcatcatcgacggcgccgtgtacgcgggcaccgcgctgcagtccatcctgctgggttccatcctgccgatgggtgacgaggcgaagaccgccgccaactggggcaactggccctacgccatgctgccgctgtccttcctcgggctgctgctggccacccaggtgtggaacgcccggccccagccgaagtccacgcctgtgccggccaccctgccggtgccctcggaggcgccagcgaatcggaccggtactggcgggtgatatccatgtggccccaacgatgtgtgacgttggggtcactcccgcgtgacagggatgtagcgtagactccaggtgtgtcccagtcacccgcacccctgcagagccgcttcgaggtccacgaccggaagcagtttgagatcaagctcgagtatcagccctccggggcggatgagacgcgctacctcgtcgaggcgtatctcttcctgccggggagcctgaacatcgacgcggagacgtacccgcgggcggacttctacgcggacatccacaactacgtgcgcttcaagacgccggtgatggcggtgaacgagctgctgaactcggacacctcgccgctggtgcgcttggaggcgtggctgcgcacggggatggggtccgagaaggacgtcgtgtaccaggccaagctcctctcctgcgtgctgcgcggtgcgctgcgccgcttcgccaccggggtggagtcgcggtgcgagggccccgcggcgctgaccacggacgcgtgcgcggtgctggagtccgagatcctggccatgcaggcgggtgtgacgcaggtgctggcgcgcttccgcgtgtggctgcgcgcggtgggggagctgcacctgcaggagcgctcgcgggcgtcgctgcggctggtggacgaatacgtcagcctgctggtggagggcggctttcggcgctcggtggcggacatgaagtcgctgccccgcggcgagccgtggcatgggctgcgcaaggggctgatggaggcggtgctgcgggaggaggcgtaccgcaaggagcaccggctgcgcagcgtgctcagtcccacgggggacaacgaggagtacatccttcggctgggcttcctgaagaagttctgcatgaacgtgctgttcctgtcgtcgaagcggcggcagaagcggcagggctgggaggagatgctcttcgcgctggccgcgggcatcgcgatgacggtcgccaccgcggtggccttctgggcgcaagagcgctacgcgcaggccagcctcaacttcttcctcatcctcgtggtggggtacatggtgaaggaccgcatcaaggagggcctgcgccggatgctcagccgggtagcggccatgcacctggcggaccggaccacggacctggtggaccccgtcaccgggcgcgtcattggcgcgtgtgaggagcgggtggactacgggccctcgctgaaggttccagacacggtggcggcgctgcgccagcgcgatgacttcctcaccgcgacgcagggcgagctgtcggagacggtcattcgctaccagaagcagattgtcctggatgcccggcacgtgccgcgcacgcagcgcggcctgacaggcgtgacggacatcctccgcctcaacgtcgagcgcttcctgcgcgacatggacgagccggagctggcgctggagtacgtggacctggcggacctgtccgtgggccacatccgcggcaccaagcgctacccggtggacatggtgttccgcttcacggtggtggaggaggagacggaccgcagccaggactccgtccagttcgtgcggctggtgctggaccgcaacggcatccagcgcatgcagcgcttcacggaccccggccccggaatgccgcccagccgttcggggtggaaggccgcggcctgaagcgggcccgacgctccaggcaggggggcgcatgtcagccctggtggaggtttcggcggcgccctggcgcgcgcgggggtaatctccccggcgcacatggcttacgacgacttcaagaagcgtattcgcgacgactggcgtgacaccctgcgttccatcctggagcgcgcccgctcccagggctcctccgccgtgctggcgttcgacctggactccaccctgttcgacaaccggccccggcaggcccgcatcctccgtgagtatggtgccgcccgctcgctggccgtgctggccgcctgcgagccgcaccactgggtgacgggctgggacatgaaggaggccatgcgcgcctgcggcctggaggacgccctggtggagtcccacttcgccgaagcccgccgcttctgggccgagcgcttcttcaccagcgactactgcgtggacgacgaggccatcgacggcgcggccagcttcacccacgaggtggtggccaccggcgcgaggctcgtctacgtcacgggccgccatgaggccatgcgggaaggctccgtctcctgcatgcgccgtcacggcctggtgctgccggatgacgaccgggtgctcctcgtgatgaagcccacgctggccgaggacgacgacgccttcaagcgggaggcgcacgcgcggctgggccgcctggggagcgtggtggctgcgtttgacaatgagcccacgcacgcgaacgactaccggcggaagtttccagaggccaccgtcattcacctggccacggaccattcgggccggccggtggagttgctggatggcgtcatttccgtcccgcacttcgcgctgggttcctgacgcaccgcgcctgaaacagacgtggcgtggacggggcttgaaaggctttgaagtcccactgccgcgcggctattgagtcgctcggcgtttgccgccccgggagttccgtgggcggccagcatggaggcattccgcagtggccagcccgtactcaaaagaactgctgttggacatgtaccggaagatgtacctcatccgtcgcttcgaggagcgcgcgggtcagcagtacacgctggggaagattgccggtttctgccacctctacatcggccaggaggccgtggcggtgggaccggtggaggccctgcgaccggatgactacatgctcagtgcgtatcgtgaccacggccagccgctggcccgtggcagcgacgcgggcatggtcatggccgagctgatgggccgggacaccggctacagcaagggcaagggcggctcgatgcacatcttcgacatcgagcatcacttctacggcggctacggcatcgtcggcggccagattcccctggcggcgggcatggccttcgcgagccgttatcgcaacgaggaccgcgtcaccgtctgctacttcggcgacgcggcggccagccagggcgccctccacgagacgttcaacatggcgtccaagtggaagctccctgtcatctacatctgcgagaacaaccgttacgggatgggcacggccatttcccgcatcgcggcggtgccggagatctacaagcgcgccagcgcctacgacatgcgcggcgagccggtggatggcatggacgtgctggccatgtacgaggccgtcaaggacgccgccgagtactgccgcgccggcaagggccccgtgctgctggaggccaacacgtaccgcttccgcggccactcgatggccgaccccgccacctatcgcaccaagcaggaggtggaggatgagcgcaagggcgacccgattccgaagctgcgcgcctacatcctgaagcaggggctggcccaggacgacgtcttcgagtccatcgaagcggaggtcaatgcgcaggtggaccaggcagtgaagttcgccgacgagtcgcccgagcccagcctggacgaactgtggcgcgacaccatcgtggaggagggcgaggaggacgtgcgcccccgcgagcgcgtgctggggcagaaggtgaactggccgacgtaccccagtggccaggagctgaaggtgacgtgggacctggagccgcgcgagcaggccgaggcggccgacaagaaggcgggcctcatccgctaggcgcgcgctgacctgtctaccaaccctttttcgagttcgagtcggagccgacgatgcccgagttgatgtaccgcgaggcgctgaaccaagcgctcgccgaggaaatggaacgcgacgccaacgtctatctgattggcgaggaagtgggccgttacaacggcgccttcaaggtgtcgcagggactgctggacaagttcgggagcgcgcgcatcatcgacgcgcccatcgccgagctgggcttcaccggcctgagcgtgggcgcggccatggtgggcttgcgccccgtggtggagatgatgacctggaacttcgcgattctcgcgatggaccagatcgtcaacaacgcggccaagctgcggcacatgtccggtggccagctgcgctgccccatcgtgttccgcggtccgggcggcgctggcggccggttgtccagccagcacagccaggcgctggaggccaactacgcgcacttcccgggcttgaaggtgattgcgcccgccacgcccgcggatgccaagggcatgctcaaggctgccatccgggacgagaacccggtgctcatgttcgagggcgagcggctctacgccatcaagggtgaggtgccggagggcgagcacgtcgtgccgctcggcaaggcggacgtgaagcgcgagggctccgacgtcaccatcatcacctggagccgcatgtattacttctgcatgcaggcggctgaggagttggcgaaggaggggcatcagcgtggaggtcctggacctgcgcacgctgcggcccctggatgaggaggccatcctggcgagcgtgcgcaagacgaaccgcgccgtcatcgtggaggagggctgggcgctcgccggcgtgggcgcgtccgtggtggatatcatccagtccaaggcgttcgacgacctggacgcgccggtggagcgcgtcacgggcctggacgtcaacatgtcctatgcagcgaacctggagaacgcgacccagccggacgcaccgaagatcatcgccgcggtgaagaaggtgctgtaccgcgagggagcttgaacgcgtatggccattcccatccagatgccgagcctgtccccgacgatgacggaggggaagatcgtcaagtggctcaagaagcaaggggacaaggtgtcctccggcgatgccgtggccgaggtggagacggacaagtccaacctcgaaatcgaggcctacgacgacgggtacctgctgcaggtgctcgtcggcgagggcgagatggccaaggtgggcgcgcccatcgcctatatcggtgcgaagggtgagaaggtgggggccggcaagcaggtcgcgcccgccgccgcgcctcctgagcagaagccccagccggcacccgcggcccccgcgccgcaggccgccgcgaagcccgcatcgtcgggcggcggcgacaaccgcatcgccatccagatgccgagcctgtccccgacgatgacggaggggaagatcgtcaagtggctcaagaagcagggggacaaggtgtcctccggcgatgccgtggccgaggtggagacagacaagtccaacctcgaaatcgaggcctacgacaacggcaccctggcggagatcgtcgtcggagagaaccagatggcgaaggtaggggcacccatcgcgtacctcaccgcgaagggcgccaaggcggccccggccgctccggcggcgcagcccaagccgcctgctccggctcccgagaagccggcggcagcgaagcccgcggcggctccggcccaggcgggtggccggcgtctccgcgccagccccgtggcgaagagaatcgcgcgcgagaagggtctggacctcacccaggtgagtggctccggtccgtctggccgcgtggtgaagcgcgacatcgaggaggcgctcgcgcgtggaccggcggcggttcctgccgcgaagaaggccccggccgcgcagcccgctccgggcgtgcgtcccgagccgaccgtgctccccctctcgtccatgcgcaaggtcatcgcgcagcggatgacggaggtgaagcccggcgtgcctcacttctacctcaccatcgaggtggacatggaggcggcgtcgaaggtgcgcgaagaggcgaaggcgatggacctcaaggtctccgtcaacgacctcatcgtgaaggccgtggccatggcggtgcgccgttacccgaagatcaacgtctcgctgcagggcgacaaggtcgtccagttccacagtgtggatgtgggcatcgcggtggcgctggaggaaggcctcatcacgcccatcctccgggatgcggaccagaagggcctgcaggccatcgcgtcgggcgtgcgtgagctggcggagcgcgctcgcaagcgtgccctcaagccggaggagtacaccggcggctccatcaccgtcagcaacctgggcatgtacggcatcgaccagttcgtcgccgtcatcaacccgccgcaggcctccatcctcgcggtgggtgccgtctccgagaaggcggtggtgcgcgatggtcagctggcggtccggaagatgatgacggcgacgctgtcgtgcgatcaccgcgtcatcgacggtgccattggcgccgagttcctgcgcgagctgcgcgggctgcttgagcaccccacgcggctgctgttctaggccgtccggttgccccgctccgtgtgcccgtcctggggcgcgcgcgggcggggcagcgcccggatggacccttgttacttgcgcgtcggctctttgcggccgtgcgcctcctgctccagcttgcgttgagtctgcgtcacgcttgcctggcgctcgcgagacgttccggtcggcagctcgttctcctcatcgtccgagcgaccgcggatgccgggccagggctctgggtgcgtgccctccacatgctcgatgcgctccgcataaccgttgtctccaactgcgttgtgcttcgtctcctcggatttacccttgctgtccaccatggtgtgtcctcccaagcaggtgccatccggcacacttcgtggcggtaacggtgggacgtgtgccgcgtgctgaccacccacaagcgggttgcacggcttgtccccctgcctgctccacgagcgcgaaaaaaggtcggcggccgtgggcgttcgctgcttaacttgcttccaatgaacgacgacatgacacgcgaacggcttgcccagggtgtgtcggagttggagtcgcgcgtaggcccgccgctgccgctggcggaatcgctgcacaaggcgctcgacggcgccgtctttccgctgtccgcgcggcagttgacctgggtggcccgtgagaacgaggccccggccctggtgctctcgctcctgggttcgcttccccgggccagcttcggctccgtggatgcggtggcccgggcgctggaaggcgacctggaggccacggttccgcaacagtcggcttcttcgcgctgacacgaccctggacggagaggggctctccggaaggcgcgacgcgtcaggcgtttgccctatcctggtggtgcgtgcggtacccagcagatcgccaagggggtgaggcgctatcctaggccctaccagcctggcccccttcatgggacgctggcctggaggagcgtcatgaacccgtctgaactccccgcggtcctctacgtcgacgatgacgcgctgaacctccgggtcttcgacgcgaacttcgggcagcgcttccgcatctttcgcagctcctcgcccagcgaggcgttggcgctcctggagcagcgcaggggcgagattggcgtcatcctctccgaccagcggatgccgggcatgacgggcgtggaactgctggagcgggcgcgcacgattgctccggacgccaagcgcatgctcgtcacggcctacgcggacatgcaggccgtcatcgacgccgtcaaccgcggccaggtgacgcgctacttcgtcaagccgtgggaccggacggagctccaggccgcgctcgatgacgcgctcaagattgcccgactggagctgcgcatccgcgaggtggaagggcgcatgctgaagtccgagcgcctggccaccctgggacaggtgacggcgggcatcgcccacgagctgatggggccggtgggctacctgtcgcagaacgtggcgtcgttgcagcgcgacctgggcagcgtcatccagtacgtgtcgcggcacctgcagacggaccccgagcccgccgtggcggagacggtggaggacctgcccgccctcatcaaggacctggcggacggcgccgagcacctgcggcaggtggcgctggggctgcgagcccaggcccgcggtgaggacctggaggccacggcggacgtcgcggaagtggtgtccttcgcggtgaagctggcgcgcgccgaggtgcgggagcgggcgcggctgacgagcaacggcgagcccgtgcgcgtcaccttcggcccggtgaagctgtgccaggtgctgctcaacctcatcgtcaacgcggcgcaggccatgggcaccacgggacgtcccgggcgcatcgaggtccggtggacaacgactcccgacgacgtggtgctcacggtggcggacaacggctgcggcattcccatggagcagcaggagcgcgtcttccagcccatgttcaccaccaagcccgtgggcgtgggaaccggactgggcctgtccatctgccgggagctcgtcacgcagttcggcggcagcctccggttgtcctccacgcaaggggagggcacggaaatcgaaatcaccctccggcgagccccgcccccctgagtccgaaggcgttgctgagcatgcgccacacgcggtgcagcgtctgcgtctcggaggcgcggatgtcctccaccagcaccgcgcggcgcagcgggccttccgcattctctggcgcgtactccaccaccagcgcgtaacggggaccggggcgctccaccatatggacggcccgcaccgcgtcgaagggcaccaccgccgcgcgggtagcgcccggtgaccaggccagttgctccaaccgcaaggactcggtgcggaagtgcaggacgaagcgccggcggcccagtcgggactccaacttgagggacagacccaccagggccgccgcgagcaggcccagggcgaaggccgccgtcgtgccttcccggacgcccaccaggacggcggcgcccaccgcgcaccccagtcctacgccgacgagcagtcctggcagggcacgccgctcccagggcggcgatagggattcgcccaccagccggccgccgtcataacgcagccgcacgtcgcccagccgcccgggtacccggttgtcctgcaatgcgtcttgaaagctcgccacagcttcagcatagcgggcctcaaatgcgggcttcgtagttggaagtgagctgtgcgaatctccgcggccatggagttcccgttcgaaaccggtgagggtgaaggaggggaaggggggacgctcgcctcgacggtgctggtggtggatgacgagcccgtcgtgctggacatctgtgcccgccttctggagcgagatgccgacctggtggtgacgctggccgcaagcgcggaggatgccctcccgctgctggccgagcagcgcttcgacgtcctcgtgacggacaagaacctgcccggcatgggcggcgtggagctcatcgccgaggcgcgccgtctccagccgtccctggaagcggtgatgattaccggctacgccagctccgaaagcgtcgtcgccgccttcgccgcgggcgccagtgactacatcctcaagccttttgacgacctgcgggtgctgcgcgccaaggtgcgcgccgccctggagcgccggacggcgggcctgctcgtgcgggagcaggcccgggaggtggcccgcgaggccgcggctctcctggcctccggtcaggacgcgccggagcgcgcctacgaagccctggaggcggagctgcgcgcctacgaggaagcggtgcgcctgggcctcaatggccgcgtggccgtcgtgggcagcgcgagtaccgtcaccgttcttcaggacgctggcttcgaggcggtggagctgccgccctatgcccccgaactggagcgcgtggacgtcgtcatcgtggagacgggcgacccccagtggcgcacgctggccgagcgccttcagcgcagaccgcccgacgtgctgctgctcgccagtccccaggcagacctgggtgatttgctggaggcgattacgctgcgaatggacctggtgggcttcggcaccagccagggcgccgtcgcgctgccggagaaggtgcgcatgttgttgctgcgccggggcgtgcagcgggcgcaagatcggctcgccgcggcgctcgccgccttccggcagagcatcgccgcgccgttgccctgaagtaccccgtcgaagcgtgagcaggaacgcgcgggccccgcctcgagagaggcgccgggccccgccggagggccgtctcgcgccaccaacacctggcccgcaaagcgaaacgcccaccttcttttcagaaggtgggcgtctcagtgtgaccctgccgggattcgaacccgagtttgagccgtgagagggctccgtcctaaccgctagacgacagggccgatacttgtttcaaccgccgctaactgcccgcgatttctaccttttttcgtctgccctcgtcaacccttttgtttcgtcctgctcaggttgcttcggaccaacgagcactgcaactgcgggactacaagctggggaactaggattcgaacctagataagcagagtcagagtctgctgtcctgccgttagacgattccccaaggacctgctcgaccgcggcgcttctctaccaataccacttcgggactgcaacaacttcggtgcgacgtttacttcttcctgctcttcgtcgtctccggcttcttggcgggcttggctgcctgctgggtcgggacgatgtagatgcgaacttcgtcgttcgcctcgtaaatgttcagccccgcgaagttcttccccgaggggttgctgatgtgaaccgccttgacgcccggctggttcacgatctgccggcgagggtaaccgctcgtcgagtagaccgcgcggtagtactccagcgtgccatcgaaatccctgggtgaccggtagcgattctcaccgacccgcttggacccatccggcaactgcgcgccattgatgacttcggcgcccgctgaaaccgcccagagcgccaccagcgccgctccgagcgggcgcgccttatagaaaccacgtttcaggctgtcaagggcacgcatcatgggtccgaaagataggggcctgcgctgctgacgtccaccgctacctgcgcctgatggctcaaccgcgcgtcagcgccgcgtcgatgcgcagcagggattcgtcgcggcctaccagcaccagcgtctcgccgatgcccgggctggtggtgttgccagtgagtgccacgcggatgggctgcgccaccttgcccatgccgacgctggaggcctcgctcacctgcttcaccacgccgtccagcgcctccaccgaccactccggcagcgcggtgagcgtctcgcgcaccttgcgcagcaggttgagggactctccggagaggtgcttggtggcggccttctcgtccagggtgatgccggagcggaagtagacgttggccgcggtggtggcgatgtcttccagggtgttggagcgctcgcgcagcgtgcgcaccagcgtctccagccgcgggtcgcccttcgcctggatgcccttcgcctccaggaaggggagcagccgctccaccacggtctccaccggcaactgcttcatccactgctggttgagccacagcagcttctccgggttccacacgccggaggtggtgcccacgtcgctgaagtcgaaccactcgagcatctgttcgcggctgatgacctcgtcgttgccgtggctccagcccaggcggatgacgaagttgagcagcgcctccggcatgacgccgttgcgcttgtgcaccatcacgtccgcttccgggtgcttgcgcttggacagcttctcgcggtccgggcccaggatgagcggcaggtgggcgaagtcgggaggcgtccaccccagcgcctggtacagcatgagctgcgggaaggtggagttgacgtgctcctggccgcgcgcgaccagggtgatgtccatcaggtggtcatcaatgacacacccgaagttgtacacggggatgccgtccgcccgcatcatgacccagtcatccaggtcgctgtgcgtcttggtgatggtgcccagcgccttgtcggtgaaggacacggaaccgtcacccgcgggcatcttgaagcggatgacggcgtccgcggcgttgcggccggcggggggctcggtccgctcgcggcaggtgcccgggtacttgaacgcgccgcccgccttctccgccacctgccgctgcgcgtcgaggtcctccttcgtgcagtagcaccggtaggccttgccctcggcgatgagctggtcggcgtgcttgcgataggtgtccagccgctgcatctggaagtagggggcgtaggggccttccttaccggggccctcatcccagtcgatgcccagccagttcagcccgtccaggatggcctgcaccgactccggggtggagcggccctggtccgtgtcctccatgcgaaggacgaaggtgccgccctggcgccgcgcctggagaaagttcatcagcgccgtacgggcaccgccaatgtgaaggtagccggtaggcgagggagcgaagcggacgcgaagggcaggaggcatacgggcgcgcggattagcagggcgaggatggagggtcaacgcggaggggcattcctggagtaagttggatggccagggagaactcgtatgtcgattcgtcaggtagttcgcacgttgctcctggctgtcctcctggtgggcgtgcccgcgaccgccaccacccagctccgcgtggacctgtccgggctcgcggtaggcgcggacaccgtggtccacggtgtcgtccggcgcgtggagagccgctggagcggcgacaagatgcgcatcctcaccgacgtcgaaatccaggtgacggagtcgctcaagggccagcctgggagcacggtgctcgtcacccagcccgggggccgcatgggggacattggccaggtggtgcacggcctggcgtccttcacgccgggcgaggaggtggtggtcttcctgcagaagcgcggcccccgtgccttccgcgtctccgacatggcgcaggggaagttccaggtgaagcgtgagggaaagacggcgctggccgtcccggagcccaccgagtcgcaactgttggaccccgtcacccgaaagccggccgcgtccgcgctccagtccatgacgctggtggagctgaaggccgccatccgtgaagcccttggggagcagacgccgtgatgccgctcgcgcccctgatgctggccctgaccctgggccaggtggacccctacgtccgcagccgtgtcgatgcgggtgacacgcgcacgcagtgcctctactggacgtccaatcgcgtcgtctggaaccagagcacctacggcaacccggacacggcgggcgactccgagttcgacgcgattcgcgcctccttccagagctggcaggacattttcgccgagtgcggcaacctcacgttggtggaaggcccgcgcgtggacgaacgcgaggtgggctaccggcgccagggaaccaataccaacctggtgctgttccggacccgggactgcaactccgtagtgcccgcgaccgatgcgtgctgggccgacgacacgtgtgccaacacacatgactgctgggatgacgacgacaacaccatcgccatcaccctcaccacgtacgacgagcgctcgggcatcatctacgactcggacatctccttcaacgcggcgcgcttctccttcacgacggcgaacggcggcacatgcttcccgccggtgacgacccactgcgtggccaccgacgtgcagaacaccgccacgcacgaggtcggccacctcatcggtctggaccacacgcgcgccaccggctccaccatgaaccccagcgcgccgccgggagaggtgtccaagcgcgtggtggactcgggctcgcgcggctttgtctgtgacgcctacccccaggggcaggccagccagtcgtgcctccacccggtgacgtccatcgaactggggcccaaggctggaggctgctccgcggcggggccgggtggagcgctgtcgctggtggccgtctggtcgctgtggctggcgcgccgccgccgtcgcgaggaggcggtccggtgaggaaggcgctggcgctcgcggccgcgtgcctggccacctccgctcacgcgcagatggaggaggagccgtcctaccgccgcaccgtggtgcccaggcacccgctgtgcctggtgtggccggtgcgtgagtatgtctaccacctagatgcggcgggcagcgcgcgcacgcctggagactccgaggtggcggccatcgaggcgtccttcgactcgtggcggaacatctccgacgggtgcagcgactaccggttcacccggggcgaggactggcgagcgcccatcgccgtgggctacgacgagacgcgtccccgggacaactacaacatcatcacgttccgggagacgtcgtgccacgaggttgccccggcggatgatgcgtgctggaccgaagagacgtgcggcaacgtctaccagtgctgggagcatccgcctgggaccatcggcctcaccacgtccacgttctcctatcgggacgggcgggtgttggactcggacatcgagctgaacgcgtcccagccggcacggggctacggcttcctcttcaccacggtggactcaccggtgtgtgaaggcgagccctcggtggactgcgtggccacggacatccagaacaccatgacgcatgagattggccacgtggtgggcctggaccatgtcttcgtcccgggcgccacgat

SEQ ID NO: 1131 - DNA, 15572 bp, Myxococcus xanthus
cccccaccgggccccaggacgtgatggtccagtgcgcccagaaggccgaggccctgcaggcgcccctgaagcggggcgacgtggagctccggttccaggagggccagtggaaggcctacgacgcggcgaaggcccacctctccaaggggcgcaagagcgaggcgctcgcgcagctcaacgattgcatcgcggaggggcgcatcctcgagaaccggtaccccgacttcaaggagcagaagttcgacatcggcggcaccagcatgagcatgttggagctgctccaggcctgcgcgaaggagcgcaaggcgctgcagccttccccttgagccttcctgcttcgccccgaagcccgtcgcgtcccagaggattggagcgccggggcgggcggagtggtgggcccgaacctcgaggtcgcgcggtccccttgagagggacaccgcgcggcacagactggacggagcttttccaggatgatcctccgcaacgtcacggatgaagaccttcccatcttcttcgaacaccagcgcgacccagaagcgcagcgcatggccgcatttgcatcgcgggaacgcgatgcgttcatgacccactggcgcacaaacgttctccgccctgagaacgtcacccgcaccatcgtgatgggcggtgtggtcgttgggcacatcggcagttgggaacaggatgccatgcgcctcgtcggctactggatgggtcgcgagcattggggcaagggcatcgccactcgggccctctccgagtttctcgtgctcgagcccacccggccacttcatgcgtgggtcgctctcaacaacctcgcgtcgatccgcgtcctcgagaagtgtggcttccacaccctgcgcaacgagaacccgcatcacccggatggcgttgccgaagtcctgatgaggctgggttcgacgtagtgcgtgtggctcgggcttcgatgacctcgggcccagattccggcgcttcatcatgctcgccaagagggcggcactgacggtgggctggacctttcgttcagctcagtgatcgaatcatgggcaggtgcaggggtgggcgaccaaccgaacatggagctgcgatagagaggggcggagcatgcaggtactcggaagcaaggcgcagggagcccggctcgaacgcatgaaggcgtcaccgcgcttcaaggacgggatgttccacaacacatccctggtgactcaggggctgaagaagggcaccgctgtctcgacgatgaaggagttcatctgtggcggtcagcggcgggtgccgactggcgtgctgcccatcgtcaatccgctcgagcagtggctgctcccggtgcagggcgggctccgcgcgacgtggctcggtcattccaccgtcctgcttgaggtcgatgggaagcgcgtgttgactgaccccgtgtggggagagcgcatctccccacttcccttcacggggccgaagcggtttcaccccgcgccggtgacaatcggtcagcttcctccgctccacgcggtcgtcatctcgcacgaccactacgatcacctcgactacccgaccatccttcaactcatcccgctcggggttccgttcgtcacctcactcggggtgggtgcgcatctggaggcgtggggcgtgcctcccgagcgcatcaccgagctcgactggtgggagtctgcggaggtcggtggccttaccttcaccgccgcaccatcacagcacttctcgggtcgcagcgtggccgataggaaccggacggcgtggtcgtcgattgtggtgcgcggtccgcatcacgccgtcttcttcagcggcgacacgggcctgacccaggagtacgtcgagatccggcagaggctgggaccgttcgacctcatcatgctcgaggtcggcgcgtgggacccggcgtggggagatattcacctcggaccggagaatgcgttgcaagcgcacgacctgttgggcggtggcgccttcttgccggtccattggggcacgttcaatctcgcaatccattcctgggacgaacctgcggagacgctcgtgaagctcgccccaacgaatgcgccgctgatcatgcctcggctcgggcagccgatcgagccgctccaggtgcagtcgatcgacccatggtggcgcgaggtcgatcaaaccgagacggaaccggcgccggcggaggcggtgacggaaccctccgactgacgaatcagcgcgaagcgcgcgacagcacgactggccggtgtcgaaggatgcggcatccgaacagagccagagcgccgcggccgcggcctcggcctcggcctcggtggccctaccgatgcgccccatccgaatgcgggctcatcgcctccagattcggagaacagcgcgatgagctgctccacgattcgggcgaactctggcgcgcaatgcggggtgagcagatcacggcctactgtgccagtgactcacggcggcggaagacggagatgtccgtcggagcgtccttcacccaatcgtagtcaggcgactgacgcagcagttcgatgagctgccggtcgccaatcttccagccccccgcatccgcgaacgagcactccttctgcacatagcagtggttcacgttgacgaagatgagcttgggacgccgagccaggacgtattccgggtccatcttcacgtcgattccgcgctgaagcgacggaaggtgcgcgatgtgtgtgtcgttgagcccgagcatgtcgagggtgggccgccccgtcgcatagggcacgcgccccgcccaggggactgcaatgacatccgtgggctgcgtgtgctcgaggatccacgccgggaggggaccgtggggttcgtcggtgaattgagccagcttggtcttgagcaagccttgtcgggagtcaccaccggccgggaccgaggccttgagcaactgcagcccgtcctccgcccaggccagggagatcaacgcggcgacgccgaccgcgcacgcgcgcggcgagagcttcgtccaatggcggctcgcgcccgccaccaacatcaccgtcgccatccaaagcagagggagcacggggagaaccaaccgcaccgacggaaaggcggagcggtcatcgcctcccacccagacgatgtagagcacgtagacaaggcaggccccgccaagatgaagcgccagttgcaggctccgccgggcggaggggtcttcctcccgcgtcggcgttgccacccaggcgagcgcgcccaacgagacgggcgcggcgagatacggcgcccacgcgagcacgaggtagtagacgcccagcggaaggttcaggagccgattgccggagtgcttcgcgtagtacgtgtttgggaagagccacccgtagtgctgcagccgccacatgaagtacgtgagccagattgcgaagaagggcgcgacgaagaacaggagcgttcgacgtgaaatccttccgtcctcagcgctccgtcgaagagaaagccccgacgcggcgatgagtccaaagagcatgaccccttcgggccgggtgatggcggcgagaccgaagagcgtggaggaggccatcagccacagggggcgcgggttgccagcgaactcgcgcagggcgaggcccgtgctcgcgaacgcgagggccgtgaagaacacggtctccatccctgtctgcgtgtagtaggcgagcggcgtacacaacgcgacgagcgtcgcgaggaccgcacgccagggcctctcttgaatcggatgagcgccactcagcgtgagcacgatgatggcgccggcagccgcgatggagagcagcttcgaagccaggagtggcgacccaccgagtgcgatggggatggcattgaggacaacccacaagaacgatgtgtagccctcgactggcggctgctcaccgacgttccaggcaatcccatgcccaccggcgagatgcttcgcatagcggtaggtgatgaaggagtcgtccaggccgccgcccgtcaagagcaggcaagcgagcaggaagatcgccatcaacgccacacctaggagcacggtaccggcccaggcgaggcggtgctccgaggaggagccgggcacacgtcgagagtcgagctccacgcagttgaatcccgtctggaaacaagctgaggcgcgaagcgccacttcctaccaaccgtaccacgtcggatcacagccatgagcttgggagcggtgcgcttcggctgagccctcgatgacaggcgagctcaccgacccggcgtgaaacaaagcgatgggcacacggccgccctcccctgccctactccttcgcgaacaccgccacctggcgctcggcgccggagaacggcaaccggtacgcccgcgaggacacgacgcgcagttgccgctccgctgcgcgcgccgccgccttgatgaacgcgaccttcttccccaccgtgtccaccaacgtgacgcccagcgactggcatctcagtcacccgtgaaggcgcgcgcgagcgccgtgcctactcgtagcgtgggtcgtcggacacgctgcgcatggactgccgcacgacaatgcagccggcggcgccgcagccctgatgccggttgccgccccccgggggcggccgttcggtttccggccgctccgggccccatgtcgcgtcgcacatgcatcccgttttggatatgctgagaactccggccgactctccaggaatcattggatgaccaccacccgtcgtgacctgctcaagttcggtgcgctcgctgctgcctccgccgccctgccgggttgggccaagccgtccaagcccatcaaacgcgcggcgaaaccgctgaacatcctgatcctcggcggcaccggtttcaccggaccgttccaggtcaactacgcactggcgcgcgggcacaaggtgacgctgttcaaccgcggcaagcgcccgtcaccggaatggccgagcgcggtcgagcagctgttcggagaccgcaataccggcgacctcaagtcgctgcaaggtcgcaagtgggatgtgtgcatcgacaaccccaccagcctgccgttctgggtgcgcgatgccggcaaggtgctcaagggcaacgtcgggcattacctcttcatctcgacgatttccgtctatgccgacggcagcaagcagggcatcaccgaggacgcgccgctggcggtgtatgagggcaaggacgcgatggccgaaacgcaggactcactgagagcggacatcgagcacctgtacggcccgctcaaggcgttgagcgaggccgaagcgcacaagcagttcggcaagcgcgtcaccatcgtccggcctggctacatcgtcggcccgcgcgacgaaaccgatcgcttcacttactggccgcaccgcgtggcgcagggcggcgagatgctcgtgcccggcgatggctccgacccgatgcagatcatcgacggccgcgacctgggcgagtggatgatccgccttgctgaaacgggcacgcttggcacgttcaacgctgttggcccggcgaaaccgctgagcaccacggccatgctgaaaggctgcgagcgggtcaccggcaagaagccgacgtacacgcatgtgtcgccggaattccttgaggagaagaaggtcgagctgccgatctgggtgtcgtcaaagagcgggccctatgcgggctacggggcggtcagcaatacccgggcgatggcggccgggctcacttaccgccccttcgacaccacggtgaccgatctgcttgcgtggttccgcagccagccggccgagcgccaggcgacgctgcgtgccggcattacgcgggagcaggaagcggcgctgctgaaggagtggcacgccaagctctgaagcacggggtggtggcgcatgcgcatagagggatgggggccccccaatgagcaaggcccccgtcacggacggtcggacgctctgctcaccgcgagggcctggccccgggcaatgcgcctaccttcgaagtggatgatgtgtcggcggaggctcctctgcgacgggtcattctgactccaaggagggttgagctcaccccacacggtcaggtagacgacagatccccctttgattcggaggaaccttgttcaagtcgatgatcctggcggttgcggtgttggggctgacggcatgtggcagcgatgactcggagcagagcgccgagtgcaagaagtacctggcctgcatcaaggccacgacccccgagtttcaggccaccgccgaagtgacctacggcgccgacggttcctgctggaactccgacgagacggccagggtctgcactgccgcgtgcaccgacggcctgacgcagctccggggccaccaccccgacgagtccgcctgcaagtaggacggagccctgtaagggcacactggccgcgcacacgttgcgcggccaggtgcaggacttcagcccagcagcgtgaacgtctcgcgggcaatcaccatccgctgcacctcgctggtgcccaagtagaacgcataagagggatgggggccctgttgagggggagggagggtgcagaggggccgaggaaggccgctgacggggcccacctcgcacatcccgtgggcatgcccaggtgctcctgaattgcccgcactccgagggctcccttcacgtacgccaagtcccttgagccagcctccactcatcacccaggcgtacacgtcgaagtcgaacttcctcctgagcgactctgcgaaagtccactcgcggtatcctctccttcagccgctccttcctggccgctgcctcaagccccgcgctcgcctcctgcgctcctgcttgagggagcgcatctccaccacagcgacgccgccatgtcgctgaagatgctctccgagcgcgtggccgaggtggttcgctcctaccgcgtctgagccacacgccggtccggaccagcgagaagcccgctggcgattcgcgtcgcggaggctccgtcaaggcgcgagctgctcgacggagggcgcgtgcgagatgcggatggcggggttgtccacgacatcgtcgttcttcacgcgggtgcccaccatgacctgatacggcggttcgtccatgacgggagcgcggccgtagacgatgaagtagcgtccgctcgcatacgcgacgttcccgaagaggagttgccggttcgcagggcccttggagatggcgaagccgttgcggtcacggacgtccccattacgcttcacccgtgcagcgcgaacacgggcggtgtccgccgtcagggcgctccaggagacgagcacctcgtcaccctcggaggcaaccctgggcgataactccgtcgtgctcgcggtggagatgcggatgcccaaggggtccaggacgttcgcagacccgcgcttcaagcgggtgccgtagatgtctgccgagcctgagcgtgagtcgctccacgcaacgaagaagccatacttcgtcgctgtcacggactggtagttctggttgcccggcgcggcggagatgatgaagccatttgggtcgagcaccgaaccattggcgcggaccctggcggcgaaaatgtcatggctgccgtatcgcgtatccgtccatgcgaccaggtactgatcctctgaccatgccacggagatgccagaggagaactcagtgctctgggagcgggagatgaccacttcctggacatccaagcctcgtttgcccatgtcgagggtgactccgcgaacctcacgggacaccgtgtgtccagaagcaatccaagccaccaggcacttgcgtttgtggcaggcaatgccgggggagcccacggcattgtggtccgtgggtgtgaagagggtgataggatctccgtcgagcgtgccatcccggttgactcgggtaaggaagacggctctctccccggtccagatgaccaggaactgccgtccatcgaatgcggtggcgtgatagtaggcgtccgggcggaggttgggattgagttcgatggcgtcgggatccagcaaccggccgttcacggacacgcgcgcggcaacgagcttgcctgcacgactccagtccgaccaggcgacgaagaactgattcccgtcctcggccacctgagcgttgttcgcgaaggtgggtgtcgaccagttcgggagaggcccttgccccccattgccgtgaagcccgagctcgaggtccccctgcaagctcgggtcttcaaaggcggcttccggttcaccgccacacgagatggccaggaacgctccgagcagtgctcctcgccaagtccgtaggctcattgtctgcccttgcatgcttcgttcccttcaatcgcaatacagcgacaggttccgtggctcgggattgaagggcaacaccatgtggaccacgacgaacgcgagtggacatctgcgaaagacgtcaacgttcttgcgttgcatcttgaacgaatgaaagggactcacgccgcatggccagccgcgatccatggctcgcccatgtcgccacgaatcatcaaatacagccatctcaataaaagacagcggcgacggaatggcgactctgagagcaattacatctacgtaggaaccaccattgacgaacagcgtgtccctggtgcgacgtccatcccctgtcttcattgcagaactgtcaaacgaggagaaggtaatgaagcgaagcagaggcgtttccctgccacgcatgggatgggttgtcttggctgccccgatgatgtgggcatgcgggcccgaggcacaggcacccgcggcgcaggaggtgtcgcaacaggatgtgccgcgggacgtggtgagctgggaggagtatcagcggaacgcggcgcgtgtggtggatggaaaggagctgtacatcgtcgagtgggacctggcgctgacgcgcgacgaactccgtgacaggtacgaccgctatgtggccgccgcatccaccgggcaggacggctcggagtcgcttggccgcacggagtctccccttcgcgtcaaccgcgtcgggagctcggacgacatctggacttgggcgaaccggtacaacctgcgctactgcgtcagtaatgccttcggtacgaacaagacgcgaatcgtgaatgagatggcgaacgcggcggcgagctgggagtacgtcgcggacgtcgacttcatctatgacagcacccaggacgcgagctgcaccaatgcgaaccccgcggtgacgttcgcggtgcagccgtggacggccggtggtgcgtgtgccttctttccctcgggaggtggctgtatcccgcgcacggtggtcatcgacattcccagcctggacccggcgccccccacctcgccgaatgtcacgacgggaaccgtgctcatccacgaactggggcacgtgctgggcttccgccacgagcactcggcttcgtcgctgaacccctgttatgaagactcgaactggagggagctcaccacctacgacgtcgcttcgacgatgcactatccctggtgcaacggcgtttcgacgtccacgctcaacctcacgtacctggatgccgcgggggccgccgccctttatggctggcataccaatgcaaacaatggggaccgccgctacccggcggcgcacaccaatgactatactgcggcgcttcagatgggacagtcgttcctcattcccttcgcggtgaccacgaacttcgcggaggggtgcttcctggtgggcaacggcccgaccgccgctcacatccgctacagtgatggcatggcaggcgctgtgctcgcgtccgcgacgagcgtcgtcgacacgggggttcagtgtggcgtcaacgcctcgtacacctggcaccgcgccaacttcccgggcgtagcgatgttcgcgaatagcgtgttcacggtggtcttcggcaatggcacgcagacgctccgcatggccatcaacattggaaatccatacaccagtggaaacatgtgggactcatttggcggcgggcgcagcctgtctccttgggatgggcgggtccggatggggcgcctgggccctccgtgagctgaatgaacggcggggccgaggtccatggccccccggtggagcggggagggcgctccggccttcctcgcgcctcaggtgtgtcaccgcccgagtgatgctcccgtccgatggacaggccgcgcagcccctcctgagcggcgcggccaccgcgctaccgcgctaccgcctgggggggccggcttcgacacgcgactcgcgaagatcgtcggcacgattctccccgggctgcccgcgcaggacctggacagccagatgttcctgcacgacggcccggagaaggagcggttcctcgcggatccgctcatcacccacgagagctgcccgcgcgctccgccaaggcgctcatcgccgccatcgaagcgctcgaggggaggctccaggacctgagactccccctgctggtggtgcacgggggcgaggacgtcatcacctccatcgaaggcagccgcgccctgctggcgcagtccacgatcgccgacaagcgcctcatcatctacgagggccagcgccacgatctcgcgcacgaacccgacgcggagaaggtcattggagacatcgtggcctgggtggaggcccacgtcccgccgagcgccgccccccgacaatgggagcggtcgcgggacacaagtctccccctgaaaccgcccaaccacagcgcatcatcagtaccgcgagcggctgttgatgatgacctgcgtattgatccaagaacggaactcagagacccgggcatagacaccaggcaagcccggcctcgcacagcccacgccgaagctcgtgattccgtagagcacgtatccgccaccggccagagcgaccaacggccctccgctgtccccctggcagctatccttcccccctgacatgtacccagccccgagcatcacgtagggatcgatggtgatgcctgctttcttgtacgcagtcttcagggtctcagagttcacggtgggaacccacacctgcatcaagatggaggatgtatcgtatcccccctccctggtatgaccccatcctgcggtcaccatcatcgtgccatccgggacatccgcacccaccgacgagagccccacagggttgagcgacgtttcagccaacggggactgcgcgaccaggttgggacgcatgacaacactgctcttgccgcacgaagtaccgctcaccgagaacgaatcccccgggagacacacaggctgtaccgtggaggtgaacttgatgggcttgtcgagcacgacaaccgcgacatcgttcgccgtcgtatccgggttgtacgctggatggtagacagtctttctcgcggcgacaacctgctgcgaggacgacgggcgattgaaatcatgagccccagcgacgacagtcaatccggatgttccgtcgtagacgcaatgggcagccgtgaccacgatatcgctctcctccttgttgccaaccctgatgagagaaccaccgcagaagtgattgttgtattgctgcaggctgacaatccacggatgactcccaggacgtgcctcgacccctcccacaatcgcctggtccatgcggcccgtcgcttcgacgtcctgcctctccagctccggaccaccacatcccaacaggctgaccgcgacaatcactccactcacgaagcgcaatgcgccctccttgctcagacgacacatgccaacagcaagccacatgccaagcctcaactaaaggaatcccgagcgcattcgactcacggcgcgccgttgacacgtcagcgagctctcgcagagacgggatgacgcgtcagccgtccattcgtcgtgctgcgcgggccgaagagccagcaggtcagcaagagcaacccgtcaaggttgcgggcggcgtcgcgaacgttgacttccgcgacgtactgtcctgggttgtccagagccccaccgagggccggtcgacagtgaaaagacccgccaactacaagcatctgtctcccccaattttcggaccagttgaagcgtgagagagtcctcgcggcctggggtggccctcgtgccggggccaacacctcgcacatcccgtgggcaagcccaggtgctcctgaattacccgcacccaggggccccttcacgtacgccaagccccttgagcctgcctccacacctcacgcaggcgaacacggcagcggacggggcctctcgccgagccctgcgctgtcctgcttccgatggggcaacgcagcacggaggcggaaaacggctcagcgcccgagcagcgcaactcagttgcctgagcccccgactcaccggccaggaacttcgggcttctccggtgcagcgctctcaccaagtggatggtcgcggaagccctgctggagtgactgaatggctcgaacctcggcgcgctgttcttcgaccgtccgcggcctcgtggatgcgccacgcgagtccattcagatggacacggcttcggcccgcttccctcacccgccccctctcccagagggagaggggattcagccgacgaggtccgccttcgcgaggttacgtgctgcgcgcctggtggtgagtacgcccagcagcgcgggccaccccacggcgatgaccagcgccagggtgggtcccagggagttggccagccagaagcccacgggccccaccgcggcgagccccggctcgggctcgagcagcaccgatgagcgcggccacccgggcgagcagcaggccccagaaccactgcgcgcggcgcaccggctgcgtcagcatcagctcgaagaagccgctggtcttcgcgcgcacgatggccgagtgcgtgccgaccttcgagcacagcgactccaccagctccagcctcacgagcacccaggcaccaggaggaacatgtgcttgggcaccgcgcctcgcgagcagaccgtgaggcgcggctgctcccgaggcccgcgcgacgcggaaaaaggcacaccctcgtcactcgcacctgcaaagctccctccatggaacgcttcgtcgaggtcgccgagggagtctctctctgggtcgagtcacatgggcccgaggatgctcccgccatcctgctcatcatgggctccaccgtctcgggactcgtctggcccgacgagctcgtggaggccctggcacgacgccaccgcgtcatccgctatgaccaccgggacaccggcgcgtccacatgggcgttcgataccgtcccctactccgcgacccggatggccgaggacgcactcgccatcctcgatgcgctcggggtccagcgcgcacacgtcgtgggcctgtcactcggaggcgtcctggtgcagtggctcctggtcgcccaccccgagcggctgctcagcgcgaccgtcatcggagcgcccgccctcgacggggcgcccgccctcgacggaatgacagcacgcgtccccatcgaccccggcctgttcgagttctggcgccacatgttcgaaccccgggagcgcgaggcccagatcgagtggcgggtcgagaactggcgaaggctccacggcgcggtgctccccttcgacgccgaggagttccgcgccctggagcggcgcatcatcggccacgccggccgacacgacacctccaccgcccacgcgcgagccgacccctccggcctcgcacgcggagccgaactggcccacgtcaccatccccacgctcgtcatcgccacgccggaggacccgaccaaccccgagtccaacgcgcgcttcctcgctcggacgctgccgcgctccaccctggtgaccatcgacggcatggggcactcggtcccgcgcgccgtcgtgccctcgctcgcgaaggcgctgctgggccacatcgagacaatggcgcctcgctgacccaggagcgccgcgcgccctaccccttccgcagccccaccacctcgccgtacccaccggggatgaagaagtggtgcgtctccatgcccatgatgcgaagggccgtggtgacgacgcccgcggaccgcgggacgcgcttctgcgtctgtcccgtctcctcgatgatgtccaccgggacgccgaggccgcgcgtcgtgtacgtgcccacctgccggttcgccgccacgttgccaccggcgaacatcaccgaggtgtacgggtggtggtcatccggcaggttgtaggtgccgttgctcgagcgcgaggcccagctccggccgaactcgctcatcaccagcaccagcgtgtcatccagcagcgtcttgcccggcttgcccggcgccggcgaggccttcatctcgcccaggaagcgcgcgacacagtccatcccccccggccgtgcgcgcaactgaaggcatggcccccgccgttgtgcgtgtcgaagtccatccgcagcgagacatgcaccgacgtgcacaggtccgacttgagtagtcgcagcgccatgtccatccgcgggtccaaccccacgaggcggaagttcgcgttgccgaacgtgtaagtgaaggcctcgctcaggtagatcgacaggtacgcgggccggttcgacctcagcgcgtcgatgcccttggccttctccaacacggacgcgacatccgtcgcccgcacgcgggagaccgacgacagcgagccgtgcaggccctccaggtagttgtctaccttcgccgtcgagcggcccagcatcggctgcgcctgccccaacgagtaacgctccaccgtcgtcgtcttcagggtggcgcccgtgggccgtcccttcgcatccagctggtcccctggtcgatgccgtgcagcacgctcagctgcgcgtgcagcgagaagtgctgagagccatacatcagcggactacgcataatagggatgggggccctgttgagtggggagggagggtgcagaggggccgaggaggaccgctgacggggccgcccgagtgatgctcctgtccagtggacaggccgcttgagccccttggggtacacgccagcccagaccgcgctcccttcaggtgcgtggcaggagcctggacttcttggcgcctcttgagcctcaaccccccgcggcctggggtggccctcgtgccggggcccacctcgcacatcccgtgggcatgcccaggtgctccagaattgcccgcaccccgggggcccccttcacgtacgccaagacccttaagcctgcctccactcctcacgcagacgaacgtatgtggccatggaggtctcacgagaagctgattcctatcgcgtcggggcacggctaagacttacccggaacacgcacacgtctggattggcgtggacacggaagcatctggcgcccgcgaggaagccccacgccgggtggaagtgtagacacgctgcgactgtcctggaccgctgacccgtgtctgctcacggcgccagggatactccgttccactcgaggttctccatgcgttcattgcgccgtctcactgccctgctgctcctgccgctcgcctttggctgtggtcaggaaggtctccccgaaaacgaagccgagtcgctctccgcgcgagctgacccgttcaccatcatccgggagacggtccagaatgcgtgcggcaacgcaggcaccactccgcaggtcttcagcaatacgctgatgagccccgcggccctcaatgtcggcggcggagcacccacgaattggaatcccgagagtggccgcatgagccgcggtggcatggaatacgtgtccccaaatggccacggtctttagaccaca

SEQ ID NO: 1132 - DNA, 13226 bp, Myxococcus xanthus
tctaagccttcggacagggagaggccagcggcagcccagcggaggacgcccctccaggctcgcactggggagtcagtcgcgcagcttccaccggtcgaagaacccacggcgtcgggattgccgcccacgcagggccgcgaaacgggcggcgaacccggccaggtcgtcatcacgcgcggccagtgcccgcaggtcctcggcgagcttcaccgcctcgtcgtattcgctggcagcgacccggtcctcgagccgaacccaggccccgtccacgtcccgcgacagggccgtcaaccgccgctggaggcgcctcatcgcggcggcggtggccgcgctggcgcgggcggactcggctcgctcccgtgcggctcgctgggccaccatgagcgcttggagttcgtggacggtccgcgcgggccgatggcttgctggcgcgtgctccgcgcggaaggcacggagcaactcggagcccagcgggcgctccggcgcgtccaccgcgcggaggagccagcgcatctggtcctttggggcgaggtcacgaacccaggcccggaaggcgcggctgtcatcctcgtgcttcttctctccgtgcgccgccgccgcgagcaggtcctcgtcgatccggagccacgccaccagcgcctgctgagcggcggacagcgtgcccagtccctcgggaacacagggctccttcgcggatgacgccaccccgcccgcctgaacggcgcccagccacgcgagataggccccgcgcaggtctccgcgctggagttcggtccggagcggaaccagcgccgcgagcgaggcgggcggagattcctcgtccgggggctcctcatccctcacctggaagtcgagcaacacggaggtcccagacaccgtgagcgttgatggacctcgtgccggaaagcaggccttgagcgccttcatgtcgagcccctcacgcggcaggcgcagcatcagccaacggtcgccccagttcgaatggtacaggtgcgcatcgaagtagcgcaggaggagctgggctgggtccgccatcaagccaccccggtggtattcgttccagaaccgggtcggtgtgatttcggcccgcgtcgatatggcccggagttcgaccagctgctttgccgtcaagggccggtccagcgccacgaactcgtagacctgatgttcgctcatggaggccctgtacggcgagcgcgaccttgctggaaagcaggatggcctcgcagcttccagatgtgagcaacgccttccggcatcacggcgagcgggccacgtctggcaacaccagaatggcggaaccgactagtgcgcaacgccttccggcatcacggcgagcgggaccgcgtaccaagcgctccgcgtcacggataccagccttgtgctcaacgccttgcggcatcacggcgagcggcacgcccgacgtcgtccgcgtgaagggcgaccactggaccacatgctcaacgccttccggcatcacggcgagcggcacaaatggcagacgacaagaagaaggacggagaagcgtgctcaacgccttccggcatcacggcgagcggcactggtgggttggcgccgtctcgcgtcgagtgcgaggtgctcaacgccttccggcatcacggcgagcggcactcttggatgactgcattcgcagcgcgcgtaataggtgctcaacgccttccggcatcacggcgagcggcactatgttcaataaatatgacccgttccatgggttcgggtgctcaacgccttccggcatcacggcgagcggcacgaaatcgacggcgatatgttgaaacaccccgtgtgtttgtgctcaacgccttccggcatcacggcgagcggcaccaacggcggcaagctgctggccaccgtgcttgcaggtgctcaacgccttccggcatcacggcgagcggcacgaagccttacggcctaacaggcaatcttcaaacgtgctcaacgccttccggcatcacggcgagcggcacggagaacggcaatggcgggtggtactccggctacgagtgctcaacgccttccggcatcacggcgagcggcactcctgcgcggctttcgccgcacggccgccatggtgagtgctcaacgccttccggcatcacggcgagcggcacctgcgtaccgcggcatctccatcttcgtgaatgactagtgctcaacgccttccggcatcacggcgagcggcaccgggcaactcggcaccggagatcgcggagcaccctccgtgctcaacgccttccggcatcacggcgagcggcacgttgaccgtcccggacccacgcatcatcactgtcatgtgctcaacgccttccggcatcacggcgaccggcaccttgccagtcaatttctggcgcatcgcacggaagggtgctcaacgccttccggcatcacggcgagcggcaccataggccgcatccgctcaatccggccggacttcttgtgctcaacgccttccggcatcacggcgagcggcacaccacccagtcggctacatggggcgcgacgggggtttgtgctcaacgccttccggcatcacggcgagcggcacctcctgatttgaagatgtcgtgctcgtaggcgaggtgctcaacgccttccggcatcacggcgagcggcacatcgtcgcttcccccttcgtgatgcggttgtcctgtgctcaacgccttccggcatcacggcgagcggcacaccagatggccttctcgtcacggcaggtcgccgcgatgtggtgctcaacgccttccggcatcacggcgagcggcacctggagcgctgaagccgaatatcgggcctgcctggggtgctcaacgccttccggcatcacggcgagcggcactgcgctcgcactcgaccttgccgcccacctcggagtgctcaacgccttccggcatcacggcgagcggcacattcaagccggacggcatcgtgcgaatggcagagtgctcaacgccttccggcatcacggcgagcggcacccgctcagtaccgcgcagagtacctgagcgccgccctgacgtgctcaacgccttccggcatcacggcgagcggcaccacccgcagcaccgcagaggacacacgacatggcgacggtgctcaacgccttccggcatcacggcgagcggcactgaagtcgaggagcttcctggactcgatacgaggtgctcaacgccttccggcatcacggcgagcggcactggacgggagaagacgttcacggggcgcgatgggaggtgctcaacgccttccggcatcacggtgagcggcaccgccccggacatggcgcgggccgggttggatgtcgtggtgctcaacgccttccggcatcacggcgagcggcaccaggggaccgagatacgcttcgcattgcacatcgccgtgtgctcaacgccttccggcatcacggcgagcggcactctctcgaactcacccaacggccgggttggccggcctcgagtgctcaacgccttccggcatcacggcgagcggcactgaacccagcgcgctccacggccccggtgccagagtgctcaacgccttccggcatcacggcgagcggcacgccaaggccctggactacgcccggagcgacctcgccgagtgctcaacgccttccggcatcacggcgagcggcacgccaaggccctggactacgcccggagcgacctcgccgagtgctcaacgccttccggcatcacggcgagcggcacctatgaacccgtgaaggggacaatggccttctcatgggtgctcaacgccttccggcatcacggcgagcggcactcccgccttgtctctcatgcagtaggaggtagcacgtgctcaacgccttccggcatcacggcgagcggcacccatccttttcgtcacgacggcgaaggccagacgcacgtgctcaacgccttccggcatcacggcgagcggcaccgaacgcgccgccttcgtcctgattgccgaggacatgtgctcaacgccttccggcatcacggcgagcggcacccgcctcgcgctggctggcgcccacctggagctggagtgctcaacgccttccggcatcacggcgagcggcacgttaaccaattgcacagggtcagcaaaagcgttgttaggtgctcaacgccttccggcatcacggcgagcggcaccggaggacgcaaatgcaaatcaggactgagtatagtttgtgctcaacgccttccggcatcacggcgagcggcaccccatgcggtgaccttcaagcatcggaaggttcgagtgctcaacgccttccggcatcacggcgagcggcaccggaccagattttcggtgttcaccgcgaggcccaattgtgctcaacgccttccggcatcacggcgagcggcacaacagaccatggaatgaggcattcgcctcagccaatggagtgctcaacgccttccggcatcacggcgagcggcacctggagcgctgaagccgaatatcgggcctgcctggggtgctcaacgccttccggcatcacggcgagcggcaccttgagggaggacgacgacatgacggtgaagacggagtgctcaacgccttccggcatcacggcgagcggcacaccacgtgctcgtcgtcacgatgctggagcgcggcgtgctcaacgccttccggcatcacggcgagcggcacttggcatgcacgcgcaggttgtccgcgtgccacgtgtgctcaacgccttccggcatcacggcgagcggcaccatccatctagccacccgcctgagcgcatcaggccgtgctcaacgccttccggcatcacggcgagcggcacctgacgggcatgcgcggcagcctggagaagtacctgtgctcaacgccttccggcatcacggcgagcggcactcgcgcgcccgtggacgtgggccatcacccaccacgggtgctcaacgccttccggcatcacggcgagcggcactgcatgagtcgaaagagattttgaagcgccggacgtgctcaacgccttccggcatcacggcgagcggcacagcccatctgaatctcccagcagttccggcaacttactcccgtcttttcaagcacctcccccctcccggccccaggttgcgcctcccaggccctacccaagattccaaaccccatggaatcactcggtttttcataaatcatgcacctattcacctgtcaaagagccccaaccccatgaactcgctgaggatttcaacgatttcaccggcacaggcctccaccacggcgaggtgcatgaatgtcacgcaccgcacagcccccggtcctacgttcctgcaaggcccctgctccaccggcaagccttcacgcggcccgcgcgagttccccgagctgcggcacaacgccccgcaccacgggacgcggcggaagaaacaagccacaccccatgtggcggcgcccgcccaggccttgtgcctgcactcgcaacgagtcctctccagaaacgccatgcagctcgagcgcgtaacccaccacccgcttcccggcgatacgcaccagccgccgacggcccagcaccggacgtgcatcacacgccagcgcctcgagtgaacgggacacgccccgcaggaacgacgccgcgtcgagcgcatgcttgaaagtcacaatccgcgcgaagagtgacgacgcgggttccaacgcgcggagcaccggcgcaccgagcaccacctcccgcccagcgacgttcagtggcgtgagcggcaacgacagcagcagcggcaccacctccggtgaacagcgcaagcgcagcgttccccggcccaggtgcagcaggtcccccacggcgcgctcaccgcgcagcgtgaatacgcccaggtccaagcgttcatgcagcgcgggcacccgggtgcaaagcgcggagaagagcgcatacccatggtccagcggcaccgggccaccccggaccggatagagcaggtcgagtgacgtcaccgacgacctcccacggccacgcccatcctcgcgagcaactcatccctgcgcgcttcgagcttggggttcttgacgagtgaacgcagcgccttcgcaccggcctcacgcgcctccggcgccagcgacaccaaccgctccagccactccgcctcgaagcccaccaggacttgccgttgttccaccttgtcggcgcgccgagcctccacccatgacaggaactccgtcagcgcgggcgaggcgcggaccgggcgctggggacgctgaagctccaacggcccttcgcgcaccagcctgccgtaccccgccgccgtctttccgcccacgccccagtggcgcagggcctcgtccagcctctgcgcggtccacttcaggaacgcctctgcctgtgcatccgcctccatccctggcgccaggctcagcgccacgaggaaacaacctcgtggccgcaccgagaggaaggccaccggattgggcgactcgtagtcattcggccacgaggacgtgccgccataccaacccgcatggtgaaccgtgagcacgtcccgggacaggaacgtcggcgaacggtccgcgcccgtgacacgccgatacggcacccactgcgcatcatgaaagatgacctcgccagcgtgcgcgccttcgccatcctcccccggcacaccgaagagcctgcgccgcgcctccatcgcggcatcgccgtacaccgcgcgcaggtagcccgcgagcacgcccttcaacgacgagcccggcacgacggggacgccccacgtgtggtgcagcgtcagccccacccccgtgggtgacgcgttgccatgccccaccaagaggcggctctccgcgcgcgccgtgaaggtcgccgtgtacgactgccggagcgagtccttccagcgaatgaaggcgtcggcgtaatcgtctggctcggggtgcgcctccagacgagccagccacgcctcccagggtccgctctggctctcatgcttcttctccggggcataccgctcgtacaccagccccgcgtgcgaggtcttctcgacgcgccccgcgactcggcccaaagcgtcacgcatgttcgcgctcctccagggggaaggtggcctgcaccgcgcggcggaaccacaccaacagccggagcgactcgcgcgtggccagcatgtattcgttcagccccagcgcgcggacggcgccaggcaagcccagcctcttcagggacggctccgacaaccccggcaaccgcgcccgctccagacaccacgtcaggtcttccaacaggtgctgggccgccgcgttgctcttgacctctcgttccaggaaggcgagcgccgccgccagcccatcacgcaacaccgccgcgcccaggccgttcacccgaggcttgtactccgcgcacaacgctttgcctttgtcacgcgccgtgcgaacccgcgcatagacatccagcgcccgctgctgctcccgcgtctgcgccgtcatcgcccacctcgcgcatccggagccatccaggccagcagccggcaccggccgcgccccacggtggccttgcctcccagttggagcaccgtgccctcgccgccaaacgccgcatccagcaccgcgtccgccgccaacttgcgcggcgccttgttgaaggtacccgtggcgcccatcacgcccaccagcagcgtctccgcgggcaggctctcctccgtccagagctgcccctttgccgcggtgcccgtctccgggtccatgctcacgcgcgtgtccacctgtgtggctgtctcccagaggaaggacatcgtctcgtcgtccaccagcaccagccgcttcgtcagcagcgcgcgctccgcctccggcagcagccccgccaggccctgggcccaggcgcccagagccgcgtcatccttcgaggccacctgcaggtccaggtcctccaggtacacgcaagcctccgacgtgcccgcgccgtacacgacggcgctgtctcggcagggacgccacgcgcgcgccgcgctgggccagcggctccaccttcggccaggccccctccttcccgctcagcccgcccaggtcccgccgcgcgagcgcgagcagcatgggcgaggtcaccagcgcgaaggtgcccacgaagctgcgcaccggcagcgcgagcagccgtgcgtcccccaccaccagcgcgcccgcgtagtcccccggctcgtccccctccggacccgccttcgcccgccgggggccgaagacggcgtcgtgcagccctcgcgcgtcgcccgtctcctcgcgaggccgccgcaattcacgcagcacgcccttgagcgacgagcctgggacgaaggggattcccgtggccttcagccgcgccaggggcaggtcgatgacacccacgctctgcccagtgccgacgtgcagcggggacagcgcgtgaagaagatagggtcggctctccatgctcaggctccttgtccgtgacggggcggttgccacacgccgggcagcacctggcccagcgcctccgcgtggccgccgccccaggaggccagccacagcgctcgcagctcgttggcggtgaagtccccaccgctgtgtttctcgaagaagtagacggcgcctgcgggcacccaccgccgcgtgggccggggccgccgccgcaccatgtcccagccggacacgtccagcggccaggggaccagcgcggcccgaagcaccacgggcgcgtcgatgcacggcagccggcccacgtaacgtgggggtgtcccagccacgcgctcgaagccgtccggcaaccagccacgttggaactccgcgggcgtggccagcaccaggcgcagtcctcgcgtcgcccgggccacgccatccggaatcgcgaagaggtccaccttcagtggctccacggccgacagccggcgccggccgcccaggcccagcggcccgcgcggagcgccgctcgcgggggccggccacgcgcagctcagtcccagcgcccactcctccagcacgggagttcgccccgagtggcgctggaggcgcagcaactccaccacctcacgagagtgcagcatcgagtcctgcgacgcctgcgtctccacgtcgatggccaggtggatgtccgtgcgcggggtcagcgcatccggtgtctcggaggacggctccaccgcgccgcgcagccacgccatcatccgcgcctcgggccagaacaggggcgcggccatgggctttccgctcgagttccggcgcgggtgccacagcgcctcgcgcgcgtcgtcgtcatccgggcccagcgtggcggccccatccgggcgtggctccaaccgctccagatgctcggacccgtccgcgtcgcgcacgcacacagcatccgcgggaaacggccacatgcggtgggccaacgagaaggactcgcccaacgggcggcgcagcgcgacgaggtgccgcaaccggacctcctctgagcagcgctcccattcatccggggccaggaccgcaccgctgaccgccatggcgtcatgcccccaggcggcgcgaagggcgccccgcactgtggtgggcaggggccacggcaaggagtacccacgccccacctccgacgtgtaccaacctcgcccgtccttggccgacaggccgtcacgcggcagcagcgcgaagctcgcgtcactcatctcacaccttccttgtcgctcgcgggaatgagctttccgctggcccgggcgaggacatccgccaccagcagccgggatgcccatcggtccagcgatgcatggggtggctcgagggagttcggcgacgtgggcagctccaagcccacggcctccggggtgagcttcacgggcgaacgccccgcctccgcccgggcgaggatgcgcgcggcctcatccgacagcagctcagccagctcgggcgcgatggtggtgccagacgggaagcggcgcgcgagggccgccacctcatgaaccttcttcaagggcagcggctgggtgtcgctcgacagcagcgccatgtcccgcgtcagccgctcgacggggtcggtggcccacggcgccgtccacagccgctcacgtccggcgtgcttcgccaccagcactgccaacgcgtcgcgacccgcgtccttcgcggcacgctctgcccggcggcccagctccagcagctcgcccaggctctccaggacgtggccaatgcccagccccacagagagcgtgggcacctccgcgcgcgttcccgccagcgccgcttccagcgtggcgcggaaggcaacggcaagcgcctgggcacacgcgagcgcgtccatgggcgtgacgaaggcgagcaaatcgtcgccgcccgcgtagacgagcacgccccgatgctccacttcgacaatcgtcttcgcctgccgcgtgaagtccgcgagcgcccgggagatgcgttggtgcgcggcgtggccgtccggctgcctcgcgagcgcctccagcgcgcggcccatgcggtctccatccgccaccaggcaggccacgtaagggaagggctcggcgcgcacagcgtctcgaagcggctccacgaactcgtggacgaaacgcgcggcggcctgacgcgcatcggggacggcgtactcctcgaagtacggggccacgcgctcgggcagcaacaactggccgtcgtaggggaaggcctccacccagggacgattcctcacgctcaccgtctggaacccgcggcgcgcgcactcggccttgagcgcggcgaggagcgccgggtgtcgcgtggccgcggtctggagccacgccgccatcccgatggagggcacgggcacgaactggccgggattgccgccgacgcgcttgagcaccccgagcgcatccagctcctcgcgcaggccaatgcggaagtcacgccagaggtgccccacgtgacgctcgcgtcgcagcaatgacgggcgagcgccgtcgaggctcgacttgtgcgtgcccgccggcggcggctgcttccatggcacgaactcacgcaagccccggcgggcctccagggcacgctccgcctcgtgcagcgcgtcggcgtaacccgtgggcgtgtccgcgatgggtgcccaggcagcgtggatctcaaggaaggtgtcgagttgctcctcggccagcacggacgcctcggggatgagcatggactcgcacgtcttgaagacgcggcgccagtccttgagcaaccgctccttcgccgcgcgccgcgcgttccgtgcagcctgctcgggcgcgtcctccaccagcgcgaccaccttgttggccacgccggtgctcgtgtccttcgcctgctccggatgcgggaagaccagcgtcgcaccagactccgtgagggagaccgccacggttcgcgccagattcgacagcaggtggctgccgtaccagaggtcccgcgtgcggcgagactgggcgatgtagccctgcaccggcccctctttgagaacgacgacgtatttcatgggctcacgcctcctgggcacggcgggtttcctccagccaccagaagaaggcgtcgcgtaggttgtccgcctgctggagtgtctggaaaaggggttggtcatcgcgggcccggaagctgctttcaaaaggaacccgcgtccgtgggactgccgtcccccgctgcgtcatgacgacctgtccaccccgaggcgctccgcgctccagccacagcgcgatgggctcgaagcggccatccgccagcggcagcgccttgacgatgagcggcgatgcgaggcggtccatcagcttctccgaaccgctctcctcccactggagctggatgtcctcgggctccttcggctggtagtagtcattgtcctcgcgccgcttctgctggaaatggaagacaatgggcaacccgaagccagcgcgcggccaggccgcggtcgccgagtgctgtgggcgcggagcgtggacctcgggataggccttgccctcggaccttggagcgaagccgcctcggctgtccttgccagatggccgggcgaagcggcgaatcttgtcggcctccggccagttggagcggcccgcgcgatttccttcaccaggcttgcgcgcgattcccacctgttcagcactcccggcgggcgcgggctcggtgccctggcggaattcccgcagccacttgagcgcgatcaaccagacctcgctcccgtcacgcggcttggcgcccgcgttcccccggaagaggcgcgcgccccgcagcagaggcatgtcacaggcatccgccgcctgctcaggcgcgaagagcggcacgtccccgaagaggcgccgaagcgatgcccggtccgcggaggccgggagccactccgcggcaacggggcccgaggccgccaggcacacggagccgcagccgcgccggccacgcgagccataccccccaaacagaatccaggctcgcaccgcgttgcgcacctgggccatgtcctcaccctcgggtgcgatgacctccagcgtgaactggaggcccggagcccaacgagggatgtctgcctgctcgttcttccccttgcgcgccggccacagcgcataacccgccgtggtgccgaggttgatgggcttcgtgtcctctccctcgggacggacgtccaacacccgcaactccacctgggagcgccaggcacgcgcctcatcatcccctggccccttcttcgcccgccccatgccgccccagagctcgcgctcccgacgcgccagcgcctccgcgccccgccccacgtaggcgtggccgtacagcgcgcgccaccagaagcggaggtgcccgcgcagcgtggggacccggatgatgtccacggaggggaggtccgggcttcgcgccactggccctcctcccaggatgggcgtgaaggtcttcaaggccagcgtgaaggacgccagcttcggccccttggcgaagcgccggcgcaagtgaatggcttcggatgaaggtgggtcaggcagaaccagagaggacatggcgccccttcagcaggagaaaggattgagaagagagtgcgagacgcgactggggaccaggagtcccaatgccagcaaccagatggttcaccgagccatcaacaaccgtgcgcggcaacactgctgagaggtcagcatcagacttcccagccagcggcgtgtgcgcgccccgaggccgccccaaatgctccaagcacgaaccgcgttctcgaatgcagtgagccattccgatggaacggcgacatgaagcgtgaaggacaacccatcgctccaacatggggctgggggctttggcgctgagcctgtcctggtggctcgtgcaggccacagcgcatatgccccctccgaattctaccttcg

SEQ ID NO: 1133 - DNA, 15644 bp, Myxococcus xanthus
tagagacaccggcatcgcgcacgtcggagccgcgtccgaagccgaatcggaaggttcgaacatcgcgccggacgccgagctcgcgttgccacacaggcatggacggcgcgtggaccacttgagccgggcccacctgttgcgcgactgggacgacctcgctggcgcgctcaccgagtgtcgccgtgcgattcatgacgcccccgacgacgtggccgccttggcgctggcggcggagctcgccgggctcacgggccggacggacctggccgtgcgtgcccatgcccagctcggccgcctgcttcccctggatgcccgccccttggtgcgtcaggcaaggctgctggtgtccctgggccgccatgccgaagcggtgtccgtgggcgaagaggccgtgctgcgcaatcccgagtacgtggaggcctatcaggtgctcgggcgcgcgcaccttgtgcagggtgagctggcgaaagcgatgctgcgcttcgagcaggccgtccacctccaccccgagcacgggtacgccctcaacaacctgggcctcacctacctgcgtgccggagaagcccagaaggccgcggacgtgctcgtccgggcggcggagctgctccctcacgtggcttatgtgcacaacaacctgggcgtggcctacgagcggctcggacaggtggaggaggcccgggcggcctatgccgccgccatgcacctgtcaccgcgctacgtccaggcccgcgtcaacgcggaccggatgcgccgcacggcccacgcggacatggccggcgcccggacggctcgtgagcagctgctcccctcccagggagaggcgcctgcttcccggtagcgccttcctgcctggaggccctgcgccgggcgagcctccagagcggttcccgttcggtgtcccccggtctaacctgcggactttctttccagcgcaatgaccacggctccccagatgccctcttcgcccgattcctccacacccactccccccgcgccgccttcgcgaccggggttcggtgcccggctgtggcgctggacgaagcggctgctcatcaccggcctcgtgtgcctggtgctcggcgccatcaccctggcgagcggctacgcgtactacagccaggacctgccctccgtggacgcgctgcgcaactaccagccgccgcaggtgacgaaggtgacgtgcggtgacggcacgctctgcgccgagttcgcgcacgagcggcgcacgttgattcgcgtggaggacctgccgccccacgtccgcaacgccttcctggccgccgaggacgcggacttctacaagcacgagggcctggacttcttcggcatcacccgcgcggccatcaagaacctcatccccaacagccgcaagtccggcgcgtccaccatcacccagcaggtggtgaagaacctgctgctgtcccctgagcgcagcttctcccgcaaggcgcgcgagtggattctcacgccacgcgtggaggaagcgctcaccaaggaccagattctctcgctctacatcaaccagtcctactacgggcagcgccgctacggcatggaggaggcggcgctcttctacttcggcaagcacgccaaggacttgaacgtgggcgaggccgccgtgctcgcgggcacggtgcagctcccgcaccgcatcaacccggtgacgaacatcacgcgggcgaagtcgcgtcagcgctacgtgctggaccagatggcgcgcaacggcttcgtgtccgcggacgtggcggaggcggagaaggagaagcccatcgtcctggctccccggcggggcaaggtggtggggccgtattacacggaggagattcgccgcacgctcatcgcgcgctacggcgagcaggcggtgatggagggcgggctgcgcgtggacatcgccatggtgcccaagctccagctcgcggcggagcagtcggtgcgtgacggcctggaggcggtggaccggcgccagggctaccgcggtccccgtggcgcgctggagaagggccagtgggagcgataccgggccctcatcgccacgcgcatcgaggaggcgggccgccggcagaaggaccagggctacgtcgcggacctgtcctcgctggcgaaggtggagaaggaagagccgaagacgcccgagatcgcgggtgcgcccctggacccgctggaagaggaaggcaccgaggagcagcggccggacctgtcgcccgaagacgaggcgcccctctccgcggaccaactcctggcgcagtccgtgcgcctcaagcccatggaggaaggcctgcgcctcacgggctacgtcatgcaggtggacgacaagcgcaacgtggcccgcgtggacctggtgggccgcaccgccgaggtggccttcgccgccgcctcctgggcgcggcagaagggcaagagcgcgccgaagaagatttccgacgtcttcacggagggggagctcgtcttcgtgcgcgtgctcaaggcaccgcccgcgccagccttcgtggaagcggcgctggaccaggttcccgaggtgcagggcgggctggtggtcatccgtccggagaaccggcacgtggtggcgctggtgggcggctacgacgcggagcgctcgtccttcaaccgcgccacgcaggcgaagcggcagcctggctcgtccttcaagccattcctctacgccgccgccatgggcagtggccgctacacgccgctgtccaaggtcaatgacgcccctgaagccgtccgcgacccgtacacgggcaagacgtggaagccgcagaactacgaccgtcggttccacgggccgatgacgctgcgcgaggcgctcaccaagtcgaagaacacggtgtccgtgcgcctcatcgaggcgctcaccccggccaccaccatcgacgtcgcgcgccgggctggcatccactccccgctgccggagaacctcacgctggccctgggcaccggtgaagtcacgatgctggaggccgccaacgcctacgccacgctccaggccaatggccgctatgcggagcccttgctgctgctgcgcgtgcgcgatgcgcgcggcaaggtgctggaggagcatcagccggccttcgaggagacgctgccgcccgcggtggcctacctcaccacgtcgctgatgcgcagcgtggtggaggacggctcgggccgggccgtgctcgcgctggagcgccccgccgctggcaagacgggcaccacgcagcagtcccgcgacacgtggttctccggctacacggcggactgggtggccagcgcatgggtgggcttcgacaacaactcgccgctgggcggcagtgagacgggtggccgcgccgcgctgcccatctggctccagttcatgcgcgtggcccacgaagggctgcccacgcgggagttcgaggtgccccccggcgtcgtgcaagtgcgcatcgaccccatcagcggactgctggcgggcaactccgtcccgggccggctggagcccttcctcgaaggcacgcagcccaccgcggaggcaccgccgccgggacaggtgaccaccgaccagttcttcctcgacgaaggcaacaggcggggactgtgagccctgcccgagccctgctgctcgcccctgtgctggccacgctcgtggcgcgggcggcgcctgcggccgacaccaccgccgccattccccgactcgcccggcaggtgacgggggccgtgcgcgcgcagcgtggcgtggagtcgccagtggcggtgaatgtcacgggcgggtcggccgagctccgccgcgcggtgagcacgatgctcgcctcgcagctctcctccgcgggcctgtcgcccgtggtgctggaggcgcccacggccgatgccgccgagacgctggcgcgcgcgcaaggtgcccggacgctggtgcgactctcgctgaacgtcgaaggcggcgaactgcgcgcccgaggtgatgtgattggcacctgggtgaacttctggtccggccgcacgcccacgcggccgcccaagcccgccgccacgctggtggagacggtgcccgcggacccgaccgtgttggcgctcgcgttggagggcgcaggcacttcgcccacgtcgcccccggaaacgggccctcaaggcatccgactgctgggcgcggcgctggcgcgtctggagcatcccctggcggcgctcgccgccggggacctggacggggatggccgggatgaagtggtggccctgacggagcatgacgtctctgtcttcgacgcggaggggcggctcgtcgcgcgcaaggagctggactccctgcccgctggaagcgccaccacccgggagccctttggcgcgttggcgttcctgccggggcccccccggctggccgcgtggagcacccgccatgcgcacggcgagttgctggcgctggacaaggcccgcgccaccctgcgcgccgtggggacgctggacacggcgccgctgggcgccaccgagcgaggcactttcgttccgggacagacagccttcgcgcccaccctgaagctggcggagggccgcgcgctgacggtgcccgcgcccttcaccaccgcgagcatggatgcccagcggatgctgttcgtccacccggatggcaccgcggccttctacgcgcacgcgggcgcggcaccggcgcgctggacgaacctgggcgccggcagcgcgctgggagacctggatggggacggcgtgccggagctcatcaccacctcgactcagctcacccccgcccccgatgtgctgcgcgtgcacggcacctccgggggcgaccccggcacgcacgaaccgctgtggcagggcgccctgcccacgggccgcgcgctgtacgtggtgacggcccgcctggacggcgacacgcgccgcgaggtcatcgtgggcctctggaagccggacggcaccagcgagctgttcctcctgcgccagggggcgccatgagactccgctccacccttgcctgcctcgcattgctcgcatccgcgtccgcgcaggcggccggccgtcctcgttacgggggggagctgcgcgtcgcccacggcggcccgccggaagtggccgagcccgcgctggccgacacacccttggaagcaacgctgctggggctgctttccccaccggtgtgccgtgccacacgggacggcggcttcgagcccgcgctcgcgcgggagctgtcacgccccacgccccagtccctgcgcatcaccctgcccggccccgcctccgccaccgcgctcgcgcgggcatggatgcggctggcgagccacgacggcgcatcaccgtaccgagccctcttccatccgctgcgcggtgaggcacggcaggtgacgccccagggcgccacgctggagctgacgctggcctatccctggccggacctcgagcgcgcgttgtgccatccagcgctggcgccgcccgcctccgccaacgccctgggccccttcaccgccgcgggacgcggggccctggaagcgcagacggcctggccccaggggcgcccgtacctggaccggttgctgctcacctccacggaccagcgcggcctctcacggctgtggtcgtcccggcaggtccaggtggagctgggcgtcgcgtcggagacggacaccacggccggcgacccgctctacgccaccttcctggccttctccccacggcggttgcccccggacttccggcaggccgtggagagcgccatcgaccgcgaggacctgacccgcctcttcgtccaggcgcccgcgcagcccatgccgcacctgctcccgccggtgatgctcgacgctcccgcgcgctcccggccgtccgcgccgtcggcgagacccgcacggacggtgacgctgcgctacgacgcatcggtggaggaccagcgcgcggtggcggagcgcatccaggtgaagctgcacgagcgcggctacaccgtggcgctggaggcgctcccgcgcgcggccctgcgcgcccgctgggcccagggcgacttcgagctgatgctgcacgcgctgctgctgccccccatccccgggcccgcgctggcggtggtgctggatgccggtggacgcaaggacttgctgggcgtggagctgcccgccatcggcgcgcttgcgtccaccgcggcgcgggacgcgcgagcgcgcgagcgggccctggccctggcagcgtccgtgcccctggtccccctgtacgtgcaggggctgggaatgcgcttcgctccggacgtgggcggggtgatgatggatgcacaaggcctcccctcgctggacggactgcacgtgcttccaccggaggggacggcgatgggaggacgtccttgaggagaacggcatgcgcttgaggacgcggctggcgctcgccttcgccctgctggccctggttccgctcgcggtcgtcgtgccccccaccctcacccgcttgcgcgacacgttgtcgcgcgagctggacgcgcgcatggaggccgccaccgcctccgcacaggagtccctggagcgctccagcgccacggcccgccgcgcggtggaggagctggtggacagcaccagcatggaggacctggcccgcgaggcccgcgaccgccccacccgcgccatccaggccggcaccgccgaggccctgatgaagagccgcggcctgagcgtgctggccctcttcgaccgcgaaggaagggtgctctcctccggccacctgcccgcgcgccggggagacccggacccggccctcttcgccgttacgcagcagaagtcaccccggcccgtgccagtgcgcgtggaggtgcgcacggcctccggactccgtcagcttccggcgctcgtcaccgcgcgcccggtggacttcggggacctgcggctgtgggccgtgggcggcgtgctgctcgatgagagcctggcgcagcacctggcccgcctcacccagacgcaggtgacgctgctggcgggtgacacgcccctggccagcgcgggcacggccgaaccgccgacggtgacgaaggcgctgccgctgggagacgcggccacggtgcggctcgtcttcagccgcgccgccgcgcgtgaagcggaacagggcgtcatgcgcgccttcctcctgctggcggcgctgggcggcactttcgcggtgctgctgggcctgctggtgtcccggtggatgacgcggcctgtggaggccctcaccgagggcgcccggcgcgtggccgaaggcgcgctggagtcccaggtgacggtgaaggccagcggcgaggtgggcgagctggtgcggacgttcaaccgcatgacgtccgagctgaaggccaccaccgagcggctgatggccagcgagcgcatcgccgcgtggcaggaagtggcgcggcgactggcgcacgaaatcaagaacccgctgacgcccatccgcatgtcgctggagacgctccaggccgcgcaagaagcgaagcacccgcgcttccaagacatgttcaaggagagcgcgggtgtggtgctggaggaagtggaccggctgcgccgcatcgtcgacgagttcagccacttcgcgcggatgcccaagccgcagctggcgcccgtggacctgggcgagctggcgcagagcgtgctggcgctgtacgccacgcctccgaccggcatccagattctgcccacgctccagacgggcgtggtggcgcgggtggaccgcgaccagctcacccaggtgctggtgaacctggtgaagaacgccgaggaggccatggcgtccacgggtggcaccctgcgcgtgcgcgtacgctccaccgaagccgacgccatcgtcgaggtggaggacagcggccccggcattcccctggagcaccgcgcccggatcttcgagccctacttcaccaccaaggacggcggcaccggcctggggttggccatcgcctcgcgcatcctccaggagcacggcggcaaactggaggtgggcggagagcccggccacggcgcgcgcttcagcctcgtgctgccgcgcgcggcctgactcagacgctgcgctccgcgaagcggacgtggaccagcgcgggcaaccgttccttcacccagggcagcatgttgagaccgttgtaaccgtaccggaagaagccccgcgggaaggtgtagggcttcaattccacctggcggattcgcggcgcccaccgccgcagcgtcgcctccagcgcgtcgcggttgatgccccagggcatgggtggcacctggtacgcgcgggtgcggtgcagccccttgagcgtgcgccgtgagagccagcggggaatcgtgtcgaagaggagctcggcgcccgggaagcgctcggcgatgtccacgatgagccgacggacgtcgtcttcctcgaagtacatgaagaggccctgcgcgacgatgaacacgcccttgctggcgtccacgcggtccatccatgcgcggtccatggcgctcaccgggaagtgcatcagccgctcgttcggcgtgaggaagcgctcccggatggccacggcttccggcaggtccacgctcagccagcgcagccgcccgttgtccagccgctgcgcctgcgtctccagcccctctcccagcgacaccacgaagccgtcagggtgcgtggccagccacgcgcgaatgctccggtccatctccaccgcgcgaatcgcgagggacggctccgcgcggccaaaggacttctcgaagtcgtagtcgatggcgccgtagatgcgcagcgcctccgcgtccttcaggacgccgtccggccgcttcgcctcccctgcccgggaatgaagcgtccagagcatcgtctccggaatccccgtgaggttcggcacgtaccgcgtctgcatcgtccccctcctgatatcaacgacacctcccgggcgagctccgccaggcgcctcagtgcgccgccgacctggagaaggtattgatgacgatgacgcccgccaggatgagcccgatgcccacgagcgcggggacgtccaagcgctgcccgtgaaggagccacgccacgccggagacgaggacgatgcccgccccggaccagatggcgtaggcgatgcccgtggggatggtcctcagcgcgaaggacaggcagaagaaggccacgccatagcccagcaccacgaggatggacggccccagccgcgtgaagccgttggagctcttgagcgctgaggtcgccaccacctcggccacgatggcaatccccagatagaccgcgttgtgcatgaaccgcctccgcgggcctctataaccaccggctccgaaggcggcccgcgcgaacgtccgaaacgagaaggcccgcggcctctcgaggagaccacgggccttcggcacttcagcagcggacagggccgcgctcgggctcagtccttgacgggcgtggccttgagggccgccttgccttccttcacatagacctggaagcgcaccgtcttgcacgcgtacttctggacgagctgctccttgttcttgcggagcttctgcacgaacttgtcgtacgtcaggccgtcggccgcttcgccacaccgctcacgggtggtgaggaactcgcggaagacctcctggaagtgctgctcgtcggtgagcgccaccgcggagttgcccaggcccggcagcggaatcgcggcgggctgaggggcggagcgcggcggcggcatggggatggcgtccgacgtcggaggccgcgcgctggcttggagcagctcgcgcggaatcgccgccacgcgcgtcgtctccgggctgtccggtgcggcctgggaggccgccagggcgaaggggtccgccgcttgctgcagcgagtacgccgccgtgggctggtcctcgaaggcgaacgctccccggcgaggcgacgcgggcgacagcggctcgggcccaccgaaggactcgggtgaggactcgaacggcatcgcccccacgtgcgcgggctgctgctgcggcggcgcggggaacgggaacgcctcggccgagccgaaggggtccgccgcgggcgggggcgccggaggggcaaaggcaaacgggtccgccgcgggggccggaggcggagccggcggggcgaacgcgaatggatcgcccatgggagcctgcgccgttcgcgaattcgcgaacgggtctcccgacggcggcggcgcgaaggcgaacgggtccgcggcgggtgccggagccggagcggccggcggcgcgaaggcgaacgggtcggcggcgggcgcgggagcggcgggcggcggcgcgaaggcgaacgggtccgcggcgggtgccggagcagcgggcggcggcgcgaaggcgaacgggtccgcggcgggcggcggcgcgaaagcgaacgggtcggcggcgggcgcgggggccggcggcggcgtgactgcggccggcgcaggcgcggaggccatggcggccgacaggctcagcgtgtcggagctgccactggacgcctccgcgtcagccgccttgcggccggagcccatcatcagcgtccacaggaggctcaggcccagcaggcccgccagggcgaacagcgcgttctgctgatacgcggccagcatgcccagcaccggctgcgtgctggcgatcgcgagcacctccagcggcgtgctggccagcgcgcggcgcgcgcccaccatcaacggcgcgttcccccccagggggtcattctgggtgaagacgggcaacgccaccgggcccagctccaggaacttgccggtgctcagcaccacgcccgaggcatccgcggcgaccttcgtcagcgagccttccgccagcagcttctgcggaccggcgacgcccgccagcgcgtctcccttgaccagcgccagcgcggccgcgcccgacgcctggacgggggcctacagcgcaccctcgtccagcagcggcgcgcccagcaccagcgtcaccgcgggcgccccggcgttccacgacagcggcaccgcggcgaacgcatgcggcgcaccgaaggcatccaccacgctggccccggacttgacgaggctcaccacgtccagcttcgccgcgtccgaggacggctcggccccggccaccgcgtggaactgcgtgtcctgggcgaccacggccaccaccgcgcccttgagttcctggggaatcaagccttcgacggcgctgcgcaccgcggcgaagcgctcggcggtgaaggcgcgggcggcggcggcatccacctcgacgcgctcgcgctcacgctcacgctggttgcgcggcgcgggctgctccggaagcggcggcgcggcgacggacaccacttccggcatggccgcgagcttcagcgccagcgactgcacttcggcacgacgagaatccacacggcgcgccacctcggcggcgcccgcggaagcctgggccgatgcaccggcgacggcgcgctcgcgcagcggtcccgacagcatcggcagatgagcaacgcccagtccgatgaccaggaatgcgaagacgaggaacttgaggcggaccatcgccgtccttttagcccgaggttgaagggttccgcttatagcgttcaccgttccgccccagcaagattcgggcactggacaagacgagcccggccgccaggtgtacgacctgggtggccgggctcttgctaccgccaaccgcgattagtaggtgggaacgtcgaccgccacgtcctcgggcaggccgttggtatgaacgtcgcgccgcttccccagcatgcgcttgaggctcgtctccaaccggtcacgcgatgcgtcgatggcggggaacaacgagtccgccgtctccgtcacgtgcaccgaggagagcccgggcagtcgcaccgtgacccggcattccttgtccatgccgcccttgggcccgttggtgtccaccagcgagatgtcgatttccgctgcctcgtcatccgcgaaccgttcgatatggcgcaccaggtgttcgtcgacatacgacttgagagcatccgacaggttcaggtgcactccacgcagcaacaccttcatggcatttcctccgagcccaaagatgggcagcctgacgcccggtggtgagccaccccctgcccattaatggagcccgcctgacgctcccctgctctccggccgggtgggcagcgaagcgctcgcatccgggaaggacgaatccccaccgccgcgcgggtttctcaagggcatgggcgccgaacgaatcaaggtcttgctggtcgaggacgacggggacagccgggagctgctggcggagctgctggagtcggagttcgacgtgaagacggccacggatggcttggccggcctcgagatgttcgaggccgagcacccggacgtggtggtgacggacgaatccctcccaggcatgtgcggcaccgagctcgcgcagaaggtcaaggagcgcgagccccgggcccgcgtcatcctcgtgtccggttacacacaggtgcagggctccgaacactgtgacgtggtgctgcgcaagcccatcgacgtggaacgcctcagcgccgcggtgtgcaggctgggcgacgaagctcgacactgaacgaagtgacgggccccgggtgccgttccacggaacccagacctactatttccctccagacacccacgggcaggagggacggcgatgaaatactgtgcgaggtgcggctccgagtatcaggacggcgtcaacgcgtgcgctgactgtccaggcaacccgctcctcgtgagcgcggaggagatgcgcagcagggggctgccgctcccgcatgagctggatacccgcatcttcgtccgggctggctccgcagaggaccccttcaccgccgaggtctacgcgcagctcctccaggacgcgaacatccccgtcctggtgcgcgctggccgctcgggcgtcgtggacaagctgaccaccggcaacgtgctgccctggtgggaaatccacgtccccgccgaccagcaggtccgggccgcgacgctgattgagcaggagcgcctgcgggagctggccaccaacgacgaggccgcggccgccgccgaggccgaggagcgggagaccgaatctcccgccgctgaggccaaggagcgggagaccgaatcccccgccacgccgccaccggcctactgaacgcgctcagggcaccgggcgcgccaccgagccgccgctcgccacatcggggcggcgcggctcgaagaggctgacgcccgtcaccctccacttcgaatagcggccgttgcgggccaggaacgtctccaggtcctcgtccaccacgcgattgtagccgccgcgagaggcgtggcgcaggtacgtgcgcttcttgcgctgcaccacgaagcccaggtgggtgatgcgggtgaccttcagcggcaggtcctcgcgcatcaccaccaggatggtgcccgaggggatgtcgcgcgcgtgcgccatcacccgctccaggggcagcatgttcagcgggtacgtgcccaccacatgctgcgccttgggcaggcccagcgcctgcgacgagcgcgactgccaggagaccttcgtcagcgacttcgtcaccgtgacggcgtcatcccccgcgtagcgccgcgtcacatccgtcaggaagcccttgcggatgttgttgggcagccactgcgcctccatgaggtggttgcggtcctcataggtgggcgagctcgcgtagcggatgcgctcgagcagcggcgccacctcgtcctcgctgcccgcgaggctcagcgccatcgactgctccacgaaggtgaggcagtccaccgcgtccagccggaaggtggggtcggggtccacgccctggccctcgcccagcggcgacaggacgtagggcgtgttgatgaagcgctcgctcatccgcagcagccgcccggccagcggcgcgtccgcgtcctccgacacgagcgcggcgcgcgcctccgcgctgagccccacccaaccattgggtttcgccggacgggccgtggcgagctgcttggacgccgagggcgactccaggagcgcttcggcaccgggccgggtgtccacgtcctccaggggcgtggggaccgcgggcgcctgcgacagcagggccgcggccaggaccgcgacgaccttcattgcgcgacacccgccttgcggaggatggccttgcgccggtcgtcacgcagttggagcgtctccagctcccgctcgtacgcgagcttctcgtcggacttcgcgttccacgacgccagcaccagccactccaacatcgacgcgtccccgccctcgtggaggatgcgggcggcgccggcggccagcgcgcggtccttgtcctccagcagcggcttgagcgcgggcgaagccttcttcgcgctgacgccttcgtagagctccaggccctgccggcgcacgaagcggtcgtccgagccgagcagcttgcccgcgaaggcgaagccctccggcgagcccagccggcacaggccgcgcgccgccgcgaagcgggtgctctccgaatcgctggcgaggaactccttgagggccggcgcctgcttggcgtccccggcctcccccgcggcggcgagcagggccgcgcgcacctccacctccggctctttccgggcggtcttcaccaacagggcgcccatcttcggattgcgtgaggcgcccagggcccgcgccgcctcgcggcggaccccgctgctcttgtcctccagcagcggcaccagcacctgggtgagccggctgttgagcttcgccaggccctgcgcggcatacatccgcaccgcgctgtcctcatccgacgccaggcccgccagggtgggctcggcggcgcgcgttcccagccccgcaagcaccgcggtgaggttgcggcgcagccgctcctcgtggacggtgcgcagcgtggtggcgatttcccgggccgcgtaggcctcctcgcgcaggaaacgcaggcgggagacggccgcggggacggcgcccccctgcaccacggcctggatgaccgcgtccgtgtccgcgcgccgggagttccgtttggcggcggacgccgggccggacagggcggtccaggggaggagcagcgagagcaggaggacgaggcggacggacggaggcacgggcccccgacgatggcaagggcggcgccggccgtcaaagtcccgccccatgcccggttccccggccggcacgtctgcccgattcttgaccctccagggggcgattgatacgaccgccaggtttcacctctctctcaaggcgccaccctatgaagaagctgatggcgttggtggcggtgtcggggacgctcaccgcgtgcggccccgtgaagtccaccgcgaacatcctcgacgctgaagtgcagattcaggccgcgcgcacagccggggcggagaagctcgcgccctacgagtggtccgcggccaacctgtacatcggcaaggcccgcgaggaggtggggtactcggactatcaagccggcgtcgacttcgcagtgaaggcctcccgctacgccaacgaggcccgcgagaaggccatgcccgtggccggaagcaccgagcccggcgcccgtactccgaacccgtgatgacggagcgcttcccgatgaggcgtccttccctggtcacgctgcttcccctcctcttctccctctcgtgtgtcagcggcagcaagattcgcgcggacacggaggtgctcgcggccaacgtggagcgcgcccgccgtaacggcgccctgcgctgcgcgcccgtggagctggccaccgccgaggcccacctcgacttcgcccgtggcgagctgagccagggcagcagctttagagcacgg

SEQ ID NO: 1134 - DNA, 15840 bp, Myxococcus xanthus
gtcccctgtgctctaaagccagaaccgcggccatggcgaccgccaacaccacgtccgaggagtttcgggccttcagcaataccttcatgagggggttcatgacgtctgtctccgtggatggccgtccaactcccgcgcatccatcgccgtgcgcaggacgaccgccgccgcctggtacagctcctctgggatgggctcgcccacgtcgtagtggatgaggctgcgtgccagcgggatgtcccgcaccaccgcaatgccaagtcggcgtgcctgctcccgcatggcgcgcgcatccccttcccgggccttggccacgagatagggcgcctcgcattcgtcgacgtcgtagcggagcgcgaccgcgatgtgcgtggggttgacgaccacggcggtcgccttttgcaccccgcgtgccgcaccgccctgagcaagctggcgatgcagggccttccgctgccccttgtgccgggggtcgccctcactgtccttgtactcgcgctttatctcctcgcgagtcatcatcaaatccttgatgtggcgccgccaggccagcgcgtagtcccccacgcccagcaccaccagcaaacaggccaggcggctcgcgagtccggacacgtgcgcgaccgccaagctcaaaccctccgcaccgcccagccacgcggtcttcatcgcatccggagcggcctcctccacatcgctccagacgagcgcccccaccaggcagacaatcagcagcgtcttcgccagttccacccaggggcgccaactgaagagccgctgcatgcccgccacgagactgatgcgctccagcttcggctcgacatgctggaggtcggcttccagacccaccgtggccacggacacgagcagtgccgcggcgaacgcgccccccagcaccgggccacaaaaacgcgcggcaatccagagcccttcctgccacgccccaaggtcctgctgtcccaggaagaggtgctccgtccatgcctggagcctcgccatgcccactggcgcggccgccgtgagcccgaacaagccacccgccgtcaccgcgctggcgttcagcaagcggctgcggggaatctgtcctttgcgccgtgcttcacgaaggcgcttcgcgctgggcttctctgtcttctccccactcaccgcgccacctcacccaacagcgccagcgcgccttccacggacaacacacccgccagcagccgctcacacaacacgcccgtccccagccacaacagggcgccccctcccagaatcttcagcggcgtccccacctcctgaagattcacctgaggtgccgctcgcgaggccagacccaggaaacagtccacggtcagcaccgccgcggtgatcggcgcccccaccgccagccccgtggccatggccgcgcccgccagcaggacgacatgcagcgtggccgcctcggttggaacgaaggcgccgagcttcaccacgccgaacccacgcagcacgctggagatgacgagcggccacatgccaccggagaccaccagcgccaccagcagatggtagagcccctcccctgccgcggactcacggctccccgccaggggcagactcgcctcggcggaggttccacgaagcaggtcgatgaagcggccccccatgcgcgcggcatcgaagggaagtgccgcgaccaaccccacggatgtcccgaagagcagctcgcgaatcaccaatccgcccagggccaccgcggacgtgacaggcgcatccagcaccacgcctgcctccacccggaggaagagcgacagggacagcaccaatgccaggcggaccatcgtcggcgtggcctgacctcccagtagcggacacaggaacgtcataggcagcagccgcgcggcacacagcgccaccacgatgatgtccggccccagtgactcgagccaggcgcggagcggctccagattcatgccgcgacctcggagatgagcatcaggagctggtgggtgaaacgcgtgagctgcccggcaatccagggtccggcgaggaccagtgccaggacggccgcgcacagcttgggcaccaccgacaacgtggactcctgaagctgggtggtggcctggaagaggctcgacaagaaccccaccaccaggctcgcgccaatgggtggcagcgacgccatcaccatcaacagcagggcctcgcgtcccagggtgaggaaaacgtcctgggtcatggcgtcaccggtagccgaggatgaggccccgcgcgagcagcgaccaaccatccacggcgacgaagaggagaatcttgaagggcagactcacctggctgggtgacagcgtctgcatgcccagcgcgagcagcacgttggcaatcaccatgtccagcacgaggaacgggaggaagacgaggaagccaatctggaaggcttccttcaactcggtgatgacgaaggcaggaatgacgatgaagaggtccgtctcccgcaccgcgtccatctcctccaccggacgtagctcgcgcgccaggtccacgaagcgcgcgcgctcctcagcgctcccgtgcttgatcaggaaggcgcgcagcggctccgacacgcggctcgcggcggagagcatctccgcgccggagcccgacgccacctccgcgtaggccacctgcccggcgtcgtacatgcgctccatcaccggagccatgatgtgcccggtgagcaccgccgccaggcccgtgagcacgatggtaggcggcgcctgctgcgtgcccatggccgagcgggccagcgacaatacgacggcaatcttcgagaagctcgtcagcatcagcaccgcgaacggcagcagcgacatcaccgcgagcatgcccatcatcgacagagggctgcccgcgtacgacatccgcgccagtgagttctccgccgcggcggccacggcgggaaccagcaggagcactcccagcaagccgtggctcatggcccctcccgccggccccgaatcgtgcgggacctgggcatgggccgccgggcctgcgccaggacatgcccgaactccggcgcaggcgctgccgtctcgcgaatctccgcgaacgcgtcaccgaaggccaccaggtagctgcgcccatccacctccacgagcgcaacaccgcaccgctgcgagagccccgctcgcgatacgacgttcagccgtggggccgtggatgcgcccgtgacgacagcgccgcgccggtgcaaccaccaccccagcacggccagcgccacgacgcccagcagccaccgcgcggccatcgtggtggacaccccagccaccgggcccatcaccgccaaccccagcaccagtgcccccgccaacagcaagcgcgagcgcggcgaatgaacgaaacgctgtgcattcatgacgggactcacggcagcagcgccaggacgcgggctccaacctcgccctcgatttccaccaactcggcgcgggccaccgcgcggtctcccactcgcagcaccaccggctcactggcattgatgtgcaggggaagcagcgcgcccggcttgagcgccgcgagctccgagaggggaatcatcacccgcgtcagctcgatttccacatccacgggcagcggaggcatgccctcctcctgcttgttcacgaccaccatgtccgactcctggggaatcccgcgcccctgcgcgcgggtcagtgaaaagccctcggcgaggaagtctcccgagagcgcgaatccgcgtgtcaccagccgccccggcccgaagagctggccggcctgcgtgcgcacaccttcgaagacgacgacgtcccccaccacgagcgcgtccagagcgttcgcggacagcggcgtctggcctacgaggcaccgggcctccagcgaggccgccagcacctctggcgcgatgcccggcgcacgctccaccggaagcgcttggaacaccgtctggaccacctgtgacggcagcagcaaccgcgcgcccgcgcgcgactcgcccacggtcaccatcaactcaatgccaaccaagggttcgcgagggtccaagcgcgccaccacgtccgacctggacatcgtcacgcccgcgagccgtggaccgagccacgggtatgccccgcccgccgccctcaccgcggagagcgcgaccagcaggacataggccaacgtcgcctcttccaaccgggccaactccgtcaccacgccgggccgctgccccgcgccagcgatgcgctccagccccatgaaggcgagcgcgggctccagctccagcaccgccgtgcctcccaccgctgacagctccagcagcgcgaaaatcgcgggctcgcccagtccaaccgaaggagagacgacggactccaggatgcgggcctccgcatgcacgggacagccgagttcccgagtcagggccgccatcaccgcgtccagcgcctcccttccgaggctcccggcctggggccgctccgcgagcacgaggtgcgcccgggtcagccggcgcgcccccaagcggcgcaaggggcggaccttccggctggcggcgtgttcgatacgggtattcatcggtggctccgctgctgcatcgagacgcacgcctcccgtgcagagcccccgccaggggccgagttcgtggagtcgcggggttgggaagacatggcatccgcgcacgggacgccgggtacgcgggccgggacggcgccgcttccagactcagcgcgtggcctcgcgaatcaggcgctcggccagtgcccccagcgcgggaggtacctctgtcgcctgaggtgccagactcgcatcgggaaacaaggtccggtggtacggaggcagacgccggaagatttcccggcgaagcatgggaggcgcgtcactcatgaggcgcctcagccgagcagcggcatcagctcgctccccgaactccaccgccaccttcgcctgtcgctgcgcggagggcagcgcggacagacgctggaggtgctcccgcgcacgcaccgccgattcctcgcccagttcgcccagcagggtgcccgcccgctcccgccccagcacccacgcgacgagcgcgaggcgttcgaatggaatcggcaaggggcccacgagacggggcacctcctcggtcggtgcagtggcccggacggacgcggagctccggactggccgaggcttgcgccctacgcgtgtcgcatccatgcgttcgctctccatggacacctcacgccaccttgcgcgccggtcccggtgacaacacgggccgcgcgggtccgggcggcgcggacggagtcggtgtccggtcgcggtagtgccgcatccggagcgtcaccagcaccagcgccaccgacagccccgtcaccatcaggcccaacaccgccaagagggcacgcagtcgggtcagcggagacacgcccacctccgtcggagcctccactcgggtggagacctcgtccaccaacaacgagacggcttccggcgacaggccctccaccccccccgcgaggaggaccttcaacgtctcggaggattgccgcacccgggccgcattgcccggcgccacgcgaagcatggctgatgccttcgatggacccggggcctgccccactctcggcggcgcgggcaccaccaggtggacgcgcgcgagcagcaccccttccacggattggagcgtcttctccaggctccgctccatcaccctcactcggcagacgctctcctccaccggcgtgcgaaccagcccgccaccgccgaagacgtcacagcccacctcctccttcggcctcggcagccccagctccgacaggattcggaccgcgtccgaggcgtgctcatccgccacctcgatggaccatgtgggcttcttgcccgcctcggggaccttgcgcgcgtcgagccctcgctcgacgagcacggattgaagctcgttggcctgccgctcatccagaccatgctggatgcgctcgcggcaggcggtgacgctcacgagcagcacgaggaagaatgcgcgacggaaatgcaaacgcatcgggtgctcctcaaacctgggtctggaggacctgcttgacgccgccggtcgccttctcgacgaccttgccggcgaggtcgagctcctggctcgcccggtagacatgggcctgcaacgcgagcaactccgcgggcgtgaagctgcggccggactgcgctagctgaaggatgtggtccagccgcttttgcgcctgccccacccggtccagcacctgcgccgcctgctgcgatctcgccgcctgcaccgagtccacgcgagtgcccggcttcacgtccgcgcagcccggcgcggcgggccccaccccttcggcccgggagacaccccgcggcgccgaagtgagcgcgggcttcggcggcccctccgtggccaccggaaccccagtgcccttcgcaggcccctgcacctcgtccaacaccttgctgaatcgctcccggctgggctccaccgcgggcgacgcgcccgctccccccaccggccccaacgtgtccatggccatggctggtgtcgctcctcagcggatgttgttgatggccgacttcgcggagtcgtggcggaccttcatgatgttggagacggcggtgtgctcgcggctctccttctgcatctcgttctggagctgcaggtaggccatgttgaacttctggccctccgcggcgagcaccttctgcgcctccagcaggtcccacgcctcctggttgcccgccgcggcccccgcgcccgctgcgctccccgtatccgccgtcgcgggcatccccgcccccgacgtcttcggcgccaccgccgacaccaccgttttcgcgctggagacggccgcgctgacgatgggcccccccggaatcatgccgcccaccaggcccgctcccgagcgcaccacctcgttcgccgcgcgcgccagcaccgtgccgaagtcgttctgcggcgtctgacgcggaaccgtatgggtgatggtcagtgtgggaatccgactgtcattggacacgggcagcctcctgcggagagttgcccggccctgtttcagccgccgtgccagggataacccccgacaatcccaggcgatgaggcaccacggcgggtccggaagcgctccgcggaccgggaggagcgtccggaaggctggacggcggccctggctggaaacttgcgtccgctccggagtgcctcagagttgttgcatcctgtcgtgtggagaagaggagaaacccggtgcggacgaccgatggcggcccccagattgccgagcgctttcacccgcgcgtcgacgccaacctccccgtgaaggtgctcctcaagggacgctcggtgatggttcgcgctcgggacgtgtccatggcgggcctgttcctgatggcccacccggccgacaccgcacgggagctcaccatcgcggtgccactgcccggcgaccgggaaattgtcaccacctgccagattcgccgccgcgaagtggacggagtggcgctggagttcggcgagctggactgggacgacctcatcgccctggcgcgctacctccacccgcgcctgccctgaagcccgcctgactcagggcagcttcggcctcgcttcgcgcagccgctccaccagcgccatcagctcggccccccggaagggcttgtggatgtagccgtccgcccccgcctgggtggcgctctccatgtcggagcgcttcgccttcgcggtgagcatgtagagcggcacccccgcggtaacggggtctcccttgaggatgcggcacacggagataccgtccagttgcggcaacaccacatccatcaggatgaggtggaacgtctggctcttggccagcttcaggccctccagccccgtggcggcgcacaccacctccacggtgccgtcgctcagcatggagcgaaccagctcccggatgaccggctcatcctcgacgagaaggatgtggaagggtgcctgggaattgccagccatggttctccggacgcaacacgatgccaatgccacccgccgcgcgcggtatagccctccggggcgtagccgcaccagggaggatgcaacggattgtgcaatggcacccgtctcccccatacgtaagtcggacacacactggatgccttgctttttgattagaagggctgacaggcgggcgtagccagggtgggcacggccccgtccaacacggccagaaaccgggcgctatgatgaccctggaatggctgcgaaaccagaatgccccgagtgccgggcgacagtgggtggaaacgacttccagtgcacgcaatgcgggttgctgctggacccgcagcaggccagcggggagtacgtcatcaccgagcccaccatcgtccgggcgctgctgtccccgccgcagcgcacgcgcaccatggagctgccaaggcccccgccccagcgccccacgccgcatgacctggccaccgcgcgcttcacggtgcccatggacgcccacaccgtgccgcacctgcgcgctgggttggacatcgcgctccagccgcttcaccccttcgaggcgcacattgcttcgttcatcgacggggaccatgccgtgccggacctggcccgggcggcacggctgcccgaaatcgaggtgaaggtcgtcctcaaggccctgctggagcgcggcgtcgtggagctgcaccgcctgcccggcgcacccgccatgcgcacgatgacggacgagctgcccatcctggacgggcaggacttcctcgtgccagagcccatggcactcggggacgaggagcctcccgcgcggccagtgcccgtgatgagagcaccccaccgcccactgcccaccacccccacgcgcgcggcgccgcccccaagcccgcccgtcccaccgcgcaccgtccggcggctcggaatcgagccagggtcggcggaggacttcctccagcgcgccgtgcggttggagcgcgagggccaggtggaccgggccatcgacgtgctcacacgggccattgcccaagcgcccgaagccgcggtgctctacagcaagctggccctcatcctggttcaccagcgcaaggactaccggcgggctgtcgagttgctggagcgcgcggtggcactggagccggcccatcccgtcttccagcagaacctgctcaaggtgacaggcctcgcggcggcctcccccggccctcgcaaggaagagaagcgcggcctcttcgcgcgcctcacgggccgccggagctgaccggcgccgtgccggggctcatgtccagccgccctccagcagttgctccgcctcttcgagggagaaggccaggtaggcctcgtgccccacgttccggctgctgcgctggaaccgcaccgccgccatcgcggagcgccccaccacgcgcaccacccggcgaaagccgcggacccgggccgcttcgacgacgcgctcaatctgccccgagcccgactccgggagctccgtcacgcccgtcaggtcagacaggatgtcgaagcctggccggagccgctcgagctcgcgcagcgacgcatcgccaatctggagtgcttcctcctccgtgacgacaccccagaggcggatgaccaaccggttcttgccaacgagtgcctcgaccgaaaacacagggccacgacctcctggcattacctgctatccctccggaggcagtctaccctctgaatggcaggcatttccaggttttcgcgtcccgacactccgcgtacggcctcagatttcggccacgccttcccgctcggcccagccctccaggccgttgggcagacggatacggacgaagcggcccgtctcttcgagcaggcgcaccttgaggccagcgtgcacctcgaagatggaacgggcgcccggctgaggcagctcgcgagccaccagcgtgggtgccagcaccacggcctcgtgcaccgaggcccccacgtaggcgtgcgtggccacgagcagccctgacggcaccgccaccgcgaagagcaggaccgccagcacacccaccgccgtccgccggccccgccccagcaagcgccagagcagcacgaggacgaaggccgccacccaggtgcccaggaaggtccaggccaccaccgggccgtccgtggccgccgcgacgcgaggcaggaaggcgtcttccgcggtggcgcccaccaccttgtccacctgccgcgcccgggccacggagaggttggcttccaggtccggcgcctggcccccttccttccgcgcctgttcgagcgccagcaccgcgcggcccacatccccctgggccaggtgcgtagtgcccaggttgtagagcacgtcggggccgccctggccgttcgccagcagcttctcgtagccctccttggccgccgcgtagtcctcttgcgcgtaggcttcgttggccttgaggaagatgtcctgcgcctcttccggcgtgtagtagccgctcacgcccagccctccatggccgccgcggcggcatccatcaccttctgtcgctcggccgggtcgcccccgccgccatagcgcccgaagtcacacgcctccaacacgaagagcaccttggcgcgccgctccgcatccgcgccccccgccgtcagcttctcggcgagcacctcgcgggtgaggcccaccaccggcatgcccagccgtgcctccaggaagccgtgcagtgccttctccacctcgccgtagaaggcccccacgtccccgctggactggagcttctccgcatccgccagacgcttgcgcgcggccttcgcctgctgacgcccacgccccgcctcggagcgcagcgccagccgcccgcgcacgccgccaatcagcgcaacgcccaacagcagccccagcggggccagcaccgtcgggacaaagaagccccgcttccacacaggcacgcccggcgcctcgaagcgggcctggtagcgcactggccgcagacctcccgccgtcagcacgttcttctgctcgttggcctggtccgacgaagactgaggcgacgccgaggcgatggacgatgcaccgcccgcgcccgcctccaccgtaatcgtcaccgggtcggtgcgcgccacctcgtacttgcgggcgcgcgggtcgaagtaggtgaactccagcgcgggcaacgtgaagctgcccgtgcgctgcggcatcaccaggtactccatcacccgccggccctgcacacggtggcgctgcggcgacaccttgtccgtcgtggtggggtcataaatcttgagcgcggcggggcccttcagcgcggggggcgtgacgttcttcacgttgcccaccccttccaggctgaccttcaccgtgacgggctggcccagctccacgcgcgtctgggacacgtccatggacagccgccagttgcccacgtgcgcgttgggcatgtcctccggcccaccgggcggcagcggcttcaccttcaccttgagcgcgttggacacccggtgcacgcggtggccggcgaagaggaagccggtcgtgatgtccgcctccgcgggggtgatggacagcgtgccggacttcaccgggaagatggcgcggcggcgcagcaggtaggcgcggtacgggatgccgtccaccacgcgctgctcgcccgacaactgcgtggggctctccacctcttccgtccagaagccctccagcttgggcatggtgacggcgtccacgctggacaggtccacgcgcgaatagatgtagagcgacaacgtcacctgctcgcccacgtacacgttgtcccggtccaggctggcgcgcaggaagaggtcggagtccccccggggaatcgtgggccggtccggctccatcatgtcgccgaaggcctcttccatctgctgcatctgcgactggatgctggagaaggggtccggctgccggccaccgccacgggacggcgcaccgcccacccggccggccttcaccgtcaactccacgggctgcgtgcggtacgtcttgccgcgcaccgtgatttgcgacggtggaatcttgagccgccccgcgcgcgtcgcctgcatcaccaacacgtgccgcgtgacgtcctggatgacggcggggccaccgcccgacagggagatggagcgttggctgctgcgcgagctggagaggatggagaagtcctccgactccggcagcttcacctgcgcgttggcgggcgcgtccaccaccaccaccgtgaggcggaaggtgtcctcggtgcccacctcctcacggtccgccgtctggtagaaatcgaggtcgtccgaggccgcccacgctggcgcggtggccagcagggcgaacacggcgaacaccacgccgagggcgctaccagtccttctcattcggcttcctctgcttcttcttttgctggaaccgccagagctggaggttcttctcattctgcttcatcgcatccagcaggcgctccgcctcctgccgatccaggtccgactggctggagccaccatccgcctcggattcctccgagtcttcttctcccgcgctgccgccgtcgctgccaccgtcctggggctcgccctctccgtcgtcctgtccaccatccgcgccgccatccgcgcccccgtcgcccttgtccggtgggccctgctcgccgccgtccgcgcctccgtcggagccgccgtcgctgccaccatcaccgtcgccaccgtcggcaccgccgtccatgccgccatcgctggcgccgccatccgtgccgccgtcggcaccgccgtccgagccaccatcggtgccaccgtcctggggcgtgccgccgtcgcccttcgtgccgccgtcctcgccggcatccgggcgcccaccatcactgccgccgtcgttgccaccgtccgtgccgccatcctggcccttgtcctgcggcggcggcaggttgcgcaacaccacctcgtagttgtggcgggcctgcacgtcctgcgggtccagcgtgagcgcgcgccggtaggccttcagcgcttcctgccggtctccggtggtcgcatgcaggttgcccaggttgtaccaggccttctgccggaggtcggcgcggttggactccgtcaccgactggaacagcgccttcgcatccgcgatgcgccccagcttggccatcgcgtccgcgcgattgaagtccaccgtgacgtcgttggggcgctccttcttcgcggcctcgaacgcctccagcgattcctcgaaacgacccgccgtgtacgcctcgcggccctgctccaccagcgggtggtcccgctccagcggccccgcggcccacacgggcgacggcagcgccagcgacgtcaccaggccccatgtcagccaccgcgccgcgcgcgtcctcgcggcgctcatggtgacggcctccggcgcgacgacggcagcaacaacattcccagcgccagcaaggccagccccgggatggcgaacgactggaagcgctcgtcgtagcggaccgtcacccggctctccagctcactcttctgcatctggtcgatgcgctccaccacctgcgacatggccacgccacggggctggaaatagaaggtgcctccggtggcctcggcgatggccgtcagccccgcccggtccaaccgcgtaatcaccgtctcccccgcggcgtccttcttgtagtccacgaacgcgccgcgccggtcgaagacggggatgggctcaccggactccgagcccacgcccaccgccagcacctgcacgcccgaatccttcagcgcctcggtagcctccgccacgtcgccgaccaggtcctcgccgtccgtcagcaggacgaccacgcgctccttcgagccgcggtccgcgttctccagcacctgccgcgacagccgcagcgccgcgcccacgttggtgccgccctggggcatcacctccgggtccaccgcgcgcaagaacagcttcaccgccgagtagtccgacgtgagcggggactggatgaacgcatcgcccgcgaacaccaccaggcccacgcggtcgcccttcagctcgtccagcagcgtggtcagctccagcttcgcgcgctccaggcggctgggctggatgtcccgcgccagcatggacttggaggcatccagcgccaccaccacgtcgatgccgcgccgcttcgtcagttcgctcttggtgccacactgcggctgcgccagtgcgaagccgaagagcgccaaccccaggccgtacaacccgccctgcgtggccggacgccacaccgacacgcccggcgtgaagcgctctgcgtgacgttcatgcaagagcgcccgcacgcgcgagcggcgccgcagcgcccccaccagcgcgagcaggcccagcatcatgcccgcgagcacgaacagcaggaagaggggctgcgcgagccccgcctggtaaccgagcacggtgaagcgccagggttccacgggcgtcacgggaagaccctcaggaaggaggcgcgcaggagcagctccagcgcggcgaggccgaaggcggccaggaggaagggatggaactcctcgcggtaggtggcgctggcgccgccctccatcagcttcgagcgctccaacgaatcgagcaccttctggagtccctctcgcagttgctcggggtccgtggcgcggtagtactcgccgccggtgcggtccgcgatgtcctgcatcagctccgggttgatgggaatctccgtgtcgcgccacacggtgttgccgaacaggtccgtgccctgcgggaagggcaccttgccgcccttgcccaccagaatcgtgtagatgggcaccttcagcgcctgggccatgttcgccgagtccatgggcgaaatcttcccggagttgttgtcgccgtcggtgatgagcaccaccacccggctcttcgcctccgagtcccgcaggcggttgagggacgtggccagcgcgtcgccaatggccgtgccgtcctccagcacgcgcgtgcggagctgcttcaccacttccttcagcacgccgtagtccagcgtcagcggcgcctgcgtgtacgccgcgcccgcgaacaccaccaggccgatgcggtcattcacccggttggcgatgaactcgctcagcacttccttggcgacgtgcatgcggttctgcgggcggaagtcaccggcctccatcgacgtggacaggtccaacgccaccacgatgtcgatgccctccaccgacaagtcccgcacgcgcgagtcacgcacctgcggccgggcaatggccagcaccgccgccgtcaccgccgccacgcgaagcagcggcagcagcggcagcaggtacgcgcggaagccgcggccaccccgggcgaagacatgcgccgcggagaagcgcagcgtggcgcgggcgcgccgctcccgccaggcctgccagagcagcagcggcacgagcagcagcccccagagcgcctcggggttattgaacgcggggagcggcggcattgtcgggagcctggggcggcggtggcggaacgtacgtcgtgtcgatgagcgagtagccgaaggccagcgcgtcgcggcaggcgtcagcggaggcatccgcgcgtgcgtacttcaccatgtccgactcggacacgaagcgcatcagcttgtcctccggcagccccggcgtggacaggcgccgcagcgacgccatcagctcggagctggtgcactccaacgcctcgaagccgtagcgctcgcccaggtagcctcggatgatttcggacagccggaagtagaagtccttcacccggccgcgcgagggcaggtcctccgccttcagcgcgtccagcgccttgcgggcgcgcacgtccaggggcagcgtcggcaccacctccacgtgcttgggccggttcctccaccagcggaagagcacccacgccagcagcgccgcggccagcacgcccagcaccgtgagcaccaggcgccacgaacggatgggcacctcctccggcggcttgtagtcgaagaggtccgcgccctgcccctccgcgtccggcgacagcgctttagagc
